United States Patent 11,931,406 (FLAVIVIRUS VACCINE) - sequence listing, part 64

SEQ ID NO: 22489 - RNA, 9876 nt, Artificial Sequence
  derived and/or modified CDS sequence (opt6) from DENV-2__KF955364__SS-prME
acggcuggcguaauaauuauguugauaccuacagcaauggcauuucaucuuacaacacgaaacggugaaccacacaugaucguaggcaggcaggagaagggaaaaucucuucuauuuaaaaccgaggauggaguuaauaugugcacuuuaauggccauugaccuaggcgaacuuugugaagauacaaucacauacaaguguccgcugcuuaggcaaaaugaaccggaggacauagacuguugguguaauaguaccucaaccugggucacauauggaacuugcacgacaacuggcgaacacagacgagaaaaaaggucaguggcacugguaccgcauguagguaugggacucgaaacgcguacugaaacguggaugucaucugagggagccuggaagcacguacaaagaauagaaacauggauuuugcgacaucccgguuucaccauuauggcagcuauacuggcauauaccauagguacaacacauuuucaacgagcguuaauauucauucuauuaacagcaguugcaccaucuaugacaaugagauguauugguaucagcaaccgugacuuuguagagggaguaucagguggauccugggucgauauaguguuagaacauggcagcugcgugacuacaauggccaaaaacaagcccacucuugacuucgaacuaauaaaaacagaagcaaaacagccagcaacacucagaaaguacugcaucgaagcaaaauuaacaaacacuaccaccgagagcagaugucccacccaaggagaaccuuccuuaaacgaggaacaagauaaaagauuuaucugcaaacauucuaugguagaucgagguuggggaaauggauguggacuauuuggaaaaggagggauaguuacgugcgcgauguuuacuuguaaaaaaaacauggaggguaagguaguacuuccugagaaucuggaauauacaauaguaauaacgccucauuccggagaagaacaugcagugggaaacgacaccggaaaacaugguaaagaaauuaaaauaacuccacaaagcucaaucacagaggcagaacucacuggguacgguacaguuacuauggaaugcagcccuagaacuggccuagauuuuaacgaaauggucuuacugcaaauggaagauaaggcauggcuaguucaccgucaaugguuccuagauuugcccuuaccauggcuaccuggugcagauacacaagguucaaauuggauacaaaaagagacauuggucaccuucaaaaacccacacgcaaaaaaacaggauguagucguacuaggaucgcaagagggcgcgaugcacacagcucuaacuggagcuacagaaauucagaugucaagcggaaauuuauuauucacgggacaucuaaaauguagacugcguauggauaaacugcaauugaagggcaugaguuauuccauguguaccggcaaguuuaaaauuguuaaggaaauagcagagacacaacaugguacaauugucauaagaguacaauacgaaggagauggaucgccauguaaaauuccuuuugaaaucauggaucuggaaaaaagacacguauuaggucgacucauuacagucaauccuauagucaccgaaaaagacagcccaguuaauauugaagccgaaccucccuuuggggauuccuauauaauaauaggaguggaaccgggacaguugaaauuaaacugguucaagaaggggucaucaauaggucaaauguuugaaaccaccaugcgaggagcaaagcguauggccauccuaggagacaccgccugggacuucgggagccuaggaggcgucuuuacgucaaucggaaaagccuugcaccagguauuuggagccauuuauggugcagccuucaguggugugucauggaccaugaaaauauugauuggcgucauaauuacauggauagggaugaacucucguagcacaucuuuaaguguaucccugguauuggugggugugguaacacuauaucuaggugucaugguacaagccgacacaggaugcguuguaaguuggaagaacaaagaauugaagugcggcuccggaauauucauaacggauaacguucacacauggacugaacaauauaaauuucaaccugaaagccccaguaaauuggccagugcuauacaaaaagcacaugaagaaggaaucugcgggauuagaucaguaacuagacuggagaaucuuauguggaagcaaaucacaccugaauugaaccauaucuuaucagagaauggaguaaaauuaacaauuaugacaggcgacauaaaaggaauaaugcaggcaggaaaacggaguuuaagaccccaaccaacagaacucaaauacucuuggaaaacgugggggaaagccaaaauguugucaacagaaucgcauaaucagacauuuuuaauagaugguccugaaaccgcagaaugucccaauacuaaucgggcuuggaacaguuuagaaguagaagauuauggauuuggagucuuuucaacuaacauauggcuaaaauugagggagaaacaagauguauuaugcgauucuaaguuaauguccgcagcgauuaaagacaauagggcaguacacgcagauaugggauacuggauugaaagugcauuaaacgauacuuggaaaauggaaaaggcgucauucauagagauaaagucaugucauuggccaaaaucacauaccuuguggucaaaugguguuuuggaaagcgagaugauuauuccgaagaacuuugcuggaccaguaucacaacauaacuauagacccgguuaccacacacaaaccgcaggaccauggcaccuuggaaaguuagagauggacuuugauuuuugugaggggaccacaguaguaguaacugaagauugugguaacaggggcccaaguuuaaggacuacuacagcaucggggaaauugaucaccgaaugguguugucgaagcuguacucuaccaccacuaagauaucgaggagaggaugguuguugguaugguauggaaauaagaccuuuaaaagagaaagaagaaaaccuggucaauaguuugguaacagcgggacaugggcagaucgacaauuucagucuuggaguguuaggaauggcacucuuccuggaagaaauguugagaacucgggucgggacaaaauaugccauucuccucguagcaguaucauuugugacauuaaucacgggcaauauguccuuucgugaccugggacggguuaugguuaugguaggcgcgaccaugaccgacgacauagguaugggggugaccuaucuagcguuacuugcggccuucaaaguucgaccuacauuugcggcggguuuacuccuucguaaguuaacaagcaaggagcuaaugauggcaacgauaggcauugcacuacuaagccaaaguacaauuccagagacaauccuugaacuaaccgaugcgcuggcccuugggaugaugguccuuaaaauugugcgaaauauggagaaauaucaauuagcagugaccauuauggcuaucucaugcguaccaaaugcagugaucuugcaaaaugcuuggaagguaaguuguacgauauuagcagcagucagcguuuccccauuauuguugacguccagccaacaaaaagcggauuggauuccguuggcauuaacaauaaaaggucuaaauccgacugcaauuuuucuaaccacucugucucgcacuagcaaaaaacgaucauggccauugaaugaagcagugauggcagucgguaugguuucaauauuggcuucaucucuucuaaagaaugauauuccuaugacaggcccgcuagucgcuggaggauuauuaacggugugcuaugucuuaacggggaggucugcggaucucgaauuagaaagggccgcugacguuaaaugggaagaucaggcagagauaagugggagcucaccuauacuaagcauaacuauaucagaagacggcucuaugucaauuaaaaaugaagaggaagaacauacgcuaacaauucuaauucgaacagggcuucuaguuauaucuggcguauuuccaguuucaauucccauaacugcggcagcuugguauuugugggaagugaaaaagcaaagagcggggguacugugggacgugccaucacccccacccguagguaaagcugagcucgaagauggugcguaucgaauuaaacaaagagguauauucgguuauagccaaauaggcgccggugucuauaaggaagguacuuuccacacaauguggcauguaacgaggggagccguacuaaugcaucgagguaaaagaauagaaccgucgugggccgauguuaaaaaggaccuaaucucauacggcggaggcuggaaacuggagggggaauggaaagagggugaggaagugcaaguccuagcacuagaacccggaaagaacccgagagcagugcaaacaaaaccuggucuauuuaaaacaaauacgggaaccauaggcgccguaagccuagauuucagcccugguacgagugguucaccuauuguagaucgcaaagggaaaguaguuggacuauacggaaacgguguaguaacaagaucaggagccuauguaagugcaauugcacaaacagaaaaaaguauagaagauaauccagagauagaagaugauauauuccggaaaaaacgacuuacgauaauggaccuacacccaggagcagguaaaaccaaaagauacuuaccagcaauuguaagagaggcaaucaagcgcggucugagaacauugauuuuagcaccaacuagaguuguugcagcagagauggaagaagcacuucggggacuaccgauacgauaccaaacaccagcuauaagggcagaacauacggggagggaaauaguagaccucaugugccaugcaaccuuuacaaugagauugcugaguccugugagggucccaaauuauaacuuaaucauuauggacgaagcacacuuuacagacccagcaucgauugcggcgcguggguauauauccaccagagucgaaaugggggaggcggccggaauauucaugacagccacaccacccggaaguagggauccuuucccacaaaguaaugcgccaauaauggacgaagaacgagagauuccagaaagaucuuggaacuccgggcacgaauggguaacagauuucaaggguaagacaguuugguucgugccaucaauaaaagccggaaacgauaucgcagccugucucaggaaaaacggcaaaaaaguaauacaacuaucgcgaaaaacuuucgauuccgaauacgugaagacaagggcuaaugauugggauuuuguaguuacuaccgacauaucggaaaugggugcaaauuucagagccgaacguguaauagacccucggaggugcaugaaaccuguaauccucacggacggugaggagagaguaauacuggcaggaccuaugccggucacgcauaguagcgcugcgcaacgaagaggcagaauaggaagaaaccccaaaaaugaaaacgaucaauauaucuacaugggcgaaccguuggaaaaugaugaagauugugcacacuggaaagaagcaaaaaugcuauuagacaacauuaauacaccugaagguaucauaccaaguauguucgagccugagagagaaaaggucgacgcgaucgacggcgaauaccgacuuaggggcgaagcacgcaaaacauuuguggacuugaugagaagaggagaccuaccaguaugguuggcuuaccgcguagcugcagaggggaucaauuaugcagacagacguugguguuuugacgggaucaaaaauaaucaaaucuuagaagaaaacguagaggucgaaaucuggacuaaggagggagaaagaaaaaagcucaaaccaagauggcuagaugcgcgaauuuacagugauccccucgcauuaaaggaguuuaaggaauuugcagcggguaggaaaucuuuaacucugaaucuaaucacagaaaugggacgccugccgacauuuaugacgcaaaaagcaagagacgcuuuagauaauuuagcagugcuacauacugcagaaguagggggcagagcguauaaccacgccuuaucggaacuaccagaaacucuggaaacacuguuacuguuaaccuuauuggcaacuguuacaggugguaucuuucuauuccugaugucaggaaaaggcauuggaaaaaugaccuuggggaugugcuguauaauaacggcuucaauucuccugugguacgcucaaauucaaccacauuggauugcggcaagcaucauacuagaauuuuuccucauaguguuauugauuccagaaccugaaaaacaaagaacaccacaagacaaucaacuuaccuauguagugauagcaauacuaacaguagucgccgcgacgauggcuaaugagaugggauuuuuggagaaaaccaaaaaggaccuuggccuaggaagcauuacaacacaggagucagaaagcaacauauuagauauugauuugcgaccagcaucagcauggacgcuauaugcuguagccaccacuuuugugaccccaauguuacgacacucuauagaaaauagcagcgucaaugugucauuaaccgcgauugcuaaucaagcaacggugcuaauggggcuaggaagggguuggccauuaagcaaaauggacauuggcgucccuuuauuggcuauagguuguuacucccagguaaauccaauaacuuugaccgcugcucucuuacugcuaguugcacauuacgccauaauuggcccuggguuacaagcuaaagcaacacgcgaggcccagaaacgaacagcagcuggcauaaugaagaauccuacuguugacgggauaaccgucauagauuuagaaccuauaccuuaugauccaaaauuugaaaaacaauugggccaagucaugcuacuagugcuaugcguaacacagguacugaugaugaggacaacaugggcgcuaugugaagcacucacucucgcaacugguccuauaaguacucuaugggaagggaacccuggacgauuuuggaauacaacgauagcuguaucaauggcuaacauuuuucgagggaguuaccuagcgggagcaggacuuuuauuuucgaucaugaagaacacaacuaauacuaggcgaggcacaggaaacauuggugaaacauuaggagaaaaauggaaaagccgacucaacgcucuaggaaaaucggaauuccaaaucuauaaaaaauccggaauucaagaggucgauagaacuuuagcaaaagaaggcauaaaaaggggcgagacagaucaccaugcggugucucgaggaucugcaaaacugagaugguuuguggaaagaaauauggugacaccugaaggaaagguaguugaccugggaugcggcagaggggguuggagcuauuacugcgguggacuaaaaaauguacgagagguuaaggggcuaacaaaaggugggcccggacaugaagaaccgaucccaaugagcaccuacggauggaaccuaguaagacuacagucaggaguagacgucuucuuuacacccccugaaaaaugugacacauuacuaugcgauaucggagaaucgucaccuaaucccacaauugaagcuggaaggacauuacgagugcuaaauuuaguagaaaauugguuaaacaauaauacccaauuuugcguaaaagucuuaaauccauauaugccuuccgugauagagaaaauggaaacgcuacaacgaaaauauggcggugcacucguaagaaauccguuaucucgaaacucaacacacgaaauguauuggguuucaaaugcaacggggaauaucguaaguucgguaaauaugauuucccgaauguugauaaauagauuuacaaugaaacauaaaaaagcuaccuacgaacccgacguugacuugggcucaggaacgagaaauauaggaauugaaaacgagauaccuaauuuggauauaauaggaaagcguauugaaaaaauaaaacaagagcaugaaacgaguuggcauuacgaccaagaucauccuuacaaaacaugggcguaucauggcucuuacgagacaaaacaaacaggaagugcaaguaguauggugaacggcgucguuaaguugcugacuaaaccaugggauguuguaccaaugguuacacaaauggcaaugacagauacaacuccauucggucaacaacguguauuuaaagaaaaaguagauacgcgaacucaagagccgaaagaaggaacaaaaaaauuaaugcguaucaccgcugaauggcucuggaaagaacuugggaaaaaaaagacaccccgcauguguacccgugaagaauuuacacgaaaaguaagaucgaaugcggcacugggggcaauauuuacagaugagaauaaauggaaaagcgcacgcgaagcagucgaagauaguagguucugggaauuaguugauagggagagaaauuuacauuuagaagggaagugugaaaccugcguauacaacaugauggguaaacgagaaaagaaauugggagaauucggaaaagcuaaaggaucccgugcuauaugguauaugugguuaggggcacgauuucuggaguuugaagcguuaggguuccuaaaugaagaucacugguucagcagagggaauucacugucaggaguagaaggagagggccuucauaagcuaggauauauuuugagggaugucagcaagaaggaagguggugcaauguaugcggaugauacagcuggcugggacacaaggauaacgcuggaagauuuaaaaaaugaagagauggucaccaaucacaugaaaggagaacacaaaaaguuagcugaagcaauuuucaaacucacuuaucagaacaagguaguaaggguucaacgacccacaccgaggggaaccgucauggacauaaucagccgcaaggaccaaagaggcucuggacaagucggaacauacggucugaacacauucacuaauauggaggcgcaacuuauuagacaaauggagggcgaggguauuuucaagaguauccaacgacuaacaguaacagaagaaauugcaguacaaaauuggcuagccagagugggaagagaaagacucagucggauggcaauaucgggggaugauuguguuguuaaaccauuagaugauagauucgcaagugcguuaacggcucucaaugauaugggcaaggugagaaaagacauacagcaaugggaaccuucuagaggcuggaacgauuggacacagguacccuucugcagccaccauuuucaugaacuaguaaugaaagacggcaggguacuuguagugccauguagaaaucaagacgaacuuauaggaagagcgagaauaucacaaggcgcagguugguccuuaaaggaaacagccugucuaggaaagagcuaugcgcaaauguggacuuuaauguauuuccauagaagagauuuaaggcuagcugcuaacgccaucugcucugcagucccgagccauuggguuccaaccuccaggacaacuuggucaauucacgcaaaacacgaguggaugacuacugaagauaugcuugccguauggaacagagucuggauacaagaaaacccguggauggaagacaaaaccccaguagaauccugggaagaaguccccuaucuaggaaaaagagaggaccaauggugcggaagccuuauuggccuaacaucaagagcaaccugggcuaaaaauauccaaacugcaauaaaucaaguuagaucguuaauugggaacgaagaauacaccgauuauaugccgucuaugaagcgauucagaaaggaagaagaagaagcgggaguccugugguag

SEQ ID NO: 22490 - RNA, 9876 nt, Artificial Sequence
  derived and/or modified CDS sequence (opt6) from DENV-2__KF955372__SS-prME
acugcaggagugauuauaauguuaauuccaacugcgauggcguuccaucucaccacucgcaacggugaaccacacaugauugugggaaggcaagaaaaaggaaaaagccuauuauuuaaaacggaagauggagucaauauguguacucuuauggcgauagauuuaggagaauugugcgaagauaccaucacauauaaauguccauugcugagacaaaacgaaccggaagauauagacuguugguguaacuccaccaguacguggguuacauaugguacuugcacaacaacgggagaacauagacgagaaaaacgaagcguagcauuaguaccacacguggguaugggacuggaaaccagaacugaaacauggaugucgagugaaggugcauggaaacauguucaaaggauagaaacauggauuuuacgacacccuggauucacaauaauggcagcaauucucgcauauacuaucgguacgacucauuuucaaagagcacugauauuuauauugcuuaccgcaguagcgccuagcaugaccaugagauguauugguauuagcaauagagauuucguggaagggguaucaggaggcaguuggguugauauaguacuagaacacggcuccuguguuacuacaauggcgaaaaacaaaccuacucuagacuuugaacuaauuaaaacagaagcaaaacaaccagccacuuuacgaaaauacuguauagaagcgaaauuaacaaacacaacgacagagucgagauguccaacgcaaggcgaaccuagccucaacgaggaacaagacaaacguuuuaucuguaaacauagcauggucgauaggggcugggguaacggcuguggucucuuugguaaaggaggaauaguuacaugugcaauguucacauguaagaaaaauauggagggaaaaguaguacuuccagaaaaucuugaauauacaauugucauaacaccucauaguggagaagaauaugcaguaggaaaugacaccggaaaacacgguaaagagauaaaaauuacaccacaaucgucaauaacagaagcugagcuaaccggauauggaacaguaaccauggaaugcucgccaagaacgggcuuagauuucaaugaaauggugcuuuuacaaauggaggacaaggcuuggcuuguucauagacaaugguuccuagaccuuccucuaccauggcuaccgggagcagacacucaagguucaaacuggauacaaaaagaaacguuaguuacauucaaaaauccgcaugccaagaaacaagauguaguagugcuaggaucccaagaaggagcaaugcacacagcauugacuggagcaacugagauacagaugucuucaggaaaucugcuuuuuacgggacaccuaaaaugucggcuccgaauggacaaauuacaacugaaaggaaugucauacaguaugugcacagggaaauucaaaauugugaaagagauagcggaaacacaacacggaacaauuguaauaagaguacaguaugaaggagacggaucgcccugcaaaauaccauuugaaauaauggacuuagagaaacggcacgucuuagggagauuaauaacugugaauccgauaguuacagaaaaagacucaccaguuaauguagaggccgaaccuccauuuggagauaguuacauaauuauugguguugaacccggacaauuaaaacuaaauugguucaagaaaggaucuucaauaggucagauguuugaaacaacaaugagaggggcaaaaaggauggcaauuuuaggugauacggcaugggauuucggauccuugggugguguauucaccucaauagggaaggcacuccaucagguguuuggagcaauauacggagcugcguucagcggcgucagcuggacuaugaagauacucaucgggguaaucauuaccuggauagggaugaacucgcggaguacuucauuaaguguuucccuaguccuuguuggcguagucacguuguaucuaggagugaugguucaagccgacucagguugcguaguaaguuggaaaaacaaagaacuuaagugcggguccggaauauuuauaacagacaauguucacacuuggacagagcaauacaaguuucaaccagaaagcccuagcaaauuagcauccgcgauacagaaagcucacgaagaaggcaucugugguauacgaucaguaacgaggcucgaaaaucugauguggaaacaaauuacgcccgaauuaaaucacauuuugagcgaaaaugaagucaagcuaaccauuaugacaggagacauaaaggguauaaugcaggccggaaaaagaucacucagaccgcaaccaacugaacuaaaauacucauggaaaacuuggggcaaagccaaaaugcugaguaccgaaagucacaaccagacuuuucuuauagauggaccggaaacagcagagugucccaauaccaacagagccuggaauagucuugaaguagaggacuauggauuuggcguuuucagcacaaacauauggcuaaagcuacgcgaaaaacaggacguauucugugauucaaaauugaugucugcugcgauuaaagacaaccgggccguacacgcagacaugggauacuggauugaaagugcacuaaacgauacauggaaaauggaaaaggcuucuuucauagaaguaaagucgugucauuggccaaaaagucauacccuaugguccaacggcguacuagagagugaaaugauaauacccaaaaauuuugcugggcccguaagucagcauaauuaucgcccggguuaccauacgcagaccgcuggccccuggcaucuagguaaauuagaaauggauuucgauuuuugugaagggacaacagucguagugacagaagauugcgguaauagaggaccgagcuuacgaaccacaacggcuucaggcaaacuuauuacagaauggugcugcaggaguuguacacuaccgccguuaagauaucgaggugaagacgguuguugguacggaauggaaauaaggccccuaaaagaaaaggaagaaaaucuuguaaacucgcuagucaccgcuggacauggacagauugacaauuuuagcuuagggguacuggggauggcucucuuccuugaggaaauguuaaggaccagaguugggacuaaacaugccauucugcuagucgcaguuucauucguaaccuuaauuacagguaacaugucauuuagggauuugggaaggguaaugguuaugguaggagcaacuaugacugacgacauagguaugggcgugaccuaccucgcgcuauuggccgccuucaaagucaggccgacuuuugcagccggucucuuauuacgcaagcuaacaucuaaagaacuuaugauggcaacaaucgggauagcacuccuaucacaaagcacuaucccagaaacaauacuagaacuaacagaugcauuagcgcuagguaugaugguuuuaaaaaucguccguaacauggaaaaauaccaacuugcggucacaauuauggcuauaucguguguaccgaacgcgguaauacuacagaacgcguggaaggucagcugcaccauucucgcagcaguaagcgucucaccuuuauuacuaacgagcucacagcaaaaggcugauuggauaccacuagcuuuaacaauaaaaggcuuaaauccuacagcgauauucuuaaccaccuuguccagaaccagcaagaaaagaagcuggccuuuaaaugaagccguaauggcaguagguaugguuucaauacuggcgaguaguuuacucaaaaacgauauaccaaugacgggcccacugguagcggguggacuacuaacggucuguuauguacucacuggaagauccgcugacuuagaauuggagcgagcugccgacguuaagugggaagaccaagcagaaauaaguggaucaucaccuaucuuaagcauuacaauaagugaggacgggagcaugucgaucaaaaaugaagaggaggaacaaacccuuacgauauuaauucguacagguuuauuagucauaucggguguguucccaguuagcauaccaauaacggcagcugccugguacuugugggagguuaagaaacaaagagcgggaguuuugugggacguaccgucaccuccuccugucgguaaagcggaacuagaagacggagcauaccggauuaaacaacgaggaaucuuuggcuauagucagaucggagcugguguauauaaagaaggcacuuuucauacgauguggcacgugacccguggagcaguguuaaugcauagagguaaaaggauugaaccguccugggcagacguaaagaaagauuuaauaucuuaugguggcggauggaaacucgagggggaguggaaagaaggugaagagguccagguuuuagcucuagagcccggcaaaaauccccgagcuguacagacaaaacccggauuguucaaaacaaacacagguacgauuggugcuguaucgcuagacuuuaguccaggaaccucgggcagcccgaucguggaucggaaagggaaaguaguuggguuauacggaaaugguguggugacgagaagcggugcauacguuucggcaaucgcacaaaccgagaagucaauagaagauaaucccgaaauagaagaugacaucuuuagaaagaaaagacugacuauaauggaucuacauccaggagcuggcaaaacaaagcgauaccuaccggcgauaguaagggaggcgaucaagaggggauuacgaacacuaauuuuggcaccgacacgggucguugccgcggaaauggaggaggcuuugcguggauuaccuauacguuaccaaacaccagcaauacgggcugagcacacuggaagagagauaguugacuuaaugugucacgcgacguuuacuaugagacuacuaucaccgguacgcgucccaaauuauaaucuaauaauaauggaugaagcacacuucacagacccagcuagcacagccgcuagagguuacauaaguacaagaguagaaaugggagaagcggcaggaauuuuuaugacagcgacgccgccugguagucgagacccauucccacaaaguaaugcgccgaucauggacgaagaaagagaaauuccugaacguucguggaauagcggucacgagugggucacagauuucaagggaaaaacagucugguuuguaccgaguauaaaagcaggcaaugauauugccgcaugcuugaggaaaaacggcaagaaagugauacaauugucuagaaagacauucgauucugaauauguaaaaacaagggcuaaugacugggacuuuguaguaacuacagauaucagugaaaugggagcaaacuuccgagccgaaagaguaauagauccacggaggugcaugaaaccugucauccuaaccgacggagaggaaagaguaauauuggcggguccuaugccaguuacccauucauccgcggcucaaagaagggguagaauuggacgcaaccccaaaaacgaaaacgaccaauauauauauaugggugagccacuugaaaaugacgaagacugugcucauuggaaagaagcaaaaaugcuccuagauaacauaaauaccccggagggaauaauaccuucaauguuugaacccgaacgagaaaaaguagaugcuauugauggcgaauacagacuacgaggggaagcuaggaagacuuucguagaccugaugagacguggggaucuuccuguauggcuagcauaccgcguugcggcagaaggaauuaacuaugcagacagaagguggugcuuugacgggaucaaaaauaaucaaauauuagaggaaaauguggaaguugaaauauggacgaaggaaggugaacgaaagaaauugaaaccuagauggcucgacgcacgaauauauucagauccccuggcuuuaaaagaguucaaagaguuugcugcgggucggaagucguugacguuaaauuuaauaacugaaaugggccgacugccuacguuuaugacacaaaaagcuagagacgcgcuggacaaucuagcuguccuacacacugccgaagucggugguagagcguauaaucaugcucugucugaauugccagaaacuuuagagacacucuuacuauugacacugcuugcuacaguaacgggagguaucuuucuauuccuuaugagugggaaagggauugguaaaaugacucuagguauguguuguaucauaacggccucaauacuucuaugguacgcucaaauacaaccucauuggaucgccgcaucaaucauacuugaauuuuuccugauaguccuacucauaccagaaccagaaaaacagaggacuccccaagauaaccaacuaacuuaugucguuaucgcgauacugacagugguugccgcaacaauggcaaacgagaugggauuucuagagaaaaccaagaaagaucucgggcucgguucgauaaccacgcaagaaucggaaucaaacauccuagauaucgauuuacgaccagcaucugcauggacacuuuaugcaguggcgacaacauuuguaacuccaauguugcgacauagcauugaaaauagcucaguaaauguaucauuaaccgcgauagcaaaucaagcuacaguacugaugggcuuaggaagaggguggcccuuaaguaagauggauauaggagucccgcuacuagcgauaggcugcuacucccaagugaauccaaucacucucacagccgcgcuauuguugcugguugcucauuaugcaaucauugguccuggauuacaagcaaaagcaaccagagaagcgcagaaaagagcugcugcaggcauaaugaagaacccuacaguugacggaaucacaguuaucgaucucgaaccgauuccuuaugacccaaaguuugaaaaacaauugggacaagucaugcuuuuggugcucuguguaacccaaguacucaugaugaggacaacaugggcuuuaugugaagcacuaacucuugccacggguccgauuagcacccuaugggaagggaauccaggucgauuuuggaacacaacaauagccguaaguauggcgaacauauuucgugguucuuaucuugcaggcgccggacuauuguucagcauaaugaaaaauacuacaaacacccguagaggaacuggcaacauuggugagacucuaggggaaaaauggaaaucucgauuaaacgcuuuagggaagucugaguuccaaauauacaagaaauccggaauacaagaaguagaccgcacacucgcaaaagagggaaucaaaagaggcgaaacagaccaucaugcgguuagucgaggaucagcaaaacuuagaugguuuguggaaagaaauaugguaacuccggaagggaaaguuguagaccugggauguggaagaggcggauggucuuacuacuguggcgguuugaaaaacguaagagaagucaaaggauuaaccaaaggaggcccugggcaugaagaacccaucccuaugaguacuuacgguuggaaccuaguucgccuacagucuggaguugacgucuucuuuaccccuccugaaaaaugcgauacucuacuuugugacauuggugaaucgagcccuaaucccacuauugaggcagguagaacccuaaggguacucaaccuuguagaaaacugguuaaacaacaacacacaauucugcauaaaaguacuaaauccuuacaugccaucuguaauagaaaagauggaaacucuacagagaaaguauggaggcgcuuuaguuagaaacccauugaguagaaauagcacacaugaaauguauugggugaguaaugcaacagggaauauuguaaguucaguaaauaugaucagccgcauguuaauaaauagauuuacgaugaagcacaagaaagcaaccuacgagcccgacguagacuuaggcagugguacgagaaacauuggaauagaaaacgaaauaccaaaucuagauauuauaggaaagagaauagaaaagauaaaacaagagcaugaaaccaguuggcacuacgaccaggaccauccuuauaaaacgugggccuaucacggcucguaugaaacaaaacagacggguucagcaagcaguaugguaaacgguguggugcgauuauuaaccaaaccgugggacgugguacccaugguaacacaaauggcaaugacugauacaacaccauucggucaacaaagaguuuuuaaagaaaaaguggacacgagaacucaagagccaaaagaagguacuaagaaauuaaugaggaucacagcagaauggcucuggaaagaauuagguaaaaagaaaacuccuaggaugugcacucgagaagaauuuacaagaaaaguacgcagcaaugcagcuuuaggggcaauauucacggaugaaaacaaauggaaaagugcucgggaagccguugaagacagucgauuuugggagcucgucgauagagaacgcaauuuacauuuagaaggaaaaugcgaaacauguguuuauaacaugaugggaaaaagagagaagaaacuaggagaguucggcaaagcuaaggggaguagggcuauuugguacauguggcugggagcacgauuucuggaguuugaagcacuaggauuuuuaaacgaagaucauugguucaguagaggcaauucauuaucaggaguagaaggggaaggucuccauaaacuuggauacauucuucgagaugucagcaagaaagaagggggagcgauguaugcagacgacacagccggaugggacacacgaaucacccuagaagaccugaaaaaugaagaaauggucaccaaucacaugaaaggugaacacaagaaacuagcggaagcaauauuuaaacuaacguaccaaaacaaaguagugaggguucaacguccgacuccacgaggaaccgucauggauauaauaaguaggaaagaccaaagaggcucaggacaaguaggaacauacggacuuaacacguucacuaauauggaagcacaauuaauuagacaaauggagggugaaggaauauuuaaaucuauacaaagauuaacaguaacggaagaaaucgcgguacaaaauugguuagcacggguaggcagagagcgacugucgagaauggcuauuucuggggacgauugcgugguuaaaccuuuggacgaccgauucgcaucugcucuuacagcucuuaacgauauggguaaagucaggaaagacauccagcaaugggaaccaucuaggggcuggaaugauuggacccaagugccauuuugcagccaucacuuucacgaauuaguuaugaaagacgggcgaguuuuaguaguaccuugucgaaaucaagaugagcuaaucggaagggccagaauaucccaaggggcaggaugguccuuaaaggaaacagcaugucuaggaaaaagcuaugcacaaauguggacacucauguacuuucauagacgagaucuuagacuagcugcaaaugcuauuuguagugcgguuccgucucauugggugccgacaagucgaacgacauggucuauacaugcaaaacacgaauggaugacaacggaggauaugcuagcaguauggaaccgcguauggauacaagaaaauccauggauggaagauaaaacucccguagaaucaugggaagagguuccauacuuaggaaaaagagaagaccagugguguggauccuuaaucggcuuaacuucaagagcuacaugggccaaaaacauacagacggcuauaaaccaaguaaggucauuaaucgguaaugaagaauauacugauuauaugcccucuaugaaacguuuuaggaaagaggaggaggaagcgggcgugcuaugguaa

SEQ ID NO: 22491 - RNA, 9876 nt, Artificial Sequence
  derived and/or modified CDS sequence (opt6) from DENV-2__KF955373__SS-prME
accgcaggaguuaucauaauguuaauaccuacggccauggcauuucaccuaacgacccggaauggagaaccccauaugauugucggcagacaagaaaaaggcaagucuuugcuauuuaaaacagaagauggcguaaauauguguacacuaauggcgauugacuuaggcgaacucugcgaagauacaaucaccuacaaauguccauuacuaaggcagaaugaaccugaggauauagauuguugguguaauagcacaucaacaugggucacuuacggaacuuguaccacgaccggugaacauagaagggaaaaacggucaguagcacuaguaccucauguggguaugggucuagagacacguacagagacuuggaugaguagugagggagcauggaaacacguacaacgaauugaaacauggaucuuaaggcauccagguuuuacaauaauggcagcuauacucgccuauacaauaggaacgacacauuuucaaagagcuuuaaucuuuauuuuacuuacagcugucgcuccuucuaugacaaugagauguaucggaaucuccaaucgugacuuuguagagggagugagcgguggcaguugggucgauauuguacuagagcacggaaguugugucacuaccauggcgaagaauaaaccuacacucgacuuugaacuaauuaagacugaagcuaaacagccagcaacccuacgaaaauauuguaucgaagcuaaacuuacaaacaccacaaccgaaucgcgcuguccgacacagggcgagccaagccuuaaugaggaacaggauaaaagauuuauauguaaacauucaaugguggacaggggcuggggcaacgguuguggguuauuugggaagggaggcauaguaacuugugcuauguuuacuugcaaaaaaaauauggagggcaagguagucuuaccagagaaucuagaauacacgauaguuauaaccccucacagcggugaagaacaugcaguaggaaaugauaccgguaaacauggaaaagaaauaaaaaucacuccacaauccuccauaaccgaggccgaacuaacuggauacgguacaguaaccauggaauguucaccgcguacgggacuugacuuuaaugagauggucuugcuccaaauggaagacaaggccuggcuaguccaucgccaaugguuucuagaccucccgcuacccuggcuaccuggugcugacacgcaagguuccaacuggauccaaaaagaaacguuaguuacauucaagaauccacaugcuaaaaaacaagauguuguaguucuugguagucaagaaggcgcaaugcacacagcuuuaacaggagccacagaaauacaaaugaguaguggcaaccucuuauucacggggcaucuuaaaugcagauuacguauggauaagcuacaacucaagggcaugaguuauucaauguguacaggaaaguuuaagauugucaaagaaaucgcagaaacacaacauggaacaauaguaauacggguucaauacgagggugaugguagcccaugcaaaauaccauucgaaauaauggacuuggaaaaaagacauguccuggggagacuuauaaccguaaacccuauaguaacagaaaaagacaguccaguuaauauugaagccgaaccgccauuuggugauaguuauauaaucaucgggguggaaccaggucaauuaaaacuuaacugguuuaagaaaggaaguaguauaggucaaauguucgaaacaaccaugagaggagcaaagcguauggcaauucuaggagacacagcaugggacuuugguucccuuggaggaguauucacuagcaucggcaaagcauugcaccaaguuuuuggagcgauauauggugcugcuuucucaggaguauccuggacuaugaagauauuaauugggguaauaaucacguggauaggaaugaauucucgaaguacgucgcuaagcguuagccuagugcuaguaggagugguuaccuuauaccuaggcguaaugguacaagcagauucaggauguguaguaaguuggaaaaauaaagaacucaaaugcgguagugggaucuuuauaacggacaauguacauacuuggaccgaacaauacaaguuucaaccagaaucgcccucaaaacuagcgucagcaauacagaaggcacaugaagaaggaauaugcgguauaagaucagugacgcgauuggaaaaucuuauguggaagcagaucacaccagaauugaaccacauuuuaagugagaacgagguaaaacuaacuauuaugacaggggacauaaaaggaauaaugcaggcaggcaaacgaucgcuacguccgcaaccuacugagcuuaaauacuccuggaaaacauggggaaaagcaaaaaugcucucgacagaaagucauaaucagacguuuuuaaucgacggaccagagacagcagaguguccuaauacgaacagagcauggaauagcuuagagguagaagacuauggauucgggguuuucucaacaaauauauggcuaaaguuacgagagaaacaagacguuuuuugcgacucuaaguuaauguccgcagcgauuaaggacaaucgugcaguccaugcggacaugggauauuggaucgaaucagcauuaaacgauacauggaagauggaaaaagcuaguuuuauugaaguaaaauccugucauuggcccaaaucgcauacacuauggucaaauggaguucucgaaagcgagaugauaauacccaagaauuuugcagguccggugucucaacauaauuaucgacccggcuaccacacucaaacggcuggaccauggcacuuaggaaaacuugagauggauuucgacuuuugugagggaacaaccguagugguaacugaagauugcggaaauaggggacccagccuuagaaccacgacagcuagugggaagcucaucacagaaugguguugccgaucauguacucuuccaccgcuuagauaucgaggcgaggauggguguugguaugguauggaaauacgcccacuaaaagaaaaagaggaaaauuuaguuaauucuuugguuacugcugggcauggacaaauugacaacuucagccuuggugugcuugguauggcauuguuucuggaagagauguuacguacaagggugggaacaaaacaugccauucuauuaguggcggucucuuuuguaacucuuauaaccggaaacaugucuuuccgugaccucggcagagugaugguuaugguuggcgccacaaugacagaugauauuggcaugggaguaacauaucuagcauuacuugcagcauuuaaaguucgucccacauuugcagccggacuacuacuacgaaaacuaaccucgaaagaguuaaugauggcaacuauaggcauagcacugcuaucccaauccacaauccccgaaacgauucuagaguuaacugaugcauuagcauuaggaaugaugguucucaaaauuguacgaaacauggaaaaguaucaauuagccgucacuaucauggcaauaucuuguguuccaaacgcaguaauucugcaaaaugcuuggaaagugaguugcacuauccuagcugcagucuccguauccccuuuauugcuuacaaguucacagcaaaaagccgauuggauuccccuugcacuuacaauuaaaggauugaauccgacagccauauuccuuacaacacuaucaaggacaucaaagaagagguccuggccuuuaaaugaagcgguuauggcuguagggaugguuucaauuuuggcgaguucacuauuaaaaaacgacaucccgaugaccggcccucuaguugcaggggguuuacucaccguaugcuaugugcugacgggccgaucagcugaucuggaauuggaacgcgcugcugacguaaaaugggaggaccaggcagagauaagcgguuccaguccuauauugucaauaacaauuagugaggacggaaguaugucuauuaaaaaugaagaagaagaacacacuuuaaccauuuuaauuaggacuggcuuacuagucauaagcgguguuuucccccuuucuauaccaaucacagcggcugcaugguauuugugggaaguuaaaaaacaaagagcgggcgugcuaugggacguuccuucaccacccccagugggcaaggccgaacuugaagauggagcauaucgaauuaaacaacgggguauuuucggauauagccaaauaggagcgggcguauacaaagagggaaccuuucacacgauguggcaugucacuagaggagcgguccuaaugcacagaggcaagcgaauagaacccucaugggcggauguaaagaaggaucuuaucuccuaugguggggguuggaaauuagaaggagaauggaaagaaggcgaagaaguccaaguauuggcgcuagaacccggaaaaaauccgagagcagugcaaacaaaaccaggacuuuucaagacuaauaccggaacaauuggcgcaguaagccucgauuucagcccaggaacaaguggaagcccgauaguggauaggaaagguaaaguugucggccucuaugggaaugguguugucacccgaaguggugcauacguaucagcaauagcacaaacagaaaaaagcauagaggauaauccggaaauagaagacgacauuuuuaggaagaagcgcuuaacaauaauggaucuacacccuggcgcgggaaaaacgaaaagauacuuaccugcuaucguuagagaagcaauaaaaagaggacuucguacguugauucuagcuccuacaaggguaguagcagcagaaauggaagaagccuuaagaggauugccaauaagguaucagacgccagcaauacgagccgaacacacuggccgggaaauuguagaucuaaugugccaugcaaccuuuacaaugcgacucuuaucacccguaagagugccgaacuauaauuugauuauuauggaugaagcgcacuuuaccgauccagcaucgauugccgcacguggauauauauccacucgaguagaaaugggcgaggccgcugguauuuucaugacagccacgccacccgggucuagagacccguuuccucagagcaacgcgccuaucauggacgaggaacgagaaauuccagaacgaucauggaauuccgggcaugaauggguaacagauuucaaaggaaagacuguaugguucgucccuucuauaaaagcagguaacgauauugcagcgugcuuaaggaaaaaugggaaaaagguaauccaauugucgaggaagaccuuugauucagaauauguaaagacaagagcaaaugauugggauuuuguaguaaccacggauauaucggaaaugggagcaaacuucagagcggagcgagucauagauccaaggagaugcaugaaacccgugauuuuaaccgacggagaagaaaggguaauauuagcgggaccaaugccgguaacacacagcucagcagcccaaagaagaggcagaauugggagaaaucccaaaaaugaaaacgaccaauacauauacaugggagaacccuuggaaaacgaugaagacugugcacacuggaaagaagcgaagauguuacuagauaauaucaacacuccagaagggaucauucccagcauguuugaaccagaaagggaaaagguagacgcaauugauggagaauauagauuaagaggggaagccagaaagacguuugucgaucugaugcgucgaggagauuuaccuguaugguuggcauaucgaguggcagcugaaggaauuaacuaugccgaccgcaggugguguuucgaugguauuaaaaauaaccaaauacuggaagagaauguggaaguagaaauauggacaaaagaaggugaaagaaaaaaguuaaaaccuagauggcucgaugcucgaauauacagugauccguuagccuugaaagaauucaaagaauuugcagcugggagaaaaucacuaacgcuaaauuuaauaacugaaaugggaagauuaccuacguuuaugacacaaaaagcaagagacgcacuugauaaccuagcaguuuugcauaccgccgaaguuggaggccgugcuuauaaucacgcuuuauccgaacuacccgagacuuuagagacccuauuacuauuaacauugcuagcgacugucacugggggcauauuccuauuucuaaugucuggaaagggaauuggcaaaaugacacugggaaugugcuguauaaucacugcauccaucuuacuaugguacgcgcaaauacaaccacauuggauagcagcuaguauaauauuagaauucuuccuaauaguccuauuaaucccagaaccagaaaaacaacguacgccucaggacaaccaauugacuuacguuguuaucgcaauucuuacaguuguagcggcgacuauggcuaaugagaugggguuccuugaaaagacgaaaaaagaccuugguuuaggaaguauaacaacucaagaaucugaaucaaacauacuagauauagauuuacguccagcaagcgccuggacuuuauacgccguagccacuacuuuuguaacacccauguuaagacacucaauagaaaacaguagcguaaauguaucauuaacugccauagcaaaucaagcgacuguacugaugggguuagguagagguuggccacucagcaagauggauauagggguuccccuguuagcuauagguuguuauucacaaguuaaucccaucacuuuaacagccgcucuacuccuacuaguagcucacuaugcaaucauuggaccaggacuacaagcuaaagcaacacgcgaggcacaaaaacgcgcagcugcgggaauaaugaagaacccaacaguugauggaauaacuguaauagaucucgagcccauuccuuacgauccuaaauuugaaaaacaauuagggcaaguaauguuacuuguccucuguguuacacaaguucuaaugaugagaacaacaugggcgcuaugugaagcuuuaacgcuagcaaccgguccaauuucuacacuaugggaggggaauccaggacguuucuggaauaccacuauugccguguccauggcaaauauauuccgugggucauauuuagcaggagcgggacuguuauuuuccauuaugaaaaacacuacuaacacuaggcgugggacagggaauauaggagagacgcuaggagaaaaauggaaaucucgauuaaaugcgcuugggaaaucggaauuucaaauuuauaaaaagucgggaauucaggagguggauagaacgcucgcuaaagaggguauaaaacgcggcgaaacggaccaucaugcaguaagucguggaucggccaaauuacgaugguucguagaaaggaauaugguaacaccagaaggaaaaguagucgaucuaggcugcggacgagguggcuggucauauuacugcggaggcuuaaaaaauguaagggaaguaaagggcuuaacaaaggguggcccuggucacgaagaaccgauaccaaugucaacauauggauggaaucucguucggcuacaaagcggaguagacguguucuuuacgccaccugaaaagugcgauacacuguugugcgacauaggagagucuagcccaaaccccaccauugaggcagggcgcacgcuccgaguucuaaaucuaguagaaaacuggcuaaauaacaacacacaguuuuguauuaagguucucaaucccuacaugccaucgguaauagagaaaauggaaacgcuccaaaggaaauauggaggagccuuaguaagaaacccccucaguaggaacagcacucacgaaauguacuggguuucaaaugcaacuggaaacauuguauccucggugaacaugauaucgcggaugcuuauuaauagguuuacuaugaaacacaagaaagcgacuuacgaaccagacguggacuuaggaucgggaacacgaaauauaggaauugaaaaugaaauaccgaacuuagacauuauaggaaaaaggauagaaaagauuaaacaggaacacgagacaucuuggcacuaugaucaagaucacccauacaagacuugggccuaccauggcucauacgaaacaaaacaaacaggaagcgccagcagcauggucaacggaguagugaaacuccucaccaagcccugggacguuguaccaaugguaacacagauggcgaugacagacacuacgccguucggacaacaaaggguguuuaaggaaaaaguagacacacgaacacaagaacccaaagaagguacaaaaaaauugaugagaauaacugcugaauggcuuuggaaagaauuaggcaaaaaaaaaaccccaagaaugugcacaagagaagaauuuaccaggaagguccgaucaaaugcggcauuaggagccauauuuacggacgaaaauaaauggaagucugcgagagaagcggucgaagacucaagguuuugggaacuaguagauagagaaagaaaucuucaucuggaaggcaagugcgaaacauguguguauaauaugauggguaaaagggagaaaaaauuaggagaguuuggaaaagccaaaggcucuagagcuaucugguauauguggcuaggggcccgauuccuugaauuugaagcauuggguuuuuugaaugaagaucauugguuuucaaggggcaauucucucucaggaguagaaggggagggguuacacaagcuaggauacauccugagggauguaucuaaaaaggaagguggcgcaauguaugccgaugauacugcgggaugggauacccgaauaacuuuagaggaccuuaagaacgaggaaauggucacuaaccauaugaagggugaacauaagaaacuagcagaagcuauuuuuaaacuaacuuaucaaaacaaagucguacguguccaacggccaacaccacgcgguaccguaauggacauuauuucaagaaaggaccaacgaggaucaggucagguuggcacauacggauuaaauacguucacuaauauggaagcgcaguuaauuagacaaauggaaggggaggguaucuuuaaaaguauucagagacuaacggugacggaggagauugcuguacagaauuggcuagcuagagucgguagagaaagacuaagcagaauggcaauaucuggagacgauugcgucguaaagccauuagacgaccgcuucgcuagcgcgcuaacggcauuaaaugauauggguaagguaagaaaagacauucaacaaugggaaccuagucguggauggaacgauuggacgcagguaccuuucuguucccaucauuuccacgaacuaguuaugaaagacggccgcguucugguagugccauguaggaaucaggacgagcuaauuggucgcgcaagaauuucacaaggugcagguuggucguugaaagaaacugcauguuugggaaaaagcuacgcccaaauguggacccuuauguauuuccaccgaagagacuuacggcuagcagcaaaugcaauuuguuccgccguaccuucccacuggguccccaccagucgaacaaccugguccauacacgcaaaacaugaauggaugaccacggaagauaugcuggccgucuggaacagaguuuggauacaagaaaacccauggauggaggacaaaacgccuguagaaucgugggaagagguaccauacuuagguaaaagagaagaucaauggugugguucccucauuggucugacgaguagagccacaugggcaaaaaauauacaaacugccauuaaccaaguuagaucacucauugguaaugaggaguauacugauuauaugccaucuaugaaaagguuccguaaagaagaggaggaggcgggaguuuuaugguaa

SEQ ID NO: 22492 - RNA, 9876 nt, Artificial Sequence
  derived and/or modified CDS sequence (opt6) from DENV-2__GQ868600__SS-prME
acagccgguaugauuauaaugcuaauaccgaccguaauggcauuucacuugaccacaagaaacggugaaccacacaugauuguauccagacaagaaaaagguaagagcuuacuauuuaaaacaaaagacgguaccaacaugugcacacuaauggcuauggaucuuggggaacuuugcgaagacacaauaacguacaaauguccauuucuuaaacaaaacgaacccgaagauauagacuguuggugcaacaguaccucgacaugggucacauaugguacuuguacgaccacuggggaacauaggagagaaaaacguucaguagcauuaguuccacacguaggaaugggacucgaaacccguaccgaaacauggaugucaagcgaaggugcauggaaacacgcgcaacguauagaaacguggauucuacgacauccaggguucaccauaauggccgcaauauuagcauacacaauaggaacaacucauuuucaaagaguacuaauuuucaucuuacuuacagcaauagcaccuucgaugacaaugagauguauaggaaucaguaauagagauuuuguugagggagugagugguggaagcuggguugacaucguguuagaacauggaagcugcgugacuacgauggcuaaaaauaaaccaacacucgauuucgaacuaaucaaaacugaagcaaaacaaccugcaacacuccgaaaauacugcauagaagcaaaauuaaccaauacuacuacagacuccagauguccaacgcaaggagagccuacccucaaugaagaacaagacaaaagauuuguuuguaaacauucaaugguagaucggggaugggguaacggauguggucuuuuuggcaaaggaggaauagugacuugcgcaauguuuacuuguaagaaaaauauggaggggaaaauagugcaaccagaaaaucuagaauacaccgucguuauaacaccgcauaguggcgaagaacacgcgguugggaacgacacaggaaaacaugggaaagaaguuaaaauaaccccacaaaguuccauaaccgaggcagaacugacaggauaugggaccguaacuauggaaugcagcccaagaacaggucuggauuucaacgaaaugguucuuuuacaaauggaggacaaggcauggcuaguucacagacaaugguucuuggaucuaccacucccgugguugccgggcgcagacacucaaggcucgaacuggauucaaaaagaaacacuuguaacuuuuaagaacccgcacgcgaaaaagcaagacguagucguacugggaagucaagaaggagcaaugcacacugccuuaacaggugcgacggaaauacaaaugucguccggaaauuuauuauuuacuggccauuuaaagugccgacucaggauggauaaacuucaguuaaaaggaaugagcuauucaaugugcacggguaaauuuaagauagugaaagaaauugcugaaacacaacauggaacaauuguaauacgcgugcaguacgaaggagauggcucaccguguaaaaucccuuucgaaauaauggaucuugaaaaacgucauguucucggccggcugauaacaguaaauccaauaguaacugagaaggauucacccguuaauauagaagcagaaccgccauuuggcgauucauacauuauaaucggagucgaaccaggacaguuaaaacuagauugguucaagaaaggaucaucuauuggacagauguuugaaacuaccaugcguggugccaagagaauggcaauucuaggagauacagccugggauuucggaucguuagguggaguuuucacuucuauugggaaagcauugcaucaaguuuuuggcgccaucuauggcgcagccuuuagcggaguaagcuggacuaugaaaauccuaauaggaguuauuauaacauggauuggaaugaacucaagaucuacaagccugagcguaagucucguccuaguaggcaucgugacgcucuauuuaggaguaaugguccaggcugacagugggugcguagucuccuggaaaaacaaagagcuuaaaugcggcagcggaauauuugucacugacaacguucauacguggacugaacaguacaaauuccaaccggagagcccaucaaaauuagcauccgcaauacaaaaagcccacgaggagggaaucugcgguauaagaagcgucaccagguuagaaaaccuaauguggaaacaaauaacgagcgagcucaaccauauuuuaucagaaaaugaagugaaacugacuauaaugacaggcgauauaaaaggaauaaugcagguagggaaaagaagucuacggccucaacccacagaacuaagguacucguggaaaacguggggcaaagccaaaauguuaaguacagaauugcauaaucagaccuuucuuauugacggaccagaaacugcagagugcccuaauacaaaccgagcuuggaacucgcuugaaguagaggauuauggcuucgggguauucaccaccaauaucuggcuaagguuaagagagaaacaggaugcuuuuugcgacaguaaguuaaugucggcugcaauaaaagacaauagagcgguacaugcggauaugggguauuggauugaaucagcacuaaaugauacauggaaaauagaaaaggcauccuuuaucgaagucaagucgugucauuggccaaaaucccauacgcuauggucgaaugguguacuggaaagugaaaugguaauucccaaaaauuuugccgggccagucagucaacacaauaauagaccgggauaucauacucaaacggccggaccauggcaccucgggaaauuagaaauggauuuugauuuuugugaaggaacgacuguaguuguuacggaggauuguggcaaucgggggccuaguuugaggacaacuaccgcaucgggaaaauuaauuacagagugguguugcagauccuguacguuaccaccacuuagauacagaggugaagacgguugcugguacgguauggaaauaaggccacuuaaagaaaaagaagagaauuuggucucgucuuuaguaacagcgggacacggucaaauugacaacuucucacuggguauuuuagguauggcacuuuuccuagaagagaugcugcgaacacgagucggcaccaaacaugcuauacuccuaguugcuguuaguuucgucacauuaauaacggguaacaugaguuuucgggaucuggguagggugaugguuauggugggagcaacgaugacggaugauauugggaugggagucacguaucuagcacuauuagcagcauuuaaagucagaccgacauucgccgcaggacuacuacucaggaaacucaccuccaaagaguuaaugaugacaacaauugggaucguacuuuuaagccaaucgaguauuccugaaacuauacuagaacucacagaugcccuugcccuuggaaugauggucuugaaaauggugagaaacauggaaaaauaccaacuagcaguaaccauuauggcgauacuuuguguaccuaacgcaguuauacugcagaacgcuuggaaaguuaguugcacaauucuagcagugguuucagugucaccguuauuauuaacaucaucucagcaaaaagcugauuggauuccuuuagcccuuacaauuaaaggccuuaacccuacagcuauauucuuaaccacacuaucaaggacuagcaagaaacgaucauggccuuuaaaugaagcaaucauggcuguuggcaugguaucuauauuagccaguucucugcuaaagaaugauauccccaugacgggaccucugguggcuggaggccuauugacgguuuguuacguauuaacggguagaucagcugauuuagaacuugaaagggcaaccgacguaaaaugggaugaccaggcggagaucucuggaagcagcccaauacuaucgauaacgaucagugaagaugguaguauguccauuaaaaacgaagaagaagaacaaacacuaacuauucugauuagaacgggcuuauuagucauaagcggacucuuuccagucagcauaccuauaaccgccgcggcgugguaucuuugggaaguuaagaaacaaagggcgggaguauuaugggauguuccuucaccaccuccaguaggaaaagccgaauuagaagacggagcuuaucguauaaaacaaaaggguauucuugguuauucccaaaucggagcaggagucuauaaagaaggaacauuucauacgauguggcacguuacaagaggugcaguuuuaaugcauaaggggaaaagaauagaaccauccugggcugaugucaagaaagaccugaucaguuauggaggaggcuggaaguuggaaggcgaauggaaagaaggggaggagguacaagugcuggcgcuggaaccaggcaaaaauccaagagcaguacaaacuaagccuggccuauuccguacgaauacugguaccauaggcgcagucuccuuagauuuuucuccaggaacaucaggaucaccaauaguugacaagaaaggaaaaguagucggacuauauggaaacggcguuguaacacgaucaggugcauacguaucggcaaucgcccaaaccgagaaaucuauugaggauaacccggaaauagaagacgauauauuuagaaaaagacgucucacaauuauggauuuacauccgggggcagguaaaacgaagcguuacuugcccgcaauaguacgugaggcaauaaaacgcggacuaagaacauugauucuggcaccuacacguguuguugcagccgaaauggaagaagcacuuaggggacuaccaauaagauaccagaccccggcaauuagggcagaacauacgggcagagaaauuguugauuugaugugccacgcaacguuuacaaugagacuauuaucgccaauacgaguucccaacuacaacuuaauaaucauggaugaagcacacuuuacagauccagccucaauugcggcaagaggauacauaaguacaagagucgaaaugggugaagcagcgggaauuuuuaugacugcaacaccacccggaucucgagauccuuuuccucaaaguaacgcaccgauaauggaugaagagagagaaauuccggaacguuccuggaacaguggucacgaaugggucacggauuucaaagguaaaacuguuugguuugugccgaguaucaagaccggcaaugauauagcagcaugucuucggaaaaauggaaagcgugucauacaauuaucaagaaaaacauuugauucggaauacguaaaaacacguacgaaugauugggacuucgucgugacgacagacauaucggaaaugggggcuaauuuuaaagcagaaagagugauugauccccguagaugcaugaaaccagucauucucacagauggugaagaacgugucauacuagcaggaccaaugcccguaacgcauucuagugcagcucaacguagaggcagaauaggucggaacccuaggaaugagaaugaucaauauauuuauaugggcgaaccacuggaaaaugaugaagauugugcccauuggaaagaagcgaagauguuauuagauaacauaaacacgccagaagguauuauaccaucaauguuugaacccgaacgugaaaaaguggaugcuauugacggugaauaccgcuugagaggcgaagcuagaaaaacauuuguagaucuuaugaggcgaggugauuuacccguaugguuagccuauaaagucgccgcggaaggaauuaacuaugcagaccgacgaugguguuucgacggaacaaggaacaaucaaauacuugaggaaaacguagagguugaaaucuggacaaaggaaggggaaaggaagaaacuuaaaccaagauggcuagaugccagaauauauucugacccucucgcacuuaaagaauuuaaggaguucgcagcgggaagaaaaucgcuaaccuuaaacuuaauuacugaaaugggaagauuaccaaccuucaugacucaaaaagcacgagaugcguuagauaaccuagcuguacugcauacagccgaagcuggcggcaaggcuuacaaccaugcgcugagcgaauuaccagaaacacuugaaacuuuguuauuauugacccuuuuggcgaccguuacugguggaauuuuccuauuccuaaugucugggcgaggcauuggaaaaaugacccuaggaaugugcuguaucauaacggccucgaucuugcugugguacgcccaaauacaaccacauuggauagcugcaagcauaauacuggaguucuucuuaaucguucugcuuauaccagaaccagaaaaacagaggaccccacaagacaaucagcugacauauguaaucauugcaauauuaacggugguugcugcgacaauggcaaaugagauggguuuucuagaaaagacuaagaaagacuuaggucuuggaaacauagcuacacaacaaccugaaaguaauauauuagauauugaccuccggccagcaagcgcauggacucuuuaugcggucgccacaacuuuuauuacuccgaugcuucgccacucgaucgaaaauucguccguaaacguaucuuuaaccgcaauugccaaucaagcuacgguauugaugggauuagggaaagguuggccacucaguaaaauggauaucggggucccucuccuugcgauagguuguuacucccaaguaaaccccauaacacuuacagcugcgcuacuauugcugguggcacacuacgcgauaauagggccuggcuuacaagcuaaagccacaagagaagcccaaaagcgagcugcugcaggaauaaugaagaauccuacaguagacgguauuacgguaauugaucuugauccgauaccuuacgauccaaaauucgaaaaacaguuaggacaaguaauguuauuaguccuuugcgucacccagguacucaugaugagaacgaccugggcguuaugcgaagcgcuuacacucgcuaccgggccuguuagcacccuuugggagggaaauccaggaagauuuuggaacacgacaaucgcagucagcauggcaaacaucuuuagaggaagcuaccuggcaggagcuggucuuuuguuuaguauuaugaaaaauacaacaaguaccaggagaggcacgggaaauauaggagaaacuuuaggugaaaaauggaagaguagguuaaaugcauugggaaaaagugaguuucaaauauacaagaaaagugguauucaagaaguagaccgcacuuuggcaaaggaaggaauuaaaagaggggagacugaccaucaugcugucagcagagguagugccaaauugagaugguuugucgaacgaaaucuagugacaccagaggguaagguaguugacuuagguuguggccgcggcggauggaguuacuacugcggcggauugaaaaacguaagggaagugaaaggauugacaaaaggcggccccggacaugaagaaccgauuccuaugagcacuuauggguggaacuuaguucgacuacagagcggaguggacgucuucuuugucccaccagagaaaugcgacacauugcuaugcgacauaggagaaucuucuccaaauccaacaguagaagcugguagaacacuacgaguacugaacuugguagaaaauuggcuuaauaacaacacacaauuuugcguaaaaguguuaaauccauauaugccuagcguaaucgaaaggauggaaacucuacagcguaaauauggcggagccuugguaaggaauccguuaucaagaaacagcacucacgagauguacuggguaucaaacgcgagcggaaacauaguuucauccgucaauaugauaaguagaaugcuuauuaacagauucacuaugcgacauaagaaggcgacuuacgaaccagauguagaccuaggaagugggacccguaauauuggaaucgaaucugaaacgccaaacuuagauaucauuggaaaaagaaucgagaaaauuaaacaagaacaugaaacgaguuggcauuaugaucaagaccaucccuauaaaacgugggcauaucacgguaguuacgaaacaaaacaaacaggcagcgcuucgucgauggugaauggugucguccgccuauuaacaaaaccuugggauguaguuccuauggugacccaaauggcaaugacugauacaacaccauucggacaacaaagaguauuuaaggaaaagguagacacaagaacacaagaaccuaaagaggggacaaagaaauuaaugaaaaucacugcagaauggcucuggaaagaacucggcaagaagaaaacaccacgaauguguacacgggaagaguuuacgaagaaagucagaaguaaugcggcauuaggagccauauucacggaugagaauaaauggaaaucggccagagaagccgucgaagacucacguuucugggagcuaguagauaaagaaagaaaucuacacuuggagggcaagugugagacuuguguuuacaauaugaugggaaaaagagagaagaaacuuggugaguucgguaaagcaaaaggaucaagggcgauaugguacauguggcuuggugcccgauuccuugaauuugaagcauugggauuuuuaaaugaagaccauugguuuagccgugaaaauucgcuuagugguguggaaggugagggacuccacaaacuaggcuacauauugagagaaguuaguaagaaagaagguggagcaauguaugccgaugauacugccggaugggacacacguauaacaauugaagaucucaaaaacgaagagaugauaacaaaccauauggcgggggaacauaagaaauuagcagaagcaauuuucaaguuaacauaucaaaauaaagugguaagaguacagcgaccgaccccaagagggaccguaauggacauuaucagucguagggaccaaagaggaucggggcaaguaggaacauacggccuaaauacauuuacuaauauggaagcacaauuaaucaggcagauggaaggagaaggcauauuuaagaguauacaacaucugacugcuagcgaagaaauagcgguacaagacuggcuugugcgaguaggacgagagagacugucgaggauggcuauaucuggagaugacugcgugguaaaaccacuagacgacagguucgcccgagcacuaacagcgcuaaaugauauggggaaaguaagaaaagacauucaacagugggaaccaagccggggcuggaaugauuggacgcaaguaccuuuuugcucgcaucacuuucaugaacucauuaugaaggauggacgcacacuugugguaccaugcagaaaucaagacgaacuaauaggacgugcucguauaucgcaaggugcaggauggucacugcgagaaacagcuugccuaggaaagagcuaugcacaaauguggucguugauguacuuucauaggagagaccucaggcuagcugcaaaugccauauguagcgcugucccaagccauuggguucccacaagucgcacaacaugguccauucaugcuucccacgaauggaugacaaccgaggacaugcugaccguguggaacaaaguauggauauuagagaaucccuggauggaagauaaaacaccuguagaaaguugggaggaaauuccauauuuaggcaaacgugaagaucaaugguguggaagucuaauuggacuuacaucucgggcaaccugggccaaaaauauacagacagcuaucaaucagguuaggucauugauagguaacgaggaguauacggacuauaugccaucaaugaaaagauuuaggcgagaagaagaagaagcaggagucuuaugguaa

SEQ ID NO: 22493 - RNA, 9876 nt, Artificial Sequence
  derived and/or modified CDS sequence (opt6) from DENV-2__KF955359__SS-prME
acggcaggagugauaaucaugcuaauaccaacugcaauggcuuuccauuugacaacaagaaauggggagccacauaugauuguaggaagacaagaaaaaggaaaaagccuauuauucaaaacagaagauggaguaaacaugugcacgcuaauggcaauagauuuaggugaauuaugugaagauacuauaacauacaaauguccucuuuuacgucagaacgagccugaggauauugauuguugguguaauucgacaaguacuuggguuacauacggaaccugcacuacaacgggcgaacauagaagagaaaaacguaguguggcacuggugccucacguaggaaugggauuagaaacgagaacagaaacauggaugaguucagaaggcgcauggaaacacguccagagaauugaaacguggauauuaagacauccaggauucacuacaauggcagcaauacuugcuuauacuauaggaacaacccacuuccaaagagcccuaauuuuuauauuacuaacagccguagcuccaucgaugacuaugcgcuguauugguauaaguaaucgugauuuugucgaaggcgugaguggagguucuuggguagauauaguacuagaacauggaaguuguguaacgacaauggccaaaaauaaaccaacgcucgacuuugaauuaauaaaaaccgaagccaaacaaccagcaauccugcguaaauacuguauagaagccaaacuuaccaauacaaccacugaaucacgauguccgacacaaggagaaccaucacugaacgaagaacaagauaaaagguuuauaugcaaacauucuauggucgaucgagguugggguaauggauguggucuauucggcaaaggagggauugugacgugugcaauguucaccuguaagaaaaauauggaaggaaaagugguauuaccagaaaaucucgaauacacuauaguuaucacgccucacaguggugaagaacacgcggugggaaaugacacugggaaacacgguaaagagauaaaaaucacuccgcaaucguccauaacugaagcugaacuuacaggauauggaacaguuacaauggaauguucaccacguacuggcuuagacuuuaacgaaaugguucuacugcaaauggaagacaaagcaugguugguacacagacagugguuucuugacuuaccauuaccuugguugccaggagcagauacccaaggauccaauuggauccagaaagagaccuuagucaccuucaaaaauccacaugccaagaagcaagauguaguaguucuuggaagccaagaaggggcgaugcauacagcuuugacuggagcgacagaaauucaaaugaguucaggaaaucuacuauuuacaggacauuuaaaauguagauuacgcauggauaaguugcaacugaaaggcaugucuuacucaauguguaccggcaaauucaagauuguaaaagagauagcagaaacacaacacgguaccauaguuauucgaguucaguacgaaggggauggcucaccauguaagaucccguucgaaauuauggaucuagagaaaagacauguccugggaagacuaauaacuguaaacccgauaguuacugaaaaagauuccccagucaacauagaagcugaaccaccauuuggggacagcuauauuauaauagguguugaacccggacagcuuaagcucaauugguuuaaaaaggggaguucaauaggacagauguucgaaaccacgaugcgcggcgcuaagcggauggcaauccuaggagacacagcaugggacuuugguucgcuuggagguguguucacgucgauugggaaagcauuacaccaaguuuucggagcgauuuauggugcagcauuuaguggaguaaguuggacgaugaaaauucugauagggguuauaauaacauggauaggaaugaauagccguagcaccucucucagugcaucucuggugcuuguagguauagucacauuauaucuaggagugaugguucaagcggacaccggcuguguugucaguuggaagaacaaagaguuaaagugcggaucaggaauauuuaucacagauaauguucauacuuggacugaacaauacaaauuucaaccagaaucuccgucaaaacuugccucagcaauacaaaaagcucaugaggaggguauuugcggcauucgcagcguuacaaggcuagaaaaucuaauguggaagcaaauuacucccgaacugaaucacauauugagcgaaaacgaaguaaaacuaacaaucaugacuggagauauuaaaggcauaaugcaggcaggaaagagaagccucaggccucaaccaacagaauugaaauauaguuggaaaacauggggaaaggcgaaaaugcugucuacagaaagucauaaucaaacauuucuaauagaugggccugaaacagcagaaugccccaacaccaauagagcuuggaacuccuuagaaguagaagauuacggcuucgggguguucuccacgaauaucuggcugaaacuacgagaaaaacaagaugucuucugcgacucuaaacucaugucagcugcaauuaaagacaaccgggcaguucacgcagauaugggguacuggaucgaaucugcccuaaacgauaccuggaaaauggaaaaagccagcuuuauagaaaucaaaucgugucacuggccgaaaagucacacacuaugguccaacggaguccucgaguccgaaaugaucauaccuaagaauuuugcgggucccguaucgcaacacaauuacaggccgggauaccauacacaaacagcaggaccauggcacuuaggaaagcuagagauggauuucgacuuuugcgaggguacaaccguuguuguaacagaggacuguggcaaccgggguccgucuuuaaggacaaccacagccucagguaagcuaauuacugaguggugcugccguucaugcacuuugcccccacuaagauacagaggggaagaugguuguugguacgguauggaaaucagaccacucaaagaaaaagaggagaaccuagucaacucucuagugacagcaggucacggucaaauagauaauuuuagucuugguguccucgggauggcucuguuucuagaggaaaugcuacgaacaagaguaggcacuaaacaugccauccuauuaguagcagucucauucguuacuuuaauaacagggaacaugucauuccgagaccuaggacgugucaugguuauggucggagcuacaaugaccgaugacauugguaugggggucacauaucuagcucuuuuagcagcuuucaaagugagaccuacuuucgcagcaggauugcucuuacgaaaguuaaccucuaaagaacuaaugauggccaccaucgguaucgcuuugcugagccagagcacaauaccagaaaccauccuggaacugacagacgcauuggcucuaggaaugaugguacuaaaaauaguccgaaauauggaaaaauaucaacuagcaguaacaauaauggcaaucucguguguacccaaugcaguuauauuacagaaugcauggaaaguuaguugcacgauucuggccgcuguaagugugucuccuuuacucuuaacaucgagccaacaaaaagcugauuggauaccgcucgcucugacuauuaaaggucuaaauccuacagcaaucuuuuuaacgacguugucuagaacaucuaagaaacgaaguuggccauuaaaugaggcuguaauggcaguuggaaugguaucaauacuugcaucaucucuguuaaagaacgauauuccaaugacugggccccuaguugcugguggacuacugacaguuugcuauguucuaacgggucguagugcugauuuagaacuugaaaaagcagcugacgucaaaugggaagaucaagcugaaauaagugggaguucgccaauacuuagcaucacgaucucagaagacggcucaaugagcauuaaaaaugaagaggaagaacauacauuaacaauauuaauaagaacaggauuauuagucauuucaggaguguucccaguuaguauaccgauuacggcugcugcaugguaucuuugggaagucaagaaacaacgugcaggaguacuaugggaugugccuuccccuccuccaguugguaaagcugaauuggaggauggcgcauaucgaauaaaacagaggggaauauuuggauacucucagauaggcgcuggaguuuauaaggaagguacuuuucauaccauguggcacguaacacguggggcuguccuuaugcacagaggcaagcgcauugagcccuccugggcggaugucaaaaaggauuugauaagcuauggagggggauggaagcuagaaggcgaauggaaggaaggagaagaaguucaaguccucgcuuuagaaccgggaaagaauccacgcgcaguucaaacaaaaccaggauuguuuaaaacaaacacggggacaauaggugcaguaagccuagauuuuagccccggaaccucggguaguccuauaguagaucgaaaaggcaaagugguuggauuauauggaaacgguguaguaaccagauccggagcauaugugagcgccauagcgcaaacagagaaguccauagaggauaacccggaaaucgaagaugauauuuucagaaagaaaagauuaacaauaauggacuuacauccaggggcaggaaaaacuaaaagauauuuaccagcaauaguccgugaggcgauuaagcgcggauuaaggacucuaauuuuagcacccacacgcguuguugcggccgaaauggaagaagcacuaagaggauuaccuauacgauaucaaacaccggcuauacgugcugaacauacaggccgagaaauaguagauuuaaugugucaugcgacauuuaccaugagacuacuaucccccguucguguucccaauuauaacuuaauuauaauggaugaggcccauuuuacagacccagcuaguauagcagcacgugguuacauaaguacucgaguugaaaugggagaggcagcaggcauauuuaugacagcaaccccucccgguuccagagauccuuuuccgcaaucuaaugcuccuauuauggacgaagaaagggaaauuccggaacgaagcuggaauagcggccaugaaugggugacagauuucaaaggcaagacugugugguuuguacccucgauaaaagcaggaaacgacauugcagcgugucuuaggaaaaauggcaagaaaguuauucaauugagcagaaaaacuuuugauagcgaauacguuaaaacaagagcgaacgauugggacuuuguugugacaaccgauauaucagagaugggagcuaacuuccgagcggaacgaguaaucgauccccgaagauguaugaaaccugugauauugacugauggugaagaacgagucauucuugcuggcccgaugccuguuacgcacagcuccgcugcacagcgacgaggaaggauaggccgcaauccuaaaaacgaaaacgaucaguacauauauaugggggaaccucuugagaacgacgaagauugcgcacauuggaaagaagcaaaaaugcuguuagauaacauaaauacgcccgaagggauuauacccucaauguucgaaccugaacgugaaaaagucgaugcaauugauggagaauaccgcuuacgaggcgaagcccguaagacuuucguagaccuaaugcgucguggagaccuucccguaugguuagcauauaggguagcugcagaagggaucaacuaugcagacaggcgauggugcuucgacggaauaaagaauaaccaaauauuggaggaaaacguugaggucgaaauauggacuaaggaaggugaaaggaagaaauugaagccucgcuggcuggacgcccguauuuauucagacccuuuagcccugaaagaguucaaagaauuugcagccggaagaaaaucucuuacauuaaaucuuauaacagaaaugggucggcuaccuaccuuuaugacucaaaaagcuagagacgcauuagacaauuuggcuguuuuacauacagccgaaguaggaggcagagcauacaaccaugcguuaagcgaacuaccagagacacuagaaacacuccuacuuuuaacacuguuagccacggugacggguggaauuuuccuauuuuuaaugagugguaaaggaauugggaaaaugacucuuggcaugugcuguaucauaacugcuagcauucuucucugguaugcccaaauucaaccccacuggauagcagcuaguauuaucuuagaauuuuucuuaauuguacugcucauccccgaaccagaaaagcaacgcacaccccaagauaaucagcuuacguauguaguaauagcaauucuaacaguaguagcggcuacgauggcgaaugaaaugggauuccuggaaaagaccaagaaagacuuagguuuaggaaguauaacuacucaagaaagcgaguccaauauacuagacaucgacuugcgcccggcaucagcauggacacuguacgccguagcgacgacauuugugacgcccaugcuaagacauaguauagaaaacucauccguuaacguaucuuugacagcaauagcuaaucaagcaaccguauugaugggauuggguagaggauggccuuuaucaaaaauggauauaggaguaccgcuacuagccauuggauguuauucacaggucaaccccauaacauugacugcugcuuugcuucuucuuguagcacauuaugcaauaauagggccaggauuacaagcaaaggcaacaagagaagcgcagaaaaggacugcagcagggauaaugaagaauccuacaguugacgguauuaccgucaucgaucucgagccuauacccuacgacccuaaauucgaaaaacaacuaggccaaguaaugcuauugguauuaugcgugacacaaguacuuaugaugaggacaacuugggcuuugugugaagcccuuaccuuagcaacaggaccaauaucgacauuaugggaaggaaacccuggcagauucuggaauacuacaauagcaguaaguauggccaacauauuuaggggaagcuacuuagcgggugcgggauuauuguuuucuauuaugaaaaauaccaccaauacucggaggggcacaggaaacauuggagaaacauuaggugaaaaguggaagucuagauuaaaugcauugggaaagagcgaguuucaaauuuauaagaaauccggcauacaagaaguugauagaacuuuagcaaaagaaggaauaaaacgcggagaaacugaucaucaugcagugagcagagguuccgccaaauuacggugguuuguggagcggaacauggugacuccggagggaaaaguuguagauuugggcuguggacgcggcggauggaguuauuauugugggggucugaaaaaugugcgggaaguaaagggacuaacuaaaggcggaccuggucaugaagaaccgauuccaauguccaccuauggauggaaccucgucagacuucaaaguggggucgacguauucuucacuccaccagagaagugugacaccuuguugugcgauauuggcgaaagcucgccuaauccaaccauugaagcaggacggacucugcgaguauuaaaucuaguagaaaauuggcugaauaauaacacgcaguuuuguguaaaaguauugaacccuuauaugccuaguguuauagaaaagauggaaacuuuacaacgaaaauaugggggugcucuaguuagaaauccauugagucgaaacaguacucacgaaauguacuggguaagcaaugcaacaggaaauauugucucuucaguuaauaugauuucaaggaugcuaaucaauagguuuacaaugaaacauaagaaggccaccuacgagccggauguggaucuagggucuggaacgcggaacaucgguauugaaaaugagauccccaaucuagacauuaucggaaagcgcaucgagaaaaucaaacaagagcacgaaacaucuuggcacuaugaucaagaucauccauauaaaacaugggcauaucauggaagcuaugaaaccaaacagaccgggucugcuucauccaugguaaaugguguugucaaauuauugacaaaaccaugggauguagugccuaugguaacccaaauggcgaugacugauacaacuccauucgggcaacaacgcguauuuaaagaaaaaguugauaccagaacccaagagcccaaagaaggaacgaagaaauuaaugagaauuacagcagaauggcuauggaaagaacucggcaagaagaaaacuccaaggaugugcacacgcgaagaguuuacaagaaaaguacgauccaacgcagcucuaggagcaauauucacagacgagaacaaauggaaaagugcgagggaagcaguugaggacucuagguuuugggagcuaguugaucgagagcggaacuuacaccuagaaggaaaaugcgaaacaugcgucuauaauaugaugggaaaaagggagaagaaauuaggggaauuugguaaagccaaagguucacgagcgauuugguauauguggcugggagcuagguuccuggaauuugaagcccugggauuucugaacgaagaccauugguuuagccgugggaacagccucucagguguagagggugaaggucuccacaaguuagguuauauacucagagacguuucaaagaaggaaggaggagcaauguaugcagaugauacagcagggugggauaccaggauaaccuuggaggaccucaaaaacgaagagaugguaacuaaucauaugaagggcgaacauaagaaacuugcagaagcaauauuuaaauuaacauaucaaaauaaaguaguccguguucaaagaccaacaccgcgcggaaccguuauggacauuauuucgaggaaagaucaacgugguaguggacaaguugggacguauggucucaauacuuuuacaaacauggaagcccaacucauacgacagauggaaggggaagguauuuuuaaaagcauucaaagacuaacggugacugaagaaauagcggugcaaaauugguuagcgcgcgucggacgagagaggcuaucaaggauggcgauaucuggcgacgauuguguagugaaaccauuggaugaucguuucgccucugcacugacagcauuaaacgacauggguaaaguccguaaagauauacaacaaugggaaccuucgagaggauggaacgauuggacucagguacccuucuguucgcaucauuuucaugaauuagucaugaaggauggaaggauguuagucguaccuuguaggaaccaggacgaauuaauaggcagagcucgcauuucccagggagcaggauggaguuugaaagaaacagcaugcuuggguaaaucauaugcucagauguggacacuaauguauuuccauagacgagacuugcgccuugcugcuaacgcaauauguagugcaguaccaucucauuggguacccacaucaaggacgacguggaguauacacgcuaaacaugaguggaugacgacugaagauaugcuagccguuuggaauagaguauggauacaagagaacccauggauggaagauaaaacgccgguagaaucuugggaggagguacccuaccuagguaaaagagaagaccaauggugugggaguuuaauaggauuaacaucgagagcgacuugggcgaagaacauccaaacagcuauaaaccaagucagaucucucaucgguaaugaggaguauacagauuauaugccaucgaugaaaagauuuagaaaggaagaagaggaagcaggcguacugugguaa

SEQ ID NO: 22494 - RNA, 9876 nt, Artificial Sequence
  derived and/or modified CDS sequence (opt6) from DENV-2__KF955360__SS-prME
acugcaggcgugauaaucaugcuuauuccuacugccauggcguuccaccuaacuacgagaaacggugaaccacacaugauaguggggaggcaagaaaaagggaaaucacuauuauuuaaaacagaagacggggugaauauguguacccuaauggcaauagaccucggugaacucugcgaagacacuaucacauauaaaugcccauuacuacgacaaaaugaaccggaggacauagacugcugguguaacucaacaaguacguggguaacauacggaaccugugcgacgaccggagagcacagaagagagaaaaggaguguugcauuaguaccacauguaggaaugggacucgaaacaagaacagagacuuggaugagcucggaaggggcauggaaacacguucaaaggauagagacauggauucuaaggcauccuggguucacaauaauggcggcaaucuuagccuauacaauugguacaacccauuuucaacgagcguuaauauucauacuauuaaccgcuguugcuccuuccaugacgaugagguguaucggcauuuccaacagagauuuugucgaggguguaucagguggaucuuggguagauauaguccuagagcaugguagcugcguaacaaccauggcuaaaaauaaaccuacauuagauuucgagcuaauaaaaaccgaagcuaaacaacccgccacccucagaaaauauugcaucgaagcaaaacugacuaacaccacaacugaaagccgaugucccacacaaggagaaccuagucuaaaugaagaacaagauaaacgauuuauauguaaacacagcaugguagauagagggugggggaaugguugcggacuguucgguaaaggcgguauugucacaugcgcaauguuuacaugcaagaaaaauauggaagguaaagugguuuugccugagaaucucgaauacaccauuguuauuacuccucauaguggggaagaacaugccguugguaaugauacgggaaaacacggcaaagaaauuaaaauaaccccacaaagcaguauuacagaagcagaacuaacaggcuauggaacagucaccauggaauguucuccucggacuggucuagauuuuaacgagaugguucuucugcaaauggaagacaaagcauggcucguacauaggcaaugguuccucgaucucccacucccuugguuaccuggugcugauacacaagguaguaacuggauucaaaaagaaacgcugguuacuuucaaaaacccucaugcuaagaaacaagacguagucgugcuaggaucccaagaaggagcgaugcacacugcucugacgggagccacugaaauucaaaugucgaguggcaacuuauuguuuaccggucaccuaaaaugucgacuuagaauggauaaauuacaacuaaaaggaaugucauauucaauguguacaggaaaauucaaaauugucaaagaaauugccgaaacgcaacaugguacaaucgugauccgaguacaauaugaaggcgauggaagcccaugcaaaauuccauucgaaauuauggauuuagagaaaagacauguauuaggacgacugauuacgguaaacccaauuguaacugaaaaagauucgccaguaaauauagaagcugagccaccauuuggugauucuuacauaauaauugguguugagccaggucaauuaaaauugaauugguuuaaaaaggguucguccauuggacaaauguucgaaacaaccaugcgcggggcuaaaaggauggccauccuaggcgauacugcuugggauuuugguucgcugggaggaguauuuacauccauuggcaaagcguugcaccaaguguucggugcuauuuauggagcugcauucucuggugugucauggacaaugaaaauucuaauuggcguaauaaucacauggauaggcaugaacucgagaucuacuucgcuuagcguaucauugguauugguagggguggugacauuguaucucggcgugaugguucaagcagacaguggaugcguaguaucuuggaagaauaaagaauuaaagugcggcucaggaaucuuuauaacugauaauguccauacuuggacugaacaguauaaauuccagccugaaucacccucaaaacuugcgucagcaauucaaaaagcucacgaggaaggaauuuguggaauaaggagugucacgcgauuagaaaaucuaauguggaaacaaaucacuccagaauuaaaccacauccuuagugaaaacgaagugaaauugaccauuaugacuggugauaucaaagguauaaugcaggcaggaaaacguucgcuaagaccucaaccaacggaacuuaaauacaguuggaaaacaugggguaaggcaaaaaugcugucaaccgagucucacaaucaaacauuccuaauugauggucccgagacggcugaauguccaaacacaaacagagcauggaacucucuagaagucgaagacuauggauuuggagucuuuucaacaaauauuugguugaaauuacgggagaagcaagauguauuuugcgauagcaaacuaaugucggcagcaauaaaagacaauagagcugugcacgcugacauggguuauuggauugaaucugcauugaaugauacuuggaaaauggaaaaagcaucauuuauagaaauaaaaucaugucauuggcccaagucucauacacuauggucaaacgguguauuagaaagugagaugauuauuccuaaaaauuucgccgggccaguaagucagcacaauuaccgacccgguuaucauacgcaaacagcgggucccuggcauuuggguaaauuagagauggauuucgauuucugcgaagggacaacaguaguuguaacagaggauugugguaacagggggccuucgcugcguacaacuacggcaaguggcaaguuaauaaccgaauggugcugccguaguuguacauugcccccguuacgauauagaggagaagacgguuguugguacgguauggaaauaagaccauuaaaggaaaaagaggagaacuuaguuaacagcuuaguaaccgccgggcacggucaaauagacaacuucucguuagggguauuaggaauggcacuuuuccuagaggaaaugcugagaacaagagucggcacaaaacaugccauacuauuaguugcuguuagcuucgugacguuaauuacagggaacauguccuuccgggaucucgggagaguaaugguaaugguaggcgcaacgaugacggaugauauaggaaugggagugaccuaucuugcauuauuagcggcuuucaaagugcgaccaacauucgcagcuggguuacuauuacguaaacuaaccucgaaagagcuaaugauggcuaccauaggcauagccuuauugagccaaaguacaauaccagaaacaauacuagaauugacugaugcgcuagcgcuaggcaugaugguucugaaaauuguaagaaauauggaaaaguaccaacuugcagucacaaucauggccauaucuuguguaccgaacgccgugauacuacaaaaugcauggaaagugaguugcacaauucuugccgcgguaagcgucaguccguuguuauuaacaaguucgcaacagaaggcugauuggauaccauuggcgcucacuauaaaagggcucaauccgacagcaauauuuuugacaacguuaucgagaaccucaaagaaacgaucuuggccucucaacgaagccguaauggcgguagguaugguaagcauacuagcaagcucucuauugaaaaaugauauaccgaugaccggcccuuuaguagcuggcgggcuccugacugucugcuacguauuaacagggcgcucugcagacuuagagcucgaaagagcagcggaugucaagugggaggaucaagcagaaauaucuggcucguccccuaucuuaagcaucacuauaucagaagacggaagcauguccaucaaaaaugaagaggaagaacauacacugacgauucuaauuagaacaggacucuuagucauuucuggcguuuucccuguuucuauaccaaucacugcagcggccugguacuuaugggaggucaaaaagcagagggccgguguauuaugggacguaccaaguccgcccccaguuggaaaggcggaacuagaagauggagcauaucggaucaagcaacgagguauuuucggauauucacaaauaggcgcaggaguauacaaagaggggacauuccauacuauguggcacgugacucgcggugcugugcuaaugcaucgugggaagagaauagaacccucaugggcagaugucaagaaagaccuaauuucauauggggguggcuggaagcucgaaggagaguggaaggaaggggaagaaguucagguucuagcccuagagcccggcaaaaaucccagggccgugcaaacuaaaccgggccuauuuaaaacgaauacugggacuauaggagcuguuagucuugacuucucucccggaacaagcggaagucccaucgucgaucgaaaaggaaaagugguaggacuguacgguaaugguguagucacucguucaggcgcauaugugagcgcgauagcacaaacugaaaagucaauagaagacaaucccgaaauagaagaugauauauuuaggaagaaaaggcuuacaauaauggaccuacacccaggugccgguaagacuaaaagauaucuuccagcaauaguaagggaggcgauaaagcgaggauuaagaacauuaauacuagcccccacucgcguuguugcugcagaaauggaggaagcccuacgaggucuacccauuagauaucaaaccccugcgaucagagcagagcacacaggaagggaaauuguugaccuuaugugucaugcgacguucacgaugagacuacuguccccaguaagagucccuaacuauaaccuuaucauaauggacgaggcucauuucacugauccggcaagcaucgcggcaagaggguacauaagcacuaggguagagaugggcgaagccgccggaauauuuaugacagcaaccccuccagguaguagagacccauucccacaaucuaacgcaccaaucauggacgaagaacgggaaauaccagaacgcuccuggaacagcggccaugaguggguaacagauuuuaaggggaagacaguuugguuugucccuagcauaaaagcuggcaacgauauagcagcauguuuacggaaaaauggcaagaaagucauucaauuaucuagaaagaccuucgacucagaguauguaaaaaccagggcgaaugauugggacuuuguggucacaacugauauaagcgagaugggagcaaacuuucgagcugaacguguaauagauccacguaggugcaugaaaccagucaucuuaacugauggggaagaacgugucauauuggcgggaccaaugccaguaacucauaguagcgccgcccagcgaagagguagaaucgguagaaaccccaaaaaugagaaugaucaauacaucuacaugggagaaccauuagaaaacgaugaggauugugcacacuggaaagaggcuaaaaugcuacuagauaacauaaauacccccgaaggaaucauaccaagcauguucgaacccgaaagggagaagguugacgcaaucgacggagaguauagauuaagaggggaagcgcgaaagacauuugucgacuuaaugagacguggagaccugccgguuuggcuagcauauagaguugccgcggaagggauuaauuaugcagacagacgauggugcuucgaugggauuaaaaacaaccaaauuuuagaagagaaugucgagguggaaauauggacuaaggaaggagagaggaagaaacuaaagccacguuggcuggaugcaagaaucuacuccgacccuuuagcuuugaaagaguucaaagaguucgcggcagggagaaaaucacuaacgcuaaaucugauaacagaaauggguagacuacccacguucaugacccaaaaagcucgugaugcgcuugacaaucuagcgguacuccauacugcugagguaggagguagagcauauaaccaugcauuaagugaacuuccagaaacacuagaaacuuuauuauuacuaacuuuauuagcaacugucacaggaggaauauuucuuuucuugaugucuggaaaggguauaggaaaaaugacccuaggcauguguugcauuauuacggcgucuauacuccuuugguaugcccaaauacagccccacuggaucgcagcaaguauuaucuuggaguucuuucuaauuguccuuuuaauacccgaaccggaaaaacagaggacgccccaagacaaccaacuuacuuaugucguuaucgcaauucucacaguaguagcagcgacuauggccaaugaaaugggauuuuuagagaaaacuaagaaagauuuaggccucggaucaauaacaacccaagaaagcgaaagcaacauauuagauauugacuuacgaccagcaucugccuggacauuauacgcagucgcaacuacuuucgugacgcccaugcuaagacauaguauagaaaauucaagugucaacguuagccugacugcaauagcuaaucaggccacaguguuaaugggacuaggaaggggauggccauuaagcaaaauggauauaggcgugccacuauuagcgauugguugcuacagucaagugaauccaauaacuuuaacagcugcgcuacuacuauuaguagcgcauuacgcaauaaucggaccaggguugcaggcgaaggcuacacgggaagcacaaaagcgcacagcagcuggaauaaugaaaaauccgacaguugacggaauuacuguuauugaucuugaacccauacccuaugauccuaaguucgaaaaacaauugggccaaguaauguuauugguacuuugcguaacccaaguucuuaugaugcgaacuacuugggcacucugcgaagcccuaacgcucgccacaggaccuaucucuacauuaugggaaggaaacccgggccgguucuggaacacaacaauagcuguaagcauggcuaauauauucagaggaucauauuuagcuggggcaggauuauuauuuagcaucaugaagaauaccacaaacacuagaaggggcacaggcaacauaggugaaaccuugggcgaaaaauggaaaagucgccucaacgcgcugggaaaaucagaauuucaaauauauaagaaauccgguauacaggaagucgauagaacauuggcaaaagaagggauaaaaagaggggaaacugaccaccaugcggugucucgagguucugcgaaacucaggugguuugucgaacgcaauaugguaacgccugaaggaaaaguuguagaccucgguuguggucgcggaggguggaguuacuacugcgguggucuaaagaauguuagagaaguaaaagguuuaacaaaggguggaccuggacacgaagaaccaauaccaaugaguacuuauggguggaaucucgucagauuacaauccggaguggauguguucuuuacuccgccagaaaaaugcgauacucuacuuugugauauuggugagucaaguccuaacccuacuauagaggcugggcguacacuuaggguauuaaaucugguagaaaacuggcuuaauaauaauacacaauuuuguauuaaaguacuuaauccuuauaugccuuccguuaucgagaaaauggaaacguuacagagaaaauauggaggggcgcucguaagaaauccacuaucaagaaauucaacccaugaaauguauugggucagcaacgcuacugguaacauaguuucuucugucaacaugauaaguagaaugcucaucaaccgguucacuaugaaacauaaaaaggcaacauaugaaccagacgucgauuuaggaucagguacacgcaauauaggaauagaaaacgaaauaccuaaucuugauauuauagguaaaagaauagagaaaauuaaacaagagcaugaaacaucauggcacuaugaucaagaccacccauauaaaacaugggcuuaucacgggucauacgaaacuaaacaaacggguagugcaucuaguauggucaacggcguaguuaaacuguugacaaaaccaugggauguugucccaaugguaacucaaauggcgaugacugacacaacuccuuuugggcaacagagagucuuuaaagaaaagguugauacgaggacccaagaaccaaaagaaggcacaaagaaacucaugcgaauuacugcagaauggcuguggaaggaacuaggaaagaagaaaacuccccgaauguguacuagagaagaauuuacgcgcaaaguacgaucuaaugcggcucuaggggccauauucacugaugaaaacaaauggaaaagugcucgugaagcagucgaagacuccagauucugggaauuggucgacagagaaagaaaucugcaccucgaggguaaaugcgaaacgugugucuacaacaugauggggaaaagagagaagaaacuuggagaguuuggcaaagcuaaggguuccagagcaauaugguauauguggcugggagcuagauuuuuagaguucgaagcacuaggcuuccucaaugaagaucauugguucucuagaggaaauucacuauccggaguggaaggcgagggcuugcacaaacugggguacauccuucgggauguaucuaagaaagaaggaggggcaauguacgcagacgauacggcuggaugggacacgagaauaacucuagaagacuugaaaaaugaggaaauggugacaaaccacaugaaaggcgaacauaagaaacuagcagaggccauauuuaagcugacauaucaaaacaaggucguaagaguccaacguccaacaccacgcggaacaguaauggacaucauaucccgaaaagaucaaagaggcaguggacagguaggcacguauggcuuaaauaccuucacaaauauggaggcccaacucauuagacaaauggaaggagaaggcauauucaaaucuauacaaagacuaaccgucacagaagagauagcuguccaaaacugguuggcacgcguaggaagagaaaggcucagcagaauggcaauaucaggugacgauugcgucguaaaaccgcuugacgaccgauuugcuucagcguugaccgcacuaaaugacaugggaaagguucgcaaagauauacaacaaugggaaccuucacgaggauggaaugauuggacccaaguuccuuuuugcagucaucacuuccaugaauuggucaugaaggacggucgcguacugguuguacccugucgcaaucaagacgaauuaaucggcagggcaagaauaagccaaggggcuggcuggucucuuaaggaaacagcgugccuaggaaaaaguuacgcacagauguggacgcuaauguauuuucauagacgagaucuaagacuugcagccaaugcuaucuguucugcuguacccucgcacuggguaccaacaagucgaacuaccuggaguauucacgcaaaacaugaauggaugacuacugaagauaugcuugcagucuggaaucgagucuggauccaagaaaauccauggauggaagauaaaacaccagucgaaucuugggaagaaguaccuuauuuaggaaagagagaagaucaauggugugguuccuuaauuggccugacuagcagggcuaccugggccaaaaauauacaaacggcuauuaaccaaguacgaagccuuauagguaaugaagaauacaccgacuauaugccgagcaugaaaagauucagaaaagaagaagaagaagcaggagugcuaugguga

SEQ ID NO: 22495 - RNA, 9876 nt, Artificial Sequence
  derived and/or modified CDS sequence (opt6) from DENV-2__KF955363__SS-prME
acggcuggggucauuauuaugcuaauaccuaccgcaauggcauuucaucuaacgacgcgaaacggcgaaccacacaugauuguuggaagacaagaaaaaggaaaaagucucuuguucaagacagaagaugguguuaauauguguacguugauggcaauugauuuaggggaacuaugugaagauaccauaacuuacaaauguccuuuguuaaggcagaaugaaccggaagauauugauuguugguguaauucuacaagcacuugggugacuuauggaaccugcacuaccacaggggaacaucgacgagaaaaaagaagcguagcgcugguuccccauguuggaaugggacuugaaacucguacagaaacguggaugucaucugaaggagccuggaaacauguucaacgaauagagacauggauauuaagacacccuggguucacaauuauggcagcaauacuagcuuauacgauaggaacuacucauuuucaacgcgcccugaucuuuauucuuuuaacugccguggcuccgagcaugacaaugagaugcauuggcauauccaacagagauuuuguggaaggcguaaguggaggaucuuggguggacauuguccuggaacaugggaguuguguaacaacuauggccaaaaauaaacccacucucgacuuugaacuuauuaaaacagaagccaaacagccagccacauuacguaaauauugcauugaagcaaaacuaacgaacacuacuacagaaucaaggugccccacucaaggagaaccgagcuuaaaugaagaacaagauaagcgauuucucuguaaacauagcaugguugaccgcggauggggaaacggcugugguuuguuuggaaaaggggguauuguuaccugcgcaauguuuacuuguaaaaaaaauauggaggguaagguaguacaaccagaaaaccucgaauauacuauuguaauaaccccucauucaggugaagaacaugcgguaggaaacgacacaggcaaacauggcaaagaaauaaaaaucacuccacaauccucaauaacagaggcagaacuuacaggcuaugguacaguuacaauggaguguucuccuagaacaggucuugacuucaaugagaugguucuuuuacagauggaggacaaagcuuggcuuguucauagacagugguucuuagaucuuccucuuccguggcugcccggagcagauacgcaggguagcaauuggauucagaaggaaacauuaguaacuuucaagaauccucacgcaaaaaaacaagacguuguagugcucggaagccaagaaggagcaaugcauacagcucucacaggugcaaccgaaauucaaaugucaucugguaaccuauuauuuacggggcaucugaaaugcagacuaagaauggacaaauuacaacuaaaagggaugaguuauucuaugugcacugguaaauucaaaauagucaaggaaauagcugaaacucaacacgggacuaucguaauacgaguucaauaugagggagauggauccccauguaagaucccauucgagaucauggaucuugaaaagagacauguccuagggcgucugauaacuguuaaucccauagugacggaaaaagauucccccguaaacauugaggcugaaccucccuuuggagacucauauaucaucauuggaguagaaccugggcaacuuaaacuuaauugguuuaagaaaggaucaucaauaggucaaauguucgagacaacgaugcgaggugcuaaaagaauggcaauccuaggagauacagcgugggacuuuggaaguuuagggggaguauucacaagcauagguaaagcacugcaccaaguuuuuggggcuauauacggagcggcuuucuccggcgucagcuggacaaugaaaauuuuaauaggaguaauaaucacauggaucggcaugaauagucgaaguacgagucuauccgucuccuuaguacuggugggagugguuacguuguaucuaggagcuauggugcaggcugauucuggcugcgucguuaguuggaaaaauaaagaauuaaagugcggcuccggaauauuuauuaccgauaauguccauacauggacagagcaauacaaauuucaaccugagagcccguccaaguuagccucugccauccagaaggcacaugaagaaggaauuuguggaauacgcucuguaacacgucucgagaaccugauguggaaacaagucaccccagaauuaaaucauauuuuaagugaaaacgagguuaagcuuacuaucaugacaggugauauuaaggguauuaugcaagccgguaaaagaucuuuaagaccccaaccgaccgaauuaaaguauagcuggaaaacuugggguaaggcuaagaugcucucaaccgaaucccacaaucaaacguucuugauagacggcccugaaacagcggaaugccccaauacuaacagagcuuggaauucacuugaaguugaggacuacgguuuuggaguguuuacaaccaauaucuggcuaaagcuaagagaaaaacaagacguuuucugugacucuaaauuaauguccgcugccauaaaagauaaccgcgcaguucacgcagauauggguuauuggauugaaagcgcacuaaaugacacguggaagauggaaaaagcaagcuuuauugaaguuaaaaguugucauuggcccaaaagccacacauuauggaguaacggcguacuugaaagcgaaaugauaauaccaaagaacuuugcagguccagucucacaacauaacuaucguccagguuaccauacacaaacggccgguccuuggcaccuagggaaauuagaaauggauuucgauuucugugaggguacaacugucgugguaaccgaggacugugguaauagggguccaagucuaagaacuacaacagcgucaggaaagcucauaacagaaugguguuguagaucuuguacuuuaccaccacuuagauaccgaggugaagaugguugcugguacggaauggagauaagaccccuuaaggagaaggaggaaaacuugguaaauucacuaguuacugcaggccauggacaaauagauaauuucucccuagggguguuaggaauggcuuuguucuuagaagaaauguuacggacgagagugggaacaaaacaugcgauauuauugguagcgguuucuuuuguaacgcuaauaacgggaaacaugucauuuagggaccuuggucgagugaugguuaugguaggcgccacuaugacagaugacaucggaaugggaguuacauacuuagccuugcucgcagcuuuuaaaguaagaccaacguuugcagcaggauuacuacuaaggaaacugacuagcaaagaacuuaugauggccacaauaggcauugcacuauuaucacaaucaacgauacccgagacaauacuagagcuaacggaugcguuggcacucgguaugaugguauuaaagauaguaagaaauauggaaaaguaccagcuggccgucacaauaauggcaauaagcuguguaccaaaugcagugauuuuacaaaaugcauggaaaguaucauguacaauacuagcagcaguauccguuucacccuuauuacuaacuagcagucaacaaaaggcagauuggauaccauuagcauuaacaaucaaaggcuugaauccaacggccaucuuucugacgacacuaucaagaaccuccaaaaaaagaucauggccacucaaugaagcaaucauggcaguaggaauggucucgauucuggcaucuucacuacucaaaaacgauauaccaaugacuggcccucuaguggcagggggacuucuuacuguuuguuaugugcucacagguagaagcgcugaucuagagcuagagagagcagcggaugucaaaugggaagaucaagcagaaauaucagguucaagcccaauucuuaguauaacaaucucagaagauggaucgaugaguauaaaaaaugaagaagaagaacaaacacuuacaauccuaauacguacggguuuauuggugauuucagguguauucccuguuaguauaccuauaacggcugcagcuugguaccucugggaaguuaaaaaacaacgggcggguguacuaugggacguaccaucuccuccuccuguaggaaaagcagaacuagaggacggcgcauaccgaaucaaacaacguggcauauuaggcuauucacaaauaggugcagggguuuauaaagaagguacguuccacaccauguggcauguaacuaggggagcgguauugaugcacagggggaagagaauagaaccaucgugggcagacgucaagaaagaucugauaucguacggaggaggauggaaauuggaaggugaguggaaagaaggagaggaagugcagguuuuggcacuagagccaggcaaaaacccaagagcaguacaaacaaagcccggauuguucaaaacaaauacaggaaccauaggagcugugucacuagacuucucucccgguaccucagggucgcccauuguugauaggaaaggaaaaguaguggguuuguacggaaacgguguaguaacuagaucuggcgccuaugucagugccauagcacagacagaaaagagcauagaagauaacccggaaaucgaagaugacaucuucagaaagaaacgauuaacaauaauggaucugcauccuggagcagguaaaaccaagagguaucuaccagcaauagucagagaagccauaaaaagggggcuacgaacucucauacuggcaccaacucggguaguagcagcggaaauggaagaagcguuaagaggacuacccauucgauaucagacuccggcuauaagagcagaacauacaggucgagaaauaguggauuuaaugugccacgcuaccuucacuaugagguuguuaagcccuguuagagucccaaauuauaaucuaauaaucauggaugaggcgcacuuuacagauccugcaaguauugcugcccggggauauauuaguacgagaguagaaaugggugaggcugcagggaucuucaugacggcaacaccacccgggagcagagauccuuuuccucagaguaacgcccccauuauggaugaagaaagagagauaccugaacguucuuggaauagcggacaugaauggguaaccgacuuuaaggguaagaccguaugguuugugccauccauaaaggcagguaaugacauugccgcauguuuacgcaaaaauggcaagaagguaauucaauuaagcagaaagacauucgacagcgaguauguuaaaacgcgagcaaaugauugggacuuuguuguaacaacagauauaucggaaaugggcgcaaauuuuaaagccgagagagugauugauccgcgaagaugcaugaaaccugucauucuuacagauggugaagaaagggucauauuagcugguccaaugccaguaacacauuccucagcugcacagagaagaggaagaauaggaaggaacccgaaaaacgaaaaugaucaauauauauacaugggagaaccgcucgaaaaugacgaagacugcgcacauuggaaagaggcaaaaauguuauuggauaacauaaacacuccagaagguauaauuccuaguauguuugaaccggaaagagagaaaguagacgcuauugauggugaauauaggcuacgaggcgaggcaagaaagacuuuuguagaucucaugagacgcggcgaucucccaguuugguuagcauacagaguugcugcggagggaauuaacuaugcugaccgaagguggugcuuugacggaauaaagaauaaucaaauacuggaagagaauguugaaguugagauauggacuaaagaaggugaaagaaagaaacuaaaaccacgguggcucgaugcccgaauauacucagauccguuggcacuuaaggaguucaaagaauuugcagcuggucgcaaaaguuuaacguuaaaucuaauuacugaaaugggacgacucccaacguuuaugacccaaaaagcgagagacgcacucgacaaucuagcaguccugcacacggcugaagcaggugggaaagcuuauaaccacgcgcuuuccgaauuaccagaaacucucgagacacuauuguugcugaccuuacuagcuaccgugaccggugggauauuccuauuucuaaugucuggcaaagggauugguaaaaugacucuaggaauguguuguauuauaacagcaucaauacuacucugguaugcucaaauacaaccgcacuggauagcagccuccaucauuuuagaguucuuucuaaucguuuugcucauaccagagccugaaaaacagcguacuccucaagauaaucaacucacuuacgucgugauagcgauacucacgguuguagcggcuacaauggcaaacgagaugggauuucuugaaaaaaccaagaaagauuuaggacugggaagcaucacgacucaagagagcgagaguaauauauuagacauagauuuacgaccugccagugcguggacauuauaugcaguugcgaccacuuucguuacccccaugcuaagacauucuauugaaaauaguucuguuaacguaagccuaacugcaauagcaaaccaagcuacuguauuaaugggauugggaaaaggcuggccacuuagcaaaauggacaucggaguaccucucuuggcaauaggaugcuacucccaagucaaccccauaacgcuuacugccgcacucuuauuguuaguugcucauuacgcuauaauagguccuggacuacaagcgaaagcaacgagagaggcucagaagagggccgcggcugguauaaugaaaaauccaaccguggacggaauuacaguaauugaccuggaaccaauaccauaugauccuaaauuugaaaaacaauuaggccaaguuauguuacugauacuaugcguaacacaaguccucaugaugcgaacaacuugggcacuaugugaggcacuaacucuggccacagggccuauaaguacgcugugggaagggaauccgggcagauuuuggaauacaacaauagcuguuuccauggcgaauaucuuucgagggucauauuuagcgggagcuggccucuuauuuuccauaaugaaaaacaccacgaauacucgaaggggaacagguaacauaggggaaacguuaggagagaaauggaaguccagauuaaacgcucucggaaaaucugaauuucagaucuacaaaaagucugguauacaagagguagacagaacccucgcuaaagaaggaaucaaaagaggcgaaacagaucaccaugcaguaucaaggggaucagcuaaacuaaggugguuuguagagcguaauaugguaaccccugaaggcaagguagucgacuugggguguggucgagguggcuggaguuacuacugcggaggcuuaaaaaauguacgugagguaaaagguuuaaccaaaggaggaccaggacacgaggaaccuauacccaugagcacauaugguuggaaccuuguacgacuacaaucaggagucgacguauuuuuuaccccgccagaaaaaugugacacucuacuaugcgauauaggagagucaaguccaaacccaacaauagaagcagguagaacuuugagaguauugaacuuaguggagaauugguuaaacaauaauacacaauuuugcaucaaaguuuuaaacccuuauaugccgucaguuauugagaaaauggaaacccuucaaagaaaauauggcggagcgcuagugcgaaauccacuauccagaaauagcacacacgagauguacugggugagcaacgcaacugggaauauuguaucaucgguaaacaugauuucccgaaugcuuaucaaucgcuucaccaugaaacauaaaaaggcaacuuacgaacccgaugucgauuuaggcuccgguacuagaaacauagggauagagucggagauaccuaaccuggacauaauuggaaaacgaauagaaaaaaucaagcaggaacacgagacaaguuggcauuaugaucaagaucacccauacaagacuugggcuuaccauggaagcuacgagacaaagcaaacuggcucugccaguucaaugguaaauggugucguacgauuauuaaccaaaccgugggacguaguucccaugguaacacaaauggcuaugacagacacgacaccauucggacaacaacgugucuuuaaggaaaaaguagauacuagaacacaagaacccaaagaagggacaaaaaaacuuaugaaaauaacagcugaauggcucuggaaagaauuagguaaaaaaaaaacaccacgaauguguaccagggaggaauucaccagaaaaguccguaguaacgcugcacuuggggcuauauuuaccgaugaaaacaaauggaaaucagcccgugaggcgguagaggacuccagauucugggaauuaguagauagagaaagaaacuuacaucuugaaggaaaaugugaaacuugugucuacaauaugauggggaaaagagaaaagaaguuaggugaauucggaaaagcuaaagggagcagggcaauaugguacauguggcuaggugcacgauuccuugaguucgaagcacugggauuucuuaacgaggaucauugguuuaguaggggaaauucucuaucugggguggaaggggaaggcuuacauaggcucggauauauccugagagacgucaguaaaaaagaggguggagcuauguacgcugaugauaccgcaggcugggauacccgaauuacucuagaggauuuaaaaaaugaagaaaugguaacaaaucauaugaaaggcgagcauaaaaaacucgcugaagcaauauucaaauuaacuuaucaaaauaaaguaguaagggugcaaaggccuacaccccgugguacgguaauggacauaauuucgagaagggaucaacguggaucaggacaaguugguacauauggucuaaauacauuuacuaacauggaggcucagcucauucggcaaauggagggcgaggguaucuuuaaaaguauucaacacuuaacgguuacggaagagauugccguucaaaauugguuggcaagaguagggcgagaacgcuuaucccgaaugguaaucucaggagacgauuguguaguuaaaccucuagaugaucgauucgcaagcgcucuaacagcacugaacgauaugggaaaaguucguaaagacauucaacaaugggagcccagcagaggguggaaugauuggacucaaguaccuuucugcagucaucauuuccacgaacuaguaaugaaagacgguagaguauuaguagucccguguagaaaccaagaugagcucauuggaagagcuagaauuagccagggagcaggguggaguuuaaaagaaacagcuugccuaggaaaaagcuacgcacagauguggacgcucauguauuuucaccggagagacuuaagguuagcagcaaaugcaaucuguuccgccguaccuucacauuggguaccuaccagccgaacuacaugguccauccaugcaaaacaugaauggaugaccacggaagacauguuagcaguuuggaauagaguuuggauucaggaaaauccauggauggaagacaaaacaccuguagagucuugggaagaaguaccuuaucuugguaaacgugaagaccaauggugcggaagcuuaaucgggcuaacuucacgugcaacaugggcgaaaaacauacaaaccgcaauaaaccagguccgaucccuuauagguaacgaggaauacaccgauuauaugcccucaaugaaacguuuccgacgcgaagaagaagaagcaggaguccucugguga

SEQ ID NO: 22496 - RNA, 9876 nt, Artificial Sequence
  derived and/or modified CDS sequence (opt6) from DENV-2__EU726767__SS-prME
uccgcugguaugauuauaaugcuaauuccuacuguuauggcauuucauuuaaccacgagaaauggagaaccccacaugauugugucaagacaagaaaaagggaaauccuuguuguuuaaaacugaagauggagugaauaugugcacauuaauggcaauggauuuaggcgaacucugugaagacacuauuacauauaaauguccgcuauuaagacaaaaugaacccgaagacauugauuguugguguaacaguacuucuacgugggugacauauggaaccugugcaacuaccggagaacaucgacgcgagaaaagaaguguggcccuaguuccacaugucggaaugggacuagaaacaagaacagaaacguggaugaguuccgaaggcgcauggaaacaugcucaacguauugaaacguggauauuaagacacccaggguuuacgauaauggcugcaauauuagcauauacgauaggcacgacacacuuccaaagagcucuaauauucauucugcucacagcggucgcaccaucuaugacuaugaggugcauuggcauaagcaaucgagacuucguggaaggaguauccggcggaucauggguugauauaguuuuagaacacggaucaugcguaaccacuauggcaaagaauaaacccacuuuagacuuugaacugaucaaaacugaagcaaaacaaccagcaacauuaaggaaauacuguauagaagcaaaauugacuaauacaacaacugaaagccgaugucccacacaaggagaaccaucuuuaaaagaagaacaagauaagcgauuuguuugcaagcacagcaugguagauagaggauggggcaaugggugcgggcuguucgguaaaggcggcauuguaacaugugcuauguucaccuguaaaaagaauauggaaggaaaaauaguacaaccugaaaauuuggaauacacaauuguagucaccccacacaguggcgaggaacacgcaguggggaaugacacgggaaaacacggaaaagaaauuaagguaacuccccaaaguucuauaacugaagccgagcuaaccggcuaugggacaguuacuauggaguguaguccacguaccggccuagauuuuaaugagaugguguuguuacaaauggaaaauaaagccugguuggugcauagacaaugguuucuugaccuuccauuaccuugguugccuggagcagacacacaaggaagcaauuggauucaaaaagaaacgcuugucacguuuaaaaauccucacgccaagaagcaagauguuguaguacuaggcucacaagaaggugccaugcauaccgcacuuacaggggcgacggaaauucaaaugaguagcggaaaucuacucuucacuggucaucuaaagugccgucuaagaauggauaaacuucaacucaagggaaugucuuacagcauguguacagguaaauuuaagguaguaaaagagauugccgagacucaacaugggacuauaguuauucgcguucaauaugaaggggauggaucacccuguaaaauuccauuugaaaucauggaccucgagaagagguacgugcuugguagauuaauaacugucaauccuaucgucacggaaaaagacuccccugugaauauugaggcugaaccaccuuuuggagacucauauauuaucauuggaguugaaccuggucaacuaaaauugaacugguuuaagaaaggaucgagcauaggacaaauguucgaaaccacaaugagaggcgccaaacgcauggcuauuuuaggugauaccgcaugggauuuuggcaguuugggcggcgucuuuacgaguauuggaaaagcccuacaucaaguauuuggagcaauauacggagcggcguuuagugguguguccuggacaaugaagauacuaauuggcgucauuauuacguggauuggaaugaacaguagaagcacaucucucagcguuucauuaguccuuguaggaauuguuacucucuaccuagguguaaugguucaggccgacucaggauguguugucucauggaaaaacaaagaacugaaaugcggaagcggcaucuuuaucacugacaauguucacaccuggacggaacaauauaaauuucaaccagaaaguccgagcaaauuagcgucugccauacaaaaagcacaagaagaagguauauguggcaucagaagcgucacuaggcuugaaaauuuaauguggaaacagauaacgccugaguugaaccacauacuggcugaaaaugaaguuaagcucacaauaaugacaggcgacguaaaagguauaaugcaagcuggcaagagaagucucagaccccaacccacagaacuaaaguauucuuggaaaacauggggcaaagcaaaaaugcuaucuacagagucccacaaucaaaccuuuuuaauagauggaccagagacugcggaaugcccuaauacuaauagagcguggaacuccuuagaagucgaagacuacgguuuugggguuuucacaaccaauauaugguuaaaguuaaaagaaaagcaagacgcauuuugugauucaaaguuaaugagugccgcgauaaaagauaaucgagcaguacaugcagauauggguuauuggaucgaaagugcgcuaaacgauacauggaagauagaaaaagcgucauuuauagaaguuaaaaauugucauuggcccaaaagucauacauuguggucuaacgguguacuagaaagcgaaaugauaauaccgaaaaaccuggcggggcccguuagucaacacaacuauagaccuggcuaccauacucaaaucgcagguccuuggcaucuagggaaacuagaaauggacuuugacuucugugagggaacuaccgucguugucacagaagauugugguaauagagguccaucacuucguacaacgacggcaucugguaaacuuauuaccgagugguguuguagaagcugcacccuaccuccacuacgcuacagaggagaagacgguugcugguaugggauggagauuagaccguuaaaagaaaaagaagaaaacuugguaaauagucuugucacagcaggccacggacaaguugauaacuuuucguuaggcguacuggguauggcauuauuucuagaagaaaugcuacgaacgagaguuggaacuaaacaugcaauauugcuaguagcuguuagcuucaugacauuaauaacagggaacaugagcuucaaagaccuagguagaguggucguuaugguuggagcugcaaugacugaugauauuggcaugggagugaccuauuuagcacuucuagccgcuuucaagguacgaccaaccuucgcugcaggacuuuuacuaaggaaacuaacaaguaaagaauugaugaugacuacuauaggaauagcguuacuaucccaaaguaccauaccagaaacaauucucgaauuaacagaugcauuggcucugggcaugaugguuuugaaaaugguacgaaauauggaaaaguaccaauuagccgugacaauaauggcuaucuuaugcgugccaaaugcaguuauacuacaaaacgcguggaagguuuccuguacaauucuggcagucgucuccgugucuccauuguuacuaacuagcagucaacagaaaacagacuggaucccgcuagcauugacuauuaaaggguuaaacccuacugccauauucuuaacaacauuaucaagaaccagcaagaaacgaucauggcccuuaaacgaagcaauaauggcugucgggauggugucuauuuuggccucaagucuacugaaaaaugacauucccaugacgggaccucuuguagcuggcggucuauuaaccgucugcuaugucuuaacagggcggagcgcagaccuagagcuggagagagcgacugauguaaaaugggaagaccaagccgagauaagcggaucgagcccaauucuaagcauuacaauaagugaagacggaucaaugagcaucaaaaaugaagaggaagaacagacguuaacuauauuaauaagaacgggauuauuagucauaaguggacucuucccaguuagcaucccaauaacagcagcggcaugguauuugugggaggucaagaaacagagagcagggguacuuugggacguuccgucaccacccccuaugggaaaagccgagcucgaagauggagccuaucgaauaaaacaaaaaggaauuuuaggguauagccaaauaggggcuggaguguacaaagaaggaaccuuccacacuauguggcaugugacgcguggagcagucuuaaugcacaaaggaaaaagaauagaaccuagcugggcagacguuaagaaagauuuaauaucauauggugggggauggaaauuggaaggagaauggaaagaaggcgaggaaguacaaguguuagcgcuugaaccagguaaaaauccgagggcaguccaaacgaagccuggauuauuuaaaacuaacgcuggaacaauaggggcaguuucgcuugacuuuucaccaggaacguccgguaguccaaucaucgacaaaaaggguaaggugguaggguuauauggaaacggaguaguaacacggaguggagcuuacguuuccgcgauagcacaaaccgagaaauccauagaagauaaucccgaaauagaggaugauauauuuaggaagagacgacuuacuauuauggaccuacacccgggugcuggaaaaacgaaaagauauuuaccagcaauuguaagagaggcaauaaaacgaggguugcggacauuaauucuugcuccaacucggguagucgcagcggagauggaagaggcuuuacgaggccucccaauuagauaccaaaccccagcuauuagagcugagcauacuggcagggaaauaguagauuugaugugccacgcuacguuuacuaugcgguuacucagcccuguaagaguaccaaacuauaaccuuauaauaauggacgaagcgcauuuuacggauccugcuuccauagcugccaggggauacauuucaacacgagucgagaugggggaagcugcaggcauauucaugacagcaacuccuccuggaucgagagauccuuuuccucaaucaaacgcaccaaucauagaugaagagagagaaauaccggaacgaaguuggaacucuggccacgaguggguuacggauuucaaaggcaaaacaguaugguuuguuccaucuaucaaggcgggcaaugauaucgccgcaugccuaaggaaaaaugguaagaaagugauacaacuaucaagaaaaacauuugacagugaguauguaaagacaagaacaaaugauugggauuuugucguaaccacugauauuuccgaaaugggugcaaauuucaaagcagagcguguuauagauccgcggcgguguaugaaaccgguuauauuaacagauggggaggagagaguaauacuagcuggcccaaugccaguuacucauaguucugcggcccagcggagaggccgcauuggucgaaacccuaaaaacgaaaacgaucaauacaucuauaugggugaaccauuggaaaacgacgaagacugugcgcacuggaaagaggcgaaaauguugcuugauaauauaaacacgccugagggcauaaucccuaguauguuugagccagaaagagagaaaguagaugcgauagauggggaauaucgucuucgaggcgaggcuagaaaaaccuucguugacuugaugcgccgaggagaucuaccagugugguuggccuacaaaguagcggcagaagguauaaacuaugcagaucgacgauggugcuucgauggaaucaaaaauaaccaaauucuugaagagaacguagaaguggaaaucuggacuaaagaaggagagcgcaagaaauuaaaacccagguggcuggaugccagaauauacagugauccuuuagcacugaaagaauuuaaagaguucgcugcaggacgaaaaucucuuacccuaaaccugaucacagaaaugggaagauugccaaccuucaugacucagaaaaccagagaugcauuagacaaucuggcgguuuugcauacagcagaagcaggagggcgggcuuauaaucaugcgcuaucggaacuuccagaaacgcuagaaacacuucuguugcucacguuauuagccacaguuaccggaggaauauuccuauucuuaaugagcggucgggguaucggaaagaugacauuaggaaugugcuguauuauaacagccuccauccuauuaugguaugcgcaaauucaaccccacuggauugcggccucaaucauccuagaguucuuccuuauugugcuauuaauaccagagccggaaaaacaacgaacgccucaagacaaucaauuaacuuauguggucauugcaauauugaccgugguagcugcgacaauggcaaaugaaaugggcuucuuagagaaaacuaagaaagaccuaggccuggguaguaucguaacgcaacaaccggaaagcaacauacuagacauagaucuucgaccugccucagcauggaccuuauacgcuguagcaacgacuuuuguaacuccuaugcuaaggcauucuauagaaaacucaaguguaaauguaagucuaacagcuauagccaaccaagcgaccguacuaaugggacucgggaagggauggccgcuaucaaaaauggacauaggaguuccacugcuagcuauuggcuguuauucacaaguaaauccaauuacauuaacugcagcccuacuguuacucgucgcacauuaugcgauuaucggcccaggucuucaagcuaaagcuaccagagaagcgcagaaaagagcagccgcugguaucaugaaaaacccuaccguagaugguauaacuguuauugauuuagaucccaucccauaugacccuaaauucgaaaagcaguugggacaagucaugcuuuuaguuuuaugcgugacacagguacuaaugaugagaacaacgugggccuuaugugaggcuuugacccuggcgaccgguccaaucagcacgcuuugggaaggaaauccaggaagauuuuggaacacaacaaucgcuguuaguauggcaaauauauuuagagggucguacuuggcuggagccggauuauuauuuucaaucaugaaaaauacgacuaauacacguaggggcacagguaauauaggugaaacucuaggagagaaguggaagucuagacuaaaugcucuaggaaaaucagaguuucaaaucuauaaaaagaguggaauacaggaaguugacaggacauuggcaaaagaaggaauuaaacgcggggaaacggaccaccaugcggucaguagggguucagccaaacuucgaugguucgucgaacgaaauaugguaaccccagaagguaaagucguugaccuuggcuguggacgagggggauggagcuauuauugugggggccucaaaaauguaagggaaguaaaaggucuuaccaaagggggaccgggucaugaagaaccuauaccaaugaguacauaugguuggaauuuagucagauugcagucggguguagaugucuucuuuauaccaccugaaaaaugugacacuuuguuaugugauaucggugagucuucaccaaauccuacggucgaagcuggcagaacgcuaagggucuugaauuuaguagaaaauugguugaauaauaacacucaauuuuguauaaaaguucugaauccauauaugccuagcguuaucgagaaaauggaggcacuacaaaggaaauacggaggagcccuaguaaggaacccccuuucuagaaacuccacacaugaaauguacuggguuaguaaugcaagcggaaauauaguuucuucagugaauaugauuuccaggauguuaauuaauagauuuacaaugcgucacaagaaagcaacuuaugaaccggauguagacuugggcucaggaacaagaaauauuggcauugaaucagaaauaccuaaccuagacauaauagguaaaagaauagagaaaauaaagcaagaacacgaaacaucauggcauuaugaccaggaccaccccuauaagacaugggccuaucacggcuccuaugaaacuaaacaaaccggaucggcgucuaguaugguuaacgggguaguccgacuguuaaccaaaccuugggacgucuuacccacugugacccaaauggcuaugacagauacaaccccauuuggucaacaacguguauucaaggaaaagguagacacaagaacgcaagaacccaaagaaggcacuaagaaacuaaugaaaaucacugcagaauggcuauggaaagaacuaggaaagaagaaaacccccaggaugugcacuagagaagaauuuaccagaaagguucguaguaacgcagcauuaggagccguuuucacugaugaaaauaaauggaaaagugcaagagaggcggucgaagacucgagauuuugggaauuaguagacaaagaacgcucauugcauuuagaaggaaaaugcgaaacgugcguauauaauaugauggggaagagagaaaagaaacucggcgaauuuggcaaggcuaaaggcucucgagcgauuugguauaugugguuaggagcaagguuucucgaguucgaggcucuuggauuccucaacgaagaucauugguucucgagggaaaauucauugagugggguggaaggcgaaggacuccauaaacuaggauacauacuaagggauguaucaaagaaagagggaggugcgauguaugcugaugauacagcgggaugggacacaagaaucacacuggaggauuugaaaaaugaggagauggugacgaaucauauggaaggcgaacauaagaaauuagccgaggccauauucaaauuaacguaucaaaauaaaguuguacgaguacaacgaccuacacccagagggacugugauggauauuauaucacgcagggaccaaagagguucuggacaagucgggacauauggcuuaaauacauucaccaauauggaagcccaguuaauccggcaaauggaaggagagggugucuucaagaauauacaacaucuaacuguuaccgaagagauugcggugcagaacuggcuggcccgugucggaagggagcgacuaucuaggauggcuauuucaggagaugauuguguugugaaaccguuagacgauagauucgcaucagcccuaacagcgcuaaacgauaugggcaaaauuagaaaagacauccagcagugggaaccuagcagaggauggaaugacuggacgcaaguuccauucuguucacaucacuuccacgaauuaauaaugaaagauggccgaguguuagucgugccuugucguaaucaagacgaacuuauuggacgagcacgaauuagccaaggagcggguuggagccucagagaaacggcaugucugggaaaaagcuaugcacagauguggucgcuaauguacuuucauaggagagauuuacgccuugccgcaaacgcaauuuguucugcuguuccuucccauuggguaccaacuucucgaaccacuuggagcauacaugcuaaacaugaguggaugacgacagaggauaugcuaacaguuuggaacaggguauggauucaggaaaaccccuggauggaagauaagacgccgguugaaaguugggaagagauaccuuauuuaggaaaacgagaagaccaaugguguggcaguuuaauagguuuaacaagcagagcaacaugggccaaaaacauacaagcugccaucaaucagguaaggagcuuaauuggaaacgaggaauauacggacuacaugcccuccaugaaaagauuuaggcgggaagaagaggaagcaggaguuuuaugguaa

SEQ ID NO: 22497 - RNA, 9876 nt, Artificial Sequence
  derived and/or modified CDS sequence (opt6) from DENV-2__EU687246__SS-prME
uccgcagggaugauuauaauguuaaucccgacggugauggcuuuucaucuaacaacccgaaacggcgaaccucauaugaucgucaguauccaggaaaaagguaaaagucucuuauucaaaacagaggauggaguaaauaugugcaccuuaauggcuauggacuuaggggaguuaugugaagauacuauuacauacaaauguccauuauugagacaaaaugaaccagaagauaucgacugcuggugcaauagcaccaguaccugggucacauacgguacauguaccacaacaggcgaacauagaagagaaaagagaagcguggccuuggugccccauguuggcaugggacuggaaacacguaccgaaacguggaugaguucagaaggagcguggaaacacgcacaacgcauugagaccuggauacuaagacauccuggauuuacaauuauggcagcgauccuugccuauacuauuggcacgacucauuuucaaagagcacucauuuuuauauugcugaccgcaguagccccauccaugacaaugagauguaucgguauaagcaacagagauuucguugaaggaguaagcgguggcagcuggguagacauaguuuuagaacacggaagcugugugacaacaauggccaaaaauaagcccacacuagacuuugaauuaauuaaaacagaggcaaaacaaccagcaacuuugagaaaauauuguauagaggcaaaauuaacaaauacaacuacagaaucacgcugcccaacccaaggagagccaucucuuaaagaagaacaagacaaaagauuuguaugcaaacauagcaugguagaucgagggugggguaauggaugugguuuauuuggcaaagguggaauugucacuugcgccauguucacgugcaaaaagaauauggaaggcaagaucgugcaaccggaaaaucucgaauacacuaucguuguaacaccgcauucgggugaagaacaugccgucggaaacgauaccggcaaacacggaaaagaaauaaaagugacuccucaguccucuauaaccgaagccgaacugacuggauacgguacagucacaauggaaugcucaccucgaacagguuuagauuucaacgagauggugcuccuacaaauggaaaauaaggcgugguuaguacaccgacaaugguuucuugacuugccccuaccaugguuacccggugccgacacucaagguucuaauuggauacaaaaggaaacuuuaguuaccuuuaaaaauccucaugcuaaaaaacaagacguagucguauuaggaagucaagagggugcuaugcauacggcacuaacaggggcgacagagauucaaaugagcucaggaaauuugcuguucacgggacaucuaaagugccgauuaagaauggauaaauuacaacuaaaaggcaugaguuauucaauguguacuggaaaauuuaaggucguaaaagaaaucgcagaaacgcagcacggcaccauaguuauaaggguucaguaugaaggagacggcuccccguguaaaauaccauuugaaauaauggaucuagaaaaaagguacguguuaggccguuuaaucacgguaaauccaauagugacagagaaagauucuccgguuaauauagaagcggaacccccuuuuggcgacucguauaucauuauuggggucgaaccuggacaacuuaaacuaaauugguuuaaaaaaggaucgucuauaggacagauguucgagacgacaaugagaggggccaagaggauggcgauauugggagauacagcgugggauuuugguucccuggggggaguauuuacuaguauuggaaaagcacuccaucaggucuuuggcgcaaucuacggggcagccuucucgggaguuucauggacgaugaagaucuuaauugguguuauuauuaccuggaucggcaugaauagucguucgacauccuuaaguguaucguuaguauuaguuggaauuguaacguuguaccuaggagugaugguacaagccgauuccgguugugugguuuccuggaaaaauaaagaacuuaaaugcggaagcggaaucuuuauuacagacaacguacauacguggaccgagcaguacaaguuccaaccagaaucgccuaguaaauuggcgagcgccauacagaaggcucaagaagaaggcauauguggaauaaggagcguuacaagauuggaaaauuuaauguggaaacaaaucacaccagaauugaaucauauacuggcggaaaaugaaguaaaacuuacaauuaugacgggagauaucaaaggaauaaugcaagccgguaaacgaucacuuaggccucaaccuacagaacuaaaauacucauggaaaacauggggaaaagcgaaaauguugucaacugaaucucacaaccagaccuucuuaauagauggaccggaaacugcugaauguccaaauacuaacagagcguggaacagcuuagaaguagaagauuacggauuuggcguuuucacgacgaacauaugguuaaaguugaaagaaaaacaagaugcuuuuugugacucgaaacuaaugucugcugcaauuaaggacaauagagcaguacacgcggacaugggauauuggauagaaagcgcauuaaaugauacauggaaaauugaaaaggcuucuuucauagaagugaagaacugccauuggccgaagagccacacacuauggaguaacggcguucuugaaagugaaaugauuauacccaaaaaucuagccgguccgguaucacaacacaauuauagaccaggauaccacacucaaauugcuggaccuuggcaucuaggaaaacucgaaauggacuuugauuuuugcgauggaacuacuguaguagugacugaagacuguggaaauagaggcccuucuuuacggacgaccacggccucagguaaauuaauuacggaaugguguuguagaagcugcacccuaccaccuuugagauacagaggugaagauggcuguugguauggaauggagauaaggccuuugaaggagaaggaagagaauuuaguaaacaguuuagugaccgccggucacggacaggucgauaauuuuagucuuggaguccuuggcauggcauuguuccuagaagagaugcuccgaacccgagucgggacgaaacacgcuauauuauuaguagcauuaucauuuguuacgcuuauaaccgguaauaugucauuuaaggauuugggaaggguaguaguaaugguuggggcgacaaugaccgacgauaucgguauggguguuacuuaccuugcccuccuugcagcauuuaaaguuagaccuacuuucgcagcaggauuauuacuccguaaacuuaccucaaaagaauuaaugaugacgaccauuggaauuguccuucuuagccaaucuaacauaccagaaacgauucucgaacuaacugaugcgcuagcauuaggaaugaugguauuaaaaaucguacgggauauggaaaaauaucaacuagcaguaacuauuauggcuauauuaugcguaccuaaugcugucauauuacaaaaugccuggaaggugucuuguacuauauuagccguugugucggucuccccauuacuccuaacaucaucucaacaaaagacggacuggauaccguuggcucucacuauaaaagggcugaauccuacugcaaucuuuuuaacuacacuuucacggaccaacaaaaaacgaaguuggccacuaaacgaagccauaauggcagucgguaugguaucaauucuagcgaguucguuacucaagaaugauauaccuaugacaggaccccuagucgcuggaggauuauuaacuguaugcuacguauuaacaggcagaucggcagauuuagagcuugaacgagccacagaugugaaaugggaggaucaggcagagauuaguggaagcucgccgauauuaucgauaacaauuagcgaagacggaucuaugucuauuaaaaaugaagaagaagagcagacccugacaauacuuauaagaacuggguuauuaguaauaucuggguuauuuccgguauccauaccuauaacagcagcugcaugguaucuaugggaaguuaaaaaacaaagagccgguguccugugggacguuccuagcccaccacccaugggaaaggcugaacuagaagacggagcauaccgcauaaaacaaaagggaauauuaggguauucacaaauaggugcaggcguuuauaaagaagggacguuccauacuauguggcacguuacucgaggugcgguauugaugcacaaagguaagagaauagaaccaucaugggccgacguaaaaaaggaucucauuucauauggggggggauggaagcuagaaggagaauggaaggagggcgaagagguacaaguucuugcacuagagccugggaaaaauccgagggcaguacaaacuaaaccaggacuuuuuaaaaccaacacuggcacaaucggugcugugagcuuggacuuuucacccgguacaucgggaucccccauaauugacaaaaaaggcaaagucguagguuuauauggcaauggaguagucacucguagcggcgcguacguaucugcaauagcgcaaacagaaaaaaguauugaagauaacccugacauugaagaugauaucuuuaggaaaagacgccugacuaucauggaucuacacccuggagcagggaaaacuaagcgguaucuaccugcaauagugcgggaagcuaucaagcggggguuaagaacuuugauauuggcaccaacgcgagugguugcugcggaaauggaagaagcuuuaagaggucuucccauucgguaucagacaccagcuauucgagccgagcauacuggacgugaaauagucgaucugaugugucacgcuacuuuuacaaugcgucuucuaucgccuguucgaguuccaaauuauaaccuuauaauuauggaugaggcgcacuucacugaucccgcuaguauagcggcacgagguuacaucucgacgcggguagagaugggcgaggcagcugguauauucaugacagcaacaccacccggaucaagagauccuuuuccccagaguaacgcacccaucauugaugaggaaagagaaauaccagagagaucuuggaacaguggacacgaaugggugacugacuuuaaaggaaagacugugugguucguaccaagcauaaaagcuggaaacgauauagcugccuguuuaaggaaaaauggaaagaagguuauacaguuaagucgaaagacguuugauucggaauacauuaaaacaagaacuaaugauugggauuucguuguaacaacagauaucagcgagaugggcgcaaacuuuaaagccgaaagaguaauagacccaagaagauguaugaagccagucauacugacagacggggaggagagaguaauucuggccgggcccaugcccguuacacauucuagugccgcgcaaagacguggccguaucggacgcaauccuaaaaaugaaaacgaucaguauaucuauaugggagaaccucucgaaaaugaugaggauugugcgcacuggaaagaagccaaaauguuacuugacaauauaaacacacccgaaggaauaauaccuagcauguuugaacccgagagagaaaaaguagacgccauugauggagaauauaggcuacgcggugaggcaagaaaaacauucguagaucuaaugcguagaggcgauuuaccaguguggcuagcguauaaaguggcagcagaagggauaaauuaugcggauagaaggugguguuuugacggcauuaagaacaaucaaauccuagaagaaaaugucgaggucgaaauauggacaaaagaaggagaaagaaaaaaguuaaaaccgcgaugguuggaugcuagaauuuacucugauccccuagcacugaaagaauuuaaagaguuugccgcaggaagaaaaaguuuaacucucaaccuaaucacagagaugggccgauugcccacauuuaugacacaaaagacucgagacgcauuggacaaccuugcuguauugcauacggcugaggcgggaggaagagcuuauaaccacgcgcucagugaacuaccggaaacgcuagaaacucuuuuauugcuuacucucuuagccacagucacaggagggauauuccuguuuuuaaugucagggcggggaauuggaaaaaugacacuagguauguguugcaucauaacagccaguauuuuauuaugguaugcccaaauucaaccccacuggaucgcagcuucuaucauccuagaauuuuuccuaauaguuuuguugauacccgaaccugaaaaacaacgcaccccucaagacaaccaacuaaccuaugucguaauugcaauacuuacaguaguugcugccacaauggcuaaugaaaugggauuucuagaaaaaacaaaaaaagacuugggauuaggaucuauagcuacgcaacaaccggaaucuaauauacuagacauagaccugcgaccagcuucugcuuggacuuuauacgcuguggcaacgacguuuauaacuccuaugcuaagacauuccauagaaaauucaucagugaaugucuccuugacugcaauagcuaaucaagcaacaguauuaaugggccucgguaaagguuggccauuaucuaaaauggacauagggguaccgcuuuuagccauagguugcuacucccaaguaaauccaaucacauugaccgcggcacugcugcuccugauugcacauuaugcuauuaucggaccuggacuccaagcaaaagcgacuagggaggcucaaaaacgagcagcagcagggauaaugaaaaauccaaccguugauggaauuacagugauagaccucgacccaauaccguaugacccaaaguuugaaaaacagcuaggacaagugauguuacucguccuguguguaacacaaguccuaaugaugcguaccacaugggcucucugugaggcacuaacguuagcaacgggcccaauuuccaccuugugggaagguaauccgggaagauuuuggaauacuacaauagcggugucgauggcaaauauauuccgugggucuuaccuugcaggggcagggcuucuguucucuaucaugaaaaauacaacaaauacacggagagggacugguaauauuggugaaaccuuaggcgaaaaauggaaaagcagauuaaaugcccuuggaaaaagugaauuucaaauuuacaagaaaucggguauccaggagguugaccgaacauuagcaaaagaagggauuaagagaggcgaaaccgaccaucaugcgguaagucgagggucugcaaaauuacgaugguuuguggaacguaauaugguaacaccagaagguaagguggucgauuuaggcuguggcagagggggauggaguuauuacuguggaggauuaaaaaacgucagagaagugaaaggauuaacgaaaggcggacccgggcacgaagaaccaauaccuaugaguaccuauggauggaacuuggugcggcuacaaucgggaguagacguuuucuuuauaccaccugagaaaugugacacuuuacuaugugacauaggugagucuucaccaaacccuacugucgaagcagguaggacauuaagaguauuaaauuuaguagaaaauugguuaaacaauaauacgcaauucugcauuaaaguucuaaauccuuacaugccuagcguaauugaaaagauggaaacccuccaacgaaaauauggcggggccuuagucaggaauccauuaagccggaacucaacgcaugaaauguacugggucucaaaugccucgggcaauaucguauccagcgucaacaugauaucaagaauguuaauuaacagguuuacuaugcgacacaaaaaagcuacguaugaaccagauguagaccuggguagugguacacgaaauauuggaauagaaagcgaaaucccaaaucuggacauaauaggaaaaaggaucgagaaaauuaagcaagaacacgaaacuagcuggcacuaugaccaggaucauccauacaaaacuugggcuuaucacgggagcuaugaaaccaagcaaacaggaagugcauccucaaugguaaacgguguaguccgacuccuaacuaaaccuugggauguucucccgacgguaacacaaauggcaaugacagauacaacgccauuuggucaacaacguguuuuuaaagaaaaagucgacacuagaacacaggaaccaaaggaggguaccaaaaaacuaaugaaaauuaccgcagaauggcuauggaaggaguuggggaagaaaaaaacaccaagaauguguacgcgagaagaauucacuagaaaagugagaucaaacgcugcauuaggagcgauauuuacugaugagaauaaguggaaguccgcucgugaagcgguagaggauucaagguuuugggaacuaguagacaaagaacgcaacuuacaucuagaggguaaaugcgagacguguguauauaauaugauggguaaacgagaaaaaaaacuaggugaguucgguaaagcaaaaggcucuagggcaauaugguauauguggcuaggggcaagauuucuugaauucgaagcauuaggcuuucuaaaugaagaccauugguuuucaagagaaaacagcuuaucagggguagaaggagaaggacuucauaagcuaggcuacauccugagggauguuaguaagaaagaggguggugcuauguaugcugaugauacagcugggugggacacucgcaucacauuggaagaucuuaaaaacgaggaaaugguaacaaaccauauggaaggagaacauaagaaguuagcagaagcgaucuuuaaacuaacauaccagaacaaaguuguaagaguucagaggccaaccccuagaggcacugucauggacauaauaaguagaagagaucagcgagggagcggccaaguggggacguacggauugaauacguucacaaacauggaagcucaguuaauaagacaaauggaaggggaaggaguguuuaaaaacauucagcacuuaaccguaaccgaagaaaucgcgguccaaaauuggcuagcccggguagggagagagagauugagcagaauggcaauaucaggugaugauuguguaguuaaaccucuugacgacagauuugcaagugcauugacugcauuaaacgacaugggcaagaucagaaaggauauccagcaaugggaacccaguagaggcuggaacgauuggacacaaguacccuucuguagucaucauuuucaugaacuaaucaugaaagauggccgggucuuaguaguuccgugcaggaaccaagaugaacuaauaggucgagcgcgaauuucucaaggagcgggauggucccuacgggaaacagcauguuuagggaaguccuacgcccaaauguggagccucauguauuuucaucggcgggauuuaagauuagcagcuaaugccauuugcucugcagucccaagccacuggguuccgacuucaagaacuacuugguccauucacgcuaaacaugaauggaugacuaccgaagauaugcugacggucuggaaucgggucuggauccaagaaaaccccuggauggaggauaaaacgccaguggaaucaugggaagaaauuccauauuugggaaaaagagaagaucaguggugugguucucuaaucggccuuacgucgagagcgacgugggcaaaaaauauacaagcugcaauaaaucaaguaagaucuuuaauaggauccgaggaauauacagacuauaugcccucaaugaaaagauuucgccgcgaagaagaggaagcaggaguguuaugguaa

SEQ ID NO: 22498 - RNA, 9876 nt, Artificial Sequence
  derived and/or modified CDS sequence (opt6) from DENV-2__FJ639828__SS-prME
aguguaggaaugauaauaauguuaauuccaacaguaauggcauuccaucuuacgacuagaaauggagaaccucauaugauuguaagcauucaagaaaaagggaaauccuuacuuuucaaaacggaagacggagugaauaugugcacacuaauggcaauggauuugggagaacuaugcgaagacaccauuacuuacaaauguccacuuuuaagacagaacgaaccagaagacauugauuguuggugcaauucaacaaguacauggguaacauaugguacuuguaccacuacgggugaacaccgucgcgaaaaacgcaguguagcauugguuccacauguaggaaugggucuugaaacgcgaacggaaacauggaugaguucagaaggugcauggaaacacgcacaaagaauagaaacauggauucugagacauccuggauucacaauaauggcagcaauucuugcguauacaauaggaacuacacacuuucaacgaacauugauuuucauacugcuuacugcaguugcuccuucgaugacaaugagaugcauagguauuaguaauagagacuucguagaggguguaagcggcggcucauggguagauaucguauuggaacauggaucgugcguuaccacuauggcuaaaaauaaaccaacacuagauuucgaacuaauaaaaaccgaggcgaaacaaccagcuacccuucggaaauacuguauagaagcaaaacugacuaauacaaccacugaaucuagauguccaacacagggagaaccaagucuuaaagaagaacaagacaaacgauucguauguaaacacaguaugguugacagagguuggggaaacggaugugggcuauuuggaaaaggcgggauuguaacuugugcuauguucacuuguaagaaaaauauggaagguaaaauagugcagcccgaaaauuuagaauauacaauagugguuacuccacauucuggugaggaacaugcgguggggaaugacacggggaaacauggaaaagagaucaaaguaacuccacaaucuaguauuacggaagcugagcuuacuggcuauggcacugucacuauggaguguucuccgagaacaggacuagauuuuaacgaaaugguccuauuacaaauggagaauaaagcguggcucguacaucgacaaugguuuuuggauuugccauuaccauggcucccgggagcagauacucaaggaaguaauuggauacaaaaagagacucuaguaacguuuaaaaauccacaugccaagaaacaggaugucgugguauuaggaagccaggaaggugccaugcauacugcacuaacuggagcaacggaaauacaaaugaguuccggaaauuuacuauucaccggccacuuaaaaugccgccuacgcauggacaaacuacagcuaaaggguaugucauauucaauguguacaggcaaauuuaaaguagucaaggaaaucgcugagacucaacacggcacuaucgucauccgaguucaauaugagggagauggcucgcccuguaaaauuccauucgagauaauggaucuugaaaagcgauacguacucggaagauugauaacaguaaauccuauagcaacugaaaaagauucaccugucaauauugaggcagaacccccauuuggagauagcuauauuauaauuggcguugaaccaggucaacuuaaacucaauugguuuaagaagggaaguucaauaggccaaauguuugaaacaaccaugcgaggagcaaaacguauggccauuuuaggcgauacugcuugggacuucgguagccugggagggguuuuuaccagcauaggaaaagcguuacaucagguauuuggggcgauuuauggagcugcauuuucaggcguaucauggacaaugaaaauuuuaauaggaguaauuauuacuuggauugggaugaauaguagaaguaccucucugucagucagucuuguccuaguaggagugguuacuuuauaccuugggguaaugguacaggcagauucagguugcguuguaucguggaaaaacaaagaguugaaguguggaucuggaauauuuauaaccgauaauguacacacauggacagaacaguauaaauuccaaccagaaucacccucgaaauuggcuagcgcuauccaaaaagcucaggaagagggcauaugugggauuagaucgguaaccagacuagaaaacuuaauguggaaacaaauaacuccagaguuaaaccauauacucgcagaaaacgaaguaaaauugacaauaaugacaggagauauuaaaggaauuaugcaagcgggaaaaagaagucucagaccacaaccgacugaauuaaaguauucauggaaaaccuggggcaaagcuaaaauguuaaguacagaaagccauaaccaaacuuuccuuaucgacggaccagagacugcggagugcccaaauaccaaucgugcuuggaacaguuuagaagucgaagauuacgguuuuggaguauuuacuacuaacaucuggcuaaaacucaaagaaaaacaagaugcuuucugcgacagcaaacuuauguccgcagcaauaaaagauaaucgcgcaguacacgcugauaugggguacuggaucgaaagcgcucuaaacgacaccuggaaaauugaaaaggccucauuuauagaagucaaaaauugucauuggccgaaaucccauacgcuauggucgaacggaguauuggaauccgagaugauaauacccaaaaacuuagcaggaccuguuagccagcauaacuacagaccgggauaucacacacaaauugcugguccguggcaucuaggaaaauuagaaauggauuucgacuuuugugaugggacuacaguuguuguuacugaggacugugguaaucggggcccgucccucagaacuacaacggcaucgggaaaauuaaucaccgaaugguguugccguucauguacacuaccaccccuccgauaccgcggcgaagacggaugcugguaugguauggaaauaaggccuuuaaaagagaaagaagagaacuuggucaacucacucguuacggcgggacauggucaggucgauaacuucucacuaggaguguuaggcauggcacuauuucuggaagagauguuacguacuagagucggcaccaaacaugcaauauuauuaguagcaguaucguuuguuacguugaucacugggaacaugucuuucaaagauuuaggccgcguaguaguaaugguaggagcaacaaugacagaugauauagguaugggcgucacguaccucgcucuccuagcugcauuuaaagucagaccgacuuuugcugcgggacuauuucuuagaaaguuaaccucaaaagaacuaaugaugaccacaauaggaauagucuuauugucccaaucaacauugcccgaaacuauacuugaauugacugaugcccucgcauugggaaugaugguuuugaaaaugguaagggauauggaaaaguaccaacuggcaguaacgauaauggcaauauuauguguuccgaaugccguaauuuuacaaaaugcauggaaaguuucauguacuauacuugccgugguaaguguuucgccuuuacuacuaacaaguucacaacagaagacugauuggauccccuuagcauuaacgauaaaggguuuaaauccuacagcaauauuuuuaacaacguuaucaagaacaaauaagaaaaggucauggccacuaaaugaagcgaucauggcggucggcaugguaucuauacucgcguccucacuucuaaagaaugauauaccaaugacgggaccacuuguagcaggggguuuacugaccguuuguuacgugcuaacagggagaucagccgauuuagaacuugaaagggcuacggaugugaaaugggaagaucaagcagaaaucagcggaucaaguccgauucuaucaaucacaauaucugaagauggcuccaugucgauuaaaaaugaagaagaagaacaaacucuaacgauccuaauacgaacaggguuauuaguaauaagugguuuauuuccuguuuccauuccaauaacagcggcugcaugguauuuaugggaagugaagaaacaacgugcaggcgugcuuugggauguaccgucaccuccuccgaugggaaaagcugaacuagaagauggugcauacagaaucaaacaacgaggaauacuaggauauagucaaauaggugcaggaguauauaaagaggggacauuucauacaauguggcaugucacaagaggagcgguacucacacauaaaggaaaaagaauagaaccgucaugggcggacguaaagaaagaccuuauauccuacggaggcggcuggaaacuugaaggugaauggaaagaaggagaagaagugcaagugcuagcacuagaacccggcaaaaauccaagagcaguacaaacaaaaccagguuuauuuaaaacaaauacagguacaaucggcgcaguuagucuagauuuuucgcccggaacaucggguaguccgauuauagauaagaaaggaaaaguagugggauuguaugggaacggagucgugaccagaucuggagcauacguaagugcgauagcacagacagaaaagaguaucgaagacaauccugacauagaagaugauauuuuuagaaaacgucggcuaacgauuauggaucuacacccgggagccggaaaaaccaaacgcuacuugccugcuauaguccgugaagcaauaaaaagaggucuaagaacacuuauauuggcuccaacaagggugguagccgccgaaauggaagaggcacuaagaggguuaccuauacgauaucagacuccggccauacgggcagaacacaccgggcgggagaucguugacuuaaugugucaugcaacauuuacuaugagacucuuaucacccguaagaguaccaaacuauaacuuaaucauaauggacgaagcucauuuuacagaccccgccucaauagccgcgagagguuacauaucaacaaggguagaaaugggagaagccgcugguauuuucaugacggccacaccuccgggaucgcgggauccauucccucaaagcaacgcucccaucaucgacgaggaacgagaaauuccugaaagaucguggaacucaggucacgaauggguaacagauuuuaaaggaaaaacaguaugguuuguacccaguauuaaagcugguaaugacauugcugcuugccugcgcaaaaauggcaagaaagucauucagcuaagucgcaaaacuuuugauagcgaauacguuaaaacucgaacaaaugauugggauuuuguaguuacaacagauauauccgaaaugggggcaaacuuuaaggcggaacgaguaauagacccucgucgaugcaugaaaccaguuauacuuacagacggggaagagagaguaauauuagcaggcccuaugccgguaacacauuccagcgcagcacaacggagggggcgaauaggacgaaaccccaaaaaugaaaacgaucaguauauauauaugggggaaccacuagagaaugacgaagacugugcccauuggaaggaagcgaagaugcuguuagacaauauaaacaccccagaaggcauaauaccaucaauguucgaaccagaaagagaaaaagucgaugcaauugacggugaauaccggcuaagaggagaagcgaggaaaacuuuuguugacuugaugaggagaggcgaucuaccgguuuggcuagcauauaagguagccgcugaagguauaaacuacgccgauaggcgaugguguuuugauggaaucaaaaauaaucaaauacuagaggagaacguggaaguugaaauuuggacaaaggagggcgagcgaaagaagcucaaaccacgcugguuagacgccagaauuuauagcgacccuuuggcgcuaaaggaguucaaagaauuugcagcaggccguaagaguuuaacacuaaaccugaucacugaaauggggagguuaccaacauuuaugacacagaaaacaagagacgcacucgacaaccucgccguccuacacaccgcggaagcuggcggucgagcguauaaccacgcuuuaagugaacuuccagagacucuagagacgcuuuuacuccucacacuauuggcuacaguaaccggagguauauuccuauuucucaugucgggcagaggaauuggcaaaaugaccuuaggaauguguugcauaguuacggccucaauccuauuaugguacgcacagauacagccgcacuggauugcagccagcauuauacuagaguucuuucuaauaguacuucugaucccggaaccggaaaaacagcgaacuccgcaggauaaccaacuaacauaugugguaaucgcaaucuuaacggucguagcagcaacaauggccaaugagauggguuuccuagagaaaacuaagaaagaccucgguuuaggaucaaucgcuacccaacaaccagaaagcaacauccuugacauagacuugagaccggcaucagcuuggacucuauaugcugucgcgacgacuuuuguuacaccaaugcuucgacauucuauugaaaauagcaguguaaauguuagccuaacagcuauugcuaaucaagccacuguauuaaugggauuaggaaaaggcuggccucugucaaagauggacauaggcgcgccauuauuagcuauugggugcuacagccaaguaaaccccauaacauuaaccgcugcgcuacuacuacucguugcacauuacgcaauaaucgggccaggucuccaagcgaaggcaacccgcgaagcccaaaaacgagcagcagcaggcauuaugaaaaacccaaccguugauggaauuaccguaaucgaucuagauccaaucccguaugacccaaaauuugagaaacaauuaggucaaguaaugcucuuaguucuauguguuacccaaguauuaaugaugagaaccacuugggcccuaugcgaggcacuaacacucgcaacuggaccaauuagcacacucugggaaggaaauccagggcgauucuggaauaccacgauugcugugucaauggcuaauaucuuucgcggaucauauuuagcaggagcuggauuacuauucucgauuaugaaaaauacuacaaauagccggcgggguacuggaaauauaggcgagacacuaggugaaaaguggaaauccaggcuaaacgcccucggcaaaucagaguuccaaaucuauaagaaaucaggaauacaggaaguagauaggacgcuagcuaaagagggaaucaaaagaggugagacagaucaucaugcuguuagcaggggcagcgcuaaauuaagaugguuugucgaaagaaauaugguuacacccgagggaaaaguaguugacuuaggaugugggcgcggaggaugguccuacuacugugguggacuuaaaaacguacgcgagguaaaaggacuaacuaaaggagggccaggucacgaggaaccaauaccaaugaguacuuauggauggaacuuaguaagguuacaaucagguguggacguguuuuucauaccuccagaaaaaugcgauacacuguugugugacauaggagaaucuucgccaaauccaacggucgaggcaggaagaacccucagaguacuaaacuugguagagaacugguuaaacaacaauacgcaauuuuguauaaagguauuaaauccauacaugccgucaguuauagaaaagauggagacauuacagagaaaauacgggggcgcccuuguccgaaauccauuaucacguaacucaacacacgaaauguacuggguaagcaaugcaagcggaaauauuguaucaagcguaaauaugaucucucguauguugauuaauagguucacgaugaggcacaagaaagccaccuaugaacccgauguagaccuagggagcggcacuagaaauauagggauagaaagcgagauaccgaauuuggauaucauaggaaaaagaauugaaaagauaaaacaagagcaugaaacaucauggcauuaugaccaggaucauccauauaaaaccugggcguaucacgguuccuacgaaacgaaacaaacugguagcgcuucaucgaugguaaaugguguaguuagacuauuaacaaagccuugggauguacuaccaacaguuacacaaauggcaaugacugacacaacuccguucggacaacaacgcguuuuuaaagaaaaaguagacacgcgaacacaggaaccgaaagaaggcacuaagaaauuaaugaaaauuacugcagaaugguuguggaaggaacuaggcaagaagaaaacccccagaauguguacuagagaagaauuuacaaggaagguuaggucaaaugccgcacucggagcuauauucacagacgagaauaaauggaagucagcucgagaagcggucgaagacucaagauuuugggaauuaguggacaaagagcgaaaccuucaucuggaagguaaaugugagacaugcgucuauaacaugauggguaagcgugagaagaaacugggggaguucggcaaagcuaaaggaaguagagcgauuugguauaugugguugggugcaagauucuuagaguucgaagcccucggauuuuuaaaugaagaucauugguuuucaagagagaacagucugaguggcguagaaggagaaggccuccaucgguuagguuauauccuacgagacguaagcaagaaagaagguggugccauguaugcugacgauacagcaggaugggacacacgcauuacguuagaagauuugaaaaaugaagaaauggucaccaaccauauggaaggagaacauaagaaauuggcagaagcgaucuucaaacugacauaucaaaacaaaguggugagagugcaacgaccaacaccaagagguacagucauggauauaaucagcagacgcgaucaaagaggcucuggacaaguaggaacauauggacuaaacacauucacaaacauggaggcucaguuaauaaggcaaauggagggugaagguguauuuaaaaacauucaacaucuuacaguaacagaagaaaucgcaguacaaaauuggcuggccaggguagguagagaaagacuuucaaggauggcuauuuccggagaugacugcguaguaaagccucuggacgauagauuugcgagugcauuaaccgcucugaaugacauggggaaaauccgcaaagacauccaacagugggagccuucucgugguuggaaugauuggacucaaguaccguucuguucacaucauuuucacgaguuaauaaugaaggacgggagaguguuagugguaccauguagaaaccaggaugaacucaucgggcgggcuaggauaagucaaggagcaggaugguccuugagagaaacugcaugucuagguaaaagcuaugcacagauguggagccucauguauuuccacaggagagaucuacgacuugcugccaacgcuauaugcagugcuguaccuucacacuggguaccaacgucacggacuaccuggucuauucaugcgaaacaugaguggaugacaaccgaagauaugcugacaguauggaaccgggucuggauacaagaaaacccguggauggaagauaaaaccccaguugagaguugggaggaaauaccuuaccugggaaagcgggaggaucaguggugcggcucguugauagguuuaaccuccagagccacaugggccaaaaauauacaggcagcuauaaaccaaguaaggucucuaauagguaacgaagaguauacugauuauaugcccagcaugaagcguuuucguagggaagaggaagaggcuggugucuuaugguaa

SEQ ID NO: 22499 - RNA, 9876 nt, Artificial Sequence
  derived and/or modified CDS sequence (opt6) from DENV-2__FJ639829__SS-prME
agcguaggaaugauaauaaugcuaauaccuacagucauggcuuuccaccugaccacacgcaauggagaaccacauaugauuguaucgauucaagaaaaagguaaaucccuacuguucaaaaccgaagauggagugaacauguguacuuuaauggcuauggaccugggcgaacugugcgaagauacuauaacauauaaaugcccacuacugcgucaaaaugaacccgaagacauagauugcuggugcaacucaacaaguacguggguaacauacggaacguguaccacaaccggugaacacagacgggagaaacguucaguagcccuaguaccucacguagggaugggauuagaaacacguaccgaaacguggaugucaagcgagggugcuuggaaacaugcacaaagaauagaaacauggauucugagacauccaggcuucaccauuauggcggccauuuuagcauauacgaucgguacuacccauuuucagcgcacuuugauauucauccuuuuaacagcaguagcucccucaaugacaaugcggugcauugguauuuccaacagagauuucguagaaggcgucucggguggguccuggguugauaucguacuagaacaugggucguguguaacaacaauggcgaaaaacaaacccacacuagauuucgaauuaaucaaaacggaagcaaaacaaccagcgacucuuagaaaauacuguauagaagccaaacuaaccaauaccacuaccgaaucacggugcccuacucagggcgaaccaagucugaaagaagaacaagacaaaagguuuguaugcaaacauaguaugguugauaggggauggggaaauggcugcggucuauuugggaaaggugguauagugacaugugccauguucacguguaagaaaaauauggaaggaaaaauaguccaaccagaaaauuuagaauauacaaucguuguaacgccacacaguggagaggaacaugccguagggaacgauaccgguaagcacggaaaagaaauuaaaguuacuccacaaucuaguauaacggaagccgaauugacuggcuacggaacagugacaauggaaugcagcccacgcacaggacuagauuucaaugaaaugguuuuauuacaaauggagaauaaagccuggcuuguacaucggcaaugguuucuagauuuaccucuucccuggcuaccaggcgcagauacucaaggaucaaacuggauacaaaaagagacauugguuacuuucaaaaacccccaugccaagaaacaagauguugucguauuggggucccaggaaggugccaugcauacagcccuaaccggggcuacggagauacaaaugucgucggggaaccuacuauuuacagggcauuuaaaguguagguugagaauggauaaauugcaauuaaaaggaaugucguacaguauguguacagguaaguucaaaguaguuaaagaaauagcggaaacgcaacacgguacuauaguaauaagaguccaguaugaaggcgacggaaguccaugcaagauaccuuuugaaauaauggaccuggaaaaacgauacguacuagguagguuaauuacaguaaauccgauaguaacggaaaaagauagcccugucaauaucgaggcggaaccaccuuucggggauucuuauauaauaaucggcguagaaccgggacaauugaaauuaaauugguuuaaaaagggaucaaguauaggccaaauguucgaaaccacuaugcggggagcuaaacguauggcaauuuugggugauaccgcaugggauuuuggcucauuaggagguguauuuacguccauugguaaagcauuacaucaaguguuuggagcaauauauggugcagcguuuucaggagugucauggacgaugaaaauucugaucggggugauaauaacguggauugguaugaauagccgaucgacuucauuguccguaucauuggucuuaguaggcguggugacacuauaucuaggagugaugguacaagcggauaguggaugcguuguaucauggaagaacaaggaacuaaaaugugguucgggaauuuucauaaccgauaauguccacaccuggacugaacaauauaaguuucaaccugaaaguccuucaaaacuugcaagugcgauccaaaaggcacaagaggagggaauaugugguauucguucaguaaccagacuagaaaauuugauguggaaacagauuacaccagagcuaaaucacaucuuagcggagaaugaaguaaagcuaaccauaaugaccggagauaucaaaggaauuaugcaagccggcaaacgcaguuuaagaccacaaccuacugagcuaaaauacucguggaaaacaugggguaaagcaaagaugcugaguaccgaaucacacaaucagacuuuucucaucgauggcccagaaacagcugaauguccuaacacuaauagagcuuggaacucucuagagguagaagacuacggauucgggguguuuacaacaaauauuuggcucaaacugaaagaaaaacaagacgcuuucugugacaguaaguuaaugagugcagcaauaaaagauaauagagcuguucaugcagauauggguuauuggaucgagucagcuuuaaacgacacuuggaaaauagaaaaggcaucguuuauugaagucaaaaacugucauuggccgaaaucucauacacuguggucuaacgggguauuagaaagcgaaaugauaauacccaaaaaucuugcagggcccguuucacaacauaauuacagaccagguuaucauacucagauagcgggcccuuggcauuuaggaaagcuggaaauggauuuugacuuuugugacggcacaacaguggugguaacugaagacugcggaaaucgugguccuucacuacgaacaacaaccgcaagugguaaguuaaucacagagugguguuguaggagcugcacccucccaccccuacgguaucgcggagaagacgguuguugguacgguauggaaauuagacccuugaaagaaaaggaagaaaaucuaguaaacagcuuaguaacugcaggacacggacaaguggauaacuuuucauuaggcguucucgguauggcccuguuuuuggaagaaauguuacguaccagagugggaaccaaacaugcaauacuccugguagcggugucauucguuacucucauuacuggcaauaugucauuuaaggaucuaggaaggguuguaguaaugguaggugcuacaaugaccgacgacauaggaaugggcguuacauacuuggcucuauuagccgcuuucaaaguacggccuaccuuugcugcaggucuauucuuacguaaguuaacuucaaaagagcuuaugaugacuacaaucgguauugugcuccuuagccagucaacuauuccagaaacaauauuagaauuaaccgacgcauuggcucuugguaugaugguucuuaaaaugguaagggauauggaaaaauaucaguuggcagugacuauuauggccauuuuaugcguaccuaaugccguuauuuugcagaaugccuggaaaguaucaugcaccauacuagccgucguuucggucucaccguugcuacuaacaucaucccaacagaaaaccgauuggauuccauuggcuuugaccaucaaagguuugaauccaacugcaauuuuucucaccacauuaagccguaccaacaaaaagcgaucguggccguuaaaugaggcaaucauggccguugggaugguuaguauuuuagcaucgagcuuacuaaagaaugacaucccgaugacugguccauuagucgcaggaggauuacuaacuguaugcuauguucuaacgggcaggucagcugauuuagagcuugaaagggcaacugauguuaaaugggaagaucaagcugagauuucaggcagcagcccuauauugucaaucacgauaucagaagacggaucaaugucuaucaaaaacgaggaagaagaacaaacucugacgauauugauaagaaccgguuuauugguaaucucaggacuauuuccugugagcauacccaucacagcagccgcaugguaucucugggaagugaaaaagcaaagggcaggcgugcuuugggaugucccaaguccaccaccaauggggaaagcagaacuggaagauggagcauaccguauaaaacaacgaggaauauuaggauauagucaaauaggagcuggcgucuacaaagaaggcaccuuucauacgauguggcacgucacuaggggagcuguuuuaacucauaaagggaagcggaucgaaccaucaugggcggacguuaagaaagaccucauuucuuacggcggcggcuggaaguuggaaggagaguggaaggaaggugaggaaguucaaguacuagcccuugagccgggcaaaaauccacgagccgugcaaacaaaaccgggucuauucaagacaaauacagggacaauuggugcugugagucuagacuuuucaccaggaacaucugguucgccaauuauagauaagaaaggaaaagucguaggauuguauggaaaugggguuguuacacgaucuggagcauauguuucugcgauagcacagacagagaaaucuauagaggauaauccagauaucgaggacgauauauucagaaaaaggcgcuuaacgaucauggaccuccauccuggcgcagguaagacaaaacguuaccugccggcaauagugagggaagcuaucaaacgaggauuaagaacucugauauuagcaccgacccguguaguagcugcugagauggaagaggcacuaagggguuuaccaaucagauaucaaacaccagcgauucgcgcagaacacacgggaagagaaauaguagacuuaaugugucaugcgacauuuacaaugagauuacuauccccaguuagaguccccaacuauaauuuaaucauuauggaugaagcacacuuuaccgacccugcuagcauagccgcaagaggauauauuaguacuagggucgaaaugggagaagcagcugguauauuuaugacagcaacacccccgggaucgcgcgaucccuuuccgcaguccaaugcgccuauuaucgaugaagaaagagaaauaccggagcggaguuggaacaguggccacgagugggucacagauuucaagggaaaaacaguaugguuuguaccuucaauaaaagcagguaacgauauagccgcuugucuuaggaaaaauggcaagaaaguuauccagcucagcagaaaaacauucgauuccgaauacguaaagacaagaaccaacgauugggauuuuguuguaacgacagacaucagcgaaaugggcgccaauuuuaaagccgagaggguuauugacccuagaagauguaugaaaccugucauucuuaccgacggggaagaaagaguuauacucgcugggcccaugccuguuacucauucaucagccgcucagaggcgaggacguaucggacguaacccaaagaacgaaaacgaccaauacauauauaugggagagccucuagagaaugaugaagauugcgcccacuggaaggaggccaaaauguuacuagauaauauaaacacuccugaagggauaauaccuaguauguuugaacccgaaagagaaaaagucgaugcaauagauggugaauauagacugaggggugaggcacguaaaacuuuuguggaccuuaugcguagaggggauuuaccaguauggcuugcauacaaaguagcggcagaaggaauaaauuaugcagacagaagaugguguuucgacgggaucaagaacaaucaaauucucgaggaaaauguagaaguagaaaucuggaccaaggagggugagaggaagaaauuaaaaccaagauggcuagaugcacgaauauauucagauccacucgcauuaaaagaguuuaaagaguucgcagcaggccgcaaaagccuuacuuuaaaccugaucacugaaaugggaaggcuuccaacuuucaugacacagaaaacgagggacgccuuagauaauuuggcaguauugcauacagccgaagcuggaggccgagcuuauaaucaugcauuaucugaacuuccagaaacccuggaaacauuauugcuccuaacauuguuggcuacugucacuggcggcauauucuuauuuuugaugucagggagaggaaucgggaaaaugacauuaggaauguguugcauaguaacagcgucuauauuacuaugguaugcacaaauacaaccucacuggauugcggcaucaaucauauuagaguucuucuuaauuguacuauuaauuccagaaccagaaaagcaaagaacuccucaagacaaucaacuaacauauguaguaauagcaauucuuacaguugucgcagcgacuauggcuaacgagaugggauucuuagagaaaaccaagaaagaucuaggacucgggucaauagcuacacaacaaccagaaagcaauauuuuagacauugaccuaagaccugcuagugcuuggacuuuauaugcuguugcgacaacguucguuacaccuaugcugcgccauucaauugagaacaguucagucaacguuucauuaacggccauugcuaaucaggcuacgguacugauggguuuagggaaagguuggccauuguccaagauggacauuggagcaccuuuauuagccauagggugcuacucacaagucaauccaauaacccuuacagcugccuuauuacuauuaguggcacauuaugcgaucauuggaccaggacuucaagcaaaagccacaagggaagcucagaaacgggcggcagcaggaauaaugaaaaaccccacuguagauggaauaaccgugaucgacuuggauccaauccccuacgacccaaaauuugaaaaacaacuaggacaaguaaugcucuuaguacuuugcgugacucaaguguuaaugaugagaacaacaugggcccuuugugaagcauuaacacuagcgacugguccaauuucgacuuuaugggagggcaacccgggaagauucuggaacacgacuauugccguuucaauggccaacauuuuuagaggaucauaucucgcuggugcaggacuucuuuucaguauuaugaaaaauacgacuaacagucgcaggggaacugguaauaucggugaaacauugggggaaaaauggaagucacgucuuaaugcccuaggaaaaagugaguuccaaaucuauaagaaaagcggcauccaagaagucgaucguacauuggcuaaagaagggauuaaaagaggggaaaccgaucaucaugccgugucacgaggcucagcgaaauuaaggugguuuguugaaagaaacaugguuacaccagaaggaaaagucguugauuuaggaugugguagaggaggguggucguacuauugcggaggacucaaaaacgugagagaaguuaaaggacuaacuaaaggcggccccggccacgaagaaccgauuccuaugaguaccuauggguggaacuuaguuagauuacagagcggcguagauguauuuuucauuccaccagaaaaaugugauacguuauugugcgauauuggagaaagcagcccuaacccuacaguugaggcaggucggacucuaagggucuuaaaucuaguagaaaacugguuaaauaacaauacccaauuuugcauaaagguauugaacccauauaugccaucuguuauagagaaaauggaaacucuacaaagaaaauacggcggagcucuuguacggaauccucuaucgagaaauagcacacacgaaauguauuggguuagcaaugcgagugguaacauugucucuagcguaaauaugauaagccgaaugcuaauaaacagguuuacgaugcgucacaagaaagcgacauacgaaccagacguagauuuaggaaguggcacgcguaauauagguauagaauccgagauuccgaacuuagacaucauaggcaaacgaaucgaaaagauuaaacaggaacaugaaacuagcuggcauuaugaucaagaucauccguauaaaacuugggcuuaucauggcaguuacgaaacaaaacaaacuggaagugcaucgucuaugguaaacggugucgugagauuacucacaaagcccugggacguucuaccaacgguaacgcaaauggcaaugacggauacaacucccuucggacagcagagaguauuuaaagaaaaagucgacacaagaacacaagaaccuaaggaaggaacgaagaaacuaaugaagauuacagccgagugguuguggaaagaacuuggcaaaaagaaaacaccgcgaaugugcaccagagaagaauuuacaagaaaaguaaggucaaacgcggcuuuaggagccauauuuacggaugaaaacaaguggaagucagccagagaggcuguggaggauucgcguuuuugggagcuuguagauaaagaaaggaacuuacaccuugaaggaaaaugcgagacuugcgucuauaauaugauggggaaaagagaaaagaagcuaggagaguucgguaaagccaaagggucacgggcuauaugguauauguggcuuggggcaagguucuuagaguucgaagcacuaggcuuuuuaaaugaagaccauugguucagcagagaaaauucauuaucaggcguggagggugaagggcugcaccguuugggcuauauucuaagggauguaucuaagaaggaaggcggugcaauguacgcugacgauacagcggguugggacacacgcauuacauuagaggaccucaaaaaugaagaaaugguaaccaaucauauggagggagaacacaagaaacucgcagaggcaauauucaaauugacauaccaaaauaaagucgugagaguucagcgaccgacaccacgagguacaguaauggauaucauaucgcgccgcgaucaacgagguucaggucaaguagggacauaugguuuaaacacauuuacaaacauggaagcgcaacuaauuaggcaaauggagggagaggggguuuuuaaaaauauacaacaucuaacggucaccgaagagauagcugugcaaaauuggcuggcaagaguuggacgagaaagauuaucgagaauggcaaucucuggagaugacuguguaguaaaaccgcuugacgauagauuugcaagcgcuuuaacagcacuuaaugauaugggaaagauaagaaaagacauucaacagugggaaccaaguagagguuggaacgauuggacacaaguaccguucugcucgcaucauuuucaugagcuaauuaugaaagauggcagaguuuuaguugucccuuguagaaaucaagaugaacuaauaggaagggcccgaauaucacaaggagcagguuggagcuuacgugaaacggcauguuuagggaaauccuacgcgcaaauguggaguuuaauguauuuucauaggagagaccuaagacuagcggcaaaugcaauuuguagcgcuguacccucacacuggguaccgacaucaaggacuaccuggaguauccaugcaaaacaugaauggaugacaacugaggacaugcucacuguauggaaucgcguauggauacaggaaaacccauggauggaagauaaaacuccggucgaguccugggaggaaauaccauauuuagggaaaagggaggaucaauggugugguucguugauaggguuaacaagcagggcuacaugggcaaagaauauccaaguagccauaaaccagguaaggucucuaauuggaaaugaggaauauacagauuauaugccaucuaugaagcgauuuaggagagaagaagaggaagcaggcguauuaugguaa

SEQ ID NO: 22500 - RNA, 9876 nt, Artificial Sequence
  derived and/or modified CDS sequence (opt6) from DENV-2__FJ639831__SS-prME
agcgcuggaaugauuauuaugcuuauccccacuguuauggcauuccaucuaacaacacgcaauggggaaccucacaugauagugaguauccaagaaaaagggaaaucguugcuuuucaaaaccgaagacgguguaaacaugugcacauuaauggcaauggacuuaggcgaacucugcgaagacaccauaacuuacaaaugcccgcugcuaaggcaaaaugaaccugaagacauugauuguuggugcaauaguacaucaacuugggucacuuaugggacauguacuacuacaggugaacacaggagggagaaaagaucaguagcacugguuccccaugucggcauggggcucgaaacacguacagaaaccuggaugucaucugaaggagcguggaaacaugcacaaaggaucgaaacauggauacuaagacauccaggauucacaauuauggcagcaauacuagcauacacaauagguaccacucacuuucaacgggcgcuaauuuucauacuauuaacugcaguugcaccaucaaugaccaugcguuguauuggaauaucaaacagagacuuuguagaaggaguuucaggagguucuugggucgacauaguauuagaacauggcuccuguguuaccaccauggcuaaaaauaaacccacacuugauuuugaacuaauuaaaaccgaagcgaaacaaccagcuacucuaagaaaauauuguauagaagcaaaacuaacaaauacaacaaccgaaucaagauguccuacucaaggcgaaccaucauuaaaagaagaacaagacaaacgauucguguguaaacauaguauaguagacagaggaugggguaauggauguggacuauuugguaaaggagggauaguaacaugugcuauguucacaugcaagaaaaauauggaagggaaaaucguacaaccugaaaacuuagaauacacaaucguaguuacuccucauagcggugaagaacacgcgguaggaaaugacacuggaaaacaugguaaagaaaucaaagugacaccucaaagcuccguuacggaagcggagcuaacuggauacgggacgguuacaauggaaugcagcccaaggacaggacuugauuuuaacgagaugguuuuacugcaaauggagaauaaagcauggcuaguacaccgacaaugguuucuugauuuaccuuuaccgugguuacccggcgcagacacucaaggaaguaauuggauacaaaaagaaacccucgucacuuucaaaaauccacaugcaaagaaacaagauguaguaguuuuagggucgcaagaaggagcaaugcauacagcuuugacuggggcaaccgaaauccaaauguccucaggaaauuuauuguucacagggcacuugaaauguagacuuagaauggauaaauugcaauuaaaaggaaugaguuauucaauguguacaggaaaauucaaaguagucaaagaaauagcugaaacacagcacgguacgauaguuauaagaguacaauacgagggagacgguucaccaugcaaaauaccuuuugaaauaauggaucuagagaaaagguauguccuagggagauuaauuacuguaaauccuaucgugacagaaaaagauucacccguuaacauugaagccgaaccaccuuuuggagauucauacaucauaauuggaguagaacccggucaacucaaguuaaauugguuuaagaaagguucaucgauaggucaaauguucgagacaacaaugagaggcgcaaaacgaauggcaauuuuaggagacacagcgugggauuucgguucuuuagguggaguauucacauccauaggaaaggcgcuacaccaaguauucggcgcuauuuacggcgcugcuuuuagcggcguaaguuggaccaugaaaaucuuaauaggaguaauaauuacguggauagggaugaacucgcguucaacaucgcugucagugaguuuaguuuuggucggaauaguaacacuuuaucuuggcgugaugguucaagcagauucaggauguguuguuucauggaaaaauaaagaauuaaaauguggcuccggaaucuuuaucacagauaacguccacacauggacugaacaauacaaauuucaacccgaauccccgucaaagcucgcuagugcgauccaaaaggcccaggaagaagguaucugcgguauaagauccguuacccgacuagaaaaucucauguggaagcaaauaacccccgaacuuaaucauauccuagcugaaaacgaagugaaacucacuaucaugacuggcgacaucaaaggcauaaugcaagcugguaagagaucacuucgaccucaaccaacagaacuuaaguacucauggaagacauggggaaaagcgaaaauguuaagcacggaaagccauaaccagacuuuucuuauagacggcccagaaacggcagaauguccuaauacgaaucgggccuggaacucgcuagaaguagaggacuauggcuucgguguuuuuacaaccaacaucuggcuuaaguuaaaagaaaagcaagaugccuucugugauucaaaacuaaugucagcugcaauaaaagauaaccgagcuguacacgcagacaugggauauuggaucgaaagugcacuaaaugauaccuggaaaauagaaaaggcuucuuuuauagaagugaaaaacugccauuggcccaaaucacauacucuguggucaaauggugucuuagaaagugaaaugauuauucccaaaaaucuugcagggccuguaagccaacacaacuauaggcccggauaucacacccaaaucgcagggccauggcacuuaggaaaguuagagauggauuucgacuuuugcgauggcacaacaguagucgucaccgaggauugcgguaaucgaggcccaucucuucguacaacaacagcaagcgggaaguuaaucaccgagugguguugcaggucuuguacacuaccacccuugagguauagaggagaggacggguguugguacggaauggaaaucagaccuuuaaaagaaaaagaagagaaccucguaaauagccuuguaacagcuggacauggacaaauagacaauuuuagcuuaggaguccuaggaauggccuuauuccucgaagaaauguugcguacucgagucggaaccaagcaugccauauugcuuguugcuguaucuuuuguuacauuaauaacaggcaacaugucauuuaaagauuuaggccguguagucguaauggucggagccaccaugacagaugacauugguauggguguaacauaccuugcacuacuagcagcuuuuaaagucagaccuacguucguggcuggauuauugcuucggaaacucacaaguaaggaacugaugaugaccacgauuggaauuguuuugcuuagucaaucuacaauuccagaaaccauacucgaguuaaccgaugcucuagcauuaggaaugaugguucucaaaauaguacgagacauggagaaguaucaguuagcaguaaccauaauggccauucucuguguacccaaugcuguuauucugcaaaacgccuggaaggugucuuguaccauucuagcagugguuaguguuucaccucuucuguugacaaguucacaacagaaaacagauuggauaccauuagcacuaacgauaaaagguuuaaauccaaccgcaauuuuccuaacuacuuuaucaagaacgaauaaaaagaggagcuggccauuaaacgaagccauuauggcaguaggcaugguaagcauucuagcaucaucucuacucaaaaaugauauaccgaugacaggcccauuaguggcgggaggccuacucacuguuugcuauguacucacaggcagaucagccgaucucgaacuggaacgcgcaacggauguuaaaugggaggaccaggcagaaaucucuggcagcagccccauucuaucuauaacgauuucggaggauggcagcaugucuauaaagaaugaggaagaagaacagaccuugacaauauugauccggacgggacuuuuaguaauuuccgguuuguuuccagucagcauaccaauuacagcagcugcaugguauuuaugggaaguuaagaaacaacgagcggggguucucugggacguacccucaccgccaccuauggguaaagcugaauuagaagauggagcauaccgcauuaaacaaaaaggaguuuugggauauagucaaauuggugcaggcguauauaaggaaggcacguuccacacuauguggcauguuaccagaggagccguauuaaugcacaaggguaagcgaauugaacccuccugggcagaugugaagaaagacuuaauaucuuacgguggcggauggaaacuggaaggagaauggaaagaaggagaggaaguacaaguucucgcacucgagccugguaaaaaucccagggcaguccaaaccaaaccgggcuuauuuaaaaccaauaccgggacuauaggagcugucucauuagauuucagcccagguaccuccgggucccccaucaucgauaagaagggaaaaguagucggacucuaugguaacggaguaguuacuagaaguggagcauacguuucugcaauagcgcaaaccgaaaaaucuauugaagacaauccugauauagaagaugacauuuuucgaaaaagaaggcuuacaaucauggacuuacacccgggcgcugggaaaacuaaacgauaucuaccugccauaguucgagaagcaaucaagagggggcuacgcacacucauuuuagcacccacacgaguuguggccgcagaaauggaagaagccuuaagaggacuaccuauaagauaucaaacaccagcuauccgggcugaacauacuggccgggagauuguagacuuaaugugucaugcaacuuucacaaugagguuauuaucucccguaagaguaccaaacuauaaucugauaauaauggaugaagcgcauuucacugauccagccucaauagcggcgcggggauacauaaguacuaggguagagaugggagaagcagcuggaauauucaugaccgcaaccccgccuggcagcagggacccuuuuccacaaucgaaugcucccaucauugacgaagaaagagaaauaccagaaaggagcuggaacuccggacaugaguggguaacagacuuuaagggaaagacuguaugguuuguaccaagcaucaaagccgggaaugauaucgcugcuugucugagaaagaauggcaagaaagucauacagcuuucacgaaaaacuuucgacagcgaauacguaaagacccguacgaaugauugggauuucguaguuacaacagacauaucagaaaugggggcaaauuucaaagcugaaagaguaaucgauccuaggagguguaugaaacccguaauccuaacugacggcgaagaacgugucauauuagcgggaccaaugccaguaacucauuccucggcggcacaacgaagggguagaauugggagaaaucccaagaacgaaaacgaccaauauauauauaugggagagccuuuggaaaacgaugaagauugugcucauuggaaagaagcuaaaaugcuacucgauaacaucaacacuccagagggaauaaucccaucuauguucgagccagaacgagaaaaaguagacgcaauugauggagaauaucggcuucgaggagaagcaagaaagacauuuguagaucuuaugcgccguggugaucuuccaguaugguuagcguauaaaguugcagcugagggaaucaauuaugcagacagacguuggugcuucgacgguaucaaaaauaaucaaauucucgaggaaaacguagaagucgagaucuggaccaaagagggagaacggaagaaguugaagccccgauggcuggacgcaaggauauauucugauccacuagccuuaaaagaauuuaaagaauuugccgcaggccguaaaucgcuuacucucaacuuaauaacagagaugggacgucuccccacguucaugacacagaaaacccgcgaugcauuagacaaucuagccguauuacacacagcggaggccgguggacgggcguauaaucaugcauuguccgagcuuccugaaacuuuggaaacuuuguuauugcuuacgcuacucgccacuguaacuggagggauauucuuauuucuaaugagcgguaggggaauugguaagaugacgcugggcaugugcuguauaauuacugcaaguaucuuacugugguaugcacaaauucaaccgcacuggauagcagcauccauaauacuugaguucuuccugauuguacuucuaauuccagaaccugaaaaacagagaacaccacaggauaaccaguuaacauacguaguuaucgcaaucuuaaccguaguagcagcuacaauggcaaaugaaauggguuuucuugagaagaccaagaaagaucuagggcuagguucuauaacaacgcaacaaccggaaucgaacauuuuggacauugauuuacgucccgcauccgcuuggacuuuauaugcuguagcaacuacguuuguaacccccaugcuacgucacagcaucgaaaacagcagugucaauguuagcuugacugcuaucgcaaaccaagcaaccguacuuaugggccuaggcaaaggguggccgcuaucaaaaauggacauugggguuccucuucuagcaaucggauguuauagucaagugaauccaauuacacuuacugccgcccucuugcuguuaguagcacauuaugcaauaauuggaccaggguuacaagcgaaagcaacgcgcgaagcgcagaaacgggcagcagcaggaauuaugaaaaacccuacaguagauggcauaacagucaucgauuuggauccgaucccauacgauccaaaauucgaaaaacaacucgggcagguuaugcugcucguguuauguguaacccagguacugaugaugcgaacaaccugggcuaugugugaagcccucacccuugcaacuggccccauaaguacacuaugggaaggcaauccuggacgauuuuggaauacgacuaucgcagucucaauggcaaauauuuucagaggaaguuaccuugcaggggcaggauugcuauuuucaaucaugaaaaacacuacaaauacaagaagaggaaccgggaacauaggugagacccuaggugaaaaauggaagagucgucugaacgcucuagguaaaagugaauuucaaaucuauaagaaaucaggaauccaagaaguagauaggacacuagcaaaagaagggauuaagagaggggaaacagaucaucaugccguaagcagagggagcgccaaauugagaugguucguggaaagaaauauggucacuccagaaggcaaaguagucgauuuaggcuguggacgaggagguuggucauacuauugugguggauuaaagaaugucagggaagugaaaggauuaacaaaaggugggccggggcacgaagaaccgauuccaaugucaacauaugguuggaaccuaguccgacugcaaucugggguagacgucuucuuuaucccaccggaaaagugugacacacuacuaugcgacauaggagagaguucaccaaauccaacgguagaagcaggaagaacguuacgaguauuaaauuuaguagaaaacuggcuaaauaacaacacucaauuuuguauaaagguacuuaacccguauaugccaagcguuaucgagaagauggaaacacugcaacggaaauacggaggagccuuaguaagaaacccacucagucgcaauucuacucaugaaauguacuggguuucgaacgccagugggaauauaguaucuucagugaacaugauuucuaggaugcuaauuaaucgguucacaaugagacacaagaaaacuaccuaugagccagacguggacuuaggaucugguacaaggaacauugguauagaaucugaaaucccaaacuuagauauuaucgggaaaagaauagagaaaaucaaacaagaacaugaaacaucauggcacuacgaucaagaucaucccuacaaaacaugggcguaucacggaucauaugaaacaaagcaaacugggagugccucuaguauggugaauggcguuguucggcuauugaccaaaccaugggauguauugccaacgguuacgcagauggcgaugacugacacuacacccuuuggacaacaacggguauuuaaagagaaagucgauacccggacacaggaaccgaaagaaggaaccaaaaagcuaaugaaaaucacugcagaaugguuguggaaggaacucggaaagaagaagacaccaaggauguguaccagagaagaguuuacgcggaaaguacgcucaaaugcagcuuugggagcuauauucacagaugagaauaaguggaaaagugcacgugaggcgguagaagauaguagauuuugggagcuaguagauaaggaaagaaaauuacaucucgagggcaaaugcgagacaugcguuuacaacaugaugggaaaaagagagaagaaacuuggagaauuugguaaagcuaaaggauccagggcaauaugguacauguggcuaggagcucgcuuucuagaguucgaggcacuaggguuucucaacgaggaucacugguuuagucgugaaaauucacuaucuggagucgaaggugagggucuucauaaacuaggcuacaucuugagggaugugagcaagaaagaaggcggcgcaauguaugcugacgauaccgccgguugggauaccaggauaacacuagaagacuuaaagaacgaggaaaugguaacuaaccacauggaaggcgagcacaagaaacuugcagaagcaauauuuaaacucacauaucaaaacaaaguugucaggguucaaagaccuacuccucgcggaaccguuauggauauaauaagucgaagagaucagcgugguucagggcaaguagguacauauggacuuaauacauuuacaaauauggaagcccaauuaauacgacaaauggaaggagagggugucuucaaaaacauacaacacuuaacaguuacugaagaaauagcggugcaaaauuggcuugcaagagugggaagagagcgacuaagcagaauggcgauaucaggagacgauugcgucguaaaaccccuagaugacagguuugcaagcgcacuaaccgcguuaaaugauauggggaaaauuagaaaagacauacaacaaugggaaccuucucgugguuggaacgacuggacacaaguaccuuuuuguagucaccacuuucaugaauuaauaaugaaggaugggcgaguccuaguaguuccguguagaaaccaagaugaguuaauugguagagcacgaaucagccaaggagcgggauggagcuuaagggagacggccugccuuggaaaaaguuaugcgcaaaugugguccuugauauauuuccauaggagagacuuacgucucgcugcuaacgcgauuuguagcgcggugccaucgcauugggugccaacaucaaggacaaccuggucaauacacgcuaaacacgaauggaugacgacggaggacauguugacuguuuggaaccguguauggauucaagagaauccauggauggaagauaaaacgccgguagaaagcugggaagaaauucccuaucuagggaaaagagaagaccaaugguguggcucacuaauaggacucacaucuagagcaacaugggcuaaaaauauacaaacagcaauaaaucaagucagaaguuuaauaggaaacgaagaauacacggauuauaugcccucaaugaagagauuuagaagagaagaagaagaagcugguguauugugguaa

SEQ ID NO: 22501 - RNA, 9876 nt, Artificial Sequence
  derived and/or modified CDS sequence (opt6) from DENV-2__FJ639832__SS-prME
ucagccggcaugauuauaauguuaaucccuacuguaauggcguuccaccuaacaacgaggaacggagagccacauaugaucguagggauacaggaaaaaggcaaaagucuuuuauuuaaaacugaagaugggguaaauaugugcaccuugauggccauggacuugggagaauuaugugaggauaccauuacauacaagugcccguuacuuagacaaaaugaaccugaagauauagauugcuggugcaauagcacaucaacauggguuacauaugguacuugcacaacaacaggugagcaucgccgggaaaaacggaguguugcacugguuccacauguuggaauggguuuggagacacgcaccgagacguggaugucaagugaaggagcuuggaaacacgcccaaagaaucgaaacuuggauucugcgacauccgggauucaccaucauggcugccauauuagcuuauacaauaggaaccacucacuuccaacgaguacugaucuucauccuacugaccgcaguugcaccaucuaugacaaugagauguauagguauaucgaacagggauuuuguagaaggagucucugguggauccuggguagauauaguccuagaacauggaaguugugucacaacuauggcgaagaauaaaccuaccuuggauuucgaauugauuaaaacagaggcuaagcaaccggcaacccuaagaaaauacuguauagaagccaaacuaacaaauacaacuacggaaagccgauguccgacacagggugaaccaucuuuaaaggaagaacaagacaagagauucgucugcaaacacagcaugguagacagagguuggggaaacgggugcggauuauucggaaaaggugggaucgugaccugcgcaauguuuacguguaaaaagaacauggaaggaaagauuguacaaccagagaaucuggaauauacgauuguagugaccccccauagcggggaggaacaugcaguaggaaacgauacuggcaaacacggaaaggaaauuaaaguaacgccccaaucuaguauaacggaagccgaacuaacaggauaugggacaguuacaauggaauguagcccgagaaccggacuagauuuuaacgaaaugguucuacuacaaauggagaauaaagcuuggcucguccacagacaaugguuuuuagaucuaccacuuccaugguuaccuggagcggacaagcaagaaucuaacuggauacaaaaggaaacauugguuacauucaaaaacccucacgcgaaaaagcaagauguaguaguacucggaucccaagaaggcgccaugcauacagcacuuacaggcgcgacggaaauacaaaugucaagugguaauuuauuauuuacaggccaucuaaaaugucggcugaggauggacaagcuacaauuaaaaggcaugucuuauaguaugugcacaggcaaauuuaagguaguaaaggagauagcugaaacgcaacacggaacaauagucauuagaguacaauacgagggugaugggucaccuuguaaaauaccguuugaaauaauggauuuggaaaaacgauacguuuuagguagauugauaacuguaaauccaauagucacugaaaaggauucaccugugaauauugaagcugagccgccauucggagauucauacaucauuauugggguugaacccggacagcuaaaacuaaauugguuuaaaaaagguucaucuauuggucagauguucgaaacaacaaugagaggugcgaaacgcauggcuauauuaggugacacugcaugggauuucggaagucuagguggagucuuuaccucaaucgguaaagcacuacaucaaguguuuggugccaucuauggugcagccuucuccggagucaguuggacaaugaaaaucuuaauugguguaauaaucacguggauaggaaugaacagcaggucaacuucgcucucuguuucguuaguccuuguugggauaguaacacucuauuuaggagugauggugcaagcagauucugguugcguagugaguuggaaaaauaaagaacuuaaaugugggagcgguauuuucauuacagauaacguacauaccuggacagaacaauauaaauuucagccagaaucaccaucgaaacuggcaucugcuauacaaaaagcccaagaggaaggcaucugugggauuaggucaguuacaagauuggaaaaccuaauguggaaacaaaucacgcccgaguugaaccacauccuugccgaaaaugaagugaaacuaacaauaaugacaggggacaucaaaggcauaaugcaggcaggaaagagaucucuaaggccucaaccgaccgaguugaaauauuccuggaaaacauggggcaaagcaaaaaugcucagcaccgaaaguuauaaccagaccuuuuuaauagacgggccagagaccgcagaaugcccaaauacaaaucgggcuuggaauucccuggagguggaggacuacggguuuggugucuucaccacuaauauaugguuaaaauuaaaggagaagcaagacgcuuuuugugauaguaaauuaaugucagccgcgauuaaggacaacagagcgguccacgcggacaugggcuacuggauagagucugcucuaaaugacacauggaaaaucgagaaggcgaguuuuaucgaaguuaaaaacugucauuggccuaagagucauacuuuauggucuaacggaguguuagagagugaaaugauuaucccaaaaaaucuagcgggaccuguaagucaacauaauuauagaccugguuaucacacacaaaucgccgguccuuggcacuuaggcaaacucgagauggauuuugauuucugugacgggacaacagucauaguuacugaggauugcgggaauagaggcccuucacuacguacaacaacagccucaggaaaauuaauaacagaaugguguugcaggagcuguacacuuccuccccuccgguacagaggggaggacggcuguugguauggcauggaaauucgcccucugaaggagaaggaggagaauuuagugaacucacugguaaccgcaggacacggacagguugauaauuucucacuaggaguucuaggaauggcacuguuccuggaagaaauguuacgaacaagaguuggaacaaaacaugcaauuuugcuuguagcagucuccuuuguuacucuuauuacgggcaauaugucauucaaagauuugggucgaguagucguaaugguuggagccacaauggcggacgacauagguaugggaguaacuuaccuugcucuucuugcugcauuuaaaguaagaccaacauuugcggcugguuuacuauugcgcaaauuaaccucaaaggaguugaugaugacaacaauaggaauuguacuauugucacaaucaacuauaccugaaacuguacuugaacuaacggacgcacuagcguuagguaugaugguccuuaaaauuguaagaaacauggaaaaauaccaacuagcgguuacaauaauggcaauacugugugugccaaaugcuguaauccuucagaaugcauggaaaguaucgugcaccauuuuagcaguaguuucggucucuccauuacuucucacaaguagccaacaaaaaacugacuggauaccacuagcauuaacgauaaaagguuugaaccccacagccaucuuucuaacaaccuuauccagaacuaacaaaaagcgauccuggccauuaaaugaagcuauaauggcgguuggaaugguaagcauauuggcgaguagcuuauuaaaaaaugacauaccaaugacaggaccucuaguagcaggggguuuauuaacuguaugcuaugucuugacaggcaggagcgcggacuuagaguuagaacgugcaacggaugucaaaugggaggaucaagcagagauaucagguucaucacccauucuuagcauuacaauaagugaggacggaaguaugagcauaaaaaacgaagaagaagaacaaacgcuaaccauacucauccguacuggacugcuuguaauuucaggguuauuucccauuucaauuccuaucacugcggcagcaugguaccuaugggagguuaaaaaacagagagcaggaguauuaugggauguaccaaguccaccuccgaugggcaaagcagaauuggaagauggggccuauagaauuaaacaaaaaggcauacuaggcuauagucagaucggagcuggcguuuauaaagaggguaccuuucacacuauguggcaugucacgagaggcgcaguauuaaugcacaaaggcaaacgaaucgaaccaagcugggcagacguaaaaaaagauuuaauauccuauggaggagguuggaaauuagagggagaauggaaagagggagaagaaguucaagugcuugcauuagaaccgggaaaaaaucccagggcaguucaaacuaagccaggacucuucaagacaaauaccggaaccauaggagcaguaucauuagauuuuucaccgggcacaagugggaguccaaucaucgauaagaaggguaaagugguuggacuauacggaaauggaguaguaacaaggaguggagccuauguuucugcuaucgcacaaacugaaaagagcauugaggauaacccugagauagaagacgacauuuucagaaaaaggcgcuuaaccaucauggauuugcacccaggugcagguaaaacuaaaagauauuuaccugccauagugagggaagcuauaaaaagaggacuuaggacucugauauuagcaccaacuaggguuguagcugcagaaauggaagaagcucuucgagguuuaccaauaagauaccaaacuccagcaauaagagcggaacacaccggcagagaaauugucgauuuaaugugccacgccacguuuacaaugagacuacuuagcccagugagaguaccuaacuacaaucugauuauaauggaugaagcacacuuuaccgacccugccucaauagcagcuagagguuauaucucaacaagagucgaaaugggagaagcagcaggaauauucaugaccgcaacuccccccggaucuagggacccguucccgcagucaaaugcacccauuauugaugaagaaagagaaauuccugaacgcuccuggaauucaggacacgagugggucacugauuuuaaaggcaaaacagucugguucgugccaaguauuaaagcagggaacgauauagcagccugccugaggaaaaacggaaaaaaaguaauacaacuaucccgcaaaacauucgauagugaauauguaaagacuagaacgaaugacugggacuucguuguuacuacagacauuagcgaaaugggcgcaaauuuuaaagcagaaaggguaauagacccgcgccgcuguaugaagccaguaauauugacugauggagaagaaagaguuauucuagcaggcccuaugccuguuacacacucgucagccgcucagagaaggggccgaaucgggagaaauccaaaaaacgaaaacgaucaauacaucuacaugggugaaccacuagaaaaugaugaggauugugcccauuggaaggaagcaaagauguuguuagacaacauaaacacccccgaaggaauaauacccucuauguucgagccugagcgagaaaaagucgaugcuauagauggugaauaccgacugaggggcgaagcaagaaagacuuucguggacuuaaugcggcguggagaccuaccgguauggcuugcauauaaaguagcugccgaaggaauuaauuaugcugacagaagauggugcuuugauggaauuaaaaauaaucaaauauuagaggaaaacguugagguagagaucuggacaaaagaaggagagaggaaaaaacugaagccuagauggcuagaugcgagaaucuauucggauccauuagcccugaaagaauuuaaagaauuugcagcugguagaaaaaguuuaacguuaaauuuaaucaccgagauggguagauuaccuacguuuaugacgcaaaagacgcgcgaugcguuggauaaccuugcaguucuacacacugcagaagcaggaggacgggcauauaaccaugcucuuucagaacuaccggaaacguuagagacacuucuccuauuaacguuacuagcgacugucacagggggcauauuuuuauuccuaaugagcggcagaggcauaggaaagaugacacuuggaauguguugcauuauuaccgcaucuauauuauugugguacgcucaaauucagccccauuggauugcagcaucgauaauccuggaauuuuuuuugauuguuuuacuuauccccgaaccagaaaaacagcguacuccucaagauaaccaauuaaccuaugucgucauagcuauuuuaaccguuguugccgccaccauggcaaaugaaauggguuuucucgagaaaaccaagaaagacuuaggauuaggaaguauugccacacagcaacccgaaucuaacauauuagauauagauuugagaccagccagcgcauggacacuauaugccguagcuacgacuuuuguuacccccaugcuacgacacagcauagagaacuccagcguuaacgucagcuugacagcgaucgcaaaucaggcuacgguuuuaauggggcuaggcaaaggauggccuuugucaaaaauggauauaggcguuccgcuauuggcuauugggugcuauucacagguuaauccuauuacguuaacugcggcauuacuacuacucguagcacauuacgcaauuaucgguccaggauugcaagcaaaggcuacgagggaagcucagaaacgagcggcggcaggaauaaugaaaaauccuacaguagauggaauaacagucauagaucuugauccgauaccguacgacccuaaauucgagaaacaauuaggucaaguaaugcugcuaauauugugugucacacaaguccuaaugaugagaacuaccugggcacucugcgaggcguuaacacuagcaacaggaccaaucagcaccuugugggaggguaauccugggagauuuuggaacacaacaauugcgguaucaauggcgaauauauuccguggaucauauuuggcaggggcugggcuauuauucuccauaaugaaaaauaccacaaacacgagaagagguacaggaaauauaggagaaacauuaggcgagaaauggaaaagucgguugaaugcacugggaaaaucagaguuucaaauauacaagaagaguggaauccaagaaguagauaggacacuggcgaaagagggcaucaaaagaggggaaacggaccaucacgcgguuagucggggaagcgcaaagcuacgaugguucguagaacgaaauauggucacgcccgaaggcaagguaguugaccucgguuguggcagagguggauggucauacuauugcgggggguugaagaauguaagagaaguaaaaggccuaacaaagggagggcccggccaugaagaacccaucccaaugucaacauacggcuggaaccuuguaaggcugcaaaguggaguagacgucuuuuucaucccuccggaaaaaugcgauacacucuuaugcgauauaggggaaaguucuccuaauccaacugucgaagcaggcaggacacuuagagucuuaaaccuuguagagaauuggcuuaauaacaauacgcaauucuguauaaagguccuuaauccauacaugccaagcgucauagagaaaauggaggcguuacaacguaaguauggaggugcauuaguacgaaauccauuaucccgaaauaguacacacgaaauguauuggguuuccaacgcgucagggaauauaguauccucaguaaauaugauauccaggauguuaaucaauagguucacgaugagacacaagaaggccacguaugagccagauguugacuuaggcagcgguacaagaaauauaggaaucgaaucagaaguaccgaaucuagauaucauagguaaaaggauagaaaaaauaaaacaagaacaugaaacgucauggcacuaugaccaagaucauccuuacaagacgugggcuuaucaugguagcuaugaaacgaaacagacuggaucagcaucaagcauggucaauggcguaguacguuuacuaacaaaaccuugggacguacuuccaacggucacgcagauggcaaugacagacacaacaccuuuuggacagcaaagagucuucaaagaaaaaguagacacaaggacccaagaaccaaaggaaggcacaaaaaaacuuaugaaaauaacagcagaauggcucuggaaggaguuagguaaaaaaaaaacgccacgaauguguacaagagaagaauuuacgagaaaagucagaucaaacgcagcgcuuggagcuauauuuaccgacgagaacaaauggaaaucagcucgagaagcgguggaagacagccgcuuuugggaacuaguugauaaagaacguaauuuacauuuggaaggaaagugugagacuuguguguacaauaugaugggaaaaagggaaaaaaaacuuggugaauuugggaaggcuaagggaagcagagccauaugguacauguggcuaggggcccguuuuuuagaauuugaggcauugggguucuugaaugaagaccauugguucagucgagaaaauaguuuaagcggaguagaaggagaaggucuacacaaauugggauauauacuucgagacgucaguaagaaagaaggcggugcaauguacgcugacgauacagcagggugggauacacgaauaacacuagaagaccuuaagaacgaagagauggucaccaaucauauggaaggagaacauaagaaauuggcugaggcaauauuuaaacuaaccuaccagaauaaaguuguucgcguacaacgaccaacaccuagaggaacaguuauggacauaaucucacgaagggaucaaagaggcaguggucaagucggaacauauggucuaaauacauuuacuaacauggaagcacaguuaauucgacagauggaaggagaaggcguuuuuaaaaacauucagcaucuaacaguaacagaggagguagcuguacaaaacuggcuagcgagagucggucgugaacguuugaguagaauggcaauaaguggagacgacugcguagucaaaccauuagaugaucgguucgcaaaugcacuuacggcucuaaaugauauggguaaaauuagaaaagacauucaacaaugggaaccaucaaaaggguggaaugauuggacucaaguuccuuucuguucacaccacuuccaugaauugauaaugaaagauggcagaguacuugugguaccuuguagaaaucaagaugaacucaucggaagagcaagaauaucacaaggagcaggguggagucuacgcgaaacagcuugucucgggaaaucauaugcgcaaauguggagucuuauguacuuucauagacgcgauuugagauuggcggcuaaugccaucugcagugcagucccaagucauuggguaccuacaagccggacaacauggucgauacaugccaaacacgaauggaugacuaccgaagauauguuaacaguguggaaccgaguauggauuagggagaauccuuggauggaggauaaaaccccaguugaaucgugggaagaaauuccauaccuagggaaacgcgaagaucaaugguguggaucuuuaauaggcuuaacaagucgagcuaccugggcaaagaauauacaagcagcuauaaaccagguuagaucccuaaucgggaacgaggaauacacggauuauaugccaucaaugaaacguuuccguagagaggaagaagaagcaggagugcugugguga

SEQ ID NO: 22502 - RNA, 9876 nt, Artificial Sequence
  derived and/or modified CDS sequence (opt6) from DENV-2__FJ687434__SS-prME
agcgugggaaugauaauuauguuaauacccacggucauggcauuccacuuaaccacucguaauggggaaccacacaugaucguaagcauacaggaaaaagguaaaaguuuacuuuucaaaacugaagacggaguuaacauguguacucuaauggccauggauuuaggugaauuaugcgaggacacuauaacauauaaauguccgcuuuuacgucaaaaugaaccggaagauauagauugcuggugcaauucuacaucaacgugggucacauacggaacuuguaccacaacaggcgaacaucgccgagaaaaacgcucaguagcguuaguuccacauguagguauggguuuagaaacuaggacugagacuuggaugucuucagaaggugcauggaaacaugcgcaaaggaucgagacauggauacuaagacacccuggcuuuaccauaauggcugcaauuuuagccuacacuauagguacuacccacuuucagcggacauuaaucuucauauuauugacggcaguugcuccuagcaugacaaugagauguauaggcaucucgaauagagacuuugucgaaggaguaucaggagguucuugggucgauaucgugcuagaacacgggucuuguguuacuacgauggcuaaaaacaaacccaccuuggauuuugaauuaauaaagacugaagcgaaacagccagcuacauuaagaaaguacuguauugaagcucggcuaacuaauacaacgacagagagucgauguccuacacaaggugaaccaagccuaaaagaagaacaggauaagagauuuguuuguaaacacaguaugguugaccgagguuggggaaacgguuguggccuauuuggaaagggaggcaucguaacaugugccauguuuacauguaagaaaaauauggagggaaaaauaguacagccugaaaacuuagaguacaccauagucguuaccccgcauucaggagaagaacacgcagugggcaaugacacaggcaaacauggaaaagaaauuaaaguuacuccacaaaguucuauuacugaagcagaauuaaccgguuaugguacgguaacaauggaaugcucaccaaggacaucauuagauuucaacgaaaugguccugcuacaaauggaaaauaaagcauggcucguucaucgccaaugguuucucgauuuaccucuaccgugguuacccggugcggauacgcaagguagcaacuggauccaaaaagaaacguugguaacauucaaaaauccacacgcuaaaaaacaagaugugguuguuuuaggaucucaagaaggggcuaugcacacugcgcuaacgggagcuacagagauacagaugucgucgggcaaucuauuauucacaggacauuuaaagugcagauugcguauggauaaacuacaacuaaaagguaugucuuauucaaugugcacuggaaaauuuaaaguugucaaagagauugcagaaacgcaacaugguacaauagugauaagaguccaauaugagggagauggaucacccuguaaaauacccuucgagauuauggauuuagaaaaacgguauguauuaggucgacuaaucacaguuaacccuauuguaacagaaaaagauuccccagugaauaucgaagcagagccaccauuuggggauaguuacauaauaauaggaguugagccaggacaauuaaaacucaauugguucaaaaagggaucaaguauaggccaaauguuugaaaccacaaugcgcggcgcuaaacgcauggcgauucugggggauaccgcuugggauuucgggucgcucggugguguuuuuacuagcauaggaaaagcucuacaucaaguguuuggcgcuauauacggagcggcauuuucagguguaucguggacgaugaaaaucuugauugguguaauaauaacauggauuggaaugaauagucggaguaccagcuuauccguuuccuuaguauuaguaggagucgugacauuauacuuaggagugaugguacaggcagacagcgggugcgugguuucguggaaaaacaaggaacuuaaguguggaucuggaaucuucauaacugauaauguacauacguggacugaacaauacaaauuucaaccugagagcccuagcaaguuagcaagcgcuauccaaaaagcacaggaagaagggaucuguggcauuagaucggucacaagguuagagaaucugauguggaaacaaauaacaccagaauuaaaucauauuuuggcagaaaacgagguaaaacuaacaauuaugacaggagauauuaaggggauaaugcaagcagggaaaagaaguuugcgaccccaaccaacugaauuaaaauacucauggaagacaugggguaaagcgaaaauguuaucaacagaaagccacaaucaaacuuuuuugauagaugggccugaaacggcagaaugcccaaauacuaauagggcguggaauagucuggaaguggaagauuauggguucggaguauuuacuacaaauauauggcugaaacugaaagaaaagcaagaugcauuuugcgacucaaagcugaugucagccgcuauaaaggauaaccgagcagugcacgcagauaugggguauuggauugaaucugcauuaaaugacaccuggaaaauagaaaaagcuucauuuaucgaaguaaaaaauugucacuggccgaaaucacacacacuauggagcaauggaguacuugaaucagagaugauuaucccaaaaaauuuagcgggaccaguaucacaacacaauuaucgaccugguuaucauacacagauagcuggcccuuggcauuuaggaaaacuggaaauggacuuugacuucugugaugggaccacaguuguagugaccgaagacugcgggaacagggguccaucgcuuagaaccacuacugccagcggcaaacuaauaacugaaugguguuguagaucgugcacucuuccaccauuacgcuaccgcggggaagauggguguugguaugggauggaaauacggccgcucaaggaaaaagaagagaaccuaguuaacucuuugguuacagcaggucauggccaaguagauaauuuuagucuuggaguccuggggauggccuuguucuuggaggaaaugcucagaacuagaguugggacaaaacacgcaauauuauuagucgcagugucuuucgucacccucaucaccggcaauauguccuuuaaagaucuaggucguguuguaguuaugguaggugcuacuaugacagaugacauagggaugggagugacuuauuuagcguugcuugcagcauucaaagugagaccuacauuugccgcgggccuucuacuaagaaaauuaacuuccaaagagcuaaugaugaccacuauagggauagucuuacugagucagucuacgauucccgaaacaauauuagaguugacagaugcauuagcccuggguaugaugguucuaaagauggucagggacauggaaaaauaccaacuggcugucacgauaauggcaaucuuaugcgucccaaaugcgguuauccuccagaaugcuuggaaagugagcuguacaauacucgccguaguuucagucucaccauuauuacucacaucuagccaacaaaagacagacuggauaccguuagcucuuaccaucaaaggauugaauccaacagcgauauuccuaacaacucuuucaaggaccaacaaaaaacgcaguuggccuuuaaaugaagcaauuauggcaguagguaugguauccauauuagcaaguagucuacuaaaaaacgacaucccaaugacaggcccucuaguggcugguggccuacugacaguauguuaugugcuaacagggagaucugcggaccuagaauuagaaagagcaacugaugucaaaugggaagaccaagcugaaauaagcggaaguucaccaauacuuagcauaaccauaagugaagacggcucaaugucaauaaaaaaugaagaggaagagcaaacauuaacaauacucauacguaccggauugcuagugauaaguggucuauucccaguauccaucccuauaacggcagcagcuugguaucuaugggaaguuaaaaagcagagagcuggaguacuuugggaugugccaaguccuccaccaauggguaaagcagaauuagaagauggagcuuacagaaucaaacaaagagguauacuggguuauagccaaauaggggcaggaguauauaaagaagguacguuccauacaauguggcaugucacuaggggcgcuguguuaaugcauaaaggcaaaagaauagaacccagcugggccgauguuaaaaaagauuuaauuuccuacgggggcggcuggaaacuagaaggagaauggaaagaaggcgaagagguccaaguucuugcauuagagcccggaaaaaauccuagggcaguacaaacgaagccaggauuauucaaaacgaauacagggacaauuggagcggucagccuagauuucagcccggguaccagcgguagcccgaucauugacaaaaaagguaaaguggugggacuauacgguaaugggguuguuacacggaguggcgcuuauguaagcgcaauugcgcaaacugaaaagucaauagaagauaacccugauauagaagacgauauauuuagaaaaaggaggcuaaccauuauggauuugcauccgggcgcuggaaaaacgaaacgauaccuuccugcaaucguaagggaagcaauaaaaagagggcuuaggacucugauauuggcccccacucguguagucgcagccgaaauggaggaagcauuacgcggccuaccaauucgauaucaaacaccugcaauacgugcggaacacacugggcgugaaauaguagauuugaugugucaugccacauuuacuaugagauuacugucgccgguacgaguaccaaauuauaaccugauaaucauggacgaagcacacuucaccgacccugccaguauagcagcaagaggguacauaaguacacgaguggagaugggagaagccgcggguauuuuuaugacagcgaccccgccugguagcagagauccauucccacaaucuaacgcuccaauuauagaugaggaacgugaaauacccgaaagaucuuggaacucagggcaugaguggguaacagacuuuaaaggaaagacgguaugguucguaccaucgauaaaagcgggaaaugauauugccgcauguuugagaaaaaacggaaaaaaggucauccagcucucacgcaaaacauuugacagugaauacguaaaaacacgcacuaaugauugggauuucguggugacaacagauauaagugaaaugggugcaaacuuuaaggccgagagaguaauugacccaaggagaugcaugaaaccggucauucuuacugauggggaagagagaguaauccuugcagggcccaugcccguuacacauucgucagcagcacaacguagagggagaauaggucgaaaucccaaaaaugaaaaugaucaauacaucuauaugggagaaccccucgagaaugaugaagacugugcacacuggaaagaagcaaaaauguuacucgauaacauaaacaccccggaaggaauaauuccaucuauguuugagcccgagcgagaaaaaguggaugcaauugauggcgaauauagguuacgaggugaagccagaaagacuuucguugaccuaaugcgcagaggugacuugccuguaugguuagcuuacaagguggcagcggaaggaauaaacuacgccgacagaagauggugcuucgauggcaucaaaaacaaucaaauuuuagaagaaaauguugagguagaaauuuggaccaaagaaggcgaacgcaagaaacugaaaccuaggugguuggacgcgcguauuuacagcgacccuuuggcucuuaaggaauucaaagaguuugccgcagguagaaaaucauuaacauuaaauuuaauaacagagaugggaaggcuaccgacauucaugacccagaaaacacgagacgcuuuagacaaccuagcaguccuucacacagcugaggcgggaggcagagccuauaaucaugcccuaagugaacuacccgagaccuuggaaacauuguuauuacuaacauuacucgcaacuguaacuggugguauauuucuauuucuaaugucuggaagaggcauuggaaaaaugacccucgguaugugcugcauaguaaccgcuagcauauuacuuugguaugcucaaauccagccgcacuggaucgccgcuucuaucauccuagaauucuuccuuauaguguuauuaauaccagaaccggagaaacagagaacgccgcaagauaaucaacucacauauguggucauugcuauauuaacgguuguagcagcgacaauggcaaaugagaugggcuuuuuagagaagaccaaaaaagauuuaggcuuaggaucaauagcgacacaacaaccagaaagcaacauacuagauauagauuuacgaccugcauccgcauggacguuauacgcuguugcaacuacuuuuguaacgccaauguuaaggcacucuauugaaaauagcagcguuaauguaucacuuacugcaauagcaaaccaagcaacuguacuaaugggauuggguaaaggcuggccgcucucaaagauggauauaggagcacccuuauuagccauagguuguuacucgcaaguaaacccaauaacccugaccgcugcucuccuucuauuaguugcucacuacgcaaucauagggcccggucuucaagcuaaggcuacacgagaagcacaaaagcgggcagcugcuggaauaaugaaaaacccgacgguggacggaauaacuguaauagauuuagauccaauacccuaugacccaaaguucgaaaaacaacuaggacaggcuaugcuauugguguuguguguaacacagguucuuaugaugcguacgacaugggcauuaugugaggcucugacacucgccacagguccaauaucuacucuaugggagggaaauccuggccgauucuggaacacuacuaucgcugugaguauggcuaauauauucagggguucauaccuagcaggugccggacugcuuuuuagcaucaugaaaaauacaacaaauaguagacguggcaccggcaacauaggggagacuuuaggagaaaaguggaaauccaggcucaacgcacucgguaaaucugaauuucagaucuacaaaaaaucagguauacaggaaguugauaggacauuagcuaaggaggggaucaagagaggugaaacagaccaccacgccguaucuagagggagcgccaaguugagaugguuuguagaaagaaauaugguaacaccagaagggaagguaguagaccugggguguggacguggcggguggucauauuauuguggaggacugaaaaacguaagggaaguaaaagggcuaacuaagggaggaccaggccacgaggaaccaauaccgaugucaaccuaugguuggaauuuggugcgucuacaaucaggcguugacguauuuuuuaucccacccgaaaagugugacacauuacugugugacauuggcgaaaguucacccaacccaacuguugaggcgggaagaacuuugcguguacuuaauuugguugaaaacuggcuaaacaauaauacucaauuuugcauaaaagugcugaacccauauaugccaucuguuauugaaaaaauggaaacccuccaacgcaaauaugggggggcacuuguaagaaauccauuaucucgaaauuccacucaugaaauguacuggguaucaaaugcuucagguaacaucgucucuagcgucaauaugaucucgcgaauguuaaucaaucgauuuaccaugcgacauaaaaaagccaccuacgaaccagacguagaccuaggaucuggaacaagaaacaucggcauagaaucggaaauucccaauuuagacauuauuggaaaacguauugaaaaaauaaaacaagaacacgaaacaucauggcacuacgaucaggaucauccauacaagacuugggccuaccauggauccuaugagacaaaacaaacggguagcgcuagcucaaugguuaauggcguggugagacucuuaacaaaaccuugggacguucuccccacgguaacucagauggcaaugacagauacuacgccauuuggucaacaacgcguguucaaagaaaaaguagacacacguacucaagaaccgaaggaaggaacaaagaagcugaugaagaucacagcagaaugguuauggaaagaacuagguaaaaaaaaaacgccgcgaaugugcacacgcgaagaguucacuagaaagguacgaucuaacgcugcccucggcgcgaucuucacagaugaaaauaaauggaagagugcgagagaagcgguggaagacucucguuucugggaauugguagauaaggaacggaacuuacacuuagaagggaagugcgagaccuguguuuauaauaugaugggaaaacgugaaaagaaauuaggagaauucgguaaagcaaaagguucuagagcuauaugguacaugugguuaggcgcacgguuccuagaauuugaggcauugggauucuuaaaugaagaucacugguucagucgagaaaauagccuaucgggcguagaaggugaggguuuacacaaauuaggauacauuuuacgagaugugucuaaaaaagagggaggugcaauguacgcggaugauacagcagggugggacacuagaauaacuuuagaagauuuaaaaaaugaggaaaugguaacgaaccacauggaaggagagcacaagaaauuagcggaggcuauauucaaacuaacauaccaaaauaaaguaguucgggugcaacgaccuaccccaagaggcacuguaauggacaucauuucuaggagggaccaacgcgguagcggacagguggguacauacggucuuaauacguuuaccaacauggaagcccaacuuauacgacaaauggaaggggagggagucuuuaagaauauacagcauuugacugucacagaagaaauagccguacagaacugguuagcaagggugggaagggaacgauuaucacguauggcuauaucgggcgaugacugcguaguuaaaccacuagacgaucguuucgcuuccgcuuuaacagcauuaaaugauaugggaaagauaaggaaagacauacaacaaugggaaccuucaagaggauggaaugacuggacccaaguuccauuuugcagucaccauuuucaugaauuaauaaugaaagauggaaggguuuuggucguaccauguaggaaucaggaugaguugauaggucgcgcccgaauuucucaaggugcggguuggucccuuagagaaacagcaugucuugguaaaaguuacgcacaaauguggucauuaauguauuuucaccggcgggaccucagauuagccgcaaacgcuauuuguucagccgucccaucgcacugggucccgacuucccgaacaacuuggaguauacaugcaaaacacgaauggaugaccacugaggacaugcucacaguuuggaaccgaguauggauacaagaaaauccauggauggaagacaagacaccaguagagucuugggaagaaauccccuacuugggaaaaagagaggaucaguggugugggagucuaauaggacuaacaucacgagcaacaugggccaaaaauauucaagcugcuauaaaucagguaagaucguuaaucgggaaugaggaauacacagacuacaugccgucgaugaaacgcuuuaggcgagaagaagaggaagccggaguauuaugguaa

SEQ ID NO: 22503 - RNA, 9876 nt, Artificial Sequence
  derived and/or modified CDS sequence (opt6) from DENV-2__FJ687439__SS-prME
ucagcaggaaugauaauuaugcuaauuccaacgguaauggcuuuucauuugaccacgcguaacggagaaccccauaugaucguaggaauacaagaaaaaggcaaaagccuguuauuuaaaaccgaagaugggguaaacauguguacucuuauggcuauggaucuaggcgaacuaugugaagauacaauuacauacaaaugcccguuauugcgacaaaaugaaccggaagauauagacuguuggugcaauuccacaucuacuuggguaacuuauggaacguguacaacaacgggggaacaccggagagagaaaagaucgguugcuuuaguaccucauguuggaauggggcuagaaacaaggacagaaacauggaugucgagcgaaggagcuuggaaacaugcgcaacgcauagaaacauggauacuaaggcauccagguuucacuauaauggcugcaaucuuagcuuauacgauaggaacaacacauuuccagagagcacuaauauuuauuuuguuaacggcuguagcucccagcaugacuaugagauguauugguauaucaaacagagacuuuguugaagggguaucaggaggaaguuggguagauauaguauuggaacaugguagcuguguuacaacgauggccaaaaacaaaccuacucuagauuucgaauuaauuaaaaccgaagcuaaacagccagccacauugagaaaauacuguauugaagcaaaauuaaccaacacaacaacagaaagucgguguccgacucaaggagagccuuccuuaaaagaggagcaggauaaaagauuuguguguaaacacaguaugguggauagaggauggggaaacggcuguggguuguucgguaaagguggaaucgugacaugugcuauguucacuugcaagaaaaauauggaagggaaaauaguucaaccugaaaauuuagaauauacaauuguagucaccccacauucuggagaggaacacgcuguagguaaugacacgggaaaacacggaaaagaaaucaaagucaccccacaaaguuccaucacagaagcugaacuuacagguuacggaacgguuacuauggaaugcucaccacgaacaggccuagauuuuaacgaaaugguucuucuacaaauggagaacaaagcaugguuagugcauagacaaugguuuuuagacuuaccacuuccguggcugccuggagcugacaaacaagaaaguaauuggauacagaaagagacuuuaguuacauucaaaaacccacaugcgaagaaacaagauguagucgugcuaggaucacaggagggugccaugcauaccgcucuuacaggggcaaccgagauacaaaugucgagugguaacuuacuuuuuacaggucaucuaaaaugucguuuacguauggauaaauuacaacuuaaaggaaugucuuauaguauguguacaggaaaauucaaggugguaaaagaaaucgcagaaacgcaacacgggacgauaguaauuagaguacaauacgaaggagauggcucuccguguaagauuccguucgaaaucauggaucuggaaaaacgauacguuuuaggccguuuaauuaccguuaauccaauugcuacagagaaggacucacccgucaauauagaagcagagcccccuuuuggagauucuuacauuauuauuggcguggaacccggucaacugaaauugaauugguuuaaaaagggaucgucaauuggacaaauguuugaaacaacaaugagaggcgcaaaaagaauggcaauauuaggcgauacugccugggauuuugggucguuagguggaguauucacaaguauuggaaaagcguuacaccaaguauuuggagcaaucuauggagccgcuuuuuccggugugagcuggacaaugaaaauucugauugguguuauuauaacauggaucggaaugaacaguaggucaacauccuuauccguaucacuggugcuuguaggaauuguuacauuguacuugggagucaugguucaagcagauucggggugcguagugaguuggaaaaauaaagaacugaaguguggaucaggaauauuuaucacugauaacgugcauacauggacugaacaauauaaauuucagccagagucccccaguaaacuagcaucugccauucagaaagcacaagaagaaggaauuugcgguauucgaagcguaacaagauuggaaaaccuaauguggaaacaaauaacacccgaauuaaaucacauucuagcugagaaugaagucaaauuaacuauaaugacgggagauauaaaagguauaaugcaagcugguaaacguagucuccggccgcaaccgacagaauuaaaguauuccuggaaaacguggggaaaagcgaaaaugcugagcacagaaaguuacaaccaaacauuuuuaauagaugggccggaaacagcugaauguccuaacaccaauagagcauggaacagcuuggaagucgaagacuaugguuucgguguauuuacgaccaacauuuggcuaaaacuuaaagaaaaacaagacgcauuuugcgauucaaaauugaugucagcugccauuaaagauaauagggcgguccacgcggauauggguuauuggauagaauccgcuuugaacgacacuuggaaaaucgaaaaggcuucuuuuauagaagucaaaaauugucauuggcccaagagucacacauuauggaguaacgggguauuagaaagugaaaugaucauaccgaaaaaucuagcaggacccguuucacaacauaauuaucggccggguuaccauacucaaaucgcaggaccguggcacuuaggcaaacuugaaauggauuuugacuucugcgacgggacaacuguuaucgucacugaagauugcgggaaccggggcccaucacuaagaacaacgacugcaucuggcaagcucauaacggaguggugcugccgaucauguacacuaccaccacuccgauaccguggggaagacggauguugguaugguauggagaucaggccgcuaaaagaaaaggaagaaaaccugguuaacagccuaguuacagcgggacacggccaaguagauaauuuuagccuaggcguacuagguauggcguuguuccucgaagaaauguugcggaccagaguuggcacuaaacaugccauucuauuaguggcgguaucauuuguaacuuuaauaacaggaaacaugaguuuuaaagaucucgggagagucguaguaaugguaggcgcaacaauggcagaugacauugguaugggggucacuuaucuggcacuacuagcugcauucaaaguacgcccuaccuuugcagcuggauuauuauuacgaaaauuaacaucaaaggaacugaugaugaccaccauagggauuguauuacuaucucagucaacaauaccugaaacuauccuagaguuaacggaugcuuuggccuuaggaaugaugguucuaaaaaucgugcgaaauauggaaaaauaucagcuugcaguuaccauaauggcgauauugugcguuccaaaugcugugauauugcaaaacgcuuggaaaguauccuguacaauccuagcuguaguuucgguuagcccccuacuucucacuucuucucaacagaaaacugacuggauacccuuagcacucacuauuaaggguuuaaauccuacugcuauuuuucugacgacuuuaagucgaaccaacaagaaacggucauggccccuaaaugaagccauaauggccgugggaaugguaagcauacucgcaagcuccuugcugaaaaaugacauaccaaugaccgggccacuuguugcugggggauuacuaacaguaugcuacguauuaacaggaagaagcgcagaucuagaacucgaaagagccacugaugucaaaugggaagaucaagcugaaauaucaggaucaucuccaauacuuagcauuaccaucuccgaggauggaucaaugucaauuaaaaacgaagaagaagaacaaacucuaaccauccucauaaggacgggauuauuaguaauaucgggucuguucccgauaagcauacccauuacugcagccgcaugguauuuaugggaaguuaagaaacaaagagcaggaguucuaugggacguucccucacccccaccuaugggaaaggcagaacuggaagacggagcauaucguauaaaacaaaagggcauauugggauauucccaaauuggcgcggguguauacaaagaagguacauuccauacuauguggcauguuacuagaggagcaguauugaugcauaaaggaaaaagaauugaaccaucgugggccgaugucaagaaagaucuaauaaguuauggcggaggcuggaaauuagaaggggaguggaaagaaggugaggaaguucaaguuuuggcgcuagaaccggggaagaauccgcgugcgguacagacgaagccaggucucuucaaaaccaacacggguacaauaggagcaguaucuuuagauuuuagcccugguacaagugguucacccaucauagauaagaaaggaaaaguagugggacuauacgguaauggcgugguaacccgaaguggggcauaugucagcgcaauagcacagaccgaaaaaucaauugaagacaauccagagauagaagaugauauauuucguaaaagaagauuaacgauuauggaccuacaccccggugcgggaaaaacaaaaagauaucuacccgcaauugugagagaagcuauaaaaagaggcuuacgaacucugauacuugcccccacacggguuguagcagcagaaauggaagaagcauugcgugguuuacccauuagguaccagacaccagcuauaagagcugaacacaccggaagagagauuguggauuuaaugugucacgcuacuuuuacaaugcgccuacucuccccuguaagaguaccaaauuacaaccuuauaguuauggaugaagcucacuucacugauccugcuagcauagcugcacgaggcuauauauccacgcgggucgaaaugggagaagcggcaggaauauuuaugacagcuaccccaccugguagccgagacccauuuccgcaauccaaugccccaaucauugaugaagaacgagagauaccggaacggagcuggaacucgggucacgaauggguaaccgauuuuaaaggcaaaacgguuugguuuguaccuucaaucaaagcgggaaaugauauagcagcaugucuucggaaaaaugggaagaagguaauacaguugagucguaaaacuuuugauucagaguacgucaaaacuagaacuaacgauugggacuucguugugacaaccgacauaucggagaugggcgcaaauuuuaaagcugaaagagugauagacccuaggaggugcaugaaaccaguuauacugacugacggagaagaaagaguaauauuagcagggccaaugccagugacccacucuagugcagcacagagacguggccgcauaggccggaaucccaaaaaugaaaaugaucaguacauuuauaugggggaaccucuagagaaugacgaagacugcgcacacuggaaagaagccaaaaugcucuuagauaauaucaacaccccugaaggaauaauuccaagcauguucgaaccggaacgcgaaaaaguagacgcuaucgacggugaauacagguuacguggugaagcacggaagacuuuuguggaccuuaugcgacgaggugaccuaccgguuugguuagcauauaaaguugcggcugagggaaucaacuaugcugacagaagaugguguuucgaugggaucaaaaauaaccaaauccuugaagaaaaugucgaaguggaaauuuggacuaaagaaggcgaacguaagaaacugaaacccagauggcuagacgccagaauuuacagugauccauuagcguuaaaggaguucaaagaguucgcagcggggcgaaagucacuaacacugaacuuaauuacugaaaugggcaggcuccccacguucaugacacaaaagacgagagaugcauuggauaaucuagccguguuacauacggcugaagccgguggucgagccuauaaucaugcuuuaagugaguuacccgagacacucgaaacacuauuauuacuaacucuacuugcaacaguaacagggggcauauuccuauuucuaaugagcggaaggggcauagggaaaaugacauuaggcaugugcuguauuauaacggcaucaaucuugcuuugguacgcucaaauccaaccgcauuggauugcugcaucuauaauccuggaguucuuuuugaucguguugcuuauacccgagcccgagaagcagagaacaccacaagacaaucaacuaacauauguagugauagcaauucuuacuguugucgcagccacgauggcuaacgaaauggguuucuuagagaaaacuaaaaaggaucuuggauuagguucaauagcaacgcagcaaccagaaucaaauauauuagauauagacuuaaggccagcuuccgcauggacuuuguaugccgucgcaaccacauuuguaacaccuauguuaagacauaguauagagaacagcaguguaaacauuucacuaacagcuauugcaaaucaggcgacuguauuaaugggacuaggaaaaggguggccauugucgaaaauggauauugggguaccacuccucgcaauuggcuguuauucccagguaaauccuaucacucugacugcagcacuccuucugcucguugcucacuaugcaauuauagguccugggcuacaagcgaaagcuacgagagaagcacagaagagggcggcagcgggaauaaugaaaaacccaacuguagacgguauaacuguaauugauuuagacccaauuccauaugauccaaaauucgagaaacaguuaggacaggucaugcuacuaauacucuguguuacucaaguccuaaugaugagaaccacaugggcauuaugugaagcguugacauuagccacaggaccaauuucgacguuaugggaggggaauccaggaagauuuuggaacacaacgauagcaguuucuauggcuaacaucuuccgcggaucuuaucuggcaggagcuggucuucucuucucgauuaugaaaaacacaacuaacacaagaagaggaacuggcaacauaggcgaaacauuaggggaaaaauggaaaucccguuuaaaugcacuagguaaaucugaauuucaaaucuauaagaaaucuggcauucaagagguagaccggacccucgcuaaagagggaauuaaaagaggagaaacggaccaucaugcaguaagccgggguuccgcgaaauuaaggugguuuguagaaagaaacaugguuacuccagaaggcaaaguaguugaccuuggaugcggccgaggugguuggagcuauuauugcgggggacugaaaaacguccgugaaguaaaagguuuaacaaaagguggacccggacacgaagaaccaauuccuauguccacauaugguuggaacuuggugcgacuacaauccggaguggauguauuuuucauuccuccugaaaaaugcgacacgcuauuaugugauauuggagaauccucuccaaauccgacaguagaagcagggcguacauuacgcguacuuaaucuuguagaaaauuggcuaaauaacaauacccaauucuguauaaaaguacuaaauccauauaugccgagcguaaucgagaaaauggaagcccuacaaagaaaauacggaggagcauuaguaagaaacccacuuaguagaaacagcacgcacgagauguauuggguaucgaaugccucgggaaauaucguaagcucgguaaacaugauuucaagaaugcuuauuaacagauuuaccaugaggcauaagaaagcuacuuacgaacccgauguagacuuagguagcggcacccggaauaucgggauagaaagcgaaaucccuaauuuggauaucaucgguaaaaggauagagaaaauuaaacaagagcaugagacaucuuggcauuaugaccaagaucacccauauaaaacaugggcguaucacgggucuuacgagaccaaacaaacaggaagcgcaucaaguaugguaaauggaguugucaggcuguugacuaaaccgugggauguucuaccgacgguaacucaaauggcaaugacugacacgacacccuuuggacagcaacgaguuuucaaagaaaaaguggauacaagaacccaagaacccaaagaaggaaccaagaaacucaugaaaauaacagccgaauggcuauggaaggaacuugguaaaaagaaaacaccaagaauguguacacgggaagaguucacacgaaaagugcgcaguaacgcagcccuaggagccauauuuacagaugagaacaaauggaaaagugcccgugaagccguagaagauagccguuucugggaguuaguagacaaagagagaaaucuacaucuugaagggaaaugcgaaacauguguuuacaauaugaugggaaagcgcgagaagaaauugggcgaauuugguaaagcaaaagguucgcgagcuauaugguauauguggcuaggggcacgauucuuagaguucgaggcucucgguuuucucaaugaagaucauugguucucgagggaaaacagccuaagugguguggaaggagaagggcuucauaagcuaggauacauacuaagagacguuagcaagaaagaaggaggcgccauguaugcagacgauacagcugguugggacacacgaauaacacucgaagacuugaaaaaugaagaaauggucacuaaucauauggaaggagaacacaagaaacuagcagaggcuauauuuaaacuuaccuaccaaaauaaaguaguaagaguccaaaggcccacaccucguggaacugucauggacauaauaucgaggagagaucaaagaggcagcgggcagguagggaccuacggucucaacacuuucaccaacauggaagcgcaauugauacggcaaauggaaggugaaggaguauucaaaaacauucaacauuuaacugugaccgaagagguugcaguacagaauuggcucgcccgagucgguagggagagauuaucucguauggccauaaguggugaugauugugugguaaaaccgcuggaugacagauucgccaaugcccuaacagcauuaaacgauauggggaaaauucgaaaagauauacaacagugggaacccucaaaagguuggaacgauuggacgcaaguaccauucugcagucaucauuuucaugaacuaauaaugaaggacggaagaguucuaguaguacccugcagaaaucaagaugaguugaucggaagggcaaggauaucucaaggcgcgggcuggaguuuacgggagacugcaugucuaggaaagucauacgcgcaaauguggagucucauguauuuccaucggagggaccuacgacuagcugcaaacgcgauauguucagcaguuccaagucacugggucccaacaagcaggacuacuuggucaauacacgcaaaacacgaauggaugacgacugaggauauguugacaguauggaauagaguauggauacgagaaaacccauggauggaagacaaaacccccguagaaucaugggaggagauaccuuaccugggaaagagggaagaccaauggugugggagucucauaggcuugacaucuagagcuacaugggcaaagaacauacaggcagcaauaaaccaaguaagaagucuaauagggaacgaagaauauacagacuacaugccuucaaugaaaagauuuagaagagaagaagaagaagccggagugcuaugguga

SEQ ID NO: 22504 - RNA, 9876 nt, Artificial Sequence
  derived and/or modified CDS sequence (opt6) from DENV-2__FJ687440__SS-prME
agcgcugggaugauaauaaugcuuauuccaacuguaauggcauuucauuuaacuacaagaaauggugaaccucacaugauaguugguauacaagaaaaaggaaaauccuugcuuuucaaaacagaagaugggguuaauauguguacauugauggcuauggaucucggagaauuaugugaagacacaauuacguacaaaugcccacuauuaagacaaaaugaaccagaagacauugacuguugguguaauagcacaucgaccuggauuaccuacggaacauguacaacaacaggagaacaucgucgagagaaaagaucuguagcauuaguaccacacguuggaaugggacuggaaacucgaaccgaaacuuggaugucuagugaaggagcauggaaacacgcacaacgaauagaaacauggauauuacggcauccaggauuuaccaucauggcggccauccucgcguauacaauaggcacuacgcauuuccaacgcgcccugaucuucauacuucuuacggccguagccccgaguaugaccaugcguugcauagggaucagcaaucgcgacuuuguagaaggaguuucagguggaucauggguugacauuguacuagaacauggauccugcgugacgaccauggcgaaaaacaaaccgaccuuagacuuugaacuuauaaaaaccgaagcaaaacaacccgcuacgcugagaaaauauuguauagaagcaaaauuaaccaauacaaccacugaaaguagaugcccaacccagggagaacccucccuuaaagaagaacaggacaaaagauuuguuuguaaacacaguaugguggaccguggauggggaaacggauguggauuguucgguaaaggaggaaucgucacuugcgcaauguucacaugcaagaaaaauauggagggcaaaauagugcagccggaaaaucuagaguacacuauagugguuacaccucacuccggugaggaacaugcagucggaaaugauacggguaaacauggaaaagagauaaaaguaaccccacaaucgagcauuacagaggcagaacuuacaggguacggaacaguuacuauggaauguuccccuagaaccggauuggacuucaaugaaauggucuuacuucagauggaaaacaaagcaugguugguacacaggcaaugguuccuagaccugccucuaccaugguuaccaggagcagacaaacaagguagcaauuggauucagaaagaaacuuuaguaacauuuaaaaauccccaugccaagaaacaagaugugguaguauuaggaucucaagaaggagcaaugcauacagcccugacaggagcuacagaaauccaaaugucaagugggaaucucuuguucacuggccacuuaaaaugucggcuucgcauggacaaauugcagcugaaaggcaugagcuauaguaugugcacagguaaauuuaaaguaguuaaagaaauagccgaaacacaacauggcacuauuguaauacguguacaguacgaaggagauggaucuccuugcaaaauaccuuuugaaauaauggauuuagagaaaagauacguauuagggcgucugauaacggucaacccaauaguaacagaaaaagauucacccguuaauauagaggcugaaccuccguucggagacucauacauaauaaucggcguugaaccuggacaacuuaaauugaauugguuuaagaaaggaucuaguaucggccaaauguuugaaaccacaaugcgaggugcaaaaagaauggcaauauuaggugacacugcuugggacuuugguagccugggcggaguauuuacuucuauagguaaagcccugcaucaaguauuuggagcaauauacggagccgcauuuucgggggugaguuggacuaugaagauacuuauaggaguuauuauuacauggaucgguaugaacucacggaguacuucauugucagucagcuuaguccucguggguaucguuacucuuuaucuaggaguaauggugcaagccgauucagguuguguuguaaguuggaagaacaaggaacuaaaauguggaagcgguaucuucauaacagacaacguacacacuuggacagagcaguauaaauuccaaccggaaucucccucuaaauuagcaucagcaauacagaaagcucaggaggaggguauauguggcauucgaucagucacaagguuagaaaaucuuauguggaaacaaauaaccccugagcuaaaccauauacuagcugaaaacgaaguaaaacuaacaauaaugacaggggacauaaaagggauaaugcaagcgggcaagagaucccugcgcccacagccaaccgaacuuaaauacagcuggaaaacauggggaaaagcuaaaauguuaucgacugaaucccacaaccaaaccuucuuaauagacggaccugagacagcugaaugccccaauacgaauagagcauggaacuccuuagaagucgaagauuacgguuuuggagucuuuacaacuaauaucugguugaaauuaaaagaaaagcaagaugcguuuugugacucgaaacuuauguccgcugccauaaaagacaauagagcuguccaugccgacaugggguauuggauagaaucugcucuaaaugacacauggaaaauagaaaaagcgucguuuauugaagucaaaaauugccauuggccaaaaucgcauacauuauggucgaaugguguucuugagucagaaaugauuauacccaaaaacuuagcaggacccguaucacaacacaauuaccguccuggcuaccauacgcagauagcaggcccuuggcaccuagggaaacuagagauggauuucgacuuuugugaugguacuacugucauagucacagaggauuguggcaaccgaggcccgagucuaagaaccacgaccgcaagcggaaaauugauuacggaaugguguugccgaagcugcacucuacccccucuuagguauagaggggaagacgguuguugguacggaauggaaauacgaccacucaaagagaaagaagagaaccuuguaaacagucuaguaacagcuggucauggucaggucgauaauuuuucguugggaguacugggaauggcauuguucuuggaggaaauguugcgcacacgcguagggacuaagcacgcgauucuauuagucgccguaucauuuguuacuuugauuaccggaaacaugaguuuuaaggauuuaggaagaguaguaguaaugguaggugcuacuaugacagaugauauagguaugggaguuacauauuuggccuuauuggcugcguucaaaguaagaccuacauuugcagccggauuguuacuacgaaaacugacaaguaaagaauuaaugaugacgacuauugguauuguauuguugagccaauccacaauuccagaaacaauauuagaauuaaccgaugcacuagcacuuggcaugaugguacuaaagauagugagaaauauggaaaaauaucaacuagcaguaacaauuauggcuauacuaugugugccgaaugcagugauacuccaaaacgccuggaaagucucguguacuauacucgcgguaguuagcguuaguccccuacuacucacuucuagucaacagaaaacugacuggauaccacucgcccuaacuauuaaaggucuaaauccgacggcaaucuucuuaaccacacuaucacgaacaaacaagaaaagaucauggcccuuaaaugaggcaauuauggcuguugguauggugucaauucuugcaucaucucuuuuaaagaaugacauaccaaugaccgguccgcuaguagcaggcggacuacucacaguauguuacguucuuaccggcagaucugcggacuuagagcuagaaagggcaacagacgucaaaugggaagaccaagcagaaauaucaggcucaucgccaauauuaaguaucacaauaucggaagauggaucuaugucaaucaaaaaugaggaagaagaacaaacauuaacaauucuaauacggacuggucuacucgucauaucaggacuuuuucccguuaguauuccaauuacagcugccgcaugguacuuaugggaaguaaagaaacaaagagcagggguuuuaugggacguaccaagcccucccccuaugggcaaagcggaacuagaagacggcgcuuacagaauaaaacagaaaggaauacucggauauucccagauaggggcuggaguuuauaaagaagggacguuucacacuauguggcacguaacaagaggagcaguccugaugcauaaagguaaaagaauagaaccgucaugggcugacgucaagaaggaucuuauuucuuauggaggcggcuggaaacuagaaggagaguggaaagaaggagaagagguucaggugcuagcacuagaaccagguaaaaauccucgagcgguacagacuaaaccugguuuauuuaaaacaaauaccggaacuauuggagcgguuucacuagauuuuagucccggaacaucugggagcccuaucauagacaagaaagguaagguuguaggacuguacgguaacggaguaguaacucguucuggggcuuaugucucugcgauagcacaaaccgaaaagucaauagaagauaauccagagauugaagaugauauauucagaaaacgacgucuaacgauaauggacuuacacccaggagcuggcaaaacaaaacgauacuuaccugcgauugugagagaagcaauaaaacgggguuuacggacacuaauucuugcacccacgcggguugucgcagcugagauggaggaagcguuaaggggacugccaauucgcuaucaaacacccgcaauucgugcagagcauacggggagagagauagucgaccuuaugugccacgcaacauuuacaaugagauuacuguccccaguaagaguaccaaacuauaaucuuauaauaauggacgaagcucacuuuacugauccugcaaguauugcggcccgcggcuauauaucuacaagaguagaaaugggcgaggccgcagguauuuucaugacagcaacgccuccuggcucacgagacccuuucccucaaaguaaugccccaauaauugaugaggaaagagaaauucccgaacggaguuggaacuccggacaugaaugggucacagacuucacugguaaaaccgucugguucguaccuagcauaaaggcugguaacgacauugcugcaugcuuaaggaaaaauggcaagaaagucauacaauuaucaaggaagacuuuugacucggaauauguuaaaacaaggacaaaugacugggauuuugugguaaccacugacaucucagaaaugggugccaacuuuaaagcagagagagugauugauccacguagauguaugaagccggucauauuaacagacggagaggagcgagugauauuagcgggacccaugccagucacgcauucaagugcagcccagagacgaggaagaaucggucgaaauccaaagaaugaaaaugaucaguacaucuauaugggugagccucucgaaaaugacgaagacugugcgcauuggaaagaagcaaaaaugcuucuggauaacauaaauacaccagaaggaaucauaccuagcauguucgaacccgaaagggaaaaaguggacgcaaucgacggcgaauaccgacugcguggagaagcgcgaaaaacauuuguagaucucaugaggcgcggagauuuaccuguuugguuagcauacaaaguggcagcagagggaauaaacuaugcagauaggagauggugcuuugacggaaucaaaaauaaccaaauauuggaagaaaacguugaaguugagaucuggacaaaggaaggagagaggaaaaaguuaaaaccaagaugguuggaugcaagaauauacucagauccacuagcauuaaaagaauuuaaggaauuugcugcggggagaaaaucgcugacauugaacuuaauaacggaaauggguagauugccaacuuuuaugacacagaaaacgcgagacgcucucgacaaucuagcagugcuacacacggcugaggcgggaggucgcgcuuauaaucaugcuuugucagaacuaccggaaacacuggagaccuuauuauuacucacacuccucgcgacugugaccggagguauauuucuuuucuuaaugucggggagggguauagguaaaaugacuuuagggauguguuguauaauuacugcgucgauacuacuuugguacgcacaaauacagccacauuggaucgcggccaguauuauauuagaguucuuucuaauagugcuccuuauaccugaacccgaaaagcagaggacaccacaagauaaucagcucacguacguagucauugcaauauuaaccguagucgcugcuacaauggcuaacgaaaugggauucuuagagaaaacgaagaaagauuuaggccucgggaguauagcuacucagcaaccagaaucuaauauucuagacauagaccuucguccggccagugccuggacccuauaugcuguugcaacaacauucgugacgccuaugcuucggcauagcauugaaaacaguaguguuaacguuucacuaacggcaaucgcaaaucaagccacaguucuaaugggguugggaaagggauggcccuuauccaaaauggauauagguguuccguuacuugccauaggauguuacucgcaaguaaaucccauaacccugaccgcugcguuacucuuauuaguggcgcauuaugcaauaauagggccgggacuucaggcaaaagcgacacgcgaagcacagaaaagagcagcagccggcauuaugaaaaauccuacaguggauggcauuacagugauagaucucgacccaauaccauacgacccgaaauucgagaaacaguuaggucaaguaauguugcugaucuuguguguaacacaaguucugaugaugagaaccacgugggccuuaugugaggcuuugacuuuggccaccgguccaauaagcaccuuaugggaagguaacccuggaagguucuggaacacaacuauagcagucucaauggcaaauauauuuagaggaucauacuuggcaggggccggcuuauuauucucaauaaugaagaacacaacgaauacgagaaggggaacuggaaacauuggagaaacucucggggaaaaauggaaguccaggcuuaacgcucucggaaaaagcgaauuucaaauauacaagaaaucugguauucaggaagucgauagaacuuuagcgaaagaaggcauaaagagaggagagacugaucaucaugcaguaucucgagguucugcgaaguugagaugguuuguagaaaggaacaugguuacaccugagggaaaaguagucgaucucggaugugggagggguggauggaguuauuauugcgguggauugaaaaauguaagagaagucaaaggccuaacaaaaggagguccagggcaugaagaaccaauacccaugucuacauacggcuggaaccucguaagauugcaaaguggaguggaugucuuuuucauaccaccugaaaaaugugauacacuuuuaugugauauaggagaaaguagcccaaauccgacaguagaagccggaaggacgcuacgaguuuuaaaucucguugagaauuggcuaaauaauaacacacaauuuugcauaaagguccuaaauccuuauaugccaucgguaauagagaaaauggaagcauugcagagaaaguaugguggugcccuaguaagaaauccauugucccgaaacagcacacaugagauguauugggucucgaaugcguccgggaauauaguaucaaguguaaacaugauaagcagaauguuaauuaacagguucaccaugagacacaagaaagcgacauacgaaccugauguugauuuaggcucaggcacccgaaauauagguauagaaagugaaauaccaaauuuagauauaauuggaaagagaaucgagaaaauaaagcaagaacacgaaacaaguuggcauuaugaucaagaccacccauauaaaacaugggcuuaccacgggaguuacgagacgaaacaaacaggaucagcuucuucaaugguaaacggagucgucagacuguuaaccaaacccugggacguacucccgacaguuacacagauggccaugacugacacgacaccauucggacaacaaagaguuuuuaaagagaaaguagacacaagaacgcaagaacccaaagaggggaccaagaaauuaaugaaaauaacggcagaauggcucuggaaagaacuuggaaagaagaaaaccccgagaauguguacgagggaggaauuuacuagaaaaguacggaguaacgcagcacugggagccauauucacugaugaaaacaaauggaaaucagcucgugaagccguagaagacaguagauucugggagcuaguagacaaagaacgaaaucugcaucuagagggcaaaugugaaacuuguguguauaauaugauggguaaacgagagaagaaauuaggagaguuugggaaagcaaaaggcagccgcgcaauaugguauauguggcugggggcccgcuuccuugaauuugaagcgcuuggauuucuaaacgaagaccacugguucaguagagaaaacucacucagugggguugaaggagaaggacuccauaaauugggauacaucuuaagggacguuagcaagaaagaaggcggagcaauguaugcagacgacaccgcgggaugggacacccgaauaacacuugaagaccuaaagaacgaagagaugguaacaaaucacauggaaggagaacacaagaaacucgcagaagccauauuuaaguuaacuuaccaaaauaagguagugcgcguucagagaccuacuccacgaggaacuguuauggauaucauuucucguagagaccaacguggcucaggccagguagguacauacggauuaaauacauuuacaaauauggaggcucaauuaauaaggcaaauggagggugaaggggucuuuaagaauauucaacaccuuacagcuacugaagaaauugcaguacaaaauuggcuggcuagaguggggagggaaagauuaucacguauggccauaagcggggaugauugcgucguuaaaccucuggaugaccguuuugccaaugcgcuaacagcacuaaacgauaugggaaaaaucagaaaagacauacaacagugggagccauccaaaggcuggaacgauuggacacaaguaccauuuuguucucaccauuuccacgagcuuauaaugaaagaugggcggguccuaguaguaccaugccgaaaucaggacgaauuaauaggaagggccaggaucagucaaggugcaggauggucgcuaagagaaaccgcaugccuagguaaaaguuacgcacagauguggaguuuaauguauuuucaucguagggaucuucgacuugccgcuaaugcuauauguucugcggugccaagccacuggguaccaaccuccagaacgacauggucaauucacgccaagcaugaauggaugacaacagaagauaugcuaacgguauggaacagaguuuggauacgagagaaucccuggauggaagauaaaacuccaguugaaaguugggaagaaauccccuaccuuggcaagcgagaagaccaaugguguggaucacucaucggguugacaaguagagcaacaugggccaaaaauauucaagcagcaauaaaucaggugcgaucauugauaggaaacgaagaauauacagauuacaugccaucaaugaaacguuuuaggagagaagaagaagaggccgguguguuaugguaa

SEQ ID NO: 22505 - RNA, 9876 nt, Artificial Sequence
  derived and/or modified CDS sequence (opt6) from DENV-2__FJ687441__SS-prME
ucugcagguaugauaauuaugcugauuccaaccguaauggcauuucacuuaacuacucguaauggggaaccacauaugauuguugguauacaggaaaaagguaaaucccuuuuauucaaaacugaagacgguguuaacaugugcacacuuauggcaauggauuugggagaauuaugcgaagacacuauaacauacaaaugcccccugcucagacaaaacgaaccggaagauaucgauuguugguguaacucgacaucaacauggauaacauacggaacuugcacuaccacaggagaacauaggagagagaaaagaucuguagcccuuguaccacauguaggaaugggacuagaaacaagaacagaaacauggaugucaagugaaggagcguggaaacacgcacaacguauugaaacauggauucucagacauccugguuucacgauaauggccgcuauucuggccuauaccauaggaacaacacacuuucaacgcgcucuaauauuuauucuacugaccgcgguagcgccaucaaugacaaugagaugcauugguauaaguaaucgagacuuuguagaaggaguaaguggcgggucguggguagacaucguguuagaacauggauccugcguaacaacaauggccaaaaauaaaccaaccuuagauuuugaauuaauaaaaacggaagcaaaacaaccagcaacauuaagaaaauauuguauagaagcuaaacuuaccaacaccacaacugaaagccguuguccaacccaaggggaaccuagucucaaagaagaacaagauaaacguuucguauguaaacauucaaugguagaucggggauggggaaauggauguggacuguucggaaaaggaggcauaguuaccugcgccauguucacaugcaagaaaaacauggaaggcaaaauaguucagcccgagaacuuagaguauacaaucguuguuaccccacacucaggagaagaacaugcgguaggaaaugauacagguaaacacgguaaagagauaaaagucacaccacagucuucaaucacagaagcugagcucaccgguuacggcacuguuacaauggaaugcucaccgcgcacugggcuugauuucaaugagaugguacuacuccaaauggaaaauaaagcauggcuuguccauagacaaugguuuuuagauuuaccgcuuccuuggcugccaggugcagacaaacagggaagcaacuggauucaaaaagaaaccuuggugaccuucaaaaauccccaugcuaagaaacaagaugucguuguuuuaggaucucaggaaggugccaugcacacagcccuaacgggcgcuacagagauucaaaugucgucagguaaucuccuauucacuggacaccuaaaaugccgauugagaauggauaaacuucaauugaaaggcaugagcuauucuauguguacugggaaauuuaaaguagucaaagaaauugcugaaacacaacacggaaccauagugauaagaguacaguaugagggggacggaucaccguguaaaaucccauuugaaauuauggaccuggagaaaagauauguacucggccgacuaauaaccguaaauccaauaguaaccgaaaaagacucuccaguuaauauagaggcagaaccuccauucggagacaguuauaucaucauaggcguugaacccggccaauuaaaacugaauugguucaagaaagguucauccaucggacaaauguucgagacaacuaugagaggugcaaaaagaauggcgauccugggggauaccgcaugggauuuugggucccugggaggaguuuuuacuucgauugguaaagcguuacaucaggucuuuggagccauauauggagcagcauuuagcggugucagcuggacgaugaaaauucuuauaggugucaucaucacauggauaggaaugaauagucgcucuacaucguuaaguguuucucuaguauuaguugguauuguuacuuuauaucuuggcguaaugguucaagcugacaguggaugcguaguaucauggaaaaacaaggaauugaaaugugguaguggaauuuuuauuacugacaauguccauacauggacugaacaguacaaguuccagccggaaucaccaucuaaauuagcgagugccauacaaaaagcgcaggaagaggggauuuguggcauucguuccgucacacgcuuagaaaauuugauguggaagcaaauaacaccagaauuaaaccacauacuagcagaaaaugaaguuaaacuuacuaucaugaccggggacaucaaagguaucaugcaagcuggcaaaagaucauugagaccacaacccacggaacuaaaauauucguggaaaacuuggggaaaagcaaaaaugcuaucaacggagucccauaaccagacuuuccuuauagacggcccggagacagcagaaugcccuaacaccaauagagcguggaacagucuugagguggaagauuauggguuuggaguauucacaacgaacauauggcuaaaguugaaggagaaacaagacgcuuuuugcgauucaaaacucaugucagcagcaauuaaggacaauagagccguacaugcagauaugggcuauuggauugaaagugcgcucaaugauacuuggaaaaucgaaaaggcuucuuuuauugaagucaagaauugucauuggccuaagucacacacacucuggagcaacgggguucucgaauccgaaaugauaauacccaaaaaucucgcuggaccaguaucucaacauaacuauagaccuggauaccauacucaaauagccggacccuggcaucuaggaaaauuagaaauggauuuugauuuuugcgacggaacaacaguuauaguaacagaggauugcgguaaucgugguccaagucuaagaaccacuacagcuucaggaaagcucauaacagaaugguguugucgaucuuguacguuaccuccucuccgauacagaggggaagaugguugcugguaugguauggaaauacggccguuaaaagagaaagaagagaauuuaguaaacagccuagugaccgccggccauggacaagucgauaacuuuaguuuagggguucugggcauggcucuuuuccuagaagagaugcuaagaacaagaguaggcacaaaacaugcgauccuauuaguagcaguaaguuucgugacgcuaauaacaggcaacaugaguuucaaagauuuaggucggguagucguuaugguaggggcuaccaugacagaugacauugggaugggagugacguaucucgcacuauuagcagcuuuuaaagucaggccaacguuugccgcagggcuauuguugagaaaauuaaccucaaaagaauuaaugaugacaaccaucggaaucguauuauugucacaaagcaccauaccugagacuauauuagaacuaacagaugccuuggcucuagggaugaugguguuaaaaauaguucguaauauggaaaaauaccaguuagcugugaccauuauggcaauucuauguguuccuaaugcgguaauucuacaaaacgcauggaagguuucuugcacaauccuugcuguaguuaguguuucgccauuacucuugacaagcagccaacagaaaacugauuggauuccauuggcuuuaacuaucaaagggcuaaacccaacagcaauauuuuugacaacucuaagccggacaaauaagaaacgaucuuggccacuaaaugaggcaauuauggcuguggguaugguaaguauauuggcgaguagccuucuuaagaaugauauacccaugacagguccguugguugccggcggacuacugacaguauguuauguacuuacuggaaggucagcagaucuagaauuggaacgggcaacagauguaaaaugggaagaucaagcagagauaaguggaaguucaccuauauuaagcaucacgauaucggaagacgguucgaugagcauaaagaaugaggaagaagaacaaacccugacgaucuuaaucagaacaggacuauuaguaaucucuggacuauuuccagugucaauuccuauuacagcagcagcgugguaucucugggaagucaagaaacaaagagcgggagugcucugggauguaccaagcccgccaccaaugggaaaagcagagcuagaagauggagccuacaggaucaaacagaaggggauucuuggauacucacaaauaggagccggagucuauaaagaggggacuuuucauacaauguggcacguaacaagaggcgccguuuuaaugcauaaaggcaaaagaauagagccaagcugggcagacguaaagaaagaucugaucucauauggagguggguggaaauuagagggagaguggaaagaaggcgaagagguacaaguauuagcucuugaaccggguaaaaacccccgggccguacaaacuaaaccgggacuauuuaaaaccaacaccggaacgauaggagcugugaguuuagacuuuucuccuggcacuucuggaucgccuauaauagauaagaaagggaaaguagugggcuuauauggaaacggugucguuaccaggucuggagcauauguaucagccauugcacaaacugagaaaaguauagaagauaaucccgagauagaagaugauauauuuagaaaacgaaggcuaacaauaauggaucuacauccaggagcugggaaaaccaagagauacuuaccagcaaucgucagagaggcgauaaaacgaggauuacgaacgcuaauacuagcaccaacaagaguuguggcagcagaaauggaagaagccuugagaggacuaccgauaagauaccaaacaccggcuauaagggccgaacacacgggaagagaaauuguagaucugaugugucacgcaaccuuuacaaugcgcuuauuaucuccugugagggucccaaauuacaaucuaauaauuauggacgaagcucacuucacagacccggccaguauagcggccagagguuauauaagcacgagaguagaaaugggugaagcggcagggauuuuuaugacugccacacccccaggaagucgggacccuuucccacaauccaaugcuccuauuauagacgaagaacgagagauaccugagagauccuggaacagugggcaugagugggugaccgauuucaaggguaagaccguaugguuuguaccaucaaucaaagcgggcaaugacaucgcggcuugucuacgaaagaauggcaagaaagucauacaacugucuagaaagacauucgauucagaauacguaaagacacgaacaaaugacugggauuuuguuguaacaacagacauuucugaaaugggcgcaaauuuuaaagccgaacgcgugauagauccuaggcgcuguaugaaaccaguuauacuaacagacggagaagaaagaguaauacuagcaggucccaugccuguaacgcauaguucugccgcccaaaggcgaggccguauuggaagaaaccccaaaaaugaaaaugaccaauauauauacaugggggaaccgcuagagaaugaugaagauugugcucauuggaaggaggccaaaaugcuucuagauaauauaaauaccccagaagguauuauccccagcauguucgagccagaacgagagaagguggaugcaauugacggagaauauagauuacgaggcgaagcacgaaaaacauuuguggacuuaaugagaagaggggauuuaccggucuggcuagcguauaaagucgcggcagaagguaucaacuacgcagaucguagguggugcuuugacgggaucaaaaauaaccaaauauuagaggaaaacguggaagucgagauuuggacaaaggaaggagagaggaagaaacuaaaaccaagauggcuugaugcucguauuuauagcgacccauuagcccuaaaagaauuuaaggaguuugcggcgggaaggaaaucauuaacccucaaucuuauuacagagauggguagacucccgacauuuaugacucagaaaaccagagaugccuuagauaacuuagccgucuuacacacagcugaagcgggcggcagggcauauaaucaugcacuuagugaauugccugagacacuugaaacucuauuauuauuaacgcuguuagccacggucaccgguggaauauuucucuuucuaaugagugggagaggaauagggaaaaugacacuuggaaugugcuguauuauaacggcuucuauauuacucugguacgcccaaauacaaccacauuggaucgcugcaucaauuauacuagaguucuuucuaauuguuuuacuuauuccugaaccagaaaagcaaagaaccccacaagacaaucaauugaccuacgucguaaucgccauucuuacagucguagcagcaacgauggcuaaugaaauggguuuccucgagaaaacaaagaaagauuugggacuagguaguauugcuacacaacagccugaaagcaauauucuugauauugauuugcgacccgcaagugcauggacacuauacgcgguugcaacaaccuuugucacuccgaugcuacgacauaguauagagaauagcucuguuaauguuagccugaccgccaucgccaaccaagcaaccgugcuaauggguuuaggcaaaggcuggccauuaucaaaaauggauauaggcgugccacuacuagccaucggauguuauucacaagugaacccaaucacccuaacagcugcucuacuacugcuagucgcucacuaugcuauaauaggaccugguuuacaagccaaagcaacgagagaagcccaaaagcgcgcagcugcugguauuaugaaaaacccaacuguagacggaauaacaguaauugaccuagauccaaucccuuaugauccaaaguuugaaaagcagcuaggacaaguaaugcuucugauucuaugcguuacacaaguauugaugaugagaacaacaugggcacuaugugaggcccuuaccuuagcuaccgggccgauaucaacacuuugggagggaaacccuggccgguucuggaauacaaccaucgcgguuaguauggcgaacaucuuucgggggucuuacuuggcuggcgcggggcuacuauuuuccauaaugaagaauacuacaaacacgaggcguggaaccggaaacauaggagagacgcugggggaaaaauggaagucaagguuaaaugcacuugguaaauccgaauuucaaauuuacaagaaaucugggauucaagaaguagacagaaccuuagcaaaagaaggcauaaaacgaggcgaaacagaccaucacgcaguaagccguggaucggcaaaauuaaggugguucguagaaaggaauaugguaacaccagaaggcaaaguaguugaccuagguuguggucgaggaggauggaguuacuauugcggcggucuaaagaauguaagagaaguuaaaggucucacaaaagguggaccaggucaugaagaaccuaucccgaugagcaccuauggauggaaucugguuagauuacagaguggagucgauguuuucuuuauaccaccagaaaaaugcgauaccuuacuuugcgauaucggggaaagcucucccaacccuaccgucgaagcagguaggaccuuacgaguucuuaacuuaguggaaaacugguuaaacaacaacacacaguuuugcauaaaaguccuuaauccauacaugccgucuguaauugaaaagauggaggcuuuacaacgcaaauacggaggagcauuaguacgaaacccuuugagcaggaacucuacccaugagauguauuggguaucaaacgcaagugggaauauagucaguagugugaauaugaucucacggaugcuaauuaauagguuuacuaugagacauaagaaagcuacauacgaaccugacgucgacuuaggcucaggaacgcgaaauauagggauagaauccgagaucccuaauuuagacauaauuggaaaacggauagagaaaauuaaacaagaacacgaaaccucauggcacuacgaccaggaccaucccuauaaaacaugggcguaucauggguccuaugagacaaagcaaacagguucggcaucaagcaugguaaacggcguaguacgcuuacuuacgaaacccugggacgucuuaccaacggugacgcagauggcuaugaccgauacaacaccguucggacaacagcggguauucaaagagaaaguugacacaaggacacaggagcccaaagaaggaacgaagaaacucaugaaaaucacagcugaaugguuauggaaagagcuaggcaaaaagaaaacuccaagaauguguacgagggaagaguuuacucgaaaaguacgaaguaaugcggcacucggggcuauauucacggacgaaaacaaauggaaaucugccagagaagcaguggaggacucaagauucugggagcuuguugauaaagagagaaacuuacaccuggaggguaagugcgaaaccugcguguauaauaugaugggaaaacgagaaaagaaauuaggggaauuuggcaaagcaaaaggcaguagggcaaucugguauaugugguuaggcgcucgauuuuuagaguucgaggcuuuaggauuuuuaaaugaagaucauugguuuucacgggaaaauucguuaagcggaguagaaggagaggguuuacacaaauuaggcuacaucuuacgugacguaagcaagaaagaaggcggggcgauguaugcugacgauacugcagguugggauacaaggaucacauuggaagauuugaaaaacgaagagaugguaacgaaccauauggaaggagaacacaagaaauuagcagaggcuauuuucaaacuaaccuaucaaaauaaggugguacgaguacagcguccaacgccaagaggaacaguuauggacauaauaucacgcagagaucagcgcggaaguggacagguagggaccuauggccuaaacacuuuuacuaauauggaagcucagcucauaagacaaauggagggggaagggguauuuaagaacauacaacaucuaacggccaccgaagagauagcuguucagaacuggcuugcacgagucggacgggagaggcuuucaagaauggcaaucucaggugacgauugcgucguaaaaccccucgaugaucguuuugcgaacgcauuaacugcucuuaaugauauggguaaaaucagaaaagacauucaacaaugggaaccaucaaagggauggaaugacuggacccaagucccguuuuguucacaucauuuucaugagcuaauaaugaaagauggccgagugcuaguagucccaugcaggaaccaagacgaauugauaggacgagcuagaauuagccagggcgccgguuggucccugcgugagacagcauguuuaggcaaaucauaugcucaaauguggucacugauguauuuucaccgacgcgacuuaagacuagccgccaaugcaaucugcucagcaguucccucucacuggguaccuaccaguagaacuacuuggucaauucacgccaaacacgaauggaugacuacagaggacauguugacaguauggaacagaguuuggauucgggaaaaucccuggauggaggauaagacgccggucgaaucaugggaggaaauuccauaccuaggaaaacgagaagaucaaugguguggaaguuuaauuggacucacaaguagggcaacgugggccaaaaauauacaagcagcgauuaaccaagugcgcucgcuuaucggcaacgaggaauacacagauuacaugcccucuaugaaaagguuuagaagagaagaagaagaggcuggaguuuuaugguaa

SEQ ID NO: 22506 - RNA, 9876 nt, Artificial Sequence
  derived and/or modified CDS sequence (opt6) from DENV-2__FJ687445__SS-prME
aguguuggaaugauuauaaugcuaauuccgacagucauggcuuuucauuuaaccacccgaaacggagagccacacaugauugugagcauccaagagaaagggaaaagucuuuuguucaaaacggaggauggagugaauaugugcacauugauggccauggacuuaggugaacuaugcgaagacacuaucacuuacaaauguccacucuugagacagaacgagccagaggacauagauugcuggugcaauuccacuagcaccuggguuaccuaugguacaugcaccacaacuggagagcaccgucgagagaaaaggaguguagcauuggucccucacguuggaaugggucuagaaacaaggacugaaacauggaugagcagcgaaggcgcuuggaaacacgcccaaagaauagagacauggauacugagacauccuggcuuuaccaucauggcagccaucuuggcuuacacaauaggcacuacacacuuucaacguacucuaauauuuauuuuacugacggcgguagcaccaaguaugacaaugcgauguauagguaucucaaauagagacuucguagagggcgucucgggcggaagcuggguagauaucguguuagaacacggcagcuguguaacuacaauggcaaagaauaaaccuacucucgacuuugaacuaauaaaaacugaagcuaaacaaccagcgacucuaagaaaguacuguauagaagcuaaacucacaaauacgacuacagaaucacgaugcccgacacaaggagaacccagucuaaaggaagagcaggacaaaagauucguauguaaacauaguauggucgauagaggauggggcaaugguugcgguuuguucggaaaagguggaaucgucacuugugcaauguuuacaugcaaaaagaauauggaagguaaaauaguccagccagaaaacuuggaauauaccauuguugugacaccacacagcggugaggaacaugccgucggaaacgacacggguaaacacgggaaagaaauaaaggugacaccucaaagcucgauaacugaagcggagcuaacuggauacgguacggugacaauggaauguucgccuaggacugguuuggauuucaaugaaaugguauuguuacagauggaaaauaaggccugguuaguucauagacaaugguucuuagaucuuccucugccuuggcuaccaggagcagauacucaaggguccaauuggauucagaaggaaacucuaguaacuuucaaaaacccucaugcuaaaaagcaagauguaguuguguugggaagucaagaaggcgcaaugcacacagcguuaaccggagccacugaaauccaaaugucaucagguaaucuuuuauuuacuggccaccucaaauguagauuaagaauggauaaacuucaauuaaaaggaaugucauacaguauguguacagggaaauuuaaaguaguaaaagaaauagcggaaacacaacacggaacaauaguaauaaggguucaauacgaaggggaugggucuccaugcaaaauaccuuucgaaauaauggaucuugagaaaagauauguacuugguagacuaauuacagucaacccaauagugaccgaaaaggauagcccagugaauaucgaagcagagcccccuuucggagauucauauauaaucauagggguagaaccaggccagcucaaguuaaacugguuuaaaaagggcucuucuauagggcaaauguuugagacaacgaugagaggagccaaacgaauggcaauauuaggagacacagcuugggacuucggaucauuaggaggaguauucacaaguauaggaaaagcacugcaucaaguauuuggagcuauauauggagcugcauuuagcggaguuagcuggacaaugaagauauugauuggugucauuauaacauggauagguaugaauucccgguccacgagucuaaguguaagucugguauuaguugggguugucacucuuuaucuaggaguuaugguccaagcagauucggguugugugguaucauggaaaaacaaagaacuaaaaugcggaagugguauuuuuaucacagauaacguccacacauggacagaacaauacaaauuucaaccagaaagcccaucaaaguuagcuucagcaauacaaaaggcacaagaagagggaauuugugguauacguagcguaacccgguuagaaaacuuaauguggaagcaaaucaccccagaguugaaccauauucuagcugagaaugaaguaaaguuaacgaucaugacgggcgacauaaaaggaaucaugcaagcagguaagagaagccucaggccgcaaccaacugaguuaaaguauaguuggaaaaccugggguaaggcgaaaauguuaucaacggaaucccacaaccaaacauucuugauugauggaccggaaacagcggaguguccaaauacuaauagggcuuggaacucccucgaaguggaagacuacggguucgguguauuuacaacaaacauauggcuuaaacucaaagagaagcaagaugcguuuugcgacagcaaguuaaugagugcagcuaucaaagauaaccgggcggugcacgccgauaugggcuacuggaucgagucagcguugaacgacacuuggaaaauagagaaagcgagcuuuaucgaaguuaaaaauugccauuggccaaaaucucacacacuguggagcaauggagugcuagagagugaaaugaucauuccaaaaaacuuagcagguccaguaucacagcauaauuauagaccaggauaucauacacaaauagcugggccuuggcauuugggaaaauuagaaauggauuucgacuuuugcgacgggacuacagucguagucacagaagacugcgguaaccgcggcccaagucuaaggacuacaacagcaucggguaaguuaauuacagagugguguuguagaaguuguacucugccaccacucagguaucggggugaagacggaugcugguauggaauggaaaucagaccacucaaagaaaaagaagagaaucuaguaaauucauuagucacagcagggcauggacaagucgauaacuucucuuuagguguuuuagguauggcauuauuuuuagaagaaaugcugagaacacgcguagguacuaagcaugccauauuauugguagcuguuucauuuguuacccuaauaacuggaaauaugucuuuuaaggaccugggucgugucguaguaaugguuggggccacaaugacugaugacauaggaaugggcgugacuuauuuagccuuacuagcagcuuucaaagugcgcccuacauucgcugcaggcuuguuccuaagaaaauuaacuucuaaagaacuaaugaugacaacuauaggaauuguauuguuaagucaaaguacgauuccagaaacgauucuagaauuaacggaugcgcucgcacuaggaaugaugguucuuaaaauggucagagacauggagaaauaccaguuggcuguaacuaucauggcaauuuuaugcguacccaaugcugucaucuugcaaaaugcauggaaggucucauguacaauacuagccguagugucuguuagcccucuccuguuaacgagcagucaacaaaaaacggacuggaucccucuagcgcucacaauuaaaggacuaaacccaacugcgauauuucucacaaccuuaucaagaacuaacaaaaaaaggaguuggcccuuaaacgaagcaauaauggcaguaggaauggucuccauuuuggcaaguucucucuuaaaaaaugauauaccuaugaccggcccuuuaguggcagggggucuccugaccguauguuauguguuaacaggaaggucagcagaucuagaacuugaaagggccacagacguaaaaugggaagaccaggccgaaauuagugggucgagcccaauauugagcauaacuauaucagaagaugguucaaugucgauaaagaaugaagaagaagaacaaacauuaaccauacuaauacgcacgggucuucuaguaaucucaggacuauuuccugugaguauacccauaacagcagcagccugguacuuaugggagguaaaaaaacagcgagcuggagugcucugggacguccccagucccccgccaaugggcaaagcagaacuggaagacggcgcauaccgaauaaagcagcgaggaaucuuaggauacucacaaaucggagcggggguuuauaaggagggaacuuuucacacuauguggcauguuacgagaggcgcgguucuaacccauaaaggcaagcguauagaaccaucaugggccgauguuaagaaagauuuaauaaguuacgggggaggauggaaacucgaaggcgaauggaaggagggagaagaggugcaaguacuugcccucgaaccagggaaaaacccacgugcgguucaaacuaaaccaggauuguucaagacaaauacaggcacaauaggugccgugaguuuagauuuuucacccgggacuucagguaguccuauaauagacaaaaaaggaaaagugguuggccuauacggaaaugguguuguaacgcgaucaggcgcuuaugucucggcaauugcucaaacagaaaaaaguauagaggacaacccagacauugaagaugacauauuuagaaaaagaagauugaccauaauggacuuacauccuggggcaggaaaaacuaaaagauauuuacccgcuauagugcgagaagcaauaaaaagaggacuaagaacucuaauauuggcucccaccaggguuguugcugcagaaauggaggaggcucugcgugguuuacccauacgauaccaaacaccagcuauaagagccgagcacaccgggagggaaauaguagaccuaaugugucacgcaacauuuaccaugcgccuacucaguccggugagaguuccuaauuauaaccuaauaauuauggaugaagcacacuuuacugacccagcaucgauagcggcgaggggauacauuucaacaagaguggagaugggggaagccgcaggcauuuucaugaccgcuacgccaccaggaucaagggauccguuuccacaaucuaaugcacccauaauagacgaggaacgagaaauaccagaaagaucguggaacucgggccaugaauggguuacagauuuuaaaggcaaaaccguuugguuuguuccaucaauaaaagcugggaaugacauagcagccugucuuagaaaaaacgguaaaaagguuauacaacuaucacgcaaaacauuugacucugaauauguaaaaacgagaacgaacgacugggauuuuguaguaacaacagacauaucggaaaugggugcgaacuuuaaagccgaacgaguaauagauccacguagaugcaugaaaccugucauacuaacugauggagaagaaagggucauucuagcgggacccaugccagucacucauuccucugcagcacagagaagaggaaggauaggucggaacccuaaaaaugaaaacgaccaauauauauauaugggugaaccucuagaaaaugaugaagauugcgcccacuggaaagaagcuaaaaugcuccuugacaauauuaauacgccggaaggaauaauucccucgauguuugaacccgaacgugaaaaaguggacgcuauagauggugaauauagacucaggggcgaagcgagaaaaacauuuguagaucuuaugagaaggggcgaccugccuguaugguuggcuuauaagguagcagcagaagguauuaacuacgcagauaggcgguggugcuucgauggaauuaaaaacaaccaaauauuagaggaaaauguagaaguagaaauauggaccaaggaaggugaacggaaaaaacucaaaccuagaugguuggacgcgagaauauacagugauccauuagcacuuaaagaauucaaggaauuugcugcugguagaaaaucacucacacuaaaccuaauaacggaaaugggaagguugccaacauuuaugacucaaaaaacucgagacgcuuuagacaaccuggccgugcuacauaccgcggaagcaggugggagagcuuacaaccacgccuuaagugaacuuccugagacacuugagaccuuauugcuccuuacccuauuggcaacagucacuggagguaucuuucuuuuucuuaugagcggcagggguaucggaaaaaugacauugggaaugugcuguauugugacugcuucgauauuguuaugguacgcacaaauacaaccacauuggauagccgccagcauuauauuagaauucuuucugaucguauugcuuauaccagaaccagaaaaacaacggacgccacaagauaaucagcuuacauauguuguuauugcuauuuuaacuguaguagcagcuacaauggcaaaugaaaugggguuccuugaaaagaccaaaaaagaccuuggucuagguucaaucgcuacucaacagcccgagucuaauauuuuggacauugaccuacgucccgccucugcauggacacucuaugcggucgcaacaacuuucgucacuccaauguuaagacauucaauagaaaacucuagcguaaauguauccuuaaccgcuauagccaaucaggcaacaguacugaugggucuuggaaaagguuggccauuaaguaagauggauauaggcgcaccauuauuagcaauuggcugcuauagucaaguaaacccaauuacacucacagcagcuuuguuauugcucguggcacacuaugcaaucauagggccuggucuccaagcuaaggcaacaagggaagcacaaaaaagagcagcggcaggaauaaugaaaaacccaacaguagaugguaucacaguaauugacuuggacccuauaccacacgauccuaaguuugagaaacaguuaggacaaguaaugcuccugguauuauguguuacucaaguacuuaugaugcgaacuacuugggcauuaugugaagcacuaacccuggcgacgggacccaucucgacucuuugggaagggaauccaggcagguucuggaacacaaccauugccgugaguauggccaauauuuuucgagggucauacuuagccggugcaggccuacuauuuagcauuaugaaaaauaccacaaacucucgaaggggaacaggcaauauuggagaaacauugggggagaaauggaaaucucgccuuaacgcauuagguaagucggaauuccaaauuuauaaaaagaguggaauucaagaaguugauaggacuuuagcgaaagagggaaucaaaaggggagagacugaucaccaugcggucucucguggaucugcuaaauuaagaugguucguggagcguaacaugguaacaccagaggguaaaguaguagaccucggauguggaagaggugguuggaguuacuacugugguggacucaaaaauguucgagagguaaaaggcuugacaaagggagguccuggccacgaggaaccgauaccaaugaguaccuacggauggaaucuaguuagauuacaaucaggaguugacguguuuuucaucccaccagaaaaaugcgauacccuccuaugcgauauaggagagucaagucccaauccuacuguagaagcaggucgaacgcucagaguacuaaaccuuguugaaaauuggcugaauaauaauacucaauuuugcauuaaaguguuaaauccuuauaugccuucagucauugaaaaaauggaaacuuuacaaaggaaguauggaggggcacuaguacgaaauccgcuuucccguaacagcacucaugagauguacuggguaaguaaugcaagugguaacaucguauccagcguuaauaugauaucucgaauguugauaaaucgauuuacuaugaggcacaaaaaagcaaccuaugaaccagacgucgacuuagguucugguacaagaaauauagguauugaaucagaaauaccaaauuuagauaucauagguaaaaggauagagaagauuaaacaagaacacgaaacauccuggcauuacgaccaagaucacccuuauaagacaugggcuuaccaugguuccuaugaaacuaagcaaaccgguagcgcaucguccaugguaaaugguguaguaagacuucuuacuaagccuugggaugucuugccaacaguaacacaaauggcaaugaccgauacaacaccguuuggacagcagagaguauucaaagaaaaaguagauacgagaacucaagagccaaaggagggcacuaagaaauuaaugaaaauuacugcagaauggcuuuggaaagagcucggaaaaaaaaagacgccuagaaugugcacacgagaggaauucacgcgaaaaguccguaguaaugcugcacugggggcgauauuuacggacgaaaauaaauggaagagugcaagagaagcuguggaagauagccguuuuugggaguugguugacaaagaaagaaaccuccaccucgaagggaaaugcgaaacaugcguguacaauaugauggguaaacgagaaaaaaaacuaggugaauucggaaaggcuaaaggaucccgugcaauuugguacaugugguuaggagcuagauuucuugaguucgaagcuuuaggauuuuuaaacgaagaccauugguuuaguagagaaaauagcuuauccgguguugaaggggaaggccugcaucgguugggguauauucuaagggacguuuccaaaaaagaagguggcgccauguacgcagaugauacggcugguugggacacaagaauaacauuagaagacuugaaaaacgaagaaaugguaacgaaccauauggaaggugaacauaagaaauuagccgaagcaaucuucaaguuaacauaccaaaauaaagugguaagaguucagagaccaacaccuaggggcaccguaauggauauaauuagcagaagggaucaaaggggaaguggucaaguggguacuuacggacuuaauacguucacaaacauggaagcacaacuuauaagacaaauggaaggagaaggggucuuuaaaaauauacagcauuuaacgguaaccgaggaaauagcaguacagaauugguuagcacgaguaggaagagaaagauugucuaggauggcaauaaguggggacgauuguguaguaaaaccacuugaugacagauucgcaucugccuuaacugcauuaaaugauaugggcaaaauacgaaaagacauacaacagugggaaccaucccggggcuggaacgacuggacacaaguucccuucuguagucaccacuuccaugaacuuauaaugaaagaugggcgaguuuugguaguaccuugucgcaaucaagaugaauuaaucggaagagccagaaucucacagggggcuggauggagucuucgcgagaccgcaugccuaggcaaaucauacgcacagauguggucuuuaauguauuuucacagacgcgaucuuagauuggccgcaaaugcgauaugcagugcaguaccaucucauugggugccuacaucuagaacuacgugguccauucaugcuaaacaugaauggaugaccacggaagauaugcuaacgguguggaaucgaguauggauacaagaaaauccauggauggaagauaaaacaccggucgaaaguugggaagaaauacccuauuuaggcaaacgggaagaucagugguguggaucccugauaggauuaacaagccgagcgacuugggccaaaaacauacagguugcaauuaaccaagucaggucccugaucgggaaugaagaguauaccgauuauaugccaagcaugaagagauuuaggcgggaggaagaggaagcaggcgucuuaugguga

SEQ ID NO: 22507 - RNA, 9876 nt, Artificial Sequence
  derived and/or modified CDS sequence (opt6) from DENV-2__FJ687447__SS-prME
ucugcaggaaugauaauaauguugauuccaacuguuauggcauuccauuuaacaacaagaaacggugaaccucauaugauuguaggaauccaagaaaaaggaaaaucauuacuauuuaaaacggaagacggaguuaacaugugcacucucauggcaauggauuuaggugaacugugugaagauacaauuacguauaaauguccacuauuacgacaaaaugaaccagaagacauugacugcugguguaauagcacaucgacuuggguuacauauggaacuuguacuacuacgggagaacauagacgagaaaaacguagcguagcucuugucccacauguaggaauggguuuagaaacaagaacagaaacuuggaugagcagugaaggagcguggaaacaugcgcaacgaaucgaaacauggauccucagacauccagguuucaccauaauggcggcaaucuuagcguacacuaucggaaccacgcacuuucaaagagcacuaauauuuauacuauuaacagcggucgcuccgagcaugacuaugcguugcaucggaauuucaaaucgcgauuuuguagaaggaguaagcgguggcagcuggguugacauuguauuagagcauggaucuugcguuacuacaauggcuaaaaacaaaccaacacuugauuuugaacuuauaaaaacagaagcaaaacagcccgcaacuuugcguaaauacuguauugaagcuaaacucaccaauacgacaaccgaaaguaggugcccgacccagggagaaccaagucuaaaagaggagcaagacaaacgauucguuuguaaacauaguaugguagauaggggauggggaaauggaugcggauuauucggaaaaggcggcauaguuacaugugcaauguucacuuguaagaaaaauauggaagggaaaaucguccaaccagaaaacuuagaguauacaauagugguuacuccucauucuggcgaagaacacgcaguugguaaugacacuggaaaacacgguaaagaaaucaaagucacaccacagaguucaauaacagaggcagaacuaacuggauacggcacaguuacaauggaauguucgccucguacaucuuuggauuuuaaugaaaugguauuacuacagauggaaaacaaagcaugguuaguacauagacaaugguuucuggaucuaccauugccauggcuaccuggcgcggacaaacaagaaucaaacuggauccagaaagaaacacuuguaacuuuuaaaaauccacacgccaagaaacaggauguuguaguccuuggaucccaagaaggggcaaugcacacugcacucacaggagcuacugaaauucaaaugagcucaggaaauuuguuguuuacaggucauuuaaaaugcagacuccguauggacaagcuacaguugaaaggaauguccuauaguauguguaccgguaaauuuaagguugucaaagaaauagccgagacacaacauggaacaaucgucauaagaguccaguaugaaggugaugggucgccauguaaaauuccuuuugaaaucauggaucuagaaaaacgauacgugcuugggagacuaaucacagugaauccuauaguaacagagaaagacucaccagugaacauagaagcagagcccccguucggugacaguuauauaauuauuggagucgaacccggucaauuaaaacucaacugguucaagaaaggaucaagcauuggacaaauguuugagaccacaaugcguggagcaaagagaauggcaauuuuaggcgauacggcgugggauuuugggagucucggaggcguuuuuaccagcaucggcaaagcacuucaccaaguauucggagcuauauauggagcagcauuuaguggagucucguggacuaugaaaauucuaaucggcgugauaauaaccuggaucggcaugaacuccagaucgacaucccucagugugagcuuagucuuagugggaauaguaacuuuguauuuaggaguuaugguacaggccgacucuggaugugucguaagcuggaaaaauaaagaacugaaaugcgguucagggauauuuauaacugauaauguacauacauggacagagcaauauaaauuccaaccugagucacccucuaagcuggccucagcaauccaaaaagcacaggaggaagguauaugugggauuagaagcguuacuaggcuugaaaaccuaauguggaaacaaauuacuccagaacugaaucauauuuuagcugaaaaugaaguuaaacuaacuauaaugaccggagauauaaaaggaauuaugcaagcaggaaaacgaucacuucguccccaacccaccgaacucaaauacucuuggaaaacaugggggaaagccaagauguuaaguacugaaagcuacaaucaaacauuccucauagacggccccgaaacagcagaaugcccaaacacaaaccgagccuggaacagcuuagaaguagaagacuacggcuuuggggucuucaccacaaauaucuggcuaaaguuaaaagagaaacaagacgccuuuugugauaguaaacuaaugucggcagcgauaaaagacaacagagcgguacacgcagauauggguuauuggauugaaagcgcgcuuaacgacacuuggaaaauagagaaggccagcuuuauagaagucaaaaauugucauuggccaaaaucgcacacacuguggucuaacggaguauuagagagugaaaugaucauaccuaaaaaucuugcgggacccguuucgcagcauaacuaucgaccagguuaccacacucagauugcaggaccuuggcaccucggaaaauuagagauggauuucgauuucugcgauggcacuaccguuauuguuacggaggacuguggcaaccgaggaccuucuuuaagaacaacuacggccucuggcaaauuaauaacagaauggugcuguaggucaugcaccuuaccaccccuaagauaccgaggggaagauggauguugguaugggauggaaaucaggccccuaaaagagaaagaagaaaacuuaguaaauucguuagugacugcaggacacggacagguagauaauuuuucuuuggguguauugggaauggcuuuguuucuugaagaaaugcugagaacacguguuggaacaaaacacgcaauauuauugguagccgucagcuucguaacacugauaacugggaauaugucauuuaaagaccuuggacgaguuguagugaugguaggcgcaacuauggcagaugauauagggaugggcgucacuuacuuggcucugcucgcagcguuuaaagucagaccaacauuugcagcagguuuacugcugcgaaagcucacaucuaaagaacuaaugaugaccaccaucggcauaguacuucucucccaaucuacaauuccagaaacuauuuuagaauuaacagaugcgcuugcuuuaggaaugaugguauuaaaaaucguaagaaauauggaaaaauaucagcuugcaguaaccauaauggcuauauuaugcgucccgaacgcaguuauccuccaaaaugcuuggaaaguaagcugcacuauucucgcgguaguaucagucuccccacuucuacugaccaguucccaacaaaagaccgacuggauuccucuugcauuaaccaucaaaggucuaaacccgacagcgauuuuucuaacuacauuaucacguaccaauaagaaaagaaguuggccacugaacgaagccauaauggcagucgggaugguaucuauccucgcuucaagccuccucaaaaacgauauaccuaugacaggcccauuaguugcaggagguuuauuaacagugugcuaugugcugacugggcgaucggcagaccuagaacuggaaagagcaaccgacgucaaaugggaagaccaagcggagaucucaggcucaagucccauacuaaguauuacgaucucagaagacggcucuaugaguauuaagaacgaagaagaagaacaaacauugacgauccugauucggacuggauuauuaguuauauccggucucuuucccauauccauaccaauuacugccgcagcuugguauuuaugggaggucaagaaacaaagggcaggaguccuuugggacguaccaucgccuccaccaauuggaaaagcggaacucgaggacggagcguauagaauuaagcagaaaggcauucuugguuacagucaaauuggagccggaguauauaaagaaggaacauuucacacaauguggcauguaacccgaggcgccguccuuaugcacaaaggcaaacgcaucgagccgucaugggcggacgugaagaaagauuuaauaagcuacgggggaggauggaaacuagagggcgaguggaaggaaggcgaagagguacaaguucuugccuuagaaccagguaaaaauccgagagcaguacaaacuaaacccggguuguucaaaacaaauacagguacaauuggagcuguaagccuagacuuuagcccaggaacaucuggcucaccuaucauagauaagaaaggaaaagucgucggcuuguaugggaacggcguaguaacgagguccggugcauauguuucagcuauagcacaaacagaaaaauccauagaagauaauccagaaauugaggacgacaucuuuagaaaaaggaggcuaacgauaauggacuugcauccgggugcagguaagacuaagcgcuaucugcccgcaauugugcgugaggcaauaaaaagaggccuaagaacucuaauuuuagcgccuacucgagucguugcugcagaaauggaggaggccuuacgcggcuuaccaauacgguaucagacaccagcaauacgcgcugagcacacugggcgggagauuguugaccuuaugugucaugcuacauuuacaaugagacugcucagcccgguucgaguacccaauuauaauuugauuauaauggaugaggcacauuuuaccgaccccgcgucuauagcugcccggggauacauuaguacacguguagaaaugggggaagcagcuggaauuuuuaugacggcgaccccuccagguagcagggacccauucccucaaagcaaugcccccauaauagaugaggaacgugaaauuccagaaaggucguggaauagcggccaugaaugggucacagacuuuaaaggaaaaaccguuugguuuguuccaaguauaaaagcuggaaaugacauagcagcaugccuaagaaagaacggcaagaaaguuauucagcuaucacguaaaacuuucgauucugaauauguuaaaacuagaaccaacgacugggacuuuguagugacuacagauauaucggaaaugggggcgaacuuuaaagcugaaaggguaauagauccuagacgaugcaugaaaccugucauucugaccgacggugaagaaaggguaauuuuggccggaccaaugcccguuacacauaguucagcugcacagagacgcggacgaauagguagaaauccgaagaaugagaaugaucaauacaucuacaugggcgagcccuuggaaaaugaugaagacugugcucacuggaaagaggcaaaaauguuacuagauaauaucaauacuccugagggcaucaucccgaguauguuugaacccgaacgagaaaaaguugacgcuauagacggcgaguaucgacuacgcggggaagcgaggaaaacauuuguggaucugaugcgaagaggugacuuaccuguuuggcuggcauucaaaguggcagcagaaggcaucaauuacgcggaccgaagaugguguuuugacgguauuaagaauaaccaaauauuagaagaaaauguggagguagaaauauggacuaaagaaggggaacguaagaaacuuaaaccaagaugguuagacgcgcgaauuuauucagauccacuagcucugaaagaguucaaagaauuugcugcuggaaggaaaucacuuacccucaacuugauuacugagaugggacgucuaccuaccuucaugacccagaaaacucgugaugcccuagauaauuuagcaguucuucacacagccgaagcaggagggagagcuuauaaucaugcacuuucggaguuaccagagacuuuagaaacguuauuguuguugacacuauuggcaacaguuacaggaggaauauucuuauuucuaaugucagguagaggcauaggaaaaaugacuuuaggaaugugcugcauaaucaccgcuucaaucuuguuaugguacgcccaaauucaaccacacuggauugcugcaucaauaauuuuagaguucuuccuuauaguacuacuuaucccagaacccgaaaagcagagaacuccccaagauaaucaacuaacguauguaguuauagcgauacucacaguaguugcagcgaccauggcuaaugaaaugggguuucuggagaaaacuaagaaagauuuaggccuuggaaguauugcaacacaacaaccagaaucuaauauucuugauauugaucuuaggccugccucggcauggacgcuguaugcuguagcuaccacauuuguuacaccuaugcuuagacauucaauagaaaauucaagcguuaacguaaguuuaacagccauagccaaccaagcaacaguauuaaugggcuuaggcaagggcuggccauuaucaaaaauggauauuggagugccgcuacuggcuauagguuguuacucacaaguuaaucccauaaccuuaacggcugccuuacuccuauuaguggcccauuaugcaauuauagggccaggucuucaggcaaaagccacaagagaggcacagaaaagagcagccgcaggaauuaugaaaaauccaacuguggauggaauuacgguuauagaucuagauccaauucccuacgauccgaaauucgaaaaacaacucggacaaguaaugcuguuaauauugugcgucacccaggugcuaaugaugcgaacuacaugggcauuaugugaggcucuaacacuagcaaccgguccuaucucgacauuaugggaaggcaauccugguagguucuggaacacaaccauagcgguuucuauggcuaauauuuuuagagggaguuaccuagccggggcuggucuauuguucuccaucaugaaaaauaccacuaacacaagaaggggaacaggaaauaucggcgaaacacugggagaaaaguggaagucgcgucucaaugcucucggaaaaucagaguuucaaaucuacaagaaaucuggcauacaggaaguagauaggacucuagcaaaagaagguauaaaacgaggagaaacagaucaucaugcgguaucacgcggaagugcuaaauuaagaugguuuguagaaagaaauaugguaacaccggaagggaagguaguagaucucggaugcggccgcggaggauggucauacuacugcggcggauuaaagaacguacgcgaagugaagggucucacgaaaggaggucccggacacgaagaacccauaccgaugucuacguaugguuggaaccucguaagguuacaaagcggaguugacguauucuucauuccaccagagaaaugcgauacauuacucugugauauaggggaaucgucacccaauccuacuguggaagcuggaaggacuuuacgaguccuaaauuuaguagaaaacuggcuaaacaauaauacgcaauuuugcaucaaaguauuaaauccuuacaugccaucuguaaucgagaaaauggaggcguuacaaaggaaguaugggggugcccuaguaaggaacccucuuucaagaaauucuacgcaugaaauguacuggguuuccaaugcuuccggaaauauugucuccagugugaauaugauaucuagaaugcuuauaaauagauucacaaugagacacaagaaagcuacguaugaaccagacguagaucuuggaucgggaacacgaaauauuggcauagaauccgaaauccccaaucuagauauuaucgguaaacggauagagaaaauaaaacaagaacacgaaacaaguuggcacuacgaccaagaucaccccuacaaaacgugggcauaucauggauccuaugaaacgaaacagacagguagugccaguuccauggucaacgggguaguacggcuacuaacaaagccaugggacguauuacccacgguuacgcaaauggccaugaccgacacuacaccuuucggacagcaacgagucuuuaaagaaaaaguagauacuaggacccaagaacccaaggaagguaccaagaaauuaaugaaaauaaccgcugagugguuguggaaagaacugggcaagaagaaaacuccgaggauguguacaagagaagaauuuacuagaaaaguaaggucaaacgcagcucucggagcuauuuuuaccgacgagaacaaauggaaaagugcaagggaagccguugaagacagucgguucugggaauuaguagauaaagaaagaaaccugcacuuagaaggaaagugcgagacaugugucuacaacaugaugggaaaaagagagaagaaacuaggugaguucgggaaagccaaagguucucgggcuauaugguacaugugguugggagcgcgcuucuuagaguucgaagcccuagguuuucugaacgaggaucauugguuuagcagggaaaacucacucucuggaguggaaggggaagggcuacacaaguuaggauauauacuaagagauguaaguaaaaaggaagguggugcaauguaugcggaugauacagccggcugggacacacgaaucacauuggaagaucuuaagaacgaggaaaugguaaccaaucacauggaaggugaacauaagaaacuugccgaagccauauucaaauugacauaccaaaauaagguaguuaggguacaaagaccuacuccucgaggcacuguaauggauaucauauccagacgugaucaacgcgggucaggccaaguaggaacauacggucugaauacguuuacaaacauggaggcacagcugauaagacaaauggaaggagagggaguuuucaaaaauauucaacaccuaacuguaacugaagaaguugccguucagaauuggcuugcucgagugggaagggaacgauuaucaagaauggccauuuccggagaugauuguguuguaaaaccacuagaugacagguucgcuaaugcgcuaacggcuuuaaacgauaugggaaaaauucgaaaagacauucagcagugggaacccagcaaaggcuggaaugauuggacacaagucccauuuugcagucaccauuuccacgaauuaaucaugaaagacggccgaguacugguugugccgugcaggaaucaagacgaauuaauaggcagagcucguauaagccaaggcgccgguuggucacuaagagaaacagcuuguuuagguaaguccuaugcccagauguggagucucauguauuuucacaggcgagauuugagauuagcagcaaacgcgauauguucggccguaccgagccauuggguucccaccagcagaacuacauggucgauacaugccaagcacgaauggaugacgacugaagacaugcuaacuguauggaaccgaguauggauaagagagaacccguggauggaagauaagaccccaguagagagcugggaagagauaccauaucuagggaaaagagaagaccaauggugugggagcuuaauuggacuaacuuccagggcaacaugggccaaaaauauacaagcugcaauuaaccaaguacggucuuuaauaggaaacgaagaauauacugauuauaugccauccaugaaacguuuccgcagagaagaagaagaagcgggaguccucugguga

SEQ ID NO: 22508 - RNA, 9876 nt, Artificial Sequence
  derived and/or modified CDS sequence (opt6) from DENV-2__FJ810411__SS-prME
agcgcagggaugauaauaauguuaauaccaacaguaauggcauuccaucucacaacaagaaauggagaaccgcauaugauugugggaauccaggaaaaagguaaaucauuguuguuuaaaacggaagaugguguaaauauguguacacucauggcgauggaccuuggugaacuuugugaagauacaaucacauauaaauguccccuguugagacaaaaugaaccagaagacaucgauugcugguguaacagcacaucuacaugggucacuuauggaacuuguaccacuaccggagaacaucgccgagaaaaacgaucuguagcauugguaccucacgucggcaugggauuagaaacucgaacggagacauggauguccucggagggcgcauggaaacacgcacagcggauagaaacuuggauacuucggcauccaggcuuuacaauuauggccgcaauccuagcauauacaauagguacaacacacuuccaaagagcauuaauauuuauuuuguugacagcuguagcaccgagcaugacaaugagauguauagguaucucaaauagggacuucguagagggcguuaguggcgguucauggguggauauaguacucgaacaugggagcuguguaacaacaauggcgaaaaacaaaccuacuuuagauuucgaauugauuaaaacugaagcgaaacagccggccacacuacggaaauauuguauugaagccaaacuuacaaacacaacgacagaaucacgguguccuacacaaggggaaccgucgcugaaagaagaacaagauaaaagauuuguuugcaaacauaguaugguagauagagguugggguaacggaugcgguuuguuuggaaaaggcgguauaguuacgugugcaauguucacaugcaagaaaaauauggaagguaaaauaguccagccggaaaaucuagaguauacgauagugguuacaccacauucuggcgaagaacaugcaguugguaacgauacugggaaacacgguaaagaaauaaaagugaccccacaaucguccauuacagaagcggagcucacagguuauggaacaguuacuauggaauguagcccaaggacaucccuagauuucaacgaaaugguauuacuccaaauggaaaauaaagcauggcugguacauagacaaugguuuuuagauuuaccacuuccauggcugccuggggcugauaaacaagaaaguaauuggauucagaaagaaacacuuguuacauuuaaaaauccucacgccaagaaacaagauguaguuguguuaggaucucaagaaggagcuaugcauacugcuuuaacaggugcaacagaaauucaaaugaguagugggaacuuacuauucacagggcacuugaaaugccgauugcggauggauaaauugcaauugaaagggaugucguauagcaugugcaccgguaaauucaaaguagucaaagaaaucgcagaaacgcaacaugguacuauaguuauaaggguacaguaugaaggcgauggaaguccuuguaaaauuccauuugaaaucauggaucuugagaaaagauacguuuuaggacgauuaauaacuguaaauccuauugucaccgaaaaagacuccccaguaaauauagaagcagaaccuccauucggagauagcuacauaauuauuggcguagagccuggacaauuaaaauuaaauugguucaagaaagguaguucaauaggucaaauguucgaaaccacaaugagaggagcaaaaaggauggcaauauuaggagacacagcuugggauuuuggcucccuaggggguguauuuacuucaauuggaaaagcauuacaccaaguauucggcgcaauuuauggagcggcauuuucgggaguuagcuggaccaugaaaauauuaauuggagucauaauuacuuggauagguaugaacaguagaucaaccagccugaguguaucuuuagugcuaguuggcauaguuacucuuuauuugggggugaugguacaggcggacucagguuguguagucaguuggaaaaauaaagaauugaaauguggauccgggauuuucauaacggauaauguacauacguggacagaacaauacaaauuccaacccgaaaguccuucaaaauuagcaucggcuauccaaaaagcucaagaggaagggauaugugguauuagaucaguaacgagauuggaaaauuugauguggaaacagauuacuccugaacucaaucacauacuagcggaaaaugaagucaaauuaaccauaaugacaggagacaucaaagguauaaugcaagcuggaaaaagaucccucagaccccaaccgacugagcuaaaauauagcuggaaaacgugggguaaagcuaaaaugcucagcacugaaaguuauaaucaaacuuuucuaauagacggcccugaaaccgcugaauguccuaauacuaauagagcauggaacuccuuggaaguagaagacuauggguuuggugucuuuaccacaaauauauggcucaaacuaaaggaaaaacaggacgcauucugugauaguaaguuaaugagugcagcaauuaaggauaauagagcaguucaugcagacaugggguauuggauagagagugccuuaaacgacacauggaaaauagaaaaggcaaguuucauugagguuaaaaauugccacuggccuaaaagccacacuuuaugguccaacgggguuuuggagucggaaaugauaauuccuaaaaaccucgcaggcccggucagccagcacaauuaucgaccaggguaucacacccaaauagccggcccuuggcaccucgguaagcuagaaauggauuucgauuuuugcgaugggacuacuguaauagugacugaagauugcgguaauaggggccccucacuccgaaccacaaccgcaucaggaaaacucauaacagagugguguugcagaucaugcacacuaccaccucugagauauagaggagaagacggguguugguacgguauggaaauacgaccucuaaaagaaaaagaagaaaacuuaguaaauucacucguuacugcugggcaugggcagguugauaacuucagccugggaguauuggguauggcuuuguucuuggaagaaaugcuucgaacaagagucgggacuaagcacgccauacuauuaguagccguaaguuuugucacgcugauuacuggaaauaugucauucaaagauuugggccgcgucgugguaauggucggugcaacuauggcagacgauauaggaaugggcguuacuuacuuagcacuucuggcagcuuucaagguacguccgacauucgcagccggcuuauugcuuaggaaauuaacaucaaaagaacucaugaugaccacgauaggaauugucuuacugagccaaaguacgauuccggaaacaauuuuagaauuaacugaugcacuagccuugggaaugaugguauuaaaaauuguuaggaauauggaaaaguaucagcuagcaguuaccauaauggccauuuuauguguucccaaugccguaauucugcagaaugccuggaaaguaucauguacaauucuugcaguaguaagcguaucaccucuucucuuaacaaguucccagcaaaagacagauuggauaccauuagcauuaaccauaaaagguuuaaauccuaccgccaucuuucuaacaacguuaaguaggacgaauaagaagagauccuggccccuaaaugaagcaauuauggcgguagggaugguuaguauacuagcaucuagcuuacugaaaaacgauaucccaaugacaggaccuuuaguggcugguggacuauugacaguauguuacguauuaacaggaagaucagcggacuuggaacuagagagagcgacagauguaaaaugggaagaccaggcagaaaucuccggauccagcccaaucuugucaauuacaaucucggaggaugguuccauguccaucaaaaaugaagaagaggaacagacacuaacaauuuuaauaagaacgggacuuuuagugauuucgggccuauuucccauaaguauaccgauaaccgcagcagccugguaucucugggaagugaagaaacaacgggcugguguacucugggacguuccuucuccaccaccuauuggcaaggccgagcuggaagauggugcauaucgaauuaagcagaaagggaucuugggauacucccaaauaggagcaggagucuacaaagaggggaccuuucauacgauguggcauguaaccagaggggcuguauuaaugcacaaaggaaaacguauagagccaagcugggccgaugucaagaaagaucuuauaucuuacggaggaggauggaagcuggaaggggaauggaaagaaggagaagaaguacaaguucucgcuuuagaaccagguaaaaacccuagagcuguucaaacgaaaccaggauuauuuaaaaccaauacggggacgaucggcgcaguaucauuagauuuuucaccugguacuagcgguagccccauaauagauaagaaaggaaaaguuguaggcuuauauggaaacggaguaguaacuagauccggcgccuacguaagcgccauagcacaaacagaaaagaguauugaagauaauccggagauugaagacgauauauuucgaaaaagaagacucaccauuauggaccuucauccaggagcaggaaaaacgaagcgauaucuaccagcaauagugcgagaagcaauaaaaaggggacuuagaacacuaauauuagcaccuacuagagucguugcagcagaaauggaagaagcccugcgaggauuaccgauacgcuaucaaacgcccgcaauccgagcagaacacacuggaagagaaauuguggauuuaaugugucaugcaacauuuacaaugagacuacuaagcccagugagaguuccuaacuacaauuuaauaaucauggaugaggcacauuuuacagauccggcauccauugcugcucgugguuauauauccacuaggguggaaaugggugaagcggcugguauauuuaugacugcgacuccaccaggaagucgugauccauuuccucaaucuaacgcaccaaucauagaugaagaaagagaaauaccugaaagaucguggaauagcgggcaugaaugggucaccgacuuuaaggggaaaacgguaugguucgugcccagcauuaaagcggggaaugauauagcagcauguuugaggaaaaacggaaagaaagucauucagcuaucuagaaagacauucgauagcgaauauguuaaaacccgaacgaacgacugggacuucgucguaacgacagauauaucugaaaugggugcgaauuuuaaagcagagagaguuauugacccuaggaggugcaugaaaccgguaauuuuaacggauggggaagaaagaguaauacuugcagguccaaugccuguaacucauaguagugcggcccaacgccgcgguaggaucggacggaauccaaagaaugagaaugaucaauauauuuauaugggugaaccauuagaaaaugaugaagauugugcacacuggaaagaggcuaaaaugcucuuggacaauauaaacacuccagagggcauaaucccuucaauguucgaaccugaaagagaaaaaguggacgcaauagauggcgaauaucgauuaaggggagaggcccgaaaaacauuugucgaccuaaugaggcggggcgaucuaccagucuggcuggcuuucaaaguggcugcagaaggcauaaauuacgcugaccgucgaugguguuuugacgggaucaaaaauaaucagauucuagaagaaaaugucgagguugagauuuggacaaaggaaggugaaaggaagaaauuaaaaccaagauggcuagaugcaaggauauauucugacccacuagcccucaaagaauuuaaagaguucgcugcugggaggaaauccuugacuuugaaucugauaacagagauggggcgauuaccgacguuuaugacacagaaaacuagagacgcucuagauaaucuggcugugcuucauacugcagaggcaggaggcagagcauacaaucacgcgcuuucagagcugccugagaccuuagaaacacugcuauuacuaacguugcucgcgacuguuaccggaggcauuuucuuauuuuugaugucugguagggggauuggaaaaaugacauugggcaugugcuguauuauuacagccucuauucuuuuaugguaugcucaaauccagccucauuggauugcagcaaguauaauacuugaauuuuuccugaucguacuucuaauuccggagccagaaaagcagcguacaccccaggauaaccagcuaacuuaugucguaauagcaauuuuaacugugguagccgcuacuauggcaaacgagauggguuucuuagagaagaccaagaaagaucuagguuuggguucuauagcaacacaacaaccagaaagcaauauacuugacaucgauuuacgaccggcgagcgcauggacguuauaugccguagcgacaaccuuuguaacacccaugcuuaggcacaguauagaaaacucauccgucaauguaucacucacagcaaucgccaaucaggcgacuguauuaauggggcuaggaaagggauggccgcuaaguaagauggauauaggaguaccgcuacuagcuauuggcuguuacagccaggucaaucccauuacucugacagcagcauuacuacuauuggucgcucauuaugcuauuauuggaccgggccugcaggcaaaagccaccagagaggcucaaaaacgugcggcagcggguauaaugaaaaauccaacuguagauggcauaacaguaaucgaucuagauccuaucccuuaugauccaaaauuugagaaacaauuaggacagguuaugcuacuaauacuaugcgucacucaaguucuaaugaugagaacuacuugggcucuaugugaagcauuaacccuagcuacaggaccuaucucaaccuuaugggagggaaacccaggucgauuuuggaacacaaccauagcaguaucaauggcaaauauauuucgcgggagcuaccuagcaggagcaggccuucuauucaguauuaugaagaauacaacgaacacaagacgaggaacggguaauauaggagagacacuaggggagaaauggaaaucucgauugaaugcacuaggaaaaagcgaguuccagauauacaagaaaucgggaauccaagagguugauaggacauuagccaaagaaggaauaaaacguggcgagacggaccaccaugcugugaguagaggcucggcaaaacuccggugguucguugagagaaauauggugacccccgaggggaaaguuguagaucucggcuguggcagaggaggauggucauauuauuguggcggguugaaaaaugugcgggaggugaaggggcuuacaaaaggaggaccaggacacgaagaacccauaccgaugucuaccuauggauggaaccuggugcgacugcaaucaggagucgacguguucuucauuccaccagaaaaaugugacacucugcuaugugauauuggcgagagcucgccaaacccaacaguagaagcuggaagaacccuuagaguuuuaaaccuugucgaaaacuggcuaaauaacaacacucaauuuuguaucaaaguauuaaaucccuacaugccaucuguuauagagaaaauggaagcacuacaaagaaaguaugguggugcccucgugaggaauccuuuaagcagaaacucgacacaugaaauguacugggugucaaaugcgucaggcaacaucguuucgagugugaacaugauaaguagaaugcuaauaaauagauucacaaugcgucauaagaaagccacuuacgaaccagacguggauuuaggcucagguacaagaaacaucgguaucgaaagugaaauaccaaacuuagauauuauuggaaaacggauagagaaaauuaagcaagaacaugagacuagcuggcauuaugaucaagaccauccauauaaaacuugggccuaucauggcucuuaugaaacaaagcaaacugggagcgcaucgucgauggugaacgguguaguacgucuauugaccaagccgugggacguguuaccgacgguaacacagauggcaaugacugauacaacuccuuucggccagcaacgaguauucaaggaaaaaguagauacacgaacucaagagcccaaagaaggcaccaagaaauuaaugaaaauuaccgccgaaugguuauggaaggagcuugguaagaagaaaacuccacgcauguguacacgugaggaauuuaccaagaaaguacggucaaaugcagcacucggagcgauauuuaccgaugaaaacaaauggaaaagcgcucgagaagccguagaagauucaagguucugggaacucguugauaaagaacgaaauuuacacuuagaagggaaaugcgagacguguguguauaacaugauggguaagagagaaaagaaguugggggaauuuggaaaagcaaaaggcagccgcgccauaugguacauguggcucggggcaagguuucuagaauuugaagcacugggauuucucaacgaagaucacugguuuagucgugaaaauucuuuaucggguguagaaggagaaggauuacauaaauuaggcuauauacuacgugauguaaguaagaaagaagggggcgcaauguaugcagacgauacagcaggcugggauacgcgaauaacacuagaagaccuaaagaaugaagaaaugguaacuaaucauauggagggagaacauaagaaacuagcagaagcuauauucaaauugacauaucaaaacaagguuguaagaguacaaaggcccacgccaagaggcacugucauggauauaaucucccgcagagaccagagagguucuggacaaguaggcacuuauggcuugaauacauucacgaauauggaggcgcaacuaauaaggcaaauggagggugaaggagucuucaaaaauauacagcaucuaacaguuacugaggaggucgcaguucagaacuggcucgcacguguuggaagggaacguuuaucucgaauggccauaucgggggacgauugugugguaaaaccgcucgaugaccgauucgcaaaugcauugacagcacuuaaugacauggguaaaauaaggaaagacauucagcaaugggaaccuucaaaaggauggaaugauuggacccaaguacccuuuuguucacaucauuuucacgaacucaucaugaaagacggacgcguccugguaguaccuugcagaaaccaagaugagcucauagggagagcgcguauaagucaaggugcaggauggucgcuacgagagacugcaugccuuggaaaauccuaugcgcaaauguggagucuuauguauuuucaucgucgagaucuaaggcuagcggcgaaugcgauauguucagcaguaccgagucauuggguacccaccucuagaacaacguggagcauacacgcuaagcaugaguggaugacaacggaagauaugcuaacaguguggaauagaguauggauuagggaaaacccuuggauggaggacaaaacgcccguugaaucaugggaagaaauucccuauuuagggaaaagagaggaucaauggugcgggagccuaauaggcuuaacaagcagggcgacuugggccaaaaauauacaagcggcaauaaaccaggugaggagcuuaaucggaaaugaagaauauacggacuacaugccaucaaugaaaagguuccgucgggaagaagaggaggcagggguacuaugguga

SEQ ID NO: 22509 - RNA, 9876 nt, Artificial Sequence
  derived and/or modified CDS sequence (opt6) from DENV-2__FJ744713__SS-prME
ucggcagguaugaucaucauguuaauucccacgguuauggcuuuccacuuaacuacgagaaauggugaaccacacaugauuguagggauucaagaaaaaggaaaaaguuuacuauuuaaaacugaagacggaguaaacauguguacauugauggcuauggauuuaggagaauugugcgaagauacaauaacauacaaaugcccacuauuaagacaaaaugaaccggaagauaucgacugcuggugcaauagcacaucuacguggguaacuuacggaacuuguacuaccaccggagaacaccgaagggagaaacgaucaguugcuuuaguaccgcauguuggaaugggauuggaaacccggacggaaacauggaugaguucagaaggcgcuuggaaacaugcacaacggauagaaacuuggauucuucgucauccaggauuuacaauuauggcggcaaucuuggcauauacaaucgggaccacucacuuucaacgggcuuuaauauuuaucuuacuaacugcaguagcaccaaguaugacaaugcgauguauaggcauaucaaaucgagacuucguagaaggcguauccgggggcaguuggguggacauaguacuugaacacggaucauguguuacaaccauggccaaaaacaaaccaacuuuagauuucgaacugauaaaaacagaagcaaaacaaccagcgacauugaggaaauauuguauagaagcuaaacuaacaaauaccaccacugaaucacgcugcccaacacaaggugaacccucuuuaaaagaagaacaagauaaaagguuuguuuguaaacauucgaugguagaucgagggugggggaacggaugcggauuauucggaaaaggagggauuguaacaugugcaauguucacgugcaagaaaaauauggaagggaaaauuguacagccagaaaaucuggaauacacuauaguaguuacuccucacaguggugaagaacaugcagugggaaacgauacaggcaaacauggcaaagaaauaaaagucacuccacaaucaagcauaacagaagcggaacuaacuggguacgguacaguaacaauggaauguagcccuagaacaaguuuagauuuuaaugaaaugguacuauuacaaauggagaacaaagcguggcugguacacaggcaaugguuccuagacuuaccacuaccuuggcuaccuggugcugauaaacaagagucuaacuggauccaaaaagagacauuaguuacuuuuaaaaacccacaugcaaagaaacaagaugucgucgugcuaggcagucaagaaggggcaaugcacacagcccuuacaggcgcuacugaaauacaaaugucaaguggcaauuuacuuuuuacgggccaccugaaaugucggcuaaggauggauaaacugcaauugaaagguaugucauauaguauguguacuggaaaauuuaaaguuguuaaagaaauagccgaaacccaacacggaacgauagucauacgaguucaauaugaaggagacgguucaccguguaaaauccccuucgagauaauggaucuagagaaaagauaugugcuaggccgacugaucacuguuaauccgauaguaaccgaaaaagauucaccgguaaauaucgaagcugaaccaccauucggggauaguuacauaauuauagguguagaaccuggccaacugaaauugaauugguucaagaaaggcuccaguauaggacagauguucgaaacaacuaugcgaggagcaaaacggauggccauccuuggagauaccgcaugggauuucgggucucuaggaggugucuucacgucuauagggaaggcuuuacaucagguuuucggggccauuuacggugcggcuuuuaguggugucucauggacuaugaaaauacuaauaggaguaauaauaacguggaucgguaugaauagucguaguacaucucucucaguuucccugguucuuguaggcauaguaacuuuauauuugggaguaaugguacaggccgauucuggauguguagugucuuggaaaaacaaagagcucaaaugugguaguggcauauucauuacggacaacguacacacuuggaccgaacaauauaaauuccagccggaaaguccuucaaaacuugccucagcaauacaaaaagcacaagaagaaggaauaugugguauacgaucuguaacacgccuggagaauuugauguggaaacagauaacuccggaacuaaaccacauauuagcagaaaacgaagugaaacugacuaucaugacaggagauauaaaaggaauuaugcaagccgguaaaagaucuuuacguccucaaccuaccgaauuaaaauacagcuggaaaacauggggaaaagcaaaaaugcugucuacggaaagcuauaaccaaacauuucuuauugauggccccgaaacagcggagugcccaaacacaaacagggcguggaauagcuuagaaguugaagacuauggguuuggaguguuuacuacaaauaucuggcuuaaauugaaggaaaaacaggacgcguucugugacaguaagcuaaugucagcugcgauuaaagauaaucgagcuguacaugcugacauggguuauuggauagaaucagcucuaaaugauaccuggaaaaucgaaaaggcuuccuuuauugaagucaagaauugucacuggcccaaaagucauacacuaugguccaacggaguuuuagagagcgaaaugauaauucccaaaaacuuagcugguccaguaucucagcauaauuaucguccugguuaucacacccaaauagcuggacccuggcauuuagguaaguuggaaauggauuuugacuucugugauggaaccaccguaauaguuacugaagauuguggaaauagaggccccucgcuucguaccacaacggcaagcgguaaacuuauuacggaaugguguuguagaagcugcacuuuaccaccauuaagauauaggggcgaagacgguuguugguacgguauggaaauuaggccuuuaaaggaaaaagaagaaaaucuugugaacaguuuaguaaccgcaggacacggacagguagacaacuuuaguuuggggguccugggcauggccuuauuucuagaggagaugcuaagaacgcgcgucggaacgaaacacgcuauccuacuggucgccgucucauucgucacgcuaauaacagguaacaugucauucaaagacuugggacgaguagucgugauggucggagccacaauggcagacgauauuggaaugggagucaccuacuuggcccuuuuagcugcuuucaaaguucgaccuacuuucgcagcgggucuuuuacuucgcaaacuaacaucaaaagaacucaugaugacgacuauagggaucguucuauuaucacaaucgacaaucccagagacaauucucgagcuuacugaugcgcucgcacuaggcaugaugguccucaaaaucguaaggaauauggaaaaguaucaacuagcgguuacaaucauggcuauucucuguguaccaaaugcaguaauacuucaaaaugcauggaagguaagcuguacuauacuagccguuguaucgguaucaccacuacuacuuacaucuucacaacagaagacggauuggauuccgcuagcgcuaacaauaaaaggucuaaauccgacggcgauauuucuuacgacuuuaucaagaacaaacaagaagagaucguggccacucaacgaagcaauaauggcagucgggaugguguccauccuugcaagcucauuacucaaaaacgauaucccaaugacaggaccgcugguugcaggagguuuauuaacuguaugcuauguuuuaacugguaggagugcugaucuagaauuagaaagagcaaccgacguuaaaugggaggaucaagcugagauaagcggcucgucaccaauucuauccauaacuaucuccgaagauggaaguauguccaucaaaaaugaagaggaagaacaaauacuaacgauacucauacguacaggauugcucguaauaaguggccuauucccuauuucaauacccauaacagcugcagccugguauuuaugggaaguuaagaaacagagagccggaguccuaugggaugugcccucaccaccgccaauagguaaagcagagcuagaagauggcgcauaucguauuaagcaaaaagguauacuagguuauagccaaauuggggcaggaguauauaaagaaggaacauuucauaccauguggcaugugacaagaggugcagucuuaaugcacaagggaaaacgaauagagccuaguugggccgacgucaagaaagauuugauaucguacggaggaggguggaaacuugaaggcgaauggaaggagggagaggaaguccagguccucgcacuggaaccagguaaaaauccacgcgcaguacaaacgaagccuggauuguucaaaaccaacacugguacaauaggggcaguaucuuuagacuuuagucccggaaccagcggaucuccgaucauugacaagaaagguaaaguggugggacuauauggaaacggaguagugacaagaaguggugcuuaugucagugcgaucgcucaaacugagaaaaguauagaagauaacccggaaaucgaagacgacaucuucagaaaacgucgccuaacaaucauggaucuucauccuggugcaggcaagacuaaacgcuacuuaccugcgaucguaagggaagcaauuaaaagaggauuaaggacacuaauccuagcaccuacgagagucguagcagccgaaauggaggaagcauuaagaggguuaccgauaagauaucaaacuccugcuauacgagcggaacacacaggaagagaaauuguugacuuaaugugucacgcuacauucacaaugcgacuacuuucuccaguaagagucccaaacuauaacuuaauaaucauggaugaagcccacuucaccgauccugcuucaauugcggcuagaggguauauuucaaccagggucgaaaugggagaggcagcagguauuuuuaugacggcaacuccuccggguucacgagacccauuuccacagucaaaugcaccgaucauugacgaggaaagagaaauucccgaaagaucguggaacaguggacaugaaugggugacggacuucaaaggcaaaacugucugguuuguaccuucuauaaaggcuggcaaugauauugcggcaugucucaggaaaaauggcaagaaagucauucagcuaucuagaaaaacguuugauuccgaauacgugaagacacgaacuaaugacugggauuuuguugucacuacggauaucagcgaaaugggugcuaacuucaaagcugaaagaguuauugauccuaggagguguaugaaaccagucauauuaacugacggcgaagaaagaguaauauuagcagggccaaugccaguuacccacuccucugcugcccaaagaagaggcagaaucggccgaaauccuaaaaaugaaaacgaccaguacauauauaugggggagccacuagaaaaugaugaagauugugcccacuggaaggaagcgaaaauguuguuagauaacauuaauacuccagaaggaauaauaccaagcauguucgaacccgaaagagaaaagguggaugcuauagacggugaauauagauuaagaggggaagcaagaaaaaccuuuguugauuuaaugagaagaggcgaucuaccgguguggcucgcauuuaaaguagccgcugaaggaauuaauuaugcagacagacgcuggugcuuugauggcaucaagaacaaucagauauuagaagaaaaugucgaaguggaaauauggacgaaagaaggcgaacgaaagaaacucaaaccgagaugguuagacgcccguauauacucagaucccuuggcacuaaaagaauuuaaagaauuugcagcaggaagaaaaucacucacuuugaacuuaauaaccgaaauggguagacugccaacguucaugacacaaaagacuagagaugcacuagacaauuuagcgguacugcauacugcggaagccggagggagggcuuacaaucaugcacuaagugaauugcccgaaacuuuagaaaccuuacuacuacucacacuccuagcaaccguaacaggaggaauauuuuuauucuuaaugucgggucgggggaucggaaagaugacuuuagguauguguuguaucauuacagcguccauccuauuaugguaugcucaaauccaaccgcacuggauagcagcaucuauuauacuagaguucuuucuaauuguucuauuaauuccggaaccagaaaagcagagaacaccacaggacaaccaauuaaccuacguaguuauagcuauacuaaccgugguggccgcaacuauggcaaacgaaauggguuucuuagagaaaacuaagaaagaccuaggauuaggaucuauagcuacacagcagcccgaaucuaauauccuugauaucgauuuaagacccgccucagcguggacauuauaugcaguugcuacaaccuuuguaacuccaaugcuuagacacucaaucgaaaauucaucaguuaauguuucucucacagcgaucgcgaaccaagccacgguccucaugggucucgguaaggguuggcccuuauccaaaauggacauuggcgucccacuauuggccauuggauguuacucacaaguaaacccuauaacauuaacugcggcauuacugcuccuaguagcgcauuacgcaauaauaggaccgggacugcaagccaaggcgacucgcgaagcacaaaagcgagcugcagcugggaucaugaaaaaccccacgguagacgguauaacagucauagaucucgauccuauccccuacgacccaaaauuugagaagcaguugggccaaguaaugcuuuuaauauuaugugugacucaaguauugaugaugagaaccacuugggcauugugcgaggcucuuacccuagcuaccggaccaauuuccacguuaugggagggaaauccgggccguuucuggaauacuacuauagcaguuucaauggccaauauauuccgagguucuuaucucgccggagcagggcuauuauuuucaauuaugaagaauacaaccaauacaaggcguggaaccggcaauauuggugaaacauugggagaaaaauggaaaucaagauugaaugcauuaggcaagucugaguuccagauauacaagaaaaguggaauacaggaaguagacagaacacuagcgaaagaagggaucaaaagaggcgaaaccgaucaccacgcggucagcagaggaagugcgaaacuuagaugguuuguagaaaggaacaugguuacgcccgagggaaaagucguagaccuaggguguggccgagguggauggaguuauuauuguggagggcucaaaaacguucgugaaguaaaaggacuaacuaaagguggaccaggucaugaggaacccaucccaauguccacauauggauggaaccuaguucgauuacaauccggcguagacguauucuuuauuccacccgaaaaaugcgacacauuacuuugcgauaucggagaaucaucgccuaauccuacaguugaagcuggaagaacccuaagagugcuuaaucuugucgaaaauuggcucaauaauaacacucaauuuuguauuaaaguguuaaauccguauaugcccaguguaaucgagaaaauggaggcguuacaacguaaauauggaggggcauugguucguaauccccucucaagaaacucuacucaugaaauguauuggguuuccaaugcaucuggcaacauaguaaguagcguuaacaugauaucaagaaugcuuauuaauagguuuacuaugagacacaagaaggcuacauaugaaccagacguagaccuaggguccggaacacgcaacauagguauugaaucggaaauaccaaaccuagauaucauuggcaaaagaauugagaaaauaaaacaggaacacgagacgucauggcacuaugaucaggaucacccauauaagacuugggcuuaccacgggucuuacgaaacaaaacaaacagguagcgcaucgucgauggugaauggaguaguucgauuguuaacgaaaccuugggauguucucccaacuguuacgcaaauggcaaugacugauacgacaccuuuuggacaacaaaggguuuuuaaggaaaaagucgacacccguacacaagaacccaaagaaggcaccaagaaacugaugaaaauaacagcugaguggcucuggaaagaacugggcaagaagaaaacccccaggaugugcacucgugaagaguucacaagaaaaguaaggagcaaugcagcauuaggcgcaauuuuuacagaugaaaauaaauggaaaucggcaagagaggcagucgaagauagccgauuuugggagcuuguagauaaagaacgaaaccugcauuuagaaggcaagugugaaacauguguauacaauaugauggguaaaagagagaagaaacuaggagaauuugguaaagcgaaaggaucgcgagcuaucugguacauguggcugggugcccguuuccuugaauuugaagcccuaggauuuuuaaacgaagaccauugguucucaagggaaaacucacuaucagguguagaaggugaaggccugcauaaguuaggauacauacuacgcgauguaucuaagaaagaggguggugcaauguacgcagaugacacagcugggugggauacgcggauuacacucgaagaccucaaaaaugaagaaauggucacaaaucauauggaaggagagcacaagaaacuggcggaggcgaucuucaaauuaaccuaccaaaauaaaguaguaagaguccaaaggccuaccccacgaggcacuguuauggacauaauuaguaggagagaucaacgaggaucugggcaaguuggaaccuaugggcucaacacguuuaccaacauggaggcucagcuaauacgucagauggaaggggagggcguuuuuaaaaacauccagcaccuuacuguaacugaagaaguugcuguucaaaauuggcuagcacgaguuggcagagaacgucuaagccgaauggcuauaaguggagaugacuguguagugaaaccccucgacgaccgcuuugcaaaugcacuuacagcccuaaaugauauggguaagauacggaaagacauccaacaaugggaaccuucaaaaggauggaacgacuggacucaaguuccauuuuguucucaucacuuccaugagcugauaaugaaagauggaagagucuuaguuguaccaugucguaaccaagaugagcuuauugggcgugcacgcauaagccaaggagcuggauggucacuaagagaaacagcauguuuaggaaaauccuacgcucaaauguggucucucauguauuuucaucgcagagacuuaagacuagcagcuaaugcgauauguucugcuguaccaucccauuggguaccaacaucucgaacuaccuggucgauccacgcaaaacacgaauggaugacaacggaagauauguuaaccguguggaauagagucuggauacgagagaauccuuggauggaagauaaaacacccguugagagcugggaggagauuccauaucuuggcaaaagagaagaucaaugguguggaagccugaucggauuaacuagcagggcaacaugggccaaaaauauucaagccgcgauuaaucagguaaggucgcucauuggaaaugaggaauacaccgauuauaugcccucuaugaaaagauuccgacgcgaagaagaagaagccgguguauugugguaa

SEQ ID NO: 22510 - RNA, 9876 nt, Artificial Sequence
  derived and/or modified CDS sequence (opt6) from DENV-2__FJ744714__SS-prME
agugcggggaugaucauuauguugauaccaacuguuauggcauuccaucugacuacacggaacggagaaccccacaugauuguagggauucaagaaaaaggaaaaucuuuauuauuuaaaacugaagacggaguuaacaugugcacucugauggcuauggaccuaggagaacuaugcgaagacacaauuacauacaaauguccacuauugcgacaaaaugaaccagaagauauugauuguugguguaauuccaccaguacuuggguaaccuacggaacgugcacaacaacgggugaacaccgaagagaaaaacggucuguggcauuaguuccgcaugugggaaugggacuagaaacacgaacugaaacuuggaugagcuccgaaggugcuuggaaacacgcucaacguaucgaaacguggauucuuagacacccaggguuuacaauaauggcggcuauauuagcauacaccaucgggacaacacauuuccaaagaguacugauauuuauucuauuaacggcugucgcccccaguaugacaaugagguguauaggaaucuccaaucgagauuuuguugaagggguaaguggagggagcuggguagauauugucuuagaacauggcucuuguguaacaacaauggccaaaaauaaaccaacauuagauuucgaacugauaaaaacagaagccaaacaacccgcaacccuacguaaauauuguauugaagcaaaauuaacgaauaccacgacggaaagcagaugcccuacucaaggggaaccuucacucaaagaagaacaggacaaaagguucgucuguaaacacagcauggucgaucgaggguggggcaaugguugcggcuuauuugggaaaggugguaucgucacaugcgcuauguucacuuguaagaaaaacauggaaggaaaaauuguccaacccgaaaacuuagaguacacaaucguaguaacaccccauagcggagaagaacacgccguuggcaaugacacaggaaaacaugggaaagaaauaaaaguaacuccacagucaaguauaacugaagcagaauuaacgggauaugggacaguaacgauggaguguagucccagaacaggacuagacuuuaaugaaaugguuuuacugcaaauggaaaacaaggcuuggcuuguacacagacaaugguucuuagaucuaccauuaccuuggcuuccgggggcugauaaacaagagucgaauuggauacaaaaagaaacacuuguaacguucaaaaauccacaugcaaagaaacaggacguagugguguugggaucucaagaaggagccaugcacacagcauuaacaggagcaaccgaaauacagaugaguaguggaaacuuacucuuuacaggucauuugaagugucgauuaagaauggauaaguugcaauugaaagguaugucauauaguaugugcacaggcaaguuuaaaguaguaaaagagauugcugaaacacagcacggcacuauagugaucagaguacaguacgaaggagaugggucgccguguaaaauucccuuugaaaucauggaccuugagaaaagauacguguugggcagguuaauuaccgugaacccgauuguaaccgaaaaagacaguccuguaaauauugaggcagaaccaccuuucggcgauaguuauauaauuauaggcguagaaccuggucaauuaaaacucaacugguucaagaaagguaguucgauuggucaaauguuugaaacaacgaugcguggagcaaagagaauggccaucuuaggagauacugcuugggauuuuggaagccuagguggaguuuucacuagcauagguaaagcauuacaucaaguauuuggugcaaucuacggagcagcauucaguggaguuaguuggacaaugaagauuuuaaucggggucauaauaaccuggauaggaaugaauaguagaucaacuucacuuuccguuagccuuguucuuguuggcauugugacauuguaucucggcguaaugguacaggccgauucuggaugcgucgugagcuggaaaaauaaggaacuaaaguguggcagcgguauuuucauuaccgacaacguccacacauggacggaacaauauaaauuucaacccgaaucgccuucaaaauuagcauccgcaauacaaaaagcucaagaagaaggcauauguggcauaagguccgucacccgauuagagaaucugauguggaagcagauaacuccagaauugaaccacauacuggcugaaaaugaaguaaaauugacaauaaugacgggcgacauaaagggcauaaugcaagcgggaaaacgaagccucaggccacaaccuacugaauugaaauacucauggaaaaccugggguaaagcgaagaugcugucaacggagagcuacaaucaaacguuuuuaauagacgggccugaaacagcugaaugcccuaacacuaauagagccuggaacuccuuggagguggaagacuauggguucgguguauuuacgacgaacauaugguuaaaguugaaagagaaacaagacgcauuuugugauagcaaauuaaugagcgcugcaaucaaggauaaucgugcugugcaugcagacauggguuauuggauugaaucagcgcuaaaugacacauggaagauugaaaaagcaucguuuauugaaguuaaaaauugccacuggccaaaaucacacacuuuauggucuaacggaguacuagaaagugaaaugauaauacccaaaaaucuagcgggaccaguaagccaacacaacuaccgaccaggcuaccauacacagauagcuggacccuggcaucuugguaaacucgaaauggacuucgauuucugcgacgguacaacaguaaucgucacugaggauugcgguaaccgcgguccaaguuugcgaaccacaacagccucaggcaaauuaauaacugaaugguguugcagaucaugcacuuugccacccuuacgguaucguggugaagacggcuguugguaugguauggaaauucgaccauuaaaagaaaaagaagaaaauuuggugaacagcuuaguaacagccggucauggacaaguugauaacuuuucuuugggcguauuaggaauggcccuguuucuggaagaaauguuaagaacaagagugggaacgaaacacgcuauucuacugguggcgguuagcuuuguuacacuuaucacgggaaacauguccuuuaaagaccucgguagaguugugguaaugguuggggcuaccauggcagacgauaucgggaugggugucacauaucucgcucuuuuggcugccuuuaaaguucgaccgaccuucgcagcagggcuuuuauuaaggaaguugaccagcaaagagcugaugaugacuacuauaggcauaguucuauugagucaaucuacuauccccgaaacgguucucgaacuaaccgacgcccuugcccuuggcaugaugguacuaaaaauagugcgcaacauggaaaaauaucaauuagcgguaaccauaauggcuauccuauguguaccaaacgccguuauauugcagaacgccuggaaagucagcuguacgaucuuggcaguaguauccgucucuccacuacuuuuaacuuccagccaacagaaaacugacuggauaccucuagcucugacaauuaaaggacucaaccccacugcaauauucuugacuacauuaucucguacaaacaagaaaagauccuggccauuaaacgaagcaauaauggcaguuggaaugguaagcauccuggcaagcaguuuauugaaaaaugacauuccuaugacugggcccuuaguagccggaggacuccuaacggucugcuacguauuaacuggucgaagugcggauuuagaauuggaacgagcuacggaugugaaaugggaagaucaagcagaaauaaguggaaguaguccaauacuaucgaucacgaucucugaagacggaucaaugaguaucaaaaaugaagaagaagaacaaacacucacuauucucauacgcaccgggcuauuaguaauuucugguuuguuccccauaaguauuccaauaacagcagcagccugguauuuaugggagguaaagaaacaacgagcgggggugcuaugggacguaccuucacccccgccuaugggaaaagcggaacuggaagacggagcauaccguaucaagcagaaaagaauauuaggguauucacaaauaggugcaggaguauauaaagaagguacauuccacacgauguggcaugugacuagaggugcaguauuaaugcauaaggguaaaaggauagaaccaucaugggcugauguuaaaaaggaucuaauuucguacggaggaggauggaaacuagaaggggaauggaaagaaggagaagaagugcaggucuuggcacuggagccaggaaagaacccgcgagcugugcaaacaaaaccaggcuuguucaaaacuaauacgggaacaauaggugcuguuucauuagauuucucaccggguacguccggaucaccaauaauugauaagaaagggaaagugguaggguuauacggaaaugguguagucacuaggucaggagcauacgugucagccauagcccagacggagaaaaguaucgaagacaauccagagauugaagaugacauauuuagaaaacgccgauuaacgauaauggacuuacaucccggagcagguaaaacaaaaagauauuugccagcuaucguacgugaagcgauuaaacgaggauuaagaacauugauauuagccccgacacgaguuguagcagcagaaauggaagaagccuuacgagguuuaccuauuagauaucaaaccccugcaauaagagccgaacauacugguagggaaauagucgauuuaaugugucaugccacauucacaaugagguuacuaucucccguaaggguaccaaacuacaaucuuaucauaauggaugaagcacauuucacggauccggcaucuauugcagcuagaggcuauauaagcacucgaguagagaugggugaggcagccggcauuuuuaugacugcaacgccaccuggaucgcgugauccauuuccccaauccaaugcgccgaucaucgacgaagaaagggagauaccugaaagaucauggaacagcggacacgaaugggugaccgacuuuaaaggcaaaacgguaugguucguaccaucuauaaaagcaggcaacgacaucgcagcuugucuaaggaaaaacggcaagaaagugauccagcuaagucgaaaaacauuugacucggaauauguaaaaacaaggacuaaugauugggauuuugucgugacaacugauauauccgaaaugggggcaaacuuuaaagcagaacgagugauagacccccgaagauguaugaaaccugucauauugaccgauggagaagaacggguuauauuggcggggccuaugccuguaacccauucaagugcugcacaaagaagaggccguauaggaagaaaccccaaaaaugaaaaugaccaauacaucuacaugggcgagccucuagagaacgacgaagacugcgcccauuggaaggaagcuaagaugcuacuggacaacaucaauacaccagaggggauuaucccuagcauguuugagccagagagagagaaaguugaugccauagauggggaauaccgacuaagaggagaggcacggaaaaccuuugucgacuuaaugaggagaggggaucugccaguauggcuugcuuauaaaguugcugcagaagggaucaauuaugcagaccgaagaugguguuucgauggaauuaaaaauaaccaaauucuagaagaaaacguagaggucgaaauauggacaaaagagggggaacgaaagaaauuaaaaccgagauggcuagacgcaaggauauauuccgauccacuugcguuaaaagaauuuaaagaguucgcagcaggccgaaaaaguuuaacgcuaaauuuaaucaccgaaaugggccguuuaccgacguucaugacgcagaaaacacgcgaugcacuggacaaucucgccguccuccauacagcggaggcuggagggagagcauacaaucacgcccuaagugaacuaccagaaacccuggaaacucuucuuuuacuaacguuacuagccacuguaacaggaggaauauuuuuauuccucaugaguggaagaggaauaggaaaaaugacgcuaggaauguguuguauaauaacagcaucaauccuacuaugguaugcucaaauacaaccccauuggauagcggccucaauaauauuagaauuuuuccuaaucguucuauuaauuccagaaccagaaaagcaaagaacaccccaagauaaccaacuuaccuauguaguaauagccauacugacagucguagcugcaacaauggcaaaugagaugggcuucuuggagaaaaccaagaaagaucuaggguuagggucuauugccacccaacaaccggaaucuaacauauuagauauagacuuacggcccgccagcgcguggaccuuauacgcuguggcuacaacguuuguaacgccuauguuacgacacucgaucgaaaauuccaguguuaaugucucauuaacggcaaucgcuaaccaagcuacaguacuaauggguuuagggaaaggauggccacuaucuaaaauggauauaggcguuccauuacuagccauuggcuguuauucacagguuaauccaauaacucucacagcagcuuuguuauuauuagucgcucacuaugcuaucauagggccgggauuacaagcuaaagcaacgagggaagcgcaaaagagggcggccgcagguauaaugaaaaaucccacuguugacgggauuacaguaauagacuuggaucccaucccauaugauccaaaauucgagaaacaguugggacagguaaugcuacuuauacucugugugacacaaguguugaugaugcgaaccacaugggcucugugcgaagcacucaccuuagcaacggggccuauuucuaccuuaugggaaggcaaccccgguagauuuuggaauacaaccauagcgguaucaauggcaaacauauuuaggggaucuuauuuagcaggggcugggcugcuuuucucgauaaugaagaacaccacaaauacucgaagaggaacuggaaauauaggagaaacgcuaggagagaaauggaaaucaagauugaacgcauuaggaaagucugaauuucaaauuuauaagaaaucaggcauucaagagguagaccgaacacuugcuaaagaaggaaucaaacgaggagaaacagaucaucacgcugugagccggggaucagcaaaauugagaugguuuguagaacguaauauggucacuccugaaggcaaagucguggaucuugguugcgguaggggcggauggaguuacuacuguggaggacucaagaauguaagagaagugaaagggcuaaccaaaggagguccaggacacgaggagcccauuccaaugaguacauauggauggaaccuagucagguugcaaagcggcguugauguauuuuucauaccaccggaaaaaugugacacauuauuaugcgacauaggcgaaucaagucccaaucccacgguagaagcgggcagaacuuugagaguccuuaaucuaguugaaaauugguuaaacaauaauacccaauuuuguaucaagguacuaaacccauauaugccaaguguuaucgagaaaauggaagcguuacaacgaaaauacggaggagcgcuaguacgcaacccgcucucaagaaacaguacacacgaaauguacuggguaucaaacgcaucagguaauauaguaucaagcguaaacaugaucucuagaauguuaauuaacagguucacuaugagacauaagaaagcaaccuacgagcccgacgucgauuuaggaagcggaacccggaauaucggaaucgaaucugaagucccuaaccuagacauuauaggaaaaagaaucgaaaagaucaaacaagaacaugaaacuucguggcauuacgaccaagaccacccuuauaaaacuugggcguaucaugguucuuacgaaacaaagcaaacugggucagcuaguucaaugguuaacgggguuguucggcuacugacaaagccaugggauguuuuaccaacuguuacccagauggcaaugacugauacuacaccauuuggacagcaacguguuuucaaagaaaaaguugauacaagaacgcaagaaccaaaggaaggaaccaagaaacugaugaaaauaacagcugaaugguuauggaaagaacuaggaaagaagaaaacaccaagaaugugcacgcgagaagaauuuacacgcaaaguuagaucuaaugccgcuuuaggggcuaucuuuacugaugagaauaaauggaaaagugcaagagaagcaguagaagacucuagauucugggaacuugucgacaaagaaagaaaucugcaucuugaaggaaaaugugaaacuuguguauauaacaugauggguaagagagaaaagaaguuaggagaauuugggaaggcuaaaggcagccgcgccauaugguacauguggcuaggcgcacgcuuucuagaauuugaagcccucggcuuccuuaaugaagaucacugguucucgcgagaaaacucacucucgggcguagagggagaaggauuacacaaacuggguuacauccuacgcgaugucucgaagaaagaaggcggggcaauguacgcugaugacacugcuggaugggacacacgcauuacauuagaagaucugaagaaugaagaaauggugacaaaucauauggaaggugagcauaagaaacuagcagaagcuauuuuuaaauugacauaccaaaauaagguaguucgagugcagaggcccacaccaagggggacaguuauggacauuauauccaggagagaccaaagaggaagcggacaaguagggaccuacgguuuaaacacuuucacuaacauggaagcucagcuuauacgacaaauggaaggagaggggguauuuaaaaauauccaacaccucacaguaacagaagaaguugcugugcaaaauuggcucgcuagagucggaagagaacgacuaaguagaauggcuaucucaggcgacgacugcgugguuaaaccacuugaugaccgauuugcaaaugcuuuaacagcgcuaaacgauauggguaagauaagaaaggauauacaacagugggaaccuuccaaaggauggaaugauuggacucaaguccccuuuuguucacaucauuuccacgaauugauaaugaaagauggcaggguauuagucguuccuuguaggaaucaagaugaauuaauagggagagcccguaucagucagggagcuggcuggagcuuaagagaaacggcuugucuaggcaaaucuuacgcacaaauguggagcuugauguauuuccaccguagggauuugcgccuagcagccaacgcaauaugcagugcuguuccaucccacugggugccaacaaguagaacaacauggucaauccaugcaaaacaugaauggaugaccacagaagacaugcuaaccguuuggaaucgaguauggauacgggaaaaucccuggauggaagacaaaacccccguggaaagcugggaagaaauacccuaucuaggcaaacgagaagaccaauggugcgguuccuugauagggcucaccucacgggcgacgugggccaaaaauauacaagcggcgaucaaccaaguaagaaguuugauagguaacgaggaauauacggauuauaugccauccaugaaacgauucaggagagaagaagaagaagcagggguacuaugguaa

SEQ ID NO: 22511 - RNA, 9876 nt, Artificial Sequence
  derived and/or modified CDS sequence (opt6) from DENV-2__FJ744716__SS-prME
agugcaggaaugauuauaauguugaucccuacgguaauggcauuccacuuaacaacacggaauggagaaccgcacaugauagucgguauacaagaaaaaggaaaaucacuacuauucaaaacggaagacgguguuaauaugugcacccuaauggcgauggacuuaggugaacuuugugaagauacaauaacguacaaaugcccccuauuacggcaaaacgaaccagaagacauugauugcugguguaauaguaccucaaccuggguaaccuauggcaccuguacuacaacaggugaacaccgaagagagaaaagaucaguagcguuagucccccacguuggcaugggacuagaaacgagaacugaaacauggaugaguucugaaggugcuuggaaacaugcacaacggaucgaaacauggauauuaagacauccuggauucacaaucauggcagcgauauuagcuuacacaauuggcacuacgcacuuucaaagaguacuaaucuucauacuacuaaccgcaguugcgccaaguaugacuaugcgcuguauaggaauaucaaaccgcgauuuuguugaaggcguuucaggaggaucguggguugauauaguccuggaacauggaaguugcgugacaacuauggcuaaaaauaaaccaacguuggacuucgaacugaucaaaacggaagcgaaacaaccggcaacuuugagaaaauauuguaucgaagcuaaacugacaaacaccacgacugagucaagauguccaacacaaggagaaccuucauuaaaagaagaacaagauaaacgcuuuguaugcaaacacagcaugguagauagaggauggggcaacggaugcggucuuuucgggaaagggggcauaguuacaugugcuauguuuacauguaagaaaaauauggaaggaaaaauuguucaaccagagaauuuagaguacacaaucgugguuacaccccauucaggugaagaacacgcggugggaaacgacaccggaaaacauggcaaagagauaaaagucacuccacagucgucaauuacggaggcagaauuaacaggauaugguacaguuacuauggaauguucuccuagaacaggacuggauuuuaaugaaaugguucuacugcaaauggaaaauaaggcuuggcuaguccaucggcaaugguuuuuggaucugccauuaccuugguuaccaggggcugauaaacaagaauccaacuggauucaaaaagagacacucgugacuuucaaaaacccacaugcgaagaaacaagauguaguagugcuaggaagucaagaaggggcaaugcacacugcacuaacaggugcaacugaaauucaaaugagcucaggaaacuugcuguucacgggacaucugaaauguagguuaagaauggacaaacuccaacuuaaaggaauguccuacucaauguguacaggaaaauuuaaaguaguaaaagaaauagccgaaacacaacacgguaccaucgucauuagaguccaauaugaaggagacgggucuccuugcaaaauaccuuuugagauaauggacuuagaaaaacgauauguacuugguagacuaauuacaguuaauccuauagucacugagaaggauucaccaguaaauauagaagcggagccacccuuuggggacucguauauaaucauagggguagagccgggccaauuaaaacuuaauugguucaagaaaggaucgucuauaggccaaauguuugaaacaacaaugagaggagcaaaaaggauggcuaucuuaggcgacacggccugggacuuugguaguuugggagguguguucaccucaauaggaaaagccuuacaucagguauuuggagcaauauauggagcagcuuucagcggaguaaguuggacaaugaaaauucugauaggaguaauaaucacauggauaggcaugaauaguagaucaacuucucugagcgucagucuaguccuagugggaauagugacauuguauuuagguguaaugguucaagcggacucuggguguguagugucguggaaaaauaaagaacuuaaaugcggauccggcauauuuauaacugacaacguacauacauggacagagcaguauaaguuccaaccggagucaccuucuaaacuugcaucagccauacagaaagcacaggaagaaggcauauguggaauaagaucuguaacuagacuugaaaaccuaauguggaaacaaaucaccccggaauugaaucauauucuagcagaaaacgaggucaaauuaacuauaaugacaggagacauaaaaggcauaaugcaagcagguaaacgaagccuacgcccacaaccaacagagcugaaguauagcuggaagacuuggggcaaagcgaagauguuaucgacugaaucauacaaucaaacauuucuuauagacggcccggaaacggcugaauguccuaacacgaacagggcauggaauagcuuggagguagaagauuacggcuucggaguauuuacuaccaacauaugguuaaaauuaaaagaaaagcaggaugcauuuugcgauaguaaacuaaugagcgcggcgauaaaagauaaccgcgccguucaugcagacaugggauacuggaucgagucugcuuuaaacgacacauggaaaauagaaaaggcuagcuucaucgaagucaaaaacugccacuggcccaaaagccauacgcuauggagcaauggaguacuagaauccgaaaugauuauuccuaagaaucuagcaggacccguuucacaacacaauuaucgaccaggcuaccauacgcaaauugcgggcccuuggcaucugggaaaacucgaaauggacuucgauuuuugugacgggaccacagucaucgucacugaagacuguggaaauaggggacccaguuuaaggacuacaacugcaucuggaaaacuaauaacggaaugguguugccgaaguuguaccuuaccaccuuugcgcuaccgaggcgaagauggcugcugguauggaauggagauucguccccugaaggaaaaagaagagaaccuggugaacucauugguaacggcaggucauggucagguagacaacuucaguuuggguguacucggcauggcauuguuuuuagaagaaauguuacgaacucgaguaggaaccaaacacgcuauacuucuuguagcagucucuuucguuacucugauaacgggaaacaugaguuuuaaagacuuggguagagucguaguaaugguuggcgccacgauggcagacgacauugggaugggaguuacauaccuggcguuacuagcggcuuuuaaagugaggccgacauuugccgcuggccuacuauuacggaaauuaacaaguaaggaauuaaugaugacaacaaucgguauaguguuauugucacaauccacaauaccggaaacaguucuugaacuaacggaugcucuugcauuaggaaugauggucuuaaagaucguuagaaauauggaaaaauaccaacuagcaguuacuauaauggccauauugugugucccaaaugcagucauccuacagaaugcguggaaagucucuugcacaauucuagcgguuguaaguguuagucccuuacuuuugacaucaagucaacagaaaacugacuggauaccccuugcucuaaccaucaaaggucuaaacccgaccgcuauuuuucuaacaacucuuucucgcacaaauaagaagagauccuggccucuaaacgaagcaauuauggcuguaggcaugguuucaauacuagccucuagucuuuuaaagaaugacauaccaaugacaggacccuuaguagcgggaggacuuuuaacaguauguuacguauuaacuggaagauccgcagauuuagagcuugagagggcgaccgauguuaaaugggaagaccaggcagaaauaagcgggucaaguccuauucugucgauaacaauaagugaagacggcagcaugucaaucaaaaaugaggaggaagaacaaacacuaacaauccugauccgcacaggccuauuaguaauuagcgggcuguucccaauuaguaucccgauaacugcugccgccugguauuuaugggaaguaaagaagcaaagagccgguguacuaugggacguuccaucuccaccgcccaugggaaaagcugaacucgaagacggugcguacagaauuaaacaaaaacgcauacuagguuacucacaaauuggugcggggguauauaaagaagggacuuuccauacaauguggcacguaacgcgcggagccguacuaaugcacaaagggaaacgcaucgagccgucgugggcugacgucaagaaagacuuaauuagcuauggugguggcuggaaacuugagggagaauggaaagaaggugaggaaguucaaguguuggcacucgagccugggaagaauccaagggcuguccaaacaaaaccaggccuguuuaagacaaauaccgguacgaucggagccguaaguuuagacuucagucccgggacaaguggcucaccgauaauugauaagaaaggaaaaguaguuggucuauacggcaauggagucguuacuagaagcggugcguacguuucagcgauugcucagacggaaaaaucuauugaagauaacccagaaauugaggaugacaucuuuagaaaacgaagacuuaccaucauggaucuucaucccggugcugguaaaacaaaacguuaccuacccgcaauaguucgggaggcuaucaaacgaggacuuagaacacugauucuggccccgacccgcgucguggcagccgaaauggaagaggcauugcgaggauuaccaauaagauaccagacuccggcuauacgugcagaacacacggguagagaaauugucgauuugaugugucacgcaaccuucacaaugagauuauuaagcccaguuagagugccaaacuacaauuuaaucauaauggacgaagcacauuuuacugauccggccuccauugcggcacgugguuacauuaguacaaggguggaaaugggcgaagccgcugguauauucaugacugcaaccccgcccgggucccgagacccauucccgcaaucaaaugcaccgauaaucgacgaagaacgagaaauuccggaaagaucauggaacucgggacaugaaugggucacugacuuuaaaggaaaaaccgucugguucgucccuucuauuaaagccggaaaugacaucgcagcgugccuuaggaaaaaugguaagaaaguuauucaauuaagccgcaaaacguuugauucggaguaugucaaaacgagaacaaaugauugggauuuugugguaacgacagauauaucggaaaugggagcuaauuuuaaagcugaaaggguaaucgauccucgucguugcaugaaaccagucauacuaacugauggggaagaacgugugauucuagcaggucccaugccaguuacccauaguagcgcugcacagaggcgagguagaauaggaagaaauccuaaaaaugaaaaugaccaauauauuuauaugggugaaccccuugaaaaugaugaagacugugcucauuggaaagaagcaaaaauguuacuagacaauauaaacacacccgaagguauaauaccaucuauguucgaaccugagcgagaaaaaguagaugcgauugacggggaauaucguuuacggggagaagcaaggaagacauucguggaucucaugaggagaggagaucuacccguaugguuggcauauaaaguagcugcggagggcauaaacuacgcagauagacgaugguguuucgauggaaucaaaaacaaucaaauacucgaagaaaauguagaagucgaaaucuggacuaaagaaggggaaagaaagaaauuaaaacccagaugguuagaugcaagaaucuauucagauccuuuagcauugaaagaguucaaagaguucgcugccgguagaaaauccuuaacguuaaaucucauaacggaaaugggccgauugccuacauuuaugacacagaaaacaagggaugcuuuagacaauuuggcaguacucagaacagcggaagccgguggccgugcuuauaaucacgcguuaucugaauuaccagagacacuggaaacgcuauuacuucuaacacugcuugcuacaguuaccggcgguauauuucuauuuuuaaugucuggaagaggaauagguaaaaugaccuuagguaugugcuguauaauuacagcgucgauacuucuuugguacgcccaaauccaaccgcauuggauagcugcuucuaucauauuagaguucuuucuaauaguucuuuugauucccgagcccgagaagcaacguacgccucaagauaaucaacuuaccuauguggugauugcuauucucacugucguggcugcaacaauggcuaacgagaugggauuucuugaaaagacuaagaaagacuuaggcuuagguagcauagcaacacagcaaccggaaaguaauauacucgauauagauuuaagaccugcuucggcauggaccuuauaugcggucgcaacuacuuuugucacaccgauguuacgacacagcauagaaaauucaucuguaaacgucaguuugacggcgauagcaaaccaagcaacuguacuaaugggacuagggaaaggguggccauuaagcaaaauggauauagguguaccacuccuagcgauuggguguuauucacaggugaacccaauaacuuuaacagcagcacuauugcuacugguugcucauuacgccauaaucgguccaggguuacaagcgaaagcaacgagagaagcucagaaaagagcagcagccgggaucaugaaaaaucccacuguagauggaauaacaguuauugacuuagauccaaucccguacgauccaaaauuugaaaaacaacuuggacaagugauguuacuuauuuuaugcguaacgcagguacucaugaugcgcacgacuugggcauuaugugaagcucucacguuggcgacugguccgauuaguacacucugggaaggaaauccaggccgauuuuggaacacuacaauugcagucaguauggcaaacauauuuagagguucuuaucucgccggugcgggauuacuauuuucaauuaugaaaaacacaacaaauacgcguagagguacuggaaacauaggagaaacucuuggcgaaaaguggaaauccagacuuaacgcccuaggcaaaucggaauuucaaauuuacaagaaauccggaauccaggagguggacagaacgcuagcaaaagagggaauuaaacgcggugaaacggaucaccaugcuguauccagaggcagugcuaaauuacgcugguuuguagaaagaaacaugguuacacccgaagguaaggucgucgaccucggguguggcagaggagguuggaguuacuacuguggagggcucaaaaauguaagagaaguaaaagguuuaacgaaaggugguccuggacaugaggagcccaucccaaugucaacuuacggcuggaaucuugugagacuacaaaguggcguugacguuuucuuuauaccuccggagaaaugcgacacccuccuaugcgauauuggugaaucuuccccuaaucccaccguugaggcgggcaggacacuucgggugcugaaccuaguugagaauuggcuaaacaacaauacacaguucuguauuaaaguacuuaauccuuauaugccuucagugaucgagaaaauggaagcccuucaaagaaaauaugguggcgcacuuguucgaaacccucuuaguagaaacucaacacacgaaauguauuggguuucuaaugcaucaggaaauaucguaaguaguguuaacaugauuucaaggaugcuuauaaaccgauucacaaugaggcauaagaaagcuacguaugaaccugaugucgaccuuggaucaggaacacgaaauauugggauagagucagaaguaccaaauuuggacaucaucggaaaaaggaucgaaaagauaaaacaagaacaugaaacaaguuggcacuaugaccaagaccauccauacaaaacuugggcauaucaugguagcuacgagaccaaacagacugggagugcuucgagcaugguaaacggagucguccggcuauuaacuaaaccaugggauguacucccaacaguuacucaaauggcaaugacggacacaacgccauuuggacaacaaagaguguucaaagaaaaaguggacacccgaacucaagaaccaaaggaaggaacgaagaaauuaaugaaaauuacggcagaauggcuauggaaagaauuagguaagaagaaaaccccacgaauguguacuagggaagaguucacaagaaagguaagaagcaacgccgcacuuggagcgauauucacggaugaaaacaaauggaaaucugcuagagaagcuguagaagauagucgauucugggagcuuguagauaaagagagaaacuuacacuuggagggaaaaugugagacaugugucuauaauaugaugggcaaaagagaaaagaaacuuggugaauuuggaaaagcgaaagggagcagggcaauaugguauauguggcuaggcgcucgauucuuagaguuugaggcacucggcuuucucaaugaagaccacugguuuucacgagaaaauagucuuaguggaguagaaggagaaggauuacauaaacuuggauauauuuuacgugacgugagcaagaaagaaggcggcgccauguaugcagaugacaccgcagguugggacacacgaauaacauuggaagacuugaaaaacgaggagauggugacaaaccacauggaaggugaacauaagaaauuagcagaagcgauuuucaaacuaacauaccagaauaaaguaguaagaguacaacgucccacgccgcgcggcacagucauggauauaaucagcaggagagaucaaagaggaucagggcagguaggaaccuauggccuaaacacuuuuacaaacauggaagcccagcugauaagacaaauggaaggugaagggguauucaaaaacauucagcaccugacagucacagaagagguggcaguccaaaauugguuagcacgggucgguagagaaagacuaaguagaauggccauaucaggagaugauugcgucguaaaaccauuagacgacagauucgcaaaugcacuaacggccuuaaacgauaugggaaagauaagaaaagauauucaacaaugggaaccguccaagggauggaaugacuggacucaaguuccauuuugcagucaccauuuccacgaacuuauuaugaaagauggaagggucuuagucguccccuguagaaaucaagacgaauuaauaggaagggccagaaucagucagggagccggaugguccuuaagggaaacugcuugcuuggggaaaucauaugcgcaaauguggagucuaauguacuuccauaggagggaccuacgacuagcggcaaacgcaauuuguagugccgugccaucacauugggucccaacaaguagaacaacauggucaauacaugccaagcacgaauggaugacuacagaagacaugcucacaguuuggaaucgaguuuggauucgagagaauccuuggauggaagauaaaacgccaguagaaagcugggaggagauaccauaccuaggaaaaagagaagaucaaugguguggaucuuuaauugguuuaaccaguagagcaacaugggccaaaaacauucaagcagcgaucaaccaaguaagaagucuaauaggcaaugaagaauauacagacuauaugccaucuaugaaacgauuccgcagagaagaggaggaagcaggaguuuuaugguga

SEQ ID NO: 22512 - RNA, 9876 nt, Artificial Sequence
  derived and/or modified CDS sequence (opt6) from DENV-2__FJ744718__SS-prME
ucagcugggaugauuauaaugcuuaucccuacuguaauggcauuccaccuaacuacuaggaauggagaaccucauaugauugugggaauacaagaaaaagggaaaucguugcuuuucaaaacugaggacggagugaauaugugcaccuuaauggcgauggaucucggagaacugugugaagacacuaucacauauaaauguccauuauuacgucaaaaugaaccggaggacauagauuguugguguaacuccacaagcacauggguaacauacgggacaugcacaacaacaggcgagcaucgacgagaaaaacguuccguugcacuuguaccucacguaggaaugggguuggaaacucgaacggaaacguggaugaguagugaaggagcuuggaaacaugcacaacgaauagaaacguggaucuuacgacauccaggcuuuacuaucauggcagcaaucuuagcauauaccauaggaacuacgcauuuucaacguguauuaaucuuuaucuuauugacagcaguugcaccgaguaugaccaugagaugcauuggaauaucuaaccgagacuuuguagaaggcguaagcggugggucguggguagacaucguccucgaacacgguucuugcguaacaacuauggcgaaaaacaaaccaacguuggauuuugaauuaauaaaaacagaggcaaaacaaccggcaacgcuaagaaaauauugcauagaagcaaaacucacuaacacuacuacugagucucguuguccaacgcaaggagaaccuucguugaaagaagaacaagauaaacgcuuugugugcaaacacaguaugguagauagaggauggggaaauggaugugggcuauucggcaaaggcgggauuguuaccugugcaauguucaccuguaagaaaaauauggaagguaaaauaguccaaccugaaaaccuagaauacacaauuguugugaccccacauagcggcgaggaacacgcaguuggcaacgauacggggaaacacggaaaagaaauaaaagugacuccacaaucaagcaucaccgaggcagaauugacaggauaugggacuguuacuauggaaugcucccccagaaccggucuagacuucaaugaaaugguauuacuucaaauggaaaacaaagcguggcugguccaucgacagugguucuuagacuugccauuacccuggcuucccggugcagauaaacaagaaucuaacuggauacagaaggaaacauuaguaacuuucaaaaauccucaugcaaagaaacaagauguuguuguauugggcagucaggaaggagccaugcauacagcgcugacaggugcgaccgaaauacaaaugucuuccgguaaccuucuguucacaggucaccuaaaaugcaggcuacgcauggauaaauuacagcuaaaagguaugucuuauaguauguguacaggaaaauucaaagucgucaaggagauagcagaaacucagcacggcacaaucgucauccgaguacaauaugagggagacggauccccuuguaaaauaccauucgaaauaauggauuuagaaaagcgauaugugcuagguagguuaauaacgguaaauccgauaguuacagaaaaggauucaccuguaaauaucgaggcggaaccaccauucggagacucuuacauaauaauugguguagaaccaggccaacuuaaguuaaauugguucaaaaaggguucguccauaggacaaauguucgaaacgacgaugagaggcgccaagagaauggccauccuaggugauacugcgugggacuuugguucauuagguggaguauucacaucaaucggaaaggcucuacaucaaguuuuuggagcaauauacggugccgcuuucuccgggguauccuggacaaugaagaucuuaauuggaguuauaauaacauggauuggaaugaacucacgaucgacaagccuaagcgucagcuuggucuuagugggaauuguuacguuguaccucggggugaugguacaagcugacagugguuguguuguuagcuggaagaauaaagaauuaaagugcgggucgggaaucuuuauaacugauaacguacauacuuggacugaacaguauaaauuucaaccggagucccccaguaaauuggcaucagcaauacaaaaagcgcaagaagaaggcauaugcggaauccguucugucaccagacuugaaaaucuaauguggaaacaaauaacuccagaauuaaaucauauacuagcugaaaaugaagucaaauuaacaauaaugacaggagacauaaaaggaauuaugcaagcugggaaaagaaguuuacgaccacaaccaacagaacugaaguacucguggaaaacgugggggaaagcaaaaauguugucaaccgaaucguacaaucaaacuuuccuuauagaugggccugaaacugcagaaugucccaauacaaaucgugcauggaacucuuuggaaguugaagacuauggcuuugguguauuuacaacaaauaucuggcuuaaauuaaaagagaaacaggacgcguuuugugauagcaaauuaauguccgcggccauuaaagauaauagggcaguacacgcugauauggguuauuggauagaaucugcgcuaaaugauacuuggaaaauagaaaaagccagcuuuauugagguaaagaauugucacuggccuaaaucucauacguuauggucaaacggugugcuggaaucugaaaugauuauucccaaaaaucuagcugggccaguuagccagcacaacuacagaccgggguaccauacacaaaucgcaggaccuuggcaucuggguaaacuagaaauggauuuugacuuuugcgacgggacaaccguuauaguuacggaggauugcgggaauagaggaccuucgcugaggaccacaaccgcgaguggcaaauugauuacggagugguguugucgaagcuguaccuugccuccauuacgauauagaggagaagacgguuguugguacggcauggaaauacgcccguuaaaagaaaaagaagaaaauuuagucaauagucucguuacagcgggacacggacaaguugauaacuuuagcuuaggaguccuagguauggcuuuauuuuuggaagaaauguuacguacaagagugggcaccaaacacgcgauauuacuuguagcgguaaguuucguaacucuaauaacaggcaauaugaguuuuaaagaucuaggccgaguaguugugauggugggagcuacaauggccgacgauauaggaaugggcgugacauacuuagcacuucuggccgcauuuaaaguucguccaaccuucgcugcuggacuacugcuaaggaaauuaacuagcaaagaauuaaugaugacaacaauaggcauuguauuacucagucagagcacgauaccagaaacuguacuugaauuaacugaugcuuuagcucucggaaugaugguacuuaaaauaguacgaaacauggaaaaauaccaacucgcuguuaccaucauggcgauuuugugcgucccaaaugcgguuauacuacaaaaugcauggaaaguaaguuguacaauccuugcagucguuucaguuucuccacuucuauugacgaguagucagcagaaaacugacuggauuccucuugcacucacuauaaaaggauuaaauccuacggccauauuucuaacgacuuuaucgagaacaaacaagaaaagaucuuggccguugaaugaggcaaucauggcgguuggaaugguaagcauacuggcaagcagccuacuuaaaaaugauauuccaaugacaggaccucugguagcugggggucuucuaacagucuguuauguucuaacugguagauccgcagauuuagaguuagaaagggcgacggaugucaaaugggaagaucaagccgagaucucagguucaagcccaauuuugucaauuaccauaucggaagacggcagcaugagcaucaaaaaugaagaggaagaacaaacacucacuauuuuaauucguacaggguuacugguuauaagcggucuuuuuccaauuucgauuccgauuacugcugcagcaugguaucucugggaaguuaagaagcagagagcuggugugcucugggauguaccaagcccuccuccaaugggaaaagcugaacuggaagauggggcauaucgaaucaaacaaaaggguauacuagguuacucacaaaucggugcaggcguauauaaagagggaacauuccauacaauguggcacguaacccguggugccgugcuaaugcauaaaggaaaaaggauugagccaucgugggccgauguuaagaaagacuuaauaucauauggggguggauggaaauuggaaggggaguggaaggaaggcgaggaaguccaaguccuugcauuagaaccugguaagaacccuagggccguccagaccaaaccaggccuuuuuaaaacuaauacugguacuauaggggcuguauccuuagauuuuucuccaggaacaucaggaucccccauuauagauaagaaaggaaaaguuguuggucucuauggaaacgguguaguaacgcguucaggcgcguacguuagugccauagcacaaacugaaaagaguauugaagauaaccccgaaauugaagaugacauauuuagaaaaagaagauugacaaucauggaucuucacccuggagcuggaaaaacaaaacgauaucuuccggcaauagugcgugaagccauaaaacggggacugagaacgcuaaucuuagcuccgacaagaguaguagcugcagaaauggaggaagcguuaaggggccuacccauacgguaucaaacacccgcgaucagagccgagcacaccgguagggagauuguagaucucaugugucaugcgacuuuuacaaugagacuccuaagcccaguuaggguaccuaacuauaaccuaauuauaauggaugaagcucauuucacagacccugcuucaauagcagcaagaggauauaucaguacucguguagaaaugggcgaggcugcgggaauauucaugacugcgacaccgccaggaucgagagacccauuuccgcaaaguaaugcacccauuauugaugaagagagagagauaccagagcgaucauggaauaguggacacgaauggguaacugauuuuaagggaaaaacagucugguucguaccgucgauaaaagcagguaacgauauagcugccugcuuacguaaaaaugguaagaaagugauucaauugagcagaaaaacuuuugauagcgaauacguuaaaacuagaacaaacgauugggacuuuguuguaacaacggacauaucagaaaugggugcaaacuuuaaggccgaaaggguaauagacccucgacguugcaugaaaccaguaauacuaacagacggcgaagaacgcguuauacuggccgguccgaugccagugacccauagcagugcugcgcaaaggcgcggaagaauuggucgcaaucccaaaaaugaaaaugaucaguauauauauaugggugaaccauuggaaaaugaugaagauugugcucauuggaaagaagcgaaaaugcuuuuggauaacauaaauacgcccgaggguaucauuccaagcauguuugaaccugaaagagaaaaagucgacgcaauagacggcgaauaccgucuaaggggagaagccagaaaaacauucguugaccuuaugcgacggggugacuugccagugugguuagcguacaaaguggccgcagaagguauuaacuacgcugauagaagaugguguuucgacgguauuaaaaauaaccaaauacuagaagaaaacguugaaguugaaauauggaccaaagaaggagaaagaaagaaacuuaaaccaaggugguuggaugcgagaauauauagugacccacucgcucuaaaggaguuuaaagaauuugcagccggacgcaaaucacuuaccuuaaaucugauaacggaaaugggcagauuaccgacuuucaugacucagaaaacgagagaugcccucgacaaccuagccgucuuacauacagcagaggcaggaggcagagcauauaaccacgcuuugucagaacuaccagagacauuggaaacauuauuacuucuuaccuuauuagccacagucacagguggaauauuccuauuucuaaugagcggaagaggaaucggaaaaaugacacuggggauguguugcauaauaacagcauccauucuccuaugguaugcucaaauucagccucacuggauagcagccagcaucauccuggaguucuuuuugauaguauuacuaauuccugaaccggaaaagcaaagaacaccccaagacaaccaacuuacguacguuguuauugcuauucuaacaguaguagcugcuacaauggcaaaugaaaugggguucuuagaaaagacaaagaaagacuuaggauuagguuccauagcaacacaacaaccggaaucaaauauccuggauaucgaucugcgaccggcuagcgcauggacguuguacgcaguagcuacaacauuuguaacuccaaugcugaggcacucaauugaaaauaguaguguaaacguauccuugacugccaucgcaaaccaggcgacaguacucaugggauuagggaagggauggccauugucaaaaauggacauuggggucccguuacuagccauaggaugcuauagucaaguaaaccccauuacauuaacugcggcacuauugcucuuaguagcucacuacgccauuauaggcccagggcugcaggcuaaagcaaccagggaagcacagaaaagagcagcggcugggauaaugaaaaauccaaccguagacggaauaacaguaauagacuuagacccuauuccauaugauccaaaguuugaaaagcagcuugggcaaguaaugcuucuuauuuuaugcguaacgcaaguauuaaugaugcgaacuacaugggcauugugcgaagcguuaacgcuggcgacaggaccaauaucaacauuaugggaggggaguccugguagauuuuggaacacaacgauugcuguaaguauggccaacauuuuuagaggcaguuaccucgccggugcgggucuucuuuucucgauaaugaaaaacacuacuaauacucgccgagguacagggaauauuggggaaacucucggagaaaaauggaaaaguagguugaaugcguuaggaaaauccgaguuccaaauauacaaaaagagugguauacaagaagucgaucgaaccuuggcaaaagaaggaauuaaaagaggcgagacagaccaccacgcuguuaguagagguucagcaaaauugagaugguuuguagaacgaaauaugguaaccccagagggaaaaguaguagaucuugguuguggucgcgguggauggucguacuacugcggaggacuaaagaauguacgugaaguuaaaggcuuaacaaaaggaggaccaggucaugaggagccaauccccaugagcacguauggguggaauuuaguuaggcuucaaucuggugucgaugucuuuuucauacccccugaaaaaugugauacacuacucugcgauauuggagaaagcagcccuaacccaaccguggaagcuggaagaacacuucgagugcuaaauuuaguagagaauuggcucaauaauaacacucaauucuguaucaaagucuuaaacccuuauaugccuucuguaauugagaaaauggaagcguuacaaaggaaauaugguggugcgcuagucaggaacccucucucgaggaacucgacccacgaaauguauuggguauccaaugcuucuggaaauauagugagcucaguuaacaugauaucacguaugcuuauaaauagauuuacaaugcgucauaaaaaggcuacguacgaaccggauguagacuugggaaguggaaccaggaauaucggaauugaaagcgaaguuccuaaucuagacauaauagguaaaagaauagagaaaauaaaacaagaacaugaaacaaguuggcauuacgaucaagaccauccauacaaaaccugggccuaucauggaaguuacgaaacaaaacaaacuggaagugcuucgucuaugguaaauggagucguacgcuuauuaaccaagccaugggauguucuaccaacggucacucagauggccaugaccgacacgacgccauuuggccaacaacgaguauucaaagaaaaagucgauacacgaacccaagaaccgaaagaaggaacgaagaagcugaugaaaauuacagcugaauggcucuggaaagaauuagguaagaagaaaacuccaagaauguguacacgagaagaguuuacgagaaaggucagauccaaugcugcgcucggcgcaauauuuacggaugaaaauaaguggaagagugcacgcgaggcaguggaagauaguagguucugggaguuaguugacaaagaaaggaauuuacauuuagaggggaaaugcgagacauguguguauaacaugaugggcaaaagagagaagaaacucggagaguucggcaaggcuaaggggucacgggcuauuugguauauguggcuuggugccagguuuuuagaauuugaagcauugggauuuuuaaacgaagaccauugguucucaagggagaacagucuaaguggaguagagggcgaaggacuacauaaauuagguuauauacucagagacguuaguaaaaaggagggaggggcaauguaugcggaugauacugccggaugggauacgcguauaacguuagaggaccugaaaaaugaagaaaugguaacaaaccauauggagggugaacauaagaaacuagcagaagccauauucaaauuaacguaucaaaacaaggugguacgagugcaaagaccaacgccaagaggaacagucauggacauaauuaguagaagagaccaacgcgggucugggcaaguuggaacguauggacuuaacacauucacgaacauggaggcgcaacucauuagacaaauggagggggagggaguauucaaaaauauacaacaucugaccgugaccgaagaagucgcuguacaaaauuggcuggcaagagugggucgagagagauuaagcagaauggcuaucagcggagacgacuguguaguaaaaccgcuugaugaucguuucgccaaugccuuaacagcucuaaacgauauggguaagauccguaaagacauacagcaaugggagccaucuaagggauggaaugauuggacucaagucccauuuuguucacaucacuuccacgaacuaauaaugaaggacgggaggguacuuguuguuccuugucgaaaccaggaugaauuaauugggagggcgcgcauaucccagggugcagguuggucuuuaagggaaacagcaugcuuaggaaaaucauacgcacaaauguggucuuuaauguauuuucaccgcagggaucuucguuuggccgcuaacgcuauauguucugcugucccuucacacugggugccuacaucuagaacaaccuggucgauccaugcaaagcaugaauggaugacgacagaagacaugcuaacaguuuggaaccguguauggauacgagagaacccguggauggaagauaaaacuccaguagaaucaugggaagaaauuccauacuuggggaaacgugaggaccaaugguguggaaguuuaauaggacuaacaaguagagcuacaugggccaaaaauauucaagccgcaauuaaucaaguuagaucacuaaucgguaaugaggaauauacugauuauaugcccucuaugaaacguuuucgacgagaagaagaggaagccgguguauugugguaa

SEQ ID NO: 22513 - RNA, 9876 nt, Artificial Sequence
  derived and/or modified CDS sequence (opt6) from DENV-2__FJ744722__SS-prME
agcguaggaaugauaauaaugcuaauaccgacggucauggcauuucaccugacgacuagaaacggagaaccgcauaugaucguaucaauccaagaaaaaggaaaaucgcuuuuauucaaaacugaagauggaguuaauauguguacauuaauggcaauggauuuaggagaacuuugcgaagacacuaucacguauaaauguccacuuuuaaggcaaaacgaaccagaagauaucgauuguuggugcaauagcaccucaaccuggguuaccuacgguaccugcacuacuacaggagaacauaggcgugaaaaacgaucaguggcgcuaguaccucacguaggaaugggcuuggaaacaagaacggaaaccuggaugagcucagaaggagcuuggaaacaugcucaaagaaucgaaacuuggauacuaagacauccugguuucacuaucauggcagcuauacuggcauauacaauaggaacaacacacuuucaacguacgcuaaucuucauucuucuaacggcagucgcaccauccaugacaaugagaugcaucggaauuuccaacagagacuuuguugaaggagucucuggaggcaguuggguggacauagugcuugaacacggaucguguguuacaacaauggccaaaaauaaacccacucuggauuucgaauuaaucaaaacagaggcgaaacagccagcuacauuaaggaaauacuguauagaagcaaaacuaacaaauacaaccacagaaucuagauguccaacacaaggcgaaccgaauuuaaaagaagaacaagacaaaagauuuguuuguaaacauuccaugguugaucgaggaugggguaacgguugcggcuuauucggaaagggugguauaguaacaugcgcgauguuuacauguaaaaagaauauggaaggaaaaaucguccagccagaaaacuuagaguauaccauagugguuaccccgcauucaggcgaagaacacgcugucgggaaugauacugguaaacacggaaaagagauuaaaguaacuccucaaucuucuauaaccgaagcagaauuaaccggguauggcaccguaaccauggaauguucaccaagaacuggacuagauuucaaugagaugguuuuacuucaaauggaaaauaaagcaugguuaguacacagacaaugguuuuuagaccuuccucuucccugguugccaggugcugacacacaaggaucaaauuggauccagaaagagacauuaguuacauuuaaaaacccucacgccaagaaacaagauguaguugugcuaggaucacaagaaggagcaaugcauacggccuuaacaggagcgacagagauccagaugucaaguggcaaucuuuuguucaccggucaucugaaauguagacuccgcauggacaaacuucaauuaaaaggcaugaguuauaguaugugcacaggaaaguucaaaguaguuaaagaaaucgcagagacacagcacgggacaauagucauccguguacaauaugagggagacgguuccccaugcaaaauaccguuugaaauaauggaucucgagaagagauauguccuaggaagauuaauuaccgucaauccaauagugacagaaaaagauucuccaguuaacaucgaagcagaacccccauuuggggauucauauauuaucauaggagucgaaccaggacaauugaaacuuaauugguuuaagaaaggaucgucuauaggacagauguucgaaacgaccaugcgaggagcaaaaagaauggcaauuuuaggugacaccgccugggacuuuggaucacuaggagguguuuucacaucaauuggcaaggcguugcaucaagucuuuggagccauauauggagcggcuuuuagugguguuucauggacgaugaagauacuaaucggaguaaucauaaccuggauaggcaugaacagcagaagcacaagccuuagugugucauuaguucuaguaggaguuguaacuuuauacuuaggaguuaugguacaggcggauucuggaugcguuguaucauggaaaaacaaggaauuaaaaugcggaucuggaauauucauaacagacaacguccacacuuggacugagcaauacaaauuucaaccagagucaccuaguaaguuggcaucugcaauucaaaaggcacaagaggaaggaauaugcgguauaagaagugucacuagacucgaaaaucuaauguggaaacaaauuacaccggaacuaaaucacauccuagcugaaaacgaggucaaguuaacaauaaugacaggagauauuaaaggaauaaugcaagcugggaaaaggucauuacgcccacagccaacugaacuuaaauauaguuggaaaacuuggggaaaagcgaaaauguuaucgacagaaucgcauaaucaaaccuuccuaauagacgggccagagacugccgaauguccaaauacgaauagagcauggaacucuuuagaaguagaagauuacggcuuuggggucuucaccacuaacauaugguugaaauuaaaagagaaacaagaugcauuuugugacucuaaauuaaugucugcagcuauaaaagacaauagagccgugcacgcggauauggguuauuggauagagagcgcauuaaaugacacuuggaaaauugagaaagccagcuuuauagaggucaaaaauugucacuggccgaaaucacacacgcuauggucaaaugguguauuggaaagcgaaaugaucauacccaagaaccuggccgguccgguuagucaacauaacuauagaccaggcuaccauacgcaaauagcuggcccauggcaucuagggaagcuagaaauggacuucgauuuuugugacggaacaacagugguagucacggaagacuguggaaauagaggcccuagccucaggacaacuacggcuaguggaaaauuaaucaccgaaugguguugccgauccuguacuuuacccccacuaagauaccguggugaggaugguuguugguaugggauggaaauacgcccauuaaaggagaaagaagaaaauuuggucaacucacuuguaacagcgggccauggacaaguugauaacuucaguuuagguguacuugguauggcucuauuuuuagaggaaaugcuaagaacaagaguuggcacuaagcacgcaauucuucucguggcuguuagcuuuguaacacuaaucacugguaauauguccuuuaaagaucucggaagagucguagugaugguaggugcuacgaugaccgaugacauaggaaugggggucacuuauuuagcccuccuagcagcauuuaagguaaggccgacauucgcugcuggcuuauucuuaaggaaauugacuuccaaagaacucaugaugacaacuauaggaauaguuuuacucucccaaucaacaaucccagaaacgauauuggaacuaacagacgcucuugcacuggguaugaugguucuaaaaaugguaagggauauggagaaauaccaauuggcagucacuauaauggcgauucugugcguacccaaugcggucauuuuacaaaacgcguggaaaguaucuuguacaauacuagcugucgucagcguuucaccacuacuucugacaaguagucagcagaaaacugauuggauaccgcuagcucuaacaauuaaagggcucaauccgacagcaauauuuuuaacgacccugucacguacuaauaagaaaagaaguuggccauuaaacgaggcuauuauggcaguagguaugguaucaauacucgcuucaucucuacuuaaaaaugacauaccuaugacagggccgcuaguugcaggaggacuauuaacgguuuguuauguguuaacagguaggucugcagauuuggaacuugaaagagcaacagacguaaagugggaggaccaggcagaaauaucugggucuuccccaaucuuaucgauaaccauaagugaggacgguucaaugaguaucaaaaaugaggaagaagaacaaaccuuaacaauuuuaauuagaacggggcuucuugugaucuccggcuuguuccccgucaguauaccaauaacugccgccgcgugguaccuaugggaaguuaagaaacaacgcgcgggagugcuaugggacgucccgaguccaccaccaauggggaaagcagagcuagaagauggugcuuacagaaucaaacaacguggaauccuagguuauagccaaauaggggcugguguuuacaaggaaggcacuuuccauacuauguggcacguaacacgaggagcaguauugacgcauaaaggaaaaagaauagaaccuucaugggccgauguuaagaaagaccugauuaguuacggcggugguuggaaauuagaaggugaauggaaagagggcgaagaaguacagguucuggcauuagaaccuggcaaaaauccacgagcuguacaaacuaagccuggauuauuuaaaacaaauacagggacaauaggugcugucucgcuggacuuuaguccaggaacaagcgggagucccauuauagauaaaaagggaaagguagugggcuuauauggaaacggcguagugacaagaucaggggccuauguuagcgcaauagcucaaaccgagaaaucgauagaagacaauccagauauugaagacgacauauucagaaaacgucgacugacaauuauggaccuacaccccggugcuggaaaaacaaagagauauuuacccgcaaucgugagggaagcaauaaaaagagguuuaaggacacucauuuuagcaccuacacggguaguugcagccgagauggaagaagcacuuagaggacuaccaauacgcuaccaaaccccugcaauacgggcagagcacacgggacgcgaaauuguugaucucaugugccaugcgacauucacaaugcgacuacuaucucccgucagagugccgaacuacaacuuaauuauaauggaugaagcacacuucacugauccugccaguaucgcagcccgcggcuauauuuccacacguguugagaugggugaggcggcagggauuuuuaugacugccacacccccgggaagcagagacccguucccacagaguaacgcaccuauaaucgacgaggagcgagaaauaccugaacgaucauggaacaguggucaugaaugggugacagauuuuaaagggaagacuguuugguuuguuccaucaauaaaagcagguaacgauaucgcagcaugucuuaggaaaaaugguaagaaaguaauucaacuaucgcgaaagacguucgacagcgaauauguaaagacaaggacuaacgauugggauuucguagucacuacagauauauccgagaugggcgcaaauuucaaagcugagaggguaaucgacccucgaagguguaugaagccaguaauauuaaccgauggugaagaaagagucauacuugccggaccaaugccaguaacccacuccucggccgcccagagaagaggaagaauaggcaggaauccgaaaaacgaaaaugaccaauauaucuauaugggagagccacuugaaaaugacgaagacugcgcccauuggaaagaagcaaaaaugcuacuugauaauaucaauacucccgaagguauuauuccaucaauguucgaaccagaaagagaaaagguugaugcgauugacggagaguaccgcuuacgaggagaagcuagaaaaacauuuguagacuugaugagacgaggugauuuaccagucuggcuagcauacaaaguggcagcugaagggauuaauuacgcagaccgacgcugguguuucgaugggaucaaaaacaaccaaauacuagaagaaaacguugaggucgaaauuuggacgaaagaaggggagaggaaaaaguuaaaaccaagaugguuggacgcaagaauauacucagauccauuagcguuaaaggaguucaaagaguucgcugcuggacgcaaaucucucacguuaaacuuaauaacugagaugggucgauugcccacauuuaugacccagaagacaagggaugcauuggacaaccuggcaguauuacacacggccgaagcuggcgguagagcauacaaccaugcuuuaucugaauuaccagaaacacucgaaacgcuauuauugcuuacacuguuagcgacaguuacaggaggaauuuuccuguuucuuaugucugggcgcggaauaggaaaaaugacucuuggaauguguugcauaguaacagcaaguauacuacuaugguacgcgcaaauucagccccacuggauagcagccagcauaauccuggaauuuuuccuaauagugcuccuaaucccggaaccagaaaagcaaaggacuccgcaggauaaccaauugacauauguuguaauagcuauccugacagucguugcugcaaccauggcuaacgaaaugggauuucucgagaagaccaaaaaggaucuagggcucgggagcauagcaacgcaacagccagaaucuaauauauuagauauugaucuuaggccggcaagcgcguggacucuuuaugcagucgccacaacauucgucacaccuaugcuucgucacaguauagaaaacucaucgguuaacguaaguuuaacugcuauugcgaaucaggcuacuguguuaaugggucuuggaaaaggguggcccuuaucaaaaauggacauaggugcuccacugcuagcaauagguuguuacucccaaguaaauccuauaacauugacagcggcacuuuuacuauuaguagcacacuacgcaauaauagguccuggacuacaagcaaaagcgacacgugaagcccaaaagagagcagcugcaggaauuaugaaaaauccaacggucgacggaauaacaguuauugaccuagacccaaucccuuaugacccgaaauuugaaaaacaacucggacaagucaugcuccuaguucucuguguaacucagguuuuaaugaugcguacaacuugggcacuuugcgaggcuuugacgcuagcaacagguccuauaaguacauuaugggagggaaauccaggaagauuuuggaauacgacgauugcggugucuauggcuaauauauuucggggaucauaccuugcaggagcgggacuguuauucaguauaaugaaaaauacaacaaacagcagacguggaaccgguaauaucggagaaacacucggggaaaaauggaaaagucgacuuaaugcuuuagguaaaucagaguuccagauauacaagaaaagugggauccaagaaguugauagaacccucgcuaaggagggaaucaagcgaggugagacagaucaucaugcuguaaguagaggcagcgcaaaacuacgaugguuuguagaacguaauaugguuaccccagaaggaaaaguugucgaccuugguuguggcagaggagguuggucuuauuauuguggcgggcuuaagaacguaagggaaguuaagggauugacgaaagggggacccggacacgaagaaccaaucccaaugucgacguauggauggaaccugguuagacugcaaagcgggguugauguguucuuuauucccccagaaaagugugauacacuuuuaugugauaucggagaaaguuccccaaacccaacaguagaggcagguagaacacuucgugugcugaacuuaguagaaaacuggcuaaauaauaacacccaguucugcaucaagguccucaauccuuauaugccuagcguuauagagaaaauggaaaccuugcaacgcaaguauggcggcgcucuaguaagaaauccccuuucgaggaacagcacacacgagauguauuggguaaguaaugcaagcggcaauauugucucaagcgugaauaugauuucucggaugcuaauuaacagauucacuaugagacacaagaaagccacauaugaaccagauguugaccucggaucaggaacacgcaacauagggauagaaucagaaauuccaaauuuagacauaaucgggaaacgcauagagaaaauuaaacaagaacaugaaacaucauggcauuaugaucaagaccauccguacaaaacgugggccuaucaugggucuuaugaaacaaaacaaaccggaucagcgaguucuauggugaacggaguaguucgccuacucacaaagcccugggacguccuuccaacuguaacacagauggcaaugacugacacaaccccuuucggccaacagagaguuuuuaaagaaaagguggacacccgaacucaagaaccaaaagaagguacgaagaaauuaaugaaaauuacagcagaaugguuauggaaagaguuaggcaagaagaaaacaccucgaauguguacacgugaagaauuuacacgcaaaguaaggucaaaugcagcccuaggugcuauauuuacagacgaaaacaaauggaaaucagcuagagaagcagucgaggacagucguuuuugggaguuaguggauaaggaacgcaaccuccauuuagaaggaaaaugcgagacauguguauacaacaugauggguaaacgcgagaagaaauugggagaauuugggaaagcaaaaggaucucgcgccauaugguauauguggcugggugcaagauuccuugaauuugaggcauuaggauuccuaaacgaagaucacugguucucgagggaaaauaguuugucgggaguagaaggagagggacugcauagacuaggguacauucuacgagauguaucaaagaaagaagguggggcuauguaugcggaugauacagcaggcugggauaccagaauaacgcuugaggaccucaaaaacgaagaaaugguuacuaaucacauggaaggcgagcacaagaaauuagcagaagcuauuuucaaauuaacauaucaaaauaaaguaguaaggguccagagaccuacuccaagagggacaguuauggauauaaucucacgucgagaucaacgcggauccggucaagugggaacguaugguuuaaacaccuuuaccaauauggaagcccaauugauacgacaaauggagggugaaggaguguucaaaaauauacagcauuuaacuguaacagaagagauugcuguacaaaacugguuggcucgagugggacgagagcgauuaaguagaauggcaaucucgggcgacgauugcguuguaaaaccucuugaugauagauucgcauccgcccugacugcucugaaugacaugggcaaaauacguaaggauauacagcagugggaacccagcagaggcuggaaugauuggacacaagucccauuuuguucacaucauuuccacgaacuuauuaugaaagauggccgaguccuuguaguucccugucggaaucaagacgaauuaauugggcgcgccagaauaagucaaggcgcaggauggucauuacgggaaacagcgugccucgggaagaguuaugcgcaaauguggucucucauguacuuccacagaagggacuuacgacuagcugcaaaugcuauaugcagcgcaguccccucccauugggucccuacaucucguacgacuuggucaauucaugccaaacaugaguggaugaccaccgaagauaugcuuacuguguggaauagaguauggauccaagaaaacccuuggauggaggauaagacaccaguagaaucgugggaagaaauuccauacuuggguaaaagagaggaccaauggugcgguuccuugaucggacugacaucgagagcaacgugggcuaaaaauauacaaguagcgauaaaucaaguucggucacuaauagguaaugaagaguauacagauuauaugccgaguaugaaaagauucaggcgugaagaagaagaagcgggaguauugugguag

SEQ ID NO: 22514 - RNA, 9876 nt, Artificial Sequence
  derived and/or modified CDS sequence (opt6) from DENV-2__FJ744723__SS-prME
agcguaggcaugauuauaaugcuaauaccuacagucauggcauuccaucugacgacccggaacggugaaccucacaugauagucucaauucaggaaaaagguaaaagccuacuuuuuaaaaccgaagacgguguuaauaugugcacacuaauggcaauggauuuaggugaauuaugcgaagacacaauaacauacaaaugcccacuauuaaggcagaaugaacccgaagauauugauuguugguguaauagcacuuccacgugggugacuuacggcacguguacuacuacuggagaacauagacgagagaaacgaagcguugcuuuaguaccccauguagggaugggauuggaaacgcgaacagaaacauggaugucuucagaaggugcuuggaaacaugcacaacgaauagaaaccuggauauugcgucaucccggauucacaauuauggcugcgauacucgcguacacaauaggaacgacacauuuucagaggacacuuauauuuauucuauugacugcaguagcgccuucuaugacaaugagaugcaucggcauaaguaaucgugacuuuguagaaggugucucaggaggaucuuggguagacauuguacuugaacauggauccugcguaacuacuauggcuaaaaauaaaccaacgcucgauuuugaacuaauuaaaacagaagcaaaacaaccggcaacguuaagaaaauacuguauagaagcaaaacuuaccaacacuacaacagaaucuagaugucccacucaaggagaaccuucucuaaaagaggaacaagacaaaagauuugucuguaaacauucgaugguagaucguggauggggaaacgguugcggacuauuuggaaaagguggaauaguaacaugcgcaauguucacauguaaaaagaacauggaaggcaaaaucguacagccugaaaaccuagaauauacuauagugguaacaccccacaguggugaagaacacgcgguagggaaugauacuggaaaacauggaaaagaaaucaaaguaacaccccaauccagcaucaccgaagcugaacuaacaggauacggaacuguuacuauggaauguaguccacguacgggucuagauuucaaugagaugguucuucuacaaauggagaauaaagcauggcuagugcaccgacaaugguuucuagaucuuccuuuacccuggcuuccgggcgcugacacucaaggaucuaacuggauacaaaaagagaccuuaguaacauucaaaaacccccaugccaagaaacaggauguuguuguguuaggaucacaggaaggggcuaugcauacugcauugaccggagcaacagaaauacaaaugucgucuggaaaucuguuauucacaggacauuuaaaaugucgccuccgaauggacaaacuacaacuuaaaggaaugagcuacaguaugugcacgggaaaauuuaagguagugaaagaaauagcagagacucaacauggaacaaucgugauucggguacaauacgaaggugacggauccccauguaaaauuccauucgaaauaauggaucuagaaaaacguuauguacuaggaaggcucauaacgguuaacccuauaguuacagaaaaagauaguccagugaacauugaagcagaaccuccauucggugauucauauaucaucauaggaguagaaccuggacaacuaaaguuaaacugguuuaaaaagggaucuucaauaggacaaauguucgaaacuaccaugcgaggugcaaaacggauggcgauacucggagauacugcuugggacuuugguucuuuagguggaguguuuacaagcauagguaaagcgcugcaucagguauucggcgcuauuuauggcgcagcuuuuagcgguguaagcuggacaaugaaaaucuuaauaggagucaucauaacauggaucggaaugaacucaagaucaaccagccucagcguauccuuaguccuggugggagugguaacuuuauaucuaggugugaugguacaggcggacucuggaugcguaguaucauggaaaaacaaggaguuaaaguguggcucaggcauuuuuauaacggauaauguacauacuuggaccgaacaauauaaauuucagccugaaaguccuucuaaacuggcaucagcaauacagaaagcacaggaagaaggaaucugugguauucguucagugacgagauuggaaaauuuaauguggaaacaaauuacuccggaguugaaucauauuuuggcugaaaacgaagugaaacuaacaauaaugacaggagauaucaaggguauaaugcaggcaggaaaaagaucgcugcgcccacaaccgacagaacucaaguauagcuggaagacauggggcaaagcaaaaaugcuuagcacugagagccacaaucaaaccuuucugaucgauggaccugaaaccgcggaaugcccuaacaccaaccgggcauggaacucucucgaaguagaggauuacggcuuuggagucuuuacaaccaacauauggcuaaaguuaaaagaaaaacaagacgcauucugugacucaaaacucaugucggcagcaaucaaagacaacagagcagugcacgcagacaugggcuauuggaucgaaucagccuuaaacgauacauggaaaauagaaaaggcaaguuucaucgaaguuaagaacugucauuggcccaaaucccauacauuauggucaaacggaguguuggaaagcgaaaugauaauacccaaaaaucuggcuggucccguaagccagcacaacuaccgacccggauaucauacucaaauagcugggccauggcauuuaggaaaacucgaaauggacuuugauuuuugugacggaacgacagucgugguuacugaagauugcggcaacaggggcccuucacuacguacaacuacagcuagcggaaagcucaucacagagugguguugcagaagcuguacauugccaccuuuaagguauagaggggaagacgguuguugguacggcauggaaauuagaccuuugaaggaaaaagaagaaaauuuaguuaauagucuugugacugcagggcauggacaaguugauaauuucucauuaggaguucuuggaauggcauuguuucuugaagaaauguuacgcacucgcguagguaccaaacacgcuauacuacuuguagcgguaucauuuguaacuuuaauuacgggaaacaugucauucaaagaccugggucgaguuguuguaaugguaggugcuacaaugaccgaugacauaggcaugggagucaccuaucuagcgcuucuugcggcguucaaggugagaccuacguuugcagcaggacucuuucuuaggaaauuaacuucuaaagaauugaugaugacaacuauaggaaucguuuuacugucgcaaucaaccauuccggaaacaaucuuagaauuaacugaugcauuggcacuuggaaugaugguuuuaaagaugguaagggauauggaaaaguaucaacuagcaguuacuauuauggcaauacuaugcgugccaaacgcggucauauugcaaaaugcuuggaaaguuagcugcacaauucuagcugugguaucagucagccccuuacuuuuaacaucaucucagcaaaagacugacuggauaccauuggcuuugaccauaaaaggucucaacccaacagcaauauuuuuaacuacgcuaucuaggacgaauaagaaaagguccuggcccuuaaacgaagcgauaauggcaguuggcaugguuaguauucuugcuaguuccuuacugaaaaacgacauaccuaugacagguccuuuaguggcuggggguuugcuaacuguauguuaugucuuaacgggaagaagcgcagacuuggaacuagaaagagcaacugaugucaagugggaagaccaagcggaaauaagugguucaagccccauuuuauccauaaccauaucagaggacgguucgaugucaaucaaaaacgaggaagaagaacagacacuuacaauauugauacgaacagggcuucuaguuauaucuggacucuuuccaguaaguauaccaauaacagcagcggccugguaucuaugggaagucaagaaacaaagagcaggaguucucugggacguaccaucgccgccacccaugggaaaagcagaauuggaggauggagcuuaucguauuaaacaacgagggauucuagguuauucacaaaucggggcgggaguguauaaagagggcacauuccauacaauguggcacguaacgcgaggggcuguauuaacccauaaaggcaaaagaauugagcccagcugggcugaugucaagaaagaucuaauuuccuauggaggcgguuggaaauuagaaggugaauggaaagaaggggaagaaguacaaguauuggcuuuggaaccaggcaaaaauccucgagcaguucaaacgaagccugggcuauucaagacuaauaccggaacaauaggugcaguaucucuugacuuuucaccaggaacaucagggagcccuauuauugacaagaagggaaaggucgugggguuguacgguaauggcguagugacacggagcggagccuauguaagugccauugcccaaacugagaaaaguauagaagauaauccagacauagaagaugauauuuuuaggaaacggcgguuaacgaucauggaucuccauccaggggcgggcaaaacuaagagauauuuaccagcuauuguaagagaggcaauaaaacgagguuuaaggacacuuauauuagccccaacacguguagucgcggcugaaauggaagaagcauuacgcggguuacccauccgauaucaaacaccagcaauacgcgccgagcacaccggccgcgaaauuguagacuuaaugugccacgcgacauucacuaugagauugcuaucaccagucagaguuccgaauuacaacuugauaaucauggacgaggcccacuucacggauccagcaaguauagccgcaagagguuauauaucaacccgaguugaaaugggugaggcugcaggaaucuucaugaccgcuaccccaccagguagccgggaucccuucccccaaucuaacgcaccgaucaucgaugaggaaagagaaauaccugaacgcucauggaacuccggacaugaaugggucacugauuuuaaaggaaaaacagucugguucgucccuaguauuaaggcuggcaaugacauagcagcuugccuuaggaagaacggcaagaaaguaauacagcuuaguagaaaaacuuucgacagcgaauacguuaaaacucgaacuaaugacugggacuuuguuguaacaacugacaucagugaaaugggagcaaacuucaaagcagaacgugugauugauccucgacguugcaugaagccagucauucucacagacggcgaagaaagaguaauccuggcuggaccuaugcccguaacucauagcucagccgcacaaaggcgaggaagaauuggcaggaauccuaaaaaugaaaaugaucaauauauauauaugggagagccgcucgaaaaugaugaagauugugcucauuggaaggaggcgaaaauguuauuggacaacauaaacacacccgagggcauaauaccaaguauguuugaaccugagcgggaaaagguagaugccauagacggagaauaucgauuacggggcgaagcacggaagacuuuuguggaucucaugcggagaggagacuuaccaguuuggcuagcauauaagguagcggcugagggaauaaauuaugcugauagaaggugguguuuugacggaauuaagaauaaucaaaucuuggaagagaacguagaaguugaaauauggacgaaagaaggagagagaaagaaacuaaaaccacgguggcuagaugcacgaauauacagcgauccgcuugccuuaaaagaauuuaaagaauuugccgcuggucggaagucacuaacccuuaauuuaaucacagagaugggcagacuaccaacguuuaugacucagaagaccagggaugcacuagacaaucuugcuguacugcauaccgcggaagccggugguagagcauauaaucacgcauuaucugaacucccggaaacgcuagaaacguuauuauuacuuaccuuauuagcuacaguaacuggugggaucuucuuguuccuaaugucuggccggggaauugggaagaugacacuagguauguguugcauuguaacagcaucuaucuuauugugguaugcucaaauacagccacauuggauugcagcuagcauaauauuggaauuuuucuugaucguacuuuuaauaccugaaccugaaaagcaaagaacaccccaagacaaccaauugacguaugugguuauagccauuuuaaccgucguugcugcuacaauggcaaaugaaaugggcuucuuggagaaaaccaaaaaggauuuaggacuagggaguauugcaacacaacaaccggaaaguaacauacucgacauugaucuacgaccagccagcgcauggacauuauaugcuguggcgacuacuuucgugaccccaauguugaggcauaguauagaaaauagcucuguaaacguuagccuaacagcaauugcuaaccaagcaacagugcuaaugggauuaggaaaaggauggccauuaaguaagauggacauuggugcaccuuuauuagcaauagguuguuacagucagguaaauccuauuacuuuaacagcugcacuuuugcuucugguagcacacuaugccauaauuggaccaggcuuacaagcuaaagcaacaagagaagcacagaaacgagccgcugccggaaucaugaagaacccaacaguggacgggauaacuguuauagaucuugauccuauaccauaugaccccaaauucgaaaaacaguuaggacaaguuauguuguuagucuuaugcguaacgcagguacuuaugaugcggacuaccugggcgcuuugugaagccuuaacucuggcuaccggaccaauuucgacauugugggaaggaaauccuggaagauuuuggaauaccacaauagcaguaucaauggcuaacauauucagagggaguuauuuagcuggugcuggccuguuauucaguauuaugaaaaacaccacuaauaguagaagaggaacaggaaauauuggagagacucuaggugaaaaauggaaaucgcgauuaaacgcauuggggaaauccgaguuccaaauuuacaagaaaucuggaauacaagaaguggacagaacuuuagccaaagagggaauaaaacgaggugaaacggaccaucacgccguaucgcgcggaagugcgaaauuaagaugguuuguagagaggaauaugguaacaccugaaggcaaaguuguagacuuagguugcgguagaggaggauggucuuauuauuguggcgggcucaaaaauguacgggagguaaaaggauuaacuaaagguggcccuggucacgaggaaccaauucccaugaguacguacggauggaauuuaguaagacuacaaucaggaguggauguauucuuuaucccuccugaaaagugugauaccuuacuuugcgacauaggagaaagcucaccgaauccaacuguagaagcaggaagaacauugaggguacuuaaucuuguugaaaauuggcuaaauaauaacacgcaguuuuguauuaaaguauuaaauccauacaugccaucugucauagagaaaauggaaacacuacaacguaaguacggaggagcgcugguuaggaauccuuuaucacguaauucaacucaugagauguacugggugucuaaugcgaguggcaauauaguuucaucuguaaauaugauuagucgaaugcuaauuaauagauucaccaugaggcauaagaaagccacauacgagccggauguagauuuagggagugguacacgaaacauuggaauagaaucggaaauaccgaauuuggauauuauugggaaacguauagagaaaauuaaacaagaacaugaaacuuccuggcacuaugaccaagaucaccccuauaaaaccugggcguaucauggcuccuacgaaacaaaacaaacaggaagcgcaucgucgaugguaaauggaguuguuagacuacuaacaaaaccgugggacguacuuccaacaguaacacaaauggcgaugacggauacuacacccuuuggacaacaacgugucuucaaggaaaaaguggauacacgcacucaggaacccaaagaagguacuaagaaacugaugaaaauuaccgcagaguggcuauggaaagaauuagguaagaagaaaaccccacgaaugugcacuagggaagaguucacacgaaaaguucgcucuaacgcagcacucggcgcaauuuuuacagacgagaauaaauggaaaagcgcgagagaagcaguagaagauucucgauuuugggagcuaguagauaaagaacgaaacuuacaucucgagggcaaaugugaaacuuguguauacaacaugaugggaaaacgggagaagaaacuaggagaguucggcaaagcaaaagguucuagagcuauaugguacauguggcuaggcgcaagauuuuuagaguucgaggcucuaggauuuuuaaaugaagaucauugguucaguagagaaaauucacugucagguguugaaggagaagguuuacaccgauuggguuacauauugagagacgugaguaagaaagaaggaggggccauguacgcugaugacacugcuggcugggauacuagaaucacacuagaagaccucaaaaacgaagagauggucacuaaccacauggagggugaacauaagaaauuagcggaggcaauauuuaaauuaacguaccaaaacaagguaguaagaguccaacggccaacaccuagagguacggucauggauaucauuucgagacgugaccaaagaggauccggacaaguugggacuuauggacuaaacacuuuuacuaauauggaagcgcaguuaauaagacagauggaaggugaaggcgucuuuaaaaacauccagcacuuaaccgucaccgaggaaaccgccgugcaaaauugguuagcacgaguuggccgggaacgacuaagucgaauggcaauaucuggagaugacugcguuguaaagccucuagacgaucgcuuugccuccgcccuaacggcccuuaacgauaugggaaaaauaagaaaagauauucaacagugggaaccaucccgaggauggaaugacuggacacaaguaccuuuuuguucccaucacuuucacgagcuaauaaugaaggacgguaggguccuugugguuccaugucgaaaccaagacgaauuaaucgggcgagcacgcaucagccaaggcgcgggauggucgcuucgggagaccgccugucucgggaaauccuacgcucaaauguggucauuaauguauuuucacaggcgcgaucuuagauuagcugcuaaugcgauauguagcgcgguacccagccauuggguaccaacaucacggacaaccuggucgauacacgcaaaacaugaauggaugaccacagaagauauguuaacuguauggaauagaguuuggauucaggaaaauccauggauggaggauaaaacgcccgucgagucaugggaagaaauuccuuaucugggaaagagggaagaucaauggugcggaaguuuaauaggguuaacaucuagggcuaccugggcuaaaaauauucaaguagccaucaaccaaguuaggagcuuaauugguaaugaagaauacacagacuacaugccgaguaugaaaagguuuagaagagaggaagaggaagcaggaguauuaugguag

SEQ ID NO: 22515 - RNA, 9876 nt, Artificial Sequence
  derived and/or modified CDS sequence (opt6) from DENV-2__FJ744724__SS-prME
agugcagguaugauuaucaugcuaauaccaacaguaauggcguuccauuuaacaacacgcaauggagaaccacacaugaucguaggaauacaagaaaaaggaaaaagucuucuuuucaaaaccgaagacgguguaaauaugugcacgcuaauggcgauggacuugggagaauuaugugaagauacaauaaccuauaaauguccguuacugagacaaaaugaaccagaagacauugauuguugguguaacagcacaagcacauggguuacguauggaacaugcacaaccacaggagagcacaggagagagaaaagaucuguagcguuaguuccucacguaggaaugggauuagaaaccagaacggaaacauggaugucaagcgaaggagccuggaaacaugcucaacguaucgaaacuuggauccuucgacauccaggauuuacgauaauggcugcaaucuuagcauacacaauagggacuacccauuuucaaagagucuugauauuuauuuuguuaacagccguugcuccgucaaugacaaugcgaugcaucggaaucucaaaccgagacuucguugaaggaguuucgggaggaucauggguggauauaguacuagaacauggaaguugcgucacaacaauggccaaaaacaaaccuaccuuagauuucgaauugaucaaaaccgaagcaaaacagccugcaaccuugcguaaauacugcauagaggcgaaacuuaccaauacaacaacugaaagcagaugcccaacacaaggagagccaucauuaaaagaagaacaagauaaaagauucguuuguaaacauuccaucgucgauagaggauggggcaaugggugcggacuuuucgguaaaggaggaauaguaacaugugccauguuuacgugcaagaaaaacauggaagggaaaauaguucagccagaaaauuuagaauauacgauugucguaaccccacacagcggggaagaacacgcgguuggcaaugauacaggaaaacacggaaaagaaauuaaaguuacgccucagagcucaguaacugaggcagaacuuacagguuauggcacggucacaauggaauguucgccaagaaccggauuagauuuuaacgaaauggucuuauuacaaauggaaaacaaagccuggcuaguccauaggcaaugguuucuagaccucccucuuccauggcuaccuggagcggauaaacaagaaagcaauuggauucaaaaagaaacucugguaacauuuaaaaauccgcacgcaaagaaacaagaugucguuguauuagguagccaagaaggagccaugcauacugcucugacaggagcuacagagauucaaaugucaaguggcaaucuucuauuuacaggucaccuuaaaugcagauuacgaauggacaaauuacaguuaaaaggaauguccuauuccauguguacgggaaaauuuaaaguuguaaaagaaauagcagagacacagcauggaacaaucguuauacgcguccaauacgagggugacggaucacccugcaaaaucccauucgagauaauggaccuagaaaaacgauacguccugggaagacucauaacaguaaauccaaucgugacagagaaagacucuccagugaacauagaagcagaaccgcccuucggggauaguuacauaauaauaggaguagaacccggacaauuaaaacuuaauugguuuaagaaaggaucaucuauaggccaaauguucgaaaccacaaugcgaggugcgaaacguauggccauucuaggugauacggccugggauuucgguucguuagggggaguauucacgucaauugggaaagcccuucaucaaguuuuuggagccauuuauggagcugcuuucucagguguuucuuggacuaugaaaaucuuaaucggagugauaauuacauggauugguaugaacaguagaucaaccagccuaagcguaucauuaguauuagucggaauugugacacuauaccuuggaguaaugguacaagccgauuccggguguguaguaucauggaaaaauaaagagcuuaaaugcgggucaggaauuuucauaacugacaauguacacacuuggacagagcaguacaaauuccaaccagaaagucccucgaaauuagcuagugcuauucaaaaagcucaagaagaagguaucugugguauucgcuccguaacuagacuggaaaaccuaauguggaaacaaauuacgccagaacuaaaucacauucuagcagaaaacgaaguaaaacuaacuauuaugacuggugauauaaaaggaauaaugcaagcuggaaaacgaaguuuaagaccucagccaaccgaauuaaaauacucauggaaaaccuggggaaaagcgaaaaugcuaucuaccgaaaguuacaaucaaacuuuccuaaucgauggacccgaaacagcagagugcccuaauacaaaucgagccuggaacagcuuggaaguagaagauuacgguuuuggagucuucacuacaaauauuugguuaaaauuaaaagaaaaacaagaugcauuuugcgauucgaaguugaugucggccgcuaucaaggauaaccgagccguacaugccgacaugggauauuggauagaaagugcacugaaugauaccuggaagauugaaaaagcauccuucauugaagucaagaauugucauuggccaaagagccacacacuauggucaaacggaguguuagaaucugaaaugauaauaccuaagaaucucgcagggccagucucgcaacauaauuauaggcccgguuaucauacccaaauagcaggaccauggcaucucggcaaacuugaaauggacuuugacuuuugcgaugguacaacgguaguugucacugaggauuguggaaaccguggaccaucacugcggacaaccacugcuucgggcaaacuuauuacugaaugguguuguagaaguuguacgcuaccuccuuuacguuaccgaggugaagauggcuguugguauggaauggaaauacgaccuuuaaaggagaaagaggagaauuuaguaaauucauuaguaacagcgggccauggucagaucgauaacuuuagccugggggugcuaggaauggcguuauuccucgaagagaugcucagaacaagaguaggcaccaagcaugccauacuuuugguugcaguuaguuuugucacacuuauaaccggcaauaugaguuuuaaagauuuaggaagaguaguagugaugguaggagccacaauggcagacgacauaggcauggggguaacauaucuggcacuuuuagcggcuuuuaaaguucgcccuacauucgcagcaggauuacuauuacggaaacuuacaucaaaagaacugaugaugacgacaauagguauagugcuucucucacagaguacaauuccggaaacaguuuuagaguugacagacgccuuagcuuuaggcaugauggucuuaaaaauaguacgagacauggaaaaauaccaauuagcgguuaccaucauggcgauacuauguguccccaaugcuguuauauuacaaaaugcguggaaaguaucauguacaauacuagcgguaguaaguguuaguccacuccuuuuaacaaguucacagcagaaaacugauuggauaccacuagcuuugaccaucaaaggcuuaaauccaacagcuaucuuccuuacaacauugucccgaacuaauaagaaacgcucguggccgcuaaaugaagcaauuauggcaguaggaauggugucgauccuggcaucaagucuacucaagaaugacaucccaaugacaggacccuuaguggcaggcggucugcucacagugugcuauguacuaacaggacgaagcgcagaucuugaacucgagagagcgacggacguuaaaugggaagaucaagcugaaauuagcggguccuccccaauauuaucuauaacaauaagugaggauggaaguaugaguauaaagaaugaagaggaagaacaaacacuaacgauacucauucgaacgggacuguuaguaauauccgguuuauucccuaucucaaucccaauaacggccgcggccugguauuugugggaggugaagaaacaaagagcaggaguacucugggauguaccuagcccgccaccgauggggaaagcugaauuagaagauggggcguacagaauuaaacaaaagggaauccucggauacagucaaauuggagcggguguuuacaaggaaggaacauuccauaccauguggcauguaacaagaggagcugugcuaaugcacaaggguaagcgaauagaacccaguugggcagaugucaagaaagaucugauaucauauggaggagguuggaaacuagaaggcgaauggaaggagggugaagagguccaaguucuagcucuagagccgggcaaaaauccccgugccguccaaacaaaaccaggucuauuuaaaacaaacacgggaacaauaggagcagucagcuuagacuuuagcccagguaccaguggguccccuaucauugauaagaaaggaaaaguagucggauuauacgguaacgggguuguuaccagaucaggagcauacguauccgcuauagcccagacagaaaagucaaucgaggauaacccagaaauagaagacgauauuuuccgcaagaggcgacugacaaucauggaucugcauccuggagcgggaaaaacaaaacgauauuuacccgcaauuguucgugaagcaauaaagcggggauuaagaacccugauucuagccccaacacgugugguugcugcagagauggaggaagcacuucgagguuuaccaauaagauaccaaacaccagcaauaagagcugaacauacaggucgcgaaauugucgauuuaaugugucacgcuacauuuaccaugagauuauuaagcccagucagagugccuaauuauaacuuaauaauaauggaugaggcucacuuuacggauccagcaucuauagcugcaaggggauauauauccaccagggucgaaaugggggaagcggcaggcauuuucaugacagcuacaccgccugguucgagagacccauuuccacaaagcaaugcgccaauaaucgacgaagaacgagaaaucccagagcguucguggaauagcggucaugaauggguuacugauuucaaggguaagacgguuugguucgugccguccauuaaagccgggaacgacauugcugccugccuacggaaaaaugguaagaaaguuauacaguuauccagaaaaaccuuugauucagaauaugugaaaacaagaacaaacgauugggauuuuguggugacuacagauaucucagaaaugggagcaaauuuuaaggcagaaagagucauagacccaagacguugcaugaaacccgucauacuaaccgauggagaagaacgagucauauuagcaggcccaaugccggucacucauucaucagccgcacaaagacgaggacggauaggacgaaaccccaaaaacgaaaaugaccaauauauuuauaugggagaaccgcuggagaaugaugaagauugugcccauuggaaggaagcuaaaauguuacuugauaauauaaauaccccggaaggcauaauaccgucgauguuugaaccggaacgcgaaaaaguagacgcuauagauggcgaauacagacuaagaggagaagcaagaaagaccuucgucgauuuaaugagaagaggcgaccuaccagugugguuggccuauaaaguugccgcugaaggaauuaauuacgcggaccgaagauggugcuuugacggaauaaagaacaaccagaucuuggaagaaaauguggaagucgaaauuuggacgaaagaaggcgaacgcaaaaagcugaaaccgcguuggcucgaugcaagaaucuauucagacccccuagcucuuaaggaauuuaaggaauuugcagcuggaagaaagagucuaacuuuaaaucucauaacagaaaugggaagguugccuacguucaugacucagaaaacaagagaugcgcuagacaaucuugcaguucuacacacugcagaagccggaggaagggccuauaaucaugcauuaucggaacucccggagacucuagagacgcuacucuuacuuacacuuuuggcgaccguaacaggggguaucuuucuauuuuuaaugagcggaagagguauagggaaaaugaccuuagggauguguuguauaauuaccgcaagcauuuuauuaugguacgcgcaaauccaaccucauuggauugcagcaucaauuauacuugaguucuuuuuaaucguccuuuuaauaccugaacccgagaaacagcguacaccucaggacaaucaguugacuuacguagucaucgcuauucugacaguaguugcugcaacuauggcaaaugaaaugggauuucuagagaaaaccaagaaagaccuaggucuagguucaaucgcuacucaacaaccugaaucuaauauucuugauauugaccuucgucccgcuucggccuggacgcuauacgcaguugcaacaacuuucguaacaccuaugcuuagacacagcauagaaaacucaucuguaaacguaucacuuacagcuauagccaaccaagcuacgguauuaauggggcuggguaagggguggccacugucaaagauggacauaggugugccuuuacuagcuauugguugcuauucccaaguuaacccaauaacauugacagcggcguuauuacuacuugucgcucauuacgcaaucauagguccaggauuacaggccaaggcuacacgugaagcacaaaaacgagcggcugcuggaauuaugaagaauccaaccgucgaugggauuacuguaauagaccuugacccgaucccauaugauccuaaguuugagaaacaauuagggcaagucaugcuauuaauauugugugucacgcaagugcugaugaugcgaacaaccugggcacugugugaagcccuuacacuagcuacgggaccaauuuccacauuaugggaggguaauccagguagauuuuggaacaccacuaucgcaguauccauggcaaauauuuucaggggaagcuaucucgccggugcaggguuacuauucuccauaaugaaaaauacgacaaacacaagacgaggcacagguaauauuggagaaacguuaggugaaaaauggaaaucaagauugaaugcauuaggaaaaagugaguuucaaauauacaagaaaucuggcauacaagaaguagauagaacacuugcgaaagaaggaauaaaaagaggcgaaacugaucaucaugcuguaagccgaggaucugcuaaguuaaggugguuugucgaacgaaauauggucaccccagaaggaaaagugguggaucucggauguggacguggcggauggucauauuauuguggaggguugaaaaauguccgugaagucaaaggucuaaccaaggguggaccuggacaugaagaaccgauaccgaugucuacauacggauggaacuuaguacgccuucagucaggaguggacguauucuuuauaccuccggaaaagugugacacucuuuuaugugauauuggugagaguucgccaaauccaacaguugaagcaggucgaacauugcgaguauugaacuugguugagaacuggcuaaauaacaacacucaauucuguauaaaagucuuaaauccauauaugccaucaguuauugaaaagauggaggcacuacaacguaaauaugguggugcucuuguaagaaacccuuuaucucggaacucaacgcaugaaauguacugggugucgaaugcaagugguaauaucguuagcucagucaauaugauaucaagaaugcucauuaaucgauucacgaugagacacaagaaagcaacauacgaaccggacguugaucucgggucgggaaccaggaacauagggauugaaucagaaguaccuaaccuugauauuauaggaaagcggauagaaaagauaaaacaagaacacgaaaccucauggcacuaugaucaagaccacccuuacaaaacaugggcguaccauggguccuaugagacaaaacagacgggcucagcaagcaguaugguaaacgguguuguacggcuccuaacaaaaccuugggauguauuaccuaccguaacacaaauggcuaugacagauacaacgccauuuggacagcaaagaguuuucaaagaaaagguugauaccaggacgcaagaaccaaaagaaggaaccaagaaacuaaugaaaauuacagcagaauggcuauggaaagaacuuggcaagaagaaaaccccgaggauguguacacgcgaagaauuuacccgaaaaguacgcaguaacgcugcuuugggagccauuuucacugaugagaacaaguggaaauccgcgagggaagcaguagaagacagccguuuuugggagcuuguugauaaagaacgaaacuugcaucucgaagguaaaugcgaaaccuguguguauaacaugaugggaaaacgugagaagaaacuaggggaauuuggaaaagccaaagggaguagagccauaugguauauguggcuaggagcgcgauuuuuagaauuugaggcuuuaggcuuccuaaaugaagaccauugguucucacgugaaaauucccuuucgggugucgaaggagagggcuuacauaagcucggauacauuuugcgcgauguaagcaagaaagaaggaggugcaauguaugcugaugacacugcaggaugggauacuagaauaacacuagaggaccuuaaaaaugaagaaaugguaacuaaucauauggaaggagagcauaagaaacuagcggaagccauauuuaagcuaacuuaucaaaauaaggucgugcgaguucagcgucccacgccacguggcacagucauggacauaauaaguagaagagaucaacguggaucuggucaaguaggcaccuauggauuaaacacuuucaccaauauggaagcccaacuuauacgacaaauggaaggagaagggguguucaaaaauauccaacacuuaacaguaaccgaagaagucgcuguucagaauugguuagcgcgcgucggucgagaaagacuuucacguauggccaucucaggagacgauugcguugucaaaccacucgaugauagauuugccaaugcauuaacagcacuaaaugauauggguaagauccggaaggacauacaacagugggaacccucuaaagguuggaacgauuggacacagguuccauuuuguucgcaucacuuucaugaguuaauuaugaaggauggaagaguuuuaguaguaccaugucgaaaucaagaugaacuuaucggucgagcaagaauaagucaaggggcggguuggagccucagggaaacagcgugucuaggaaaaagcuacgcacaaauguggucucuaauguacuuucaucgucgagacuuaaggcuugccgcuaacgcgauaugcucagcugugccuagccauuggguacccacuagcaggacuacauggaguauucaugcuaaacaugaauggaugacuacugaagauaugcuaacgguuuggaacagaguuuggauccgagagaacccuuggauggaggauaagacuccggucgaaaguugggaagagaucccguacuuaggaaagagagaagaucaaugguguggaucccuaauaggccuuacaagucgggcuaccugggcuaagaacauccaaacagccauaaaccaaguuagaaguuuaauugguaacgaagaguauaccgacuauaugccaucgaugaagagguucaggcgugaggaggaggaggcaggcguucuaugguga

SEQ ID NO: 22516 - RNA, 9876 nt, Artificial Sequence
  derived and/or modified CDS sequence (opt6) from DENV-2__FJ906957__SS-prME
ucggcagggaugauaauuauguuaauaccgaccguaauggcauuucaucugacgacaagaaauggagaaccacauaugauaguuucaauccaagaaaaaggaaaaucuuuacuauuuaaaaccgaagauggaguaaacauguguacauugauggcuauggacuugggagaauuaugugaagacacaauuacauauaaaugcccacuccuaagacaaaaugaaccagaagauauugacuguugguguaacucaaccucaacguggguuacguaugguacuugcaccacaacaggagaacacagaagagaaaaacgaucgguggcgcuuguaccccacguaggaaugggucuagaaaccagaacagaaaccuggaugucaagugaaggagcauggaaacaugcacaaaggauagaaacuuggauucuacgucacccaggauucacuaucauggcagcaauacuggcauacacgauaggaacaacccauuuccaaagagcccuaaucuucauucuucuaacagccguagcaccguccaugacaaugagauguauaggaauaucuaaccgggauuucguugaaggcgugaguggcgguagcuggguggacaucgugcuugaacaugguucaugcguaacaacaauggcuaaaaauaagccuacauuagacuuugaacugauuaagacagaagcaaaacaaccugcaacacuaaggaaauauugcaucgaagcuaaauuaacuaauacgacaaccgaaucaaggugccccacacaaggugaaccuagucugaaagaagaacaagacaaacgguucguauguaaacacaguaugguagauaggggguggggaaauggauguggauuguuugggaaagguggaauuguaacaugcgcaauguuuaccuguaagaaaaauauggaaggaaaaauaguucaaccugaaaaucucgaauacaccauaguaguuaccccucauuccggggaggagcaugccguaggcaacgacaccggaaaacauggaaaggaaaucaaagucacaccacaaaguaguauaacggaagcugaacuaacggguuacggaacaguaacgauggaauguucuccuagaacaggccucgauuucaaugaaaugguacuacuucaaauggaaaacaaggcguggcugguacaucgacaaugguuuuuagacuuaccuuugcccuggcugccaggcgcugauaagcaaggaucaaauuggauacaaaaagaaacauuaguaaccuuuaaaaauccacacgccaagaaacaagaugugguaguacuuggcagucaagaaggcgcaaugcauaccgcgcuaacaggugcuaccgaaauccaaaugucaucugggaaucuacuauucacaggacaucuaaaguguagacuacguauggacaagcuacagcuuaaggguaugucauauucaauguguacaggaaaguucaaggugguaaaagaaauagcagagacucagcaugggacgauaguuaucagaguacaauaugagggggauggaagucccugcaaaauuccauucgaaauuauggaccuagagaagagauacguacuaggccgucuaaucaccguuaaucccauagugaccgaaaaggauucuccuguaaacauagaagcugaaccaccuuuuggagauucuuauaucaucauuggaguagaaccaggucaacuuaaacuaaacugguuuaaaaagggguccaguauaggacagauguucgaaacgacaaugaggggugcuaaaagaauggcuauauuaggggacacugcuugggauuuuggaagucuagggggaguuuucacaaguaucgggaaagcguuacaccagguauucggugcuaucuacggggcagcuuuuagcggagugucauggacuaugaaaauccugauaggaguuauuauaaccuggauaggaaugaauagucgaucaacgagccuaucggugagucucguacuuguaggaauaguaacguuauaccuaggaguaauggugcaggcugauucagggugcguaguuucuuggaaaaacaaggagcuaaagugcgggaguggaauauucauuacugacaauguucauacauggacagaacaauauaaauuucaacccgagaguccaucuaaacuugcaucugcaauucaaaaggcucaagaagaaggaaucugcggaauacgaaguguaacgaggcuagaaaaccugauguggaaacaaauaacuccagaauuaaaccauauacuagccgaaaaugaaguaaaacuuacgauaaugacaggugacaucaaaggaauuaugcaggcuggcaaacgaucuuuaagaccacaaccgacagagcugaaauacagcuggaaaaccugggguaaagcaaagaugcuuucuacagagucucauaaccaaacauuucuaauugauggcccagagacugcagaaugccccaacacgaaucgagcauggaacucucucgaagucgaggauuauggauuugguguuuucaccaccaauauuuggcuaaaauuaaaagagaaacaagaugcauuuugugauaguaaguuaaugagugcagcuaucaaggacaaucgggcaguucaugccgauaugggauacuggauagaaucggcauugaaugauacuuggaaaauagagaaggccagcuuuauugagguuaaaaacugucacuggccaaaaucgcacacccuauggucaaauggaguauuagaaagugaaaugauaaucccuaaaaaccuugcagguccgguaagucaacauaauuacagacccggguaccacacacagaucgcuggaccguggcaucuagguaaauuagaaauggauuucgauuucugcgacgguacaacaguaguaguuacagaagauuguggaaaucggggcccgucacuacgaacgacaacagcgucaggaaaauugauaaccgaauggugcugcagaucaugcaccuuaccaccauugagauaccgaggugaggauggauguugguacggaauggaaauucgaccgcuuaaggaaaaagaggaaaacuuagugaacagccuaguaacugcagggcauggacagguagacaacuucagccugggaguacuaggcauggcacuguuccuagaagaaaugcuaaggacucgcgugggaaccaaacacgcgauacuacucguggcagccagcuucgucacauugauuacagggaacauguccuucaaagauuugggacguguaguaguaauggucggggccacgaugaccgacgauauagguaugggcguaacuuauuuagcacucuuagcugcauuuaagguacguccaacauucgcagccggcuuacuacugcggaagcuaacaucaaaagaacugaugaugacuacaauaggaauaguguuauuaucgcaaucaaccauuccugaaacaauauuggaacuuacugacgccuuagcccuaggcaugaugguucuuaaaauagugagaaauauggaaaaauaccaauuagcaguuacgaucauggcuaucuuaugcgugccaaacgcuguuauacuacaaaaugcauggaaagugaguuguacuauucuugcgguuguuagugucucaccccuccuguugacaaguucccaacagaaaacagauuggaucccucucgcacucacuaucaaaggguuaaauccuacggcaaucuuucuaacuacuuuaagccgcacaaauaaaaagagaaguuggccuuugaacgaagcaauaauggccguaggaauggucuccauauuagcaucuucauuacugaaaaaugauaucccaaugaccgguccccuugucgcaggagguuuacucacuguuuguuauguacuuacaggacgaagugcugaccuggagcuggaaagagcgacagauguaaaaugggaagaccaagccgaaauaucaggaucaucaccuauacugucaauaacaaucagcgaagauggaucaaugucaauaaagaaugaagaagaagaacaaacacuuacuauacuaauuagaacaggcuugcuaguaauaaguggguuauuucccguaucuauaccgaucacugccgcagcgugguauuuaugggagguaaagaaacagagagccggagugcucugggacguuccuagcccaccucccaugggaaaagcggaauuggaagacggagcauauagaaucaaacagaaaggcauccuaggauauagucaaaucggagcaggagucuacaaagaagguacauuccacacaauguggcaugucacucguggggcaguuuuaaugcacaaagguaaaagaauugaacccucaugggccgaugucaagaaagaucuuauaaguuauggaggaggguggaaacuggaaggugaauggaaagagggugaagaaguccagguccuagcacuagaacccgggaaaaauccaagggcuguacaaacaaaaccaggacucuuuaaaacaaacacuggaaccaucggagcugucucauuagauuuuuccccggguacgucuggaucccccauuauagacaagaaagggaaagucgucggucuauaugggaacgggguaguuacgagaaguggggcauacguuucugcaauagcgcaaacagagaaaaguauugaagauaacccugaaauugaagaugauaucuuuagaaaaagaagauuaacaauaauggauuuacauccaggcgccgggaaaacuaagcguuaucuuccagccauuguaagagaagcuauaaaacggggacuaagaacccugauccuggcuccuacacggguaguugcagcagaaauggaagaagcacuacggggcuuaccuauaagauaucaaacuccagccauaagagcagaacauacaggacgagagauaguagaucugaugugucaugcgacuuuuacaaugagacugcucucacccgucaggguaccaaacuauaaucugaucauaauggaugaagcgcacuuuacggaucccgcgucuauugcagcgcgcgguuacauuucaacaagaguugaaaugggugaagcagcuggaauuuuuaugaccgcaacaccucccgguucuagagauccuuucccacaaucaaacgcaccaauaauugacgaggaacgcgagauaccggaaaggucuuggaacucaggacaugaauggguaacagauuuuaaaggaaagaccguaugguuuguuccuaguauaaaagcaggcaaugauauagcggcaugcuugcguaaaaaugguaagaaaguaauucaauuaucuagaaaaacuuucgacucggaguauguaaaaacaagaacuaaugauugggauuucguuguuaccacggacauuucugaaaugggcgcuaacuuuaaagcugaaaggguuauugacccccgacguuguaugaagcccgucauacugaccgacggugaggaacgggugauacuagccgggccaaugccuguuacacacaguucagcugcucaaagacguggucguauuggccgaaaucccaaaaacgagaaugaucaguauauauauaugggagaaccacuagaaaacgacgaagacugugcucauuggaaagaggcuaaaauguugcuagauaacauuaauacgccugaaggcauaauaccuuccauguucgaaccagaacgcgaaaaaguagacgcgauagacggagaauaccggcuacguggugaagcacgcaaaacauucguggacuuaaugcgucguggcgaucucccaguuuggcuugcauauaaaguggcugcagaggguauaaacuacgcagaccgaagaugguguuuugaugggauuaaaaauaaccagauccuagaagagaacguugaaguugaaauauggacaaaagaaggagagcgaaagaaauuaaaaccacguuggcuagacgcaagaauuuauagugauccucuggcauuaaaagaauuuaaagaauuugccgcgggcagaaaaagucugacguugaacuuaaucaccgaaaugggucgacuaccaaccuuuaugacccagaaaacccgagaugcucuggacaaccuggcaguuuuacauaccgcagaagcuggagggcgcgcuuauaaccaugcacuauccgaacuaccugagacauuagagacccuauugcuuuuaacauuauuagcaaccguaacaggugguauuuuucucuuucuuaugagugggcgcggcauugggaaaaugacgcuaggcaugugcugcaucauaacagcgucaauauuacuaugguaugcacagauccaaccacauuggauagccgcaucgauuaucuuagaauuuuuccuuauaguguuacuaauaccugagccagaaaaacaaagaacuccccaagauaaccaacuaacuuauguagugauagcgauauugacaguaguagcugcaaccauggcaaacgaaaugggauuucuagagaaaacgaagaaagaccuaggauuagggaguauagcaacucaacagcccgaauccaauauccuagauauagaucuaagaccggcgucugcauggacucuuuacgcuguugcgaccacauuuguaacuccuaugcugaggcacucaaucgaaaacucaucugugaauguuagccucacagcuauugcaaaccaggcaacagugcuuauggguuuaggaaaaggauggccacuaagcaaaauggauauaggagugccuuuguuagcgauuggaugcuauagucagguaaauccuauuacacugacagcagcccuucugcuccuaguagcccauuaugcuauaauaggucccggccuacaagcaaaagcgacacgggaagcacagaaaagagcagcagcagggauuaugaagaacccgacggucgaugggauaacugucauagaccuggacccgauuccauaugacccaaaauuugaaaaacaacuuggucaagugauguuacuuauucuuuguguuacucaagucuuaaugaugagaaccacaugggcuuugugugaggcuuuaacacuagcuacuggaccuauaucaacacuuugggaagguaauccaggaagauuuuggaacacaacaauagcaguaaguauggcaaauauauuccgcgguaguuaccuggcuggcgcuggacuucuauucucuauaaugaaaaacaccacaaacacacgucgcgguacugguaauauaggggaaacauuaggugaaaaauggaaaagccgauugaaugcucuugguaaaagcgaauuucaaauauauaaaaagagcgguauccaagaaguugaccgaacgcuggcuaaggagggaauuaaaaggggugaaacugaccaucaugcaguuucaagaggaucugccaagcuccguugguuuguagagcggaacauggucacgccugaagggaagguugucgaccuagguuguggaagaggugguuggagcuauuacugcgguggacuuaagaauguaagagaaguaaaaggucuaacgaaagguggaccgggacaugaagaaccgauaccaaugucuacuuacggguggaauuuagugagguuacaaaguggaguugacguguucuuuaucccgccagaaaagugugauacguuauugugcgauauuggugagucuagcccgaacccaacuguugaagccggaagaacacuuaggguucugaacuuaguagaaaauuggcuuaauaauaacacgcaauuuugcauaaaaguuuuaaauccuuauaugccaucaguaauagagaaaauggaggcauuacaaagaaaauaugggggcgcccuagugaggaaucccuuaucucguaacucaacacacgaaauguauugggucuccaacgccucaggcaauauugugucaucugucaauaugauaucucgaaugcuaaucaauagguuuacaaugagacauaagaaagcaacuuaugagccagacguggauuuaggaucaggcaccagaaauauuggaauagagucugagauaccaaacuuagacauuauaggaaaacguauugagaaaauuaaacaagaacacgagacaagcuggcauuacgaccaagaucauccguauaaaacgugggcuuaccauggauccuacgaaaccaaacaaaccgguagugcuaguucuaugguaaauggaguaguucgucuacuaaccaagccaugggacgucuugccuacugugacucaaauggcgaugacagauaccacacccuucggacagcaaagaguguucaaagaaaaaguagauacacguacacaagagcccaaggaaggaaccaagaaacuaaugaagauuacagcugaauggcuuuggaaggaguugggaaagaagaaaacaccaagaauguguacgcgugaagaauuuacaagaaaaguuagaucaaacgcggcacugggugcaauauuuacugacgagaauaaauggaagucugcgagagaagcggucgaagacucgagauuuugggaauuaguggauaaagaaaggaauuuacacuuagaaggaaagugugaaacauguguuuacaauaugaugggaaagagagagaagaaauuaggcgaauuuggcaaagccaaaggaucaagagcaaucugguauauguggcuaggcgcacgguuuuuagaguucgaggcucuaggauuuuuaaaugaagaucauugguucaguagggaaaauagcuuaucuggaguagaaggcgaaggcuugcauaaauuaggauacaucuugagagaugugucgaagaaagaaggaggagcgauguaugcagacgauacggcugguugggauacaagaaucacgcuagaagaccuuaagaacgaagagaugguuacgaaucacauggaaggggagcacaagaagcuggcggaagcaauauucaaacucacuuaucaaaauaaaguggugagagugcaacggcccacgcccagaggaacgguuauggauauaauaagucggagagaucaaagaggcagcggacaaguagguacuuauggauuaaauacuuuuacgaauauggaagcacaacuuaucagacaaauggaaggagaggguguauuuaaaaacauacaacacuugacaguuacggaagaaauagcaguacaaaauuggcuagcgagaguggggcgagagagacucucaagaauggcaauaucaggugaugauugcguaguaaagccacucgaugacagauuugcaaacgcacuuacagcacugaacgauaugggaaaaauucgcaaagauauacaacagugggagccaucaaaaggauggaacgacuggacacaagucccuuucuguucccaccauuuccaugaacugauaaugaaggacggaaggguauugguaguaccaugccguaaccaagaugaacuaauagguagagcaagaaucagucaaggggccggauggucauuaagagaaaccgccugccucggaaaaucauaugcucaaauguggucacuuauguauuuccauagaagggaucucaggcuggcugccaacgcuauauguuccgcuguaccaagucauugggucccgacuucgcguacaacauggucgauccaugccaaacacgaguggaugacaaccgaagauaugcugacaguauggaaccgcguauggauucaggaaaacccauggauggaagauaaaacaccagucgaaucuugggaagaaauaccauauuuaggaaaaagagaagaccaauggugcgguucauuaaucgguuuaaccucaagagcgacgugggcuaaaaacauacaggcugccauuaaccaaguccgaagccuaauugguaacgaagaauauacugauuauaugccuucuaugaagcgcuuuagacgcgaggaagaagaggccgguguacuuugguaa

SEQ ID NO: 22517 - RNA, 9876 nt, Artificial Sequence
  derived and/or modified CDS sequence (opt6) from DENV-2__FJ906958__SS-prME
ucaguaggaaugauaauuauguuaauaccgacaguaauggcauuucaucuaacuacgcgcaauggcgaaccacauaugauaguaucuauacaagaaaaaggaaaauccuuacuauuuaaaacugaagacgguguuaacauguguacucuaauggcaauggaucuaggagaauuaugcgaagacacuaucacguacaaauguccguuauuaagacaaaaugaaccagaagauauagacuguugguguaacuccacaucaaccuggguaacauauggaaccuguacuacaacuggagaacauaggagggaaaaacguucaguagcgcuaguaccucacgucggcaugggguuagaaacgcguacagaaacauggaugucuucugaaggugcuuggaaacaugcucaacguauagaaacguggauacuacggcacccaggguucaccaucauggcugcaauuuuagcauacacaauaggaaccacacacuuucaaagagcauuaauauuuauacuauugacugcuguugcaccgucuaugacuaugagauguauuggcauuucaaaccgagacuuugucgaaggcguaucgggaggaucuuggguugauaucguguuagaacauggaaguugcgugacaacaauggcuaaaaauaaaccuacucuggacuuugaacuuauuaaaacugaagcgaaacaaccggcuacucugcgaaaauacuguaucgaagcaaaauugaccaauacgacgacagaaucaagaugccccacacaaggagaacccagucugaaagaagaacaagacaaaagauuugucuguaaacauaguauggucgaucgugguuggggcaacgguuguggacuguuugggaaaggagggauaguuacuugcgcgauguuuaccuguaagaaaaacauggaaggaaaaauuguacaaccagaaaacuuagaauacacgauaguaguuacaccgcauucgggagaagaacacgcugucgggaacgauacgggaaaacauggcaaagaaauaaaagucaccccucaaucauccauaacagaggcagaacuaacuggauaugguaccgugaccauggagugcaguccucggacggguuuggauuuuaaugaaaugguauugcuccaaauggagaauaaggcuugguugguucaucgacaaugguuccuagaccuuccguuaccauggcuaccaggagcagauacucaagggaguaauuggauacaaaaagaaacucucguuacguuuaaaaacccucaugccaagaaacaagaugugguagugcuggggucucaagaaggugcuaugcauacggcacuaacaggagcaaccgaaauccagaugagcucgggaaacuuauuauuuaccggucacuuaaagugucgauuacgaauggacaaacuccaguugaagggaauguccuauucaauguguaccggaaaauuuaaaguuguaaaagaaaucgcagaaacacaacacgguacaaucguaauccgcguacaauaugagggcgacgguucuccaugcaaggucccauuugaaauaauggaucuugagaaacgauacguccuuggucgacuuaucaccgugaacccgguaguaaccgagaaagauucucccgucaauauugaagcagaacccccguuuggagauaguuacauuauaauuggaguagagccaggacaacugaaacuuaauugguuuaagaaagggucuaguauuggacaaauguuugaaacuacuaugagaggggcaaaacgaauggcaaucuugggugacacagcaugggauuucggaagucuugguggaguuuucacaaguauaggcaaagcucuacaucaaguauucggugcaauauacggcgcagcauuuaguggcguaucuuggacaaugaaaauacucaucgguguaaucaucaccuggauuggaaugaacucccguuccacaucauuaucaguuagcuuaguccuaguagguauaguaacccuauaccugggcguaaugguucaagcugacaguggcuguguuguauccuggaagaauaaagaacuaaaaugugguucagguauauuuauaacagauaauguucauacauggaccgagcaguacaaauuucaaccugaaucacccucaaaacuagcaagcgcaauucagaaagcccaagaagagggaauaugugggauaagauccguaacccgccucgaaaaucuaauguggaagcaaauuaccccagaauuaaaucacaucuuggcagaaaacgaaguuaaguuaacaauaaugacaggugauauaaaaggaauaaugcaggccgguaaaagaucccugcgaccacaacccaccgagcuuaaauauuccuggaaaacaugggguaaggccaagaugcuuucuacagaaagucacaaucaaacauucuugauagacgguccugaaacugcugaguguccaaacacuaacagggcauggaacucgcucgaaguggaggacuaugguuucggagucuuuacaacaaauauauggcucaaacuaaaagaaaaacaggaugcauucugcgauagcaaacuaaugucagcggcugucaaggauaacagagccguacacgcagauaugggguauuggauugaaagugccuuaaacgauacauggaaaauugagaaagcaucauuuauugaagucaaaaacugccauuggccgaagagucauacauuauggucuaacgguguacuagaauccgaaaugaucauaccgaaaaaucucgcugguccggugagucaacacaacuaucgaccuggauaccauacccagaucgcaggacccuggcauuugggaaaacuagagauggacuucgacuucugugacggcacaacugucguaguaacggaagauugugguaaccguggcccaucgcucagaacuacuaccgccucagggaagcugauaacagagugguguuguagaucuugcaccuuaccaccgcugcgauaucgcggagaagacgguuguugguacggaauggaaaucagaccuuuaaaggagaaagaagagaacuuaguuaacagucuggugacagccggacaaggacagguagauaauuuuucauuaggaguacuuggaauggcauuauuucuagaggaaaugcucaggacuagaguaggaacuaagcaugcuauacuuuuaguagcaguuuccuucguuacgcucauaacagggaacaugucuuucaaagacuuaggucggguggucgucauggucggagcaacuaugacugacgacauuggcaugggaguuacauauuuggcauuacuagcggcauucaaagugaggccuacguucgcagcaggauuauugcucagaaaacucacaucaaaagaacuaaugaugacuacgauaggaauuguguuacugucacaaagcacgauuccagaaaccauucucgaauuaacugaugcauuggcacuaggaaugaugguucugaaaauuguaagagauauggaaaaauaucaacucgcuguaacuauuauggcuauauuaugugugccaaacgcaguuauccuucagaaugcuuggaaaguauccuguacaauacucgccgugguuucagucucuccuuuguuacucacauccagucagcagaaaacagauuggaucccacuggcacuuacgauuaaaggucuaaauccgaccgcuauuuuucuaacaacccucucgcgaacuaacaaaaagcgaagcuggccuuugaacgaggcuaucauggcugucgguauggucucaauucuagcuagcucguuacuuaagaaugacauuccuaugacaggaccacucguagcuggaggauugcuuacagucuguuacguacucaccggaagaagcgcagacuuagaacuagaacgcgcgaccgauguaaagugggaagaucaagcagaaauaucuggcagcaguccaauccucucuauaacaauuucagaggauggaucuaugaguauuaagaaugaagaagaggagcagacccucacaauucuaauaagaacaggauuauuaguaauaaguggacuauuuccugucaguauucccauaacagcagcagcuugguacuuaugggaagucaagaaacagagagcugguguguugugggauguaccaagcccaccacccaugggaaaagcugaacuagaagauggagcguacagaaucaagcaaaaaggaaucuugggauauucccaaauaggcgcuggaguguacaaagagggcacguuccauacaauguggcauguaacacguggagcaguacuaaugcauaaaggaaagcgaauagaaccuagcugggcggacgucaagaaagaccuaauuucauauggcggaggauggaagcuagaaggagaauggaaagaaggggaggagguccagguuuuagcacuugaaccaggaaagaauccacgagcuguacaaaccaaaccaggacuauucaagacaaauacaggaaccauaggagcgguuagccucgacuuuucaccagguacaucaggaucaccaauaauagauaaaaaggguaaaguaguaggacucuacggcaacgguguaguaacuagaaguggagccuacguuucggcgauagcacagacagagaagucaauagaggacaauccggacauagaggaugacaucuuccgcaaaagaagacugacaaucauggaucuccauccaggggcagggaaaacaaagagguaccuaccagcgauagucagggaggcgauaaagaggggguugcgcaccuuaauauuggccccgacccgaguuguugcugcagaaauggaagaagcgcugaggggacuacccauacgcuaucagacuccggcuauacgagcugaacacacagguagggaaaucgucgacuuaaugugucaugcuacauucacaaugcgauuacuuaguccaguaagaguuccaaauuauaauuugauaaucauggaugaggcccauuucaccgacccugcguccauugcugcgagaggauauauaaguacuagaguugaaaugggagaagcagcaggaauuuucaugacugcuacacccccagguagucgagauccguuuccacaaagcaaugcccccauaaucgacgaagaacgagaaauaccagaacgcaguuggaacaguggccaugaguggguuacagauuuuaaaggcaaaacuguuugguucgucccuucuaucaaagcaggcaacgauauagcagcguguuuaaggaaaaaugguaagaaagucauacaacucaguagaaaaacauuugacucagaauaugcgaaaacaagaaccaaugauugggauuuuguaguaaccacagauauuagcgaaaugggggcgaauuuuaaagccgaaagggucauagauccccgaagguguaugaaaccgguuaucuuaacagacggugaggaaagagugauauuggcaggcccaaugccugugacacacucgagugcagcacagaggagagggcgaauaggcagaaaucccaaaaaugaaaacgaucaauauaucuauaugggggagccccuagagaaugaugaagacugugcccauuggaaagaagcuaagauguuacuagacaauauuaauacaccugaaggaauaauacccucaauguuugaaccugagcgcgaaaaaguagaugcgauagacggcgaauaucgccuuagaggagaagcgagaaaaacguucguagaucuaaugaggagaggugauuuaccagucugguuagccuauaaaguugcagcagaagggaucaauuacgcagacagaagauggugcuucgacggaaucaaaaacaaucagauauuagaagaaaauguagaaguugagauuuggacgaaggaaggcgaaagaaagaaauuaaagcccagguggcuagacgccaggauuuauagcgauccacuggcgcuaaaagaguucaaggaguucgccgcaggacgaaagagucuaacauuaaauuuaauaacugagaugggacgacuaccuacauucaugacgcagaaaacccgugaugcauuagauaaucuagcagugcuacauacagccgaggccgguggucgugcauauaaucacgcucuaagcgagcugccagagacccuagagacucuacuacugcuaacccuacuagcaacagugacagguggcauuuuucuauuccugaugaguggccgagguauaggaaaaaugacucucggaauguguugcauaguaacagccucaauuuuauugugguacgcucaaauccagccacacuggauagcugcuucaauuauucucgaguucuuuuugauaguauuauuaauuccugagccugagaaacaacguacuccacaagacaaucagcugacuuacguugugauagcaauuuuaacuguaguagccgcaaccauggcuaaugaaaugggauuuuuggaaaagaccaaaaaggaccuaggacuuggcucaauugcuacacagcaaccagagucaaacauauuggacauugaucuccgaccggcgagcgcauggacucuauaugcuguagccacuacguuuguaacgccaauguuaaggcauucaauagaaaacagcucagugaauguuucacuaacugcgauagcaaaccaagccacaguguuaauggggcuagggaaagguuggccauuaaguaaaauggacauaggagucccucuacuggcuauaggauguuacucacaggugaacccaauuacguuaacagcagcacuuuuacuuuugguggcgcauuaugcaaucauuggaccuggauuacaagcgaaagcaacgcgagaagcccaaaagcgcgcagccgcaggcaucaugaaaaauccuaccguugaugguauuaccgugauugaucuggauccaauaccuuaugacccaaaguuugaaaaacaacuuggacaggucaugcuauuaguauugugcguaacacaaguacucaugaugagaacaaccugggcauuaugugaggcuuuaacauuagcaacaggaccuauaucuacguuaugggaaggaaauccaggcagguuuuggaacacgacaauagcagugucaauggccaauaucuuuagaggaucuuacuuagcuggcgcagggcuauuauucucuaucaugaagaacacuacuaacacgagacgaggaacugggaacauuggagaaacacucggcgaaaaauggaaaaguagacuaaacgcucucgguaaaagcgaguuccagauauacaagaaaucaggcauucaagaaguagaucggacauuagcaaaagaaggcauuaaacgaggugaaacagaccaucaugcuguaucacguggaagugcaaaauuaagaugguucgucgaacguaacaugguaacaccagagggaaaagucguggaucuaggcugcggccguggagguuggucauacuauugugguggacucaaaaauguaagggaaguaaaggguuuaacaaaggguggaccaggacaugaggagcccauaccaaugucuacuuauggcuggaauuuagucagacuccaaaguggugucgauguuuucuuuauaccuccggaaaaaugugacacacuacucugugacauaggagaguccaguccuaauccuacuguugaagcaggucgcaccuuacgaguacuaaaucuuguggagaacuggcuuaauaacaacacacaguuuuguaucaaaguucucaauccauauaugcccucuguuauagagaaaauggagacacuacaacgaaaguacgguggugcccuagugcgaaacccacugagcagaaauucuacucaugaaauguauuggguaaguaaugcuagugguaauauuguuucuagcguaaauaugauauccagaaugcuuaucaaucguuuuacaaugagacauaaaaaggcaacuuaugagcccgauguugaucuuggaucagguacacggaauauugguauugaaucagaaauuccaaaccuagauauuaucgguaaacgaauagaaaagauuaaacaggaacaugagaccaguuggcacuacgaucaggaucacccuuacaagacuugggcuuaccauggcaguuaugaaaccaagcaaacaggcucagcaucaucaauggugaacggaguaguacgccuguuaacaaagccaugggacguacuuccuacggucacccaaauggcaaugacagauacaacaccauuugggcaacaaagaguauuuaaagaaaagguugacacacgcacccaggaaccaaaggaaggaaccaagaaauuaaugaaaauaacggcagaaugguuauggaaagaauugggaaagaagaaaacacccagaaugugcacacgugaagaguucaccaggaaagucagaaguaacgcagcccuaggagcaauuuucacagaugagaacaaguggaaaucggccagagaagcggucgaagacagccgcuuuugggaguugguagacaaggaacggaacuuacacuuggaaggaaaaugugagacauguguuuauaacaugaugggaaaaagagagaagaaauugggagaguucggcaaggcaaaaggauccagagccaucugguauauguggcuaggagcaagguuucuugaguucgaagcacuuggauuuuugaaugaagaccacugguucucuagggaaaauagucucuccggaguagagggagaagggcuccauaaacuaggauacauccucagagauguaucuaagaaagaagguggugcuauguacgcagacgauacagcagguugggacacuaggaucacauuggaagaucucaaaaacgaggaaaugguuacgaaccauauggaaggagaacauaagagguuagcagaagcaauuuucaaacucacauaucaaaauaaaguaguccgaguacaaaggccuacgccgagaggcaccguaauggacauaaucucgaggagggaucaaagagguaguggccaaguagggacguauggcuuaaacacguuuacaaacauggaggcacaauugaucaggcaaauggaaggagaaggaguguuuaaaaauauccaacaccugacuguaacagaagaaauugcgguacaaaacuggcuagccaggguuggacgggaacgucugucacgcauggccauaucaggcgacgauugcguaguaaagccuuuagaugacagauucgccucagcgcugacugcccucaaugauauggguaaaauucgaaaagauauacaacaaugggaacccucaagaggguggaaugauuggacccagguaccuuuuugcagucaccacuuucaugaacuuaucaugaaagaugguagaguccuaguuguaccuugucgaaaccaagaugaacuaauuggucgagcuagaauaagucaaggagcgggauggagccuacgugaaacugccugccucggaaaaucauaugcacagauguggucacucauguauuuucaucguagagaccuccgucuggcugcgaacgcaaucuguuccgccguaccgucacacuggguaccuaccucucgaacgacauggucaauacacgccaaacaugaauggaugacuacagaagauaugcuuacaguuuggaaucgcguauggauucaagaaaacccuuggauggaagacaaaaccccaguugaaucaugggaggaaauacccuauuuaggcaaacgagaagaucaauggugcgguagucugaucggccuaaccucuagagccacaugggccaaaaacauacaggcugcgaucaaucaagucaggucuuuaauaggaaacgaagaauauacugacuacaugccuucaaugaaacgauuccgcagagaagaagaagaagccgggguccuuugguaa

SEQ ID NO: 22518 - RNA, 9876 nt, Artificial Sequence
  derived and/or modified CDS sequence (opt6) from DENV-2__FJ898452__SS-prME
ucagcgggaaugauuauuauguuaauuccaacaguaauggccuuccaccuaacaacaagaaacggagaaccgcacaugauaguagggauucaagaaaaaggaaaauccuuacuauucaaaacagaagacggaguaaauauguguacucuuauggcgauggauuuaggugaauuaugugaagauacaauaacguacaaaugcccguuacuacgacaaaaugaaccagaagacaucgacugcuggugcaauucaacauccacaugggugacuuauggaacuugcaccacaacuggagaacauagaagagaaaaacguaguguggcucuaguaccccauguaggaaugggauuagaaaccagaaccgaaacauggaugaguucagaaggagcguggaaacacgcucaacgaauagaaaccuggauuuuacggcaucccggauuuacaauaauggcugcaauacuagcauauacgauaggaacaacacacuuccaaaggguuuuaauauucauucuacuaaccgcaguagcgccaagcaugacuaugcgaugcauaggaauuucaaauagagauuuuguagaagguguaaguggaggaagcuggguagacauuguauuagaacacggauccuguguaaccaccauggccaaaaauaaaccaacacuugacuuugaauuaauaaaaacagaagcaaaacagccugcgaccuuacguaaauacuguauugaagcuaaacuaacgaauacaacuacagaaucaagauguccaacucagggugaaccuucacugaaagaagaacaagauaaacgauuuguaugcaaacauagcaugguagaucggggauggggcaauggauguggacuuuucggaaaaggaggaauaguaacuugugcaauguuuaccugcaagaaaaacauggaagguaaaaucguccaaccagaaaaccuggaauauacuauagucguaacaccgcauucgggugaagaacaugccgugggaaaugauacagguaaacacggaaaagaaaucaaaguaacuccccaauccaguaucacugaagcagaacuuacuggcuacgggacugucacuauggaauguagcccgagaacuggauuagacuuuaaugaaaugguauugcuacagauggaaaauaaagcgugguuaguacaccgacaaugguuccuagaucucccgcuaccauggcuacccggagcagacaaacaagaaucaaauuggauucagaaagagacucuugugacuuucaaaaauccucaugcgaagaaacaagacguagucguacuuggcucacaagaaggcgcgaugcacacugcgcuaacuggagcuacggaaauacaaauguccuccggaaauuuauuguuuacuggacauuuaaaauguaggcucagaauggacaaauugcaacuaaaaggaaugaguuauucuaugugcacagggaaauucaaaguaguaaaagaaauugcggaaacccaacacgguacuauuguaauuagagugcaauaugagggcgauggaucuccuuguaaaauacccuucgaaauuauggaucuggagaaacgcuauguuuuagggagauuaauuaccguuaauccaauugugaccgagaaagauaguccagucaacauagaggcagaaccuccauucggagauuccuauauuauaauaggcguagagccugggcaauuaaaacugaauugguucaagaaagguucuucgaucggccagauguuugagacaacaaugcgaggagccaagcguauggcgauauuaggugauacugccugggauuuugggaguuuaggugguguauuuacaucgauaggaaaagcauuacaucaaguguuuggagcaauauacggggcggcuuucucagguguaaguuggacuaugaaaauuuuaauaggcguaaucauaacauggauuggaaugaacucuagaaguacaucauuaagugucucauuaguacugguaggcauaguuacguuauaccucggcgugaugguucaagcagacaguggcugcgugguuucauggaagaacaaagaauuaaagugcggcucggguauauuuauuacagacaauguacauacauggacugaacaauacaaauuccagccugaaucaccaucgaaacuggcuucugcuauacagaaggcccaagaagaagguauaugugggauaagaagcgugacgcgacuagaaaaucuaauguggaaacaaauuacaccggaauuaaaucauauacuagcagaaaaugaaguaaagcucacaauuaugaccggugacaucaaggguauaaugcaagcuggaaagagaucucuccguccacagccaacggagcuaaaauacagcuggaagacaugggggaaggcaaaaaugcucucuacagaaucuuacaaucaaacguuuuugauugacggaccagaaacagcagaaugcccaaacacaaacagagcauggaacagcuuagaaguugaagacuaugguuucggaguauuuaccacgaauauaugguuaaaacuuaaggagaaacaagacgcuuucugcgauucuaaacuuaugucagcggcaauuaaagauaaucgugcaguacacgcagauaugggauacuggauagaaagcgcauuaaaugacacuuggaaaauagaaaaggcgucauucauugaagucaaaaacugucacuggccaaaaagucauacccuguggucgaacggcguccucgagagcgagaugauaauaccgaaaaauuuagccggaccugugagucaacacaauuauagaccugguuaucauacacagauagccgggccauggcaucucgggaaauuagaaauggacuucgauuucugugacggaacgacagucauugucacugaagauugcgguaaccguggaccaagucuaagaacuacgacugcaaguggcaaauuaauuacagaaugguguugcagauccuguacccuacccccauuaagauaucgaggugaagaugguugcugguauggaauggagauacguccuuugaaagaaaaagaagaaaacuuaguuaauagccuugugacagcuggacacggccaaguugauaauuucucgcuaggaguuuuaggaauggcacuguucuuggaagagaugcucagaacccgagugggaacaaaacaugcaauuuuacucguagcugucucauuuguaacauuaauaacgggaaacaugaguuucaaggaccuugguaggguuguagugaugguuggcgcuacaauggcugacgauaucgguaugggaguaacuuaccuagcauuacuagcggccuucaagguacggccuacauuugcugcaggacuuuuacugaggaaauuaacgucgaaagaauugaugaugacgaccauuggaauuguauuguugagucagucaacgauuccagaaacagucuuggaauuaacugacgcgcuagcauugggcaugauggucuuaaaaaucguuagaaauauggagaaauaucaacuugcgguuacuauaauggcuauauuauguguaccuaaugcaguaauacuucaaaaugcauggaaaguuagcugcacuauuuuggcuguugucucaguuagcccauuguuauuaacaucaagucaacagaaaacggauuggaucccauuggcauugacuauaaaaggccuaaauccuaccgccauauuucuaacuacauugucacgaacuaacaagaaacgcaguuggccucuuaaugaagcuauuauggcgguagguaugguauccauucucgcuaguagcuugcucaaaaacgauauaccaaugacuggccccuugguugcgggcggcuuacuaaccguaugcuacguauugacgggacguucugcagaccuugaauuagaacgagccacagacguaaaaugggaggaucaggccgaaaucucagguuccaguccaauacuaucaaucacaauaagcgaagacggaaguauguccaucaaaaaugaagaagaagaacagacguugaccauauugauucguacaggguuacuugucauaucggggcucuuuccaaucucuauaccaauuacugcagcagcaugguauuuaugggaggugaaaaagcagcgugcaggaguuuugugggauguacccucaccaccgccaaugggaaaggcagaacuagaagauggagcguacagaauaaagcaaaaagggauauugggguauagucaaaucggagcuggaguauacaaagagggaacauuccacacuauguggcauguaacacgaggagcgguccuuaugcacaaagggaagcgcauagagccaucuugggccgauguaaagaaagaucugaucucauauggagguggcuggaaguuggagggggaguggaaagaaggagaggaagugcaaguacuggcacuagagcccgguaaaaauccacgagcuguccaaacaaaaccaggacuauuuaaaacuaauacuggaacgauaggagccgucagcuuagacuuuucuccagggaccucuggaaguccaauaauagauaaaaaggggaaaguagucgguuuguacggaaauggagugguaacaaggagcggagcguacguaagugcgauagcucaaacagagaaaaguauugaagacaacccugagauagaagaugauauauuuagaaagagaagauuaacuauaauggaccuacauccaggggccggaaaaacaaaacguuaucuuccagccauuguccgagaagcaauaaagaggggacuacguacucuuauccuggcaccaacaagaguggucgcagcagagauggaagaagcguugcgaggacuaccaauaagauaucaaacacccgccauccgcgcagagcauacaggccgagaaauuguagaccucaugugucaugccacauuuacuaugagacucuuaaguccagugcguguucccaacuacaauuugauuauuauggaugaagcacacuuuacagaccccgcuucgauagccgcacgugguuacauaucuacgagagucgagaugggcgaagcugcuggaauuuuuaugacugcgacuccuccuggaucucgagauccauucccgcaaucgaacgcgccaauaaucgacgaagaaagagaaauaccugagagaucguggaauagcggccacgaauggguaacagacuucaagggaaaaacagucugguuugugccuagcauaaaagcaggcaaugacauagcagcaugccucagaaagaauggcaagaaaguuauucaauugagcagaaaaacauucgauucugaauaugucaaaacacguacuaacgauugggauuuuguaguuacaaccgacauuucggaaaugggagcaaauuuuaaagcagaaaggguaaucgacccccgucguuguaugaaaccaguaauccugacagacggagaggagagagugauccucgcuggucccaugcccgugacucauaguucagcagcacagcgccgagggcggaucggaagaaaucccaaaaaugaaaacgaucaguauauauacaugggugaaccccuugaaaacgacgaagacugugcacauuggaaagaagcuaaaaugcuacuagauaacauaaacacaccugaaggcaucauuccuucaauguuugaaccagaacgagaaaaagucgacgcaauugacggugaauauaggcucagaggagaggcaagaaaaacuuucguggaucuaaugcgacgcggugaccuuccuguaugguuagcuuauaaaguggcagccgaagguauaaauuaugcggaucguagauggugcuuugacggaauuaaaaauaaucagauuuuagaggagaacguagagguagaaauauggacaaaagaaggugaacguaagaaacuuaaaccacgcuggcuugaugccaggauauauucagacccauuggcucuuaaagaguuuaaggaauuugcugcaggacggaaaucuuuaacgcuaaauuuaauaacagaaaugggacggcucccaaccuuuaugacccagaaaacaagggaugccuuagauaaucuugcuguacuccauaccgcugaggcagggggacgcgcauauaaccaugcuuuaucagaacuaccagaaacguuagaaacacuccuucucuuaacucuauuggcaaccguaacaggaggcauauucuuauuuuugaugaguggaaggggaaucgggaaaaugacauuggguaugugcuguaucauaacagccuccauacuucuuugguacgcacaaauacaaccccauuggauugcugcaaguauuauacucgaguucuuuuuaauuguccugcuuauuccagaaccagaaaaacaacggacuccacaagauaaucaacucacauaugugguaauagcuauacuuacagugguugcggcaacgauggcaaacgaaaugggcuuuuuagaaaagacuaagaaagacuuaggacuaggcuccauagcaacacaacagccagagucuaauauccuagacauagaccuaaggccggcgagugcauggacguuguacgcaguggccacaacuuucguuacgccaauguugcgccauuccaucgaaaauagcaguguaaauguuuccuuaacugcuauagcgaaccaagcaaccguucuuauggguuugggaaaggguuggccccuaagcaaaauggacauaggaguuccuuugcuagcuaucgggugcuacucacaaguaaacccaauaacgcucacugcggcucucuuauuauuggucgcccacuacgccauuauuggaccuggucuucaggcaaaagcaacaagagaggcacagaaaagggcugcugcagguauuaugaaaaauccuacgguggauggaauaacaguaauagauuuggacccuaucccguaugauccaaaguuugaaaaacagcuaggccaaguaauguuauuaauucuaugugugacccaaguuuugaugaugagaacaacaugggcguugugcgaagcauuaacccuugccaccggcccaauuaguacguuaugggagggaaauccgggaagauuuuggaauacuacaauagcagucucaauggcaaauauuuuccguggaagcuaccuagcuggugcaggguuacuauuuagcaucaugaaaaacacuacgaacacgagaagagggacuggcaacauuggcgaaacgcugggugagaaauggaaaaguagacuaaaugcucuaggaaaauccgaguuccaaauauauaagaaaaguggaauacaagaaguugaucgaacacuagccaaagaggguauaaaacggggugagacugaccaucaugcugugaguagagguagcgcuaaauuacgaugguucguagaacgaaauaugguaacuccagaaggaaaaguaguagacuuggguugcggacguggaggauggagcuauuauugcggcgggcucaaaaauguucgcgaggucaaaggccuuacuaaagguggaccugggcacgaagaaccaauaccgaugucgacuuauggguggaaucuggugcgacuccagagcggaguggauguguucuucauaccucccgaaaagugcgacacauuacuuugcgacauaggagaaagcucuccgaauccuacaguugaagccggaagaacacugcgcguucugaauuuaguggaaaacugguuaaauaacaauacgcaauucugcaucaaagucuuaaauccuuauaugccaucagugauagagaaaauggaagcacuucaaagaaaauaugguggugcguugguccgaaacccacuuucaagaaacucuacccacgaaauguauuggguaucaaaugcgucuggaaauaucguaaguucaguuaauaugauuucgcgaaugcucauuaaucguuuuacuaugcgucacaagaaagcuacauaugaaccggauguagauuuaggguccggaaccagaaacauaggcauagaaucagagauaccgaauuuagauaucauuggaaaaagaauugagaaaauaaagcaagaacaugaaacaucauggcacuaugaccaagaucacccuuacaaaacaugggccuaucaugguucuuaugaaacgaaacaaacggggucugcuaguucaaugguuaauggagugguuagacuuuugaccaaaccaugggauguuuuaccgacaguaacacaaauggcuaugacggacaccacaccauucggucagcagaggguauucaaagaaaaaguagauacuagaacgcaagaaccgaaagaaggaacaaagaaacugaugaaaauuacagcugaaugguuauggaaagaguuaggcaagaagaaaacaccaagaaugugcacaagggaagaauuuacgcgaaaaguaaggagcaacgcggcacuaggugcaauuuuuacagaugaaaauaaauggaaauccgcuagagaggcuguggaggacuccagguuuugggaauugguagauaaagaacguaacuugcaccuugaagguaagugcgaaaccugcguuuacaacaugaugggaaaaagggagaagaaacucggugaguuugggaaagcaaaaggaagcagagcaauaugguacauguggcuuggugcuagauuuuuagaguucgaagccuuaggcuuccuaaacgaagaucauugguucaguagagaaaauagccuaagcggaguagaaggcgaaggauuacauaaacuuggauacauauuacgcgauguuagcaagaaagaaggaggagcaauguaugcagacgacaccgcuggaugggacaccagaauuacccuugaagacuugaagaaugaagaaauggugacgaaucauauggaaggugagcauaaaaaguuggccgaagcaaucuuuaaauugacauaccagaauaagguaguacgaguucaaagaccaacaccaaggggaacgguuauggacaucauuucgagaagagaucaaagggggucuggacaaguugguacguacggucuuaauacuuuuacaaauauggaggcccagcuaauaagacaaauggaaggugaagggguauucaaaaacauacaacaucugacuguaacggaggaaguugcaguacaaaauugguuagcaagagugggacgugaacgauuaucucgcauggcaaucaguggagaugauugcguaguaaagccccuagaugaucgauuugcaaacgcacucacagcucuuaaugauaugggcaaaauccggaaggauauacaacagugggaaccaucaaaaggcuggaacgauuggacccaaguuccauuuugcagucaucauuuucacgaacuaauaaugaaggacggucgcguauuaguggugccuugcagaaaucaagacgagcugauaggaagggccagaauaagccagggugcgggauggucccuucgugagacggccugucuagggaaaucauacgcgcaaauguggagucugauguauuuucacaggagggaucuaagacuugcagcaaacgcaauuugcagcgcaguccccagccacugggucccuacgaguagaaccaccuggucuauccaugcuaaacaugaauggaugacuacagaagauaugcuaacaguauggaacagaguauggauucgugaaaauccauggauggaagauaaaacaccaguggaauccugggaagaaauaccauacuuaggaaaaagagaggaccaauggugugguaguuugauuggccugacaagccgagcaacuugggccaagaacauucaagcagcaauaaaucagguaaggagcuugauaggcaacgaggaauacaccgacuauaugccuucaaugaaacgauucaggagagaagaagaagaggcaggcguucuaugguaa

SEQ ID NO: 22519 - RNA, 9876 nt, Artificial Sequence
  derived and/or modified CDS sequence (opt6) from DENV-2__GQ868591__SS-prME
ucagcaggcaugauaauaaugcuuaucccuacuguaauggcuuuccacuuaacaacaagaaauggugaaccgcacaugauaguaaguagacaagaaaaaggcaaaucgcuacuauucaaaacagaagauggugugaauaugugcacacuaauggcaauggacuugggugaauuaugugaagacaccauaacuuauaaaugcccucuacuuagacaaaacgaaccugaagacauugacuguuggugcaauaguaccaguacaugggucaccuaugggacgugcacaaccaugggggaacaccgucgagagaaaagaucaguugcuuuagucccccauguugguaugggauuagaaacacgaacagaaacguggaugaguagugaaggugcguggaaacacguacaaagaauagaaacauggauacugcgccaccccggcuuuacaaugauggcagcaauucuagcauauacuaucgggacaacacauuuucaaagagcucugauuuuuauucuacuaacagcaguuacccccucaaugaccaugagauguauugguaugucaaaccgcgauuucguugaagguguuaguggagguucaugggucgacauaguucuagaacauggcaguuguguuacgacaauggccaaaaauaaaccgacauuagauuuugaauuaauaaaaacagaagcgaaacaaccugcuacauuaagaaaauacuguaucgaagcaaaacuaaccaacacaacuacagaaucgaggugucccacucaaggcgaaccgucucuuaacgaagaacaagauaaaagguuuguaugcaaacauuccaugguggauagggguuggggaaauggaugcggccuauucgggaaagguggaauagugacaugugcaauguucaggugcaagaaaaauauggaaggcaaagucguucaaccagaaaaucuggaauauacaauagucauaacuccucacuccggagaagaacacgcaguuggcaaugacacagggaaacacggcaaagaaauuaaaaucacaccacaaagcucaaucacagaagcagaauugacuggcuacgguaccgugacuauggaauguucaccucgaacuggacuggauuuuaacgaaaugguccuguuacaaauggaaaauaaggcuuggcugguucaccgacaaugguuccuagaccuuccacuaccauggcuuccaggugcagacacccaagguucaaauuggauacagaaagaaacuuuaguaacuuuuaaaaauccccacgccaaaaagcaagacguuguagugcuaggaucacaagaaggagccaugcacacagcauuaaccggggccacggaaauacagaugaguaguggaaacuugcuauuuacaggucaucuaaagugcagguuacgaauggauaaauugcagcugaaaggaaugaguuacagcaugugcacgggaaaauuuaagguaguuaaagaaauagcggagacccaacaugguacaauaguaauccgagugcaauaugagggugauggaaguccuuguaaaauuccauucgagauuauggauuuagagaaaaggcauguauuagggagacuaauaacaguuaacccaauaguaacggaaaaagacucaccagucaauauagaagcggaaccaccauuuggugauaguuauauaauuauuggcguugagcccgggcagcuaaaauugaauugguuuaagaaaggaaguucaaucggacaaauguuugaaaccacaaugcgaggcgcaaagagaauggccauauugggugauacagcuugggauuuuggaagccuuggugggguuuucaccucaauagggaaggcucuacaucaaguuuuuggggccauuuacggugcugcguucaguggaguaaguuggacuaugaagauucuuaucgggguaauuauuaccuggaucgguaugaacucacggagcacaaguuuaucugugacguuagucuugguuggaauagucacgcuauauuuaggaguaaugguucaagcagauagcgguugcguuguaucauggaaaaauaaagagcuaaaaugcgggucaggcauauuuauaacagauaauguucauaccuggacagaacaauacaaguuucaaccugaaucucccagcaaacuugcuucagcaauucaaaaagcgcacgaagaaggaauauguggaauuagaaguguaacucgauuggagaauuugauguggaaacagauaacgccggagcuaaaucacauucucucugagaacgagguaaaguuaacuauaaugacuggugauaucaaaggaauuaugcaagcugguaaacguucuuuaaggccacaaccgacggaauugaaauauaguuggaaaacuuggggcaaagcaaagaugcuuucuacggaaucacacaaucaaacuuuucuaauugaugggccagaaacggcagaaugucccaauacaaaucgugcauggaacucacucgaaguugaggacuaugguuuugguguuuuuacgaccaacauuuggcugaaacuuaaagagaaacaagacgucuuuugcgauucuaaacuaauguccgcagcaaucaaagauaaccgggcgguacacgcggauaugggcuacuggauugaaagugccuuaaacgauaccuggaagaucgaaaaagcauccuuuaucgaagucaaaaauugccacuggccuaaaagccauaccuuauggucaaacgguguauuagaaagcgagaugauaauaccgaaaaauuuggcaggacccguuucccagcauaauuauagaccgggauaccauacacaaauuacuggaccauggcaccuagggaaauuagagauggauuuugacuucugugacgguacuacagucguuguaacagaggauugcggcaauagagguccgucauugcgaacuacuacagcgagcgguaaauugauaacugaauggugcugcagaucauguacguuaccaccacuccgauacagaggcgaagauggcuguugguaugggauggagauuaggccgcucaaagaaaaggaagagaaucuuguaaauagucuuguaacagcaggacacgggcaaguugauaauuucagccugggaguauuagguauggcgcuuuuucuagaggaaauguugcgaacgagagugggaacaaaacacgcaauccucuuaguagcggucagcuucgucacacuaaucaccggaaacaugagcuucagggaccucggacgagucaugguaauggugggcgccacaaugacagaugauauaggaaugggcguaacuuaccuagcacuauuggcagcuuuuaaaguacgaccaacuuucgcagcagggcuacuguuaagaaaacucacaaguaaagaauuaaugaugacuaccauaggaaucgugcuacuaucucagucaacgauacccgaaacaaucuuggagcuaaccgaugcguuagcauuggguaugaugguauuaaaaaugguuaggaauauggaaaaauaucaauuagcuguaacgauaauggcuaucuuauguguacccaacgcaguaauauugcagaacgcauggaaagucucuugcacaauauuagcagugguaucggucuccccacugcuauugaccucuagucaacagaaaaccgauuggauuccauuagcauuaacaauuaaaggacuaaacccaacugcgauauuucuuacuacauugucuaggacaagcaagaaacgauccuggccccuaaacgaggcgauaauggccguugguaugguuucuaucuuggcuuccagucuuuuaaagaacgauauucccaugacgggccccuuaguagcugguggacuucuaacaguuugcuacguccuuacuggaagaucagcagaccuagaauuagaacgugcagcugacgucaaaugggaggaucaagcagaaauuucaggauccucgccuauucuaucuauuaccaucagugaggaugggagcaugaguaucaaaaaugaggaagaggaacagacacugacuauacuaauacgcacaggcuuauugguaaucucaggacuuuucccggugucuaucccaauuacggcugcagccugguauuugugggaagucaagaaacagagggcaggcguccuuugggauguuccgucaccuccgccgaugggaaaagcggaacuagaagauggugcauauagaaucaaacagaaaggaauauuaggguauucgcaaauaggggccgguguauauaaagaaggcaccuuucacacgauguggcauguaacuagaggcgcaguucucaugcacaaagggaagcgaaucgagccaucuugggcggaugucaagaaagaccugaucucauacggaggaggauggaaacuugagggcgaauggaaggagggcgaagagguccagguuuuagcccucgaacccgggaaaaauccaagagcagugcaaacaaaaccaggccuguuuaagacaaaugccgguacaauuggugcagugaguuuagauuuuagcccuggcacgucaggaucccccauaauugacaagaaaggaaaaguugugggacuguacggaaacgguguagugacucgaagcggggcauacguaucugcgauugcccaaacggagaaguccauagaagauaauccagagauagaagaugacaucuucaggaaaagacgacuaacgauuauggauuugcauccaggggcuggaaagacaaaaagauaucuacccgcaaucguaagggaagcaauuaaacgaggacugagaacuuugauacuugccccuacaagaguuguagcugcugagauggaggaagcccuucgaggucucccgauacguuaucaaacuccugcuauccgagcagaacacacaggaagagagauagucgauuugaugugccacgcaacauuuaccaugagauuacuuaguccaguccgaguaccgaauuauaaucucauaauuauggaugaagcgcacuuuacggauccagccucaauagccgcuagaggguauauuuccacaagaguggaaaugggcgaggcggcggguauauuuaugacagcaacgccacccggauccagagacccguucccucaaaguaaugcccccaucauagaugaagagagggaaauaccggagagaucuuggaauagcggccaugaguggguaacugacuuuaaagguaaaacaguaugguuuguacccuccauaaaagcagggaaugacauagcagcaugccuucggaaaaauggcaaaaagguaauacaauuaucccgaaagacauuugauucagaauacgugaagacucguacaaacgacugggacuuuguaguuacgacagacauaagcgaaaugggggccaacuucaaagcagaaagaguaauagauccuagacgcuguaugaagcccguuaucuuaacagacggagaagaacgcguuauccuagcaggaccuaugccaguaacacauuccucagcggcacaaagacguggaagaauaggucguaacccgaagaaugaaaaugaucaauauauauauaugggugaaccacuugaaaaugaugaagauugugcccacuggaaagaagcgaaaaugcuauuggacaauauaaauacgcccgaaggcauaauaccuucgauguucgagccagaaagagaaaaaguagaugcuauugauggugaguauaggcuaagaggugaagcacguaaaacguucgucgaccucaugcgacgaggagauuuaccaguuugguuagcauauagaguugcagcagaagguauuaauuaugcagacagaagauggugcuucgacggugucaaaaacaaucagauucuugaagaaaaugucgaaguugagaucuggacuaaagagggcgagcguaagaaacucaaaccgagaugguuggaugcaagaauuuauagugauccauuagcucuuaaagaguuuaaagaguucgcugccgguagaaagagcuugacucuaaaccuaauaacagaaaugggcagacuccccaccuuuaugacgcaaaaggcucgagaugcacuagauaauuuagcaguacuacauacugcagaagcaggagguagagcauacaaccaugcucucuccgaauuaccggagacucuugaaaccuuauuacucuuaacacuauuagcgacuguaacaggagggauauuuuuauuuuuaaugagcggaaggggcaucggcaagaugacacucgggaugugcuguauaauuacugcgucaauacugcuaugguaugcacaaauccagccucacuggauagcugcgaguauaauuuuagaauuuuuccugauuguuuuacuaaucccagaaccugaaaaacaaagaacaccccaggauaaucaacucacauacguaguuauugcgauccuaacugucguggcggcgacgauggcaaacgaaaugggauuuuuagagaaaacuaagaaagaucuagguuuagggucaauugcgacgcaacagccagaaagcaauauauuagauauagacuuaaggccugcuagugcauggacauuauacgccguagcaacgacauucguaacaccaauguugagacauaguaucgaaaauuccaguguuaacguuuccuuaacagcgauugcaaaccaagcgacaguguuaaugggucuaggaaaagguuggccgcuaaguaaaauggacauaggcgucccucuucuggcaauaggauguuacucccaagugaauccuauaacucuaaccgcagcccuauuuuugcucguugcccauuaugcuauaaucggaccaggacuucaagcaaaagcuacaagagaagcucagaaaagggcugcagcaggaauuaugaaaaauccuacgguagaugggauaacagugauagaucuugauccaauaccauaugauccuaaguucgaaaaacaauuaggucaaguaaugcugcuaguacuauguguaacucagguauugaugaugagaacuacaugggcacugugcgaggcacuaacgcuugcaacagguccaauaucaacauuaugggaaggaaauccuggaagguuuuggaauacuacuaucgcugucucaauggcuaauauauuucgcgguaguuauuuagcaggcgcuggcuugcuguucucaauuaugaagaacacuacuaauacccguagaggaacagggaauauuggugaaacguuaggggaaaaguggaagaguagauugaaugcgcuaggcaaaagugaguuccagauuuauaagaaauccggaauacaagaaguugauagaacgcuagcaaaggaagguauaaagaggggcgagacagaucaucacgcgguuaguaggggcagcgcaaaauuaagaugguucguggaaagaaauaugguaacuccagaaggaaaaguuguggaccuagggugugguagaggaggauggaguuacuauuguggcggacuaaagaaugucagagaaguaaaagguuuaacgaaaggaggaccuggccaugaagaaccuauaccuaugucgaccuacggauggaaccuuguacgguuacaauccggaguugaugucuucuuuauaccaccggagaaaugugacacgcugcugugcgacauuggugaaucuaguccaaaucccacuguggaggccggacguacauuacgaguccuaaauuuaguagaaaauugguuaaauaacaauacccaauucugcauuaaggucuuaaaccccuacaugccuucuguuauagagaaaauggaagcccuccaaaggaaguaugguggagcacucguacgaaacccauuaucacgcaauagcacacacgagauguauugggucaguaaugcuagcgguaacauaguaucuagugugaacaugauaucacgaauguuaauuaaucgauuuacaaugcgguacaagaaggcaacguaugaaccugauguagaucuugggagcgggacuaggaauaucggaauagaaagcgaaauuccaaaccuggauauaauaggcaaaaggauagagaaaauuaaacaggagcacgagacaucauggcauuacgaucaagaccacccuuauaaaacaugggccuaucaugguaguuacgaaacaaaacaaacuggaucggcgucgucuaugguaaacggagugguucggcuuuuaaccaagccgugggaugucguacccaugguaacacaaauggccaugaccgauacaacgccauuugggcaacaaagaguguuuaaagaaaaagucgauacuagaacacaagaaccuaaagaaggaacaaagaaguuaaugaaaauaacagcagaguggcuguggaaagaacucggcaagaagaaaacuccaagaauguguacgcgggaagaguucacaagaaaagugagaagcaaugcugcguuaggagccaucuucgcagacgaaaacaaguggaaaagcgcaagagaagcaguugaggacucacgguuuugggagcuaguggauaaagaaagaaaucuucaucuagaaggcaagugugaaacuugcguuuauaacaugaugggcaaacgugagaagaaauuaggagaguucggaaaagcaaaaggaagccgcgcaauaugguauaugugguuaggcgcaagauuccuugaauuugaagccuuaggguuucuaaacgaagaucacugguucucucgugagaacucgcuaucggguguggagggagaaggucuacauaaacuugguuauaucuuacgagacguguccaagaaggaagggggugccauguaugcugaugauaccgccgguugggacacuagaaucacuuuggaagaucucaaaaaugaggaaauggucacgaaccacauggaaggugaacauaaaaaguuagcggaagcaauauuuaaacuuaccuaucaaaauaaagucguuagaguacaaaggccaacuccuagagggacaguaauggacauaauuucuagaagagaucagagagguagugggcaaguuggcaccuacgguuuaaauacguuuaccaauauggaagcucaauuaauccgacaaauggagggcgaaggagucuuuaagucuauucagcauuuaacaauuacugaagaaaucgccguccagaauuggcuugcccgcguaggacgcgaacggcuuagcaggauggcgauaaguggggaugauuguguaguaaaaccacuagaugaucguuuugcaagugcacuaaccgcccuuaacgauauggggaaaauacgaaaagauauacaacaaugggaaccaucuaggggauggaacgauuggacacaagugccuuuuuguucucaccauuuucaugaacucauaaugaaagauggucgaguccucgucguuccaugcaggaaccaagaugaacuuauaggucgagcaagaauuagccagggagccggguggaguuugagagaaacagcgugccuagguaagucuuacgcgcagauguggagccuaauguacuuucaccgccgagaccucagacuagcugcaaacgccauauguuccgcagugccaagucauuggguaccuacaucgcgaacuacguggucuauccacgcaaaacaugaauggaugacuacagaggacaugcuaaccguauggaacagaguguggauacaggaaaaccccuggauggaagauaaaacgccaguugaaucaugggaggagaucccauacuuaggaaaacgcgaagaccaaugguguggcucguuaauaggguugacaagucgugccacuugggccaaaaauauucaagcagcgaucaaccaagugcgaucuuugauaggcaacgaagaauauaccgacuauaugccuagcaugaaaagguuucggagggaagaagaggaagcaggaguauuaugguaa

SEQ ID NO: 22520 - RNA, 9876 nt, Artificial Sequence
  derived and/or modified CDS sequence (opt6) from DENV-2__GQ868542__SS-prME
agcgcagguaugauaauaaugcuaauaccaacaguaauggcguuucauuuaacaacgagaaauggugaaccucauaugauugugaguauucaagaaaaagggaaaucccugcuuuuuaaaaccgaagacggaguuaauaugugcacacuaauggcaauggaucuaggggaacuaugcgaagacacaauuacauacaaauguccgcugcuaaggcaaaacgaaccggaagacaucgauugcugguguaauucuaccagcacuuggguaacuuacggaacguguacaacuacaggggaacaucgacgugagaaaagaaguguggcacugguuccacauguaggaaugggacuagaaacacguacagaaacguggaugaguagcgaaggugcauggaaacaugcacaacgcauagaaacuuggaucuuacgacauccaggauuuacaauuauggcagcgauauuagcauauacgauuggaacaacacauuuucaacgcgcucucauauucauccuguuaacugcaguagcaccgucaaugacaaugcguuguauaggcauuucaaacagagauuuuguagaaggagugagcggagggaguuggguagacauuguauuagaacacggaucauguguaacaacuauggccaaaaauaaaccaacccuggauuuugaacugauaaaaacagaagcuaaacaaccggcaacucucagaaaauauugcaucgaagcgaaacuuacgaacacaacuacggaaucacgaugcccaacucagggugaacccucguuaaaagaggagcaagauaaaagguuuguaugcaaacacaguaugguagaucgcgguuggggcaacggauguggacuuuucggcaaaggagggauuguaacuugcgcaauguucacuugcaaaaagaauauggagggcaagauuguacagccagagaaucuagaguauacuaucgucgucacaccucacucgggugaagaacaugcaguaggaaaugacaccggaaaacacgguaaagagauuaaagucacaccucagucuucaaucacggaagcugagcugacaggcuaugguacaguuaccauggaguguucgccaagaaccgguuuggacuuuaaugaaaugguauugcuccaaauggagaacaaagccuggcucguacauagacagugguucuuggauuuaccacuacccuggcuaccuggggcggauacacagggcucaaauuggauacaaaaagaaacguugguaacauuuaaaaauccacacgcaaagaagcaggauguagucguucuggguagccaagaaggugcaaugcauacagccuugacuggagcgacggaaauucaaaugucaucuggcaaucuccuauuuacaggccauuugaaauguagauugagaauggauaaauuacaacuaaaagguaugucuuacucaauguguacagggaaauuuaaagucguuaaagaaauagcggagacacaacauggaaccaucgugauaagaguacaauacgaaggagauggcaguccaugcaagauuccuuuugaaauaauggaucuagagaaaagauauguauugggucgauuaauaacaguuaauccaauagucacugagaaagacaguccuguaaacauagaagcugaaccucccuucggagauucauauauuauaauaggaguggaaccaggccagcuaaaauugaacugguucaagaaaggaucuaguaucggacagauguuugaaacuacgaugagaggagcuaagagaauggcaauucuaggcgacacagcuugggauuucgguucguuaggagggguguucacgagcauuggcaaagcacuucaccagguuuuuggugcgauuuauggugcagcauuuaguggaguaucguggacaaugaaaauacugaucggagucauaauuaccuggauaggaaugaauagcagaagcacuucucuaagcgucagcuuaguacuuguaggaaucguaacauuguaucucggaguaaugguucaagcagauagcggguguguugugaguuggaaaaauaaggaacugaaaugcggaucuggcaucuucauaacugauaacguacauacauggacagaacaauacaaguuccaacccgagucucccagcaaauuggcaagugcgauccagaaagcucaggaggaagguauaugugguauaagaucgguuacacgacuugaaaauuuaauguggaaacaaauaacgcccgaacucaaccacaucuuggcggaaaaugaaguuaaacucacaaucaugacgggagauaucaaaggaauaaugcaagcuggaaaacguucucuacgaccucagccgacggagcuuaaauacucauggaagacuugggguaaggcuaaaaugcuuucuacagagagucauaaucagaccuuuuuaauagauggaccagaaacagcugagugcccuaauacaaacagagcauggaacagccuagaaguagaagauuauggauuuggaguauucacaacaaauauauggcugaaacuaaaagaaaaacaagaugccuucugcgauucaaaauuaaugagugccgcaaucaaggacaauagggccguacaugcggauaugggauauuggauugaaucagcgcuaaaugauacuuggaagauagaaaaggcuaguuucauagaggucaagaauugccacuggccaaaaucgcauacacuauggagcaacggcguauuggagucagagaugauaauccccaaaaauuuagccggaccagucagccaacauaacuauaggccagguuaucacacacagaucgccggcccauggcauuuaggaaaacuugaaauggauuuugauuucugugauggaacaacgguaguagugacagaggacugcgguaauagaggaccgucccuaagaacaacuacggcaucuggaaaauuaauuacugaaugguguuguaggucgugcacacuacccccgcuucguuacaggggagaggauggaugcugguaugguauggaaauucggccccuaaaagaaaaggaagaaaauuuaguaaauucuuuaguaacugcaggacacggacaggucgacaauuucaguuuaggcguauuaggaauggcucuauuuuuagaagaaaugcugcgaacgcgagucgguaccaaacacgcgauacuacuuguggccgucucauuugucacuuuaauuacggguaacaugaguuuuaaagauuuaggacgugucguagugaugguuggugcuacaaugacugacgauauuggaaugggagucacuuaucuagcucuacuugcagccuuuaagguaagaccgacuuuugcggcaggccuguuacuaaggaaauuaacaaguaaggaacucaugaugacuacaauaggcauuguucuccuuucgcaaucuacgauuccugaaacgauacucgagcuuacagaugcgcucgcuuuagguaugaugguucuaaagauagugcgaaauauggaaaaauaucaauuagcagugaccauuauggcaauucucuguguuccuaacgcugucauacuucagaaugccuggaaagugagcugcacaauccuagcggugguguccguaagcccuuugcuccuuacaucaucccaacagaaaacugauuggaucccccucgcauuaacgauuaagggauuaaaucccacagcaauauuuuuaacaacacuaucaagaacaaauaagaagagaaguuggccauuaaacgaagccauaauggcgguaggaaugguuucaauuuuagcuucaucucuccugaaaaaugacauccccaugacaggaccccuaguugcugggggucuacugacaguauguuauguccugacaggacgaagcgcugacuuagaacucgaacgugcaacagacguuaaaugggaagaucaagcagaaauaagcggaucaucaccuauacuuucgauuacgaucucagaagacggaucaaugucaaucaaaaaugaagaagaagaacaaacacugacaauauuaauucgcaccggccuccuagugauaucaggacucuucccggucucgauaccgauuacagccgcagcaugguacuuaugggaagucaagaaacaaagagcaggaguauuaugggacguaccgucucccccucccaugggcaaagcugaacuagaagauggugccuaccggaucaagcaaaaaggcauauuagguuauucccagauaggugcaggaguauauaaggaaggaacauuucauacaauguggcauguaacccgaggugcaguucuaaugcauaaagguaagcguauugagccaucaugggccgacgugaaaaaggauuuaauaucauacggaggcggguggaaauuagaaggugaauggaaggaaggggaggagguacaggugcuagcacuagaaccugggaaaaauccccgagcgguucaaaccaaaccagggcuauuuaaaaccaacacagguacaauaggugccguaaguuuagacuucucaccgggcacaucuggcucgccaaucaucgacaagaaagggaagguagucggccuguauggaaaugguguugucacgaggucaggugcauacguauccgccaucgcacagacagaaaaaucaaucgaagacaauccagaaaucgaagacgacauuuuucgcaaaaggcgacuaacaaucauggauuuacauccgggggcuggaaaaaccaaaagauacuuaccagccaucguaagagaggcuauaaaacgaggacuaagaacuuuaauauuggcgccaacuagaguuguugcagcagagauggaagaagcacuccgcggauuaccuauuagauaccagaccccugcgauccgagccgaacauacaggccgagaaauuguagacuuaaugugucacgccacguuuacuaugcggcuacuaucaccuguacgaguaccaaauuacaaccuaauaauaauggaugaagcgcauuuuacagauccggcuucgaucgccgcaagaggcuauauuaguacacggguagaaaugggggaagccgcaggaauauuuaugaccgcgaccccuccugguaguagagacccauucccucaaucaaacgccccaauuauagacgaagaaagggaaauccccgaaagaagcuggaacucuggacaugaguggguaacugauuuuaaaggaaagaccgucugguuugugcccagcauuaaagccgggaacgauauugcugccugcuuaagaaagaaugggaagaaagucauucaacuaucgagaaaaacauucgacucugaauaugucaaaacgcgaaccaaugauugggacuuuguggucacuacagacauaucagagaugggggcuaacuuuaaggcagagagagugauugacccaaggcggugcaugaaaccagugauuuuaacugacggagaagaaagagucauacuagcaggaccaaugccaguaacacacagcucagcagcccaaagacgggggagaauaggucguaaccccaaaaaugaaaaugaucaauauauauauaugggagaaccccuagaaaacgaugaagauugugcucauuggaaggaagcaaaaaugcuucuagacaauaucaauaccccagaagguauaauaccaucaauguuugaaccugaacgugaaaaagucgaugcaaucgauggagaauaucgguuaagaggggaagcaagaaaaacauuuguagaucugaugagacgaggagaccuaccgguaugguuagcuuacaagguagcugcagaaggaaucaauuacgccgaucgucgaugguguuuugauggaauuaaaaacaaucaaauuuuagaagaaaacguagaaguagaaaucuggacuaaagagggagaaaggaagaaauuaaaaccuagaugguuagaugcacguauuuauucggacccucuagcccugaaagaauuuaaagaguuugccgccggacgaaaaucacucacuuuaaacuugauaacggaaauggguagguuaccaacauucaugacacagaagacgagagacgcgcuagauaaccuagcaguacuccacaccgcagaagcgggagguagagcuuauaaucaugcgcuaagcgaauuaccagaaacauuagaaacauuauuacuguugacacuucucgcuaccguaacugguggcaucuuuuuauuucuaauguccggaagaggaauugggaaaaugacacuugguauguguugcauaaucacagcguccauauuguuaugguaugcucagauacagccccacuggauagcagcgucaauaauacuugaguucuucuugauaguauuacugaucccugaacccgaaaaacaacgcacaccgcaggauaaucaacuuacuuaugucguuauugcgaucuuaacuguagucgcagcgacaauggcuaaugaaaugggauuucuugagaaaacgaagaaagaucugggacuaggagguauugcaacucagcagccagaaagcaacauauuagacauugaucuacguccagcgagugccuggacacuauacgcaguagcgaccacuuucgucacaccuauguugagacacaguauagaaaacaguucagucaauguguccuuaaccgcaauugccaaccaggcaaccguuuuaaugggucucgggaaaggcuggccuuugagcaaaauggauauuggggucccuuugcuggcaauaggaugcuauucucaagucaauccuaucacucucacagcagcacuuuuauuauugguugcacacuacgcgauuauuggaccaggauuacaggcgaaggcaacucgagaggcacagaaacgggccgcggcagggauuaugaaaaauccaacaguugaugggauaaccguuauagauuuagaccccauaccauaugauccaaaguuugaaaaacaauuaggucaggucaugcuguuaguccugugugucacacaaguccuuaugaugcguacuacaugggcccucugugaagcauuaacauuagcuacagguccaaucucaacccuaugggaggguaaccccggaagauuuuggaauaccacuauagcuguaucgauggccaauaucuuuagagggucauauuuagcaggagcuggguuauuauucucgauaaugaagaauacaaccaauacaaggcgagguacaggaaauauuggagagacacuaggagaaaaguggaagucuagauuaaacgcacuuggaaaaucugaauuucagauauauaagaaaucagggauucaagaaguagauagaacuuuggcuaaggagggaauaaaaagaggcgaaacggaccaucacgcagugagccgaggaagcgcaaaauuacgaugguucguggagagaaauaugguaacucccgaaggaaaggucguagaccuagguugcggcagaggaggcuggucauauuacuguggcggccucaagaacguccgagaagugaaaggucuaacaaaaggagguccaggacacgaggagccuaucccuaugucgacuuacggauggaauuuaguccgacuucaaucaggggucgacguauuuuucauaccuccugaaaaaugugauacgcuuuuaugcgauauuggcgaaucuagcccaaacccuacggucgaggcaggacgcaccuuaagaguguugaaccucguagaaaauugguuaaacaauaauacacaauuuugcauuaaaguccuuaauccauacaugccgucagucauagaaaagauggaagcacuacaaaggaaguaugguggggcacucguccggaauccacugagccgaaauucaacucacgaaauguacuggguuucuaaugccucgggaaauauuguaagcagcguaaauaugaucucucgaauguuaauuaaccgauuuacaaugcggcauaagaaagcaacuuacgaaccagauguggaucuugguucuggcacuaggaacaucggaauugaaucugaaguaccuaaccuagacauuauuggaaaacguauagaaaagauaaaacaggaacacgaaacaaguuggcacuaugaucaggaucaucccuacaaaacgugggccuaucacgguucguacgaaacgaaacaaacagguucagcuucaagcauggucaauggaguaguacgcuuguugaccaaaccuugggauguccuaccaacuguaacgcaaauggcgaugacagacacaaccccauuuggacagcagaggguguucaaggaaaaaguagauacccguacgcaggagccuaaagaagguaccaagaaguuaaugaaaauaaccgcggagugguuauggaaagaauuaggcaagaagaaaacaccaaggaugugcacaagagaggaguuuacacgcaagguaagaucaaacgcggcacuuggagccauauucacagaugagaauaaauggaaaucagcaagagaagccgucgaagauucacgcuuuugggagcuaguugauaaagaaaggaaccuacacuuggagggaaagugugaaacauguguauacaacaugauggggaagagagagaagaaacuuggggaauuugggaaagcaaaagggucgagagcgauaugguauaugugguuaggggcuagauuucucgaguucgaggcgcuuggauuuuuaaacgaggaccacugguucagccgcgagaacagccuuuccgguguagagggagaaggauuacauaaauuaggauacaucuuaagagacguuucaaagaaagaaggaggaacaauguaugcugaugauaccgcagguugggauacaaggauaacauuggaagauuuaaagaacgaagaaaugguuacaaaccacauggaaggggaacauaaaaagcuagcagaagcaauauucaagcuaacguaccaaaauaaaguaguaagagugcagaggccaacgccuaggggcacaguuauggacauaaucucuagacgagaccaaaggggauccggacaaguugguacuuacggccuaaacacauucacaaauauggaagcccaauuaauuagacagauggaaggugaaggaguauuuaaaaacauucaacaccuaacaguuacagaagaaauagccguacagaauugguuggcccgagucggucgugaaaggcuaucucgaauggccauaucaggagacgauugugugguaaaaccacuagaugaccgauuugcaucagcucucacagcucuaaacgauaugggaaagauaagaaaagacauucaacagugggagccuucuagggguuggaacgacuggacgcaaguuccauucuguagucaucauuuccaugaacuaauaaugaaggauggucgggugcuugugguaccuugcagaaaccaggaugagcuaauuggaagggcaagaaucagccaaggagcagguuggagucugagagaaacggcguguuugggcaaaaguuaugcacagauguggagccucauguacuuccaccgcagggauuuacguuuagcggccaacgcuauauguucagcaguuccaucucauuggguaccuaccaguaggacaacauggucaauccacgcaaagcaugaauggaugacuacugaagauaugcuaacaguauggaaucgaguauggauacaggaaaauccauggauggaggauaaaacaccugucgacaguugggaggagauacccuaccuuggcaaaagagaggaccaauggugcggaucuuugaucggacucacuucacgcgccacgugggcaaagaauauacaggcugcuauaaaucaaguaaggucgcucauugggaaugaggaauacacagauuauaugccguccaugaaaagauuuaggcgagaagaggaggaagcaggcgugcucugguag

SEQ ID NO: 22521 - RNA, 9876 nt, Artificial Sequence
  derived and/or modified CDS sequence (opt6) from DENV-2__GQ868544__SS-prME
agcguagggaugauaauaaugcuuauuccaacaguaauggcauuccauuuaaccacucgaaacggugagccucacaugauuguaucaauacaagaaaaaggaaaaagucuuuuauuuaaaacugaagaugguguaaauauguguacauugauggcuauggaccucggugagcuaugugaagauacaaucacuuacaaaugcccauugcuacgccaaaaugaaccagaagauaucgauuguugguguaacaguacaucgaccugggucacauaugguaccugcaccacaacaggagaacauagaagagagaaacgaucaguggcccuaguaccucacguaggcaugggauuggaaacacguaccgagacguggauguccucagaaggagcauggaaacacgcacaaaggauagagacauggaucuuaagacauccagguuuuacgauuauggcagcaauacuugccuauacaauaggaacgacacacuuccagagagcccucauauuuauauuacuuaccgcuguugcuccgaguaugacuaugagauguauaggcauaagcaaccgugauuucguagaaggcguuuccgguggaaguuggguagacauuguucuagagcauggguccuguguaacgaccauggcgaaaaacaaaccaacgcuagauuucgaauuaaucaaaacugaagcaaaacaaccagcaaccuuacgaaaauauuguauugaagcaaaauuaaccaauacgacaaccgaaaguagaugcccaacucaaggagaaccuaguuuaaaagaagaacaagauaaacgauucguuugcaaacauaguaugguugauagaggauggggaaaugguuguggauuauuuggcaaaggcggaauaguaacaugcgcuauguucacuuguaagaaaaacauggaggggaaaauaguacaaccagaaaauuuagaauacacuaucguuguuacgccacacucaggggaagaacaugcaguaggaaaugauaccggaaaacauggaaaagaaauaaaagucacuccucaaaguagcauaacugaggcagaacugacgggauauggaacaguaacaauggaguguucuccaagaacaggauuagauuuuaaugaaaugguuuuacuucaaauggaaaauaaagcauggcuagugcauagacaaugguuucuggaucuaccacucccaugguuaccuggagcggacacacaaggcucgaauuggauucaaaaagaaacucuugucacauuuaaaaauccacacgccaagaaacaggacgucgucguccuagguucucaagaaggugcaaugcacacugccuuaacuggagcgacagaaauucaaaugaguucugguaacuugcuauuuacgggacauuuaaaaugucgccuaagaauggacaaacuacaacugaaagguaugaguuacagcaugugcacagguaaauuuaaaguuguaaaagaaauagccgaaacacaacacggaacaaucgucauacgcgugcaauacgagggagaugggucaccguguaaagucccauucgaaauaauggauuuggaaaaacgcuacguacuuggucgcuuaauaaccguaaacccaauagugacagagaaagauaguccuguaaauaucgaagcugagccuccauuuggggauucguauauaauaauagguguugaaccaggccaauugaaacuaaauugguuuaagaaagguagcucaauuggccaaauguucgagacuacaaugcguggugcaaaacguauggccauauugggcgauacggcaugggauuucggaucauugggaggcguuuuuacgaguauugggaaagcauuacaucaaguauuuggagcuauauauggagcagcuuuuucuggaguaucuuggacaaugaaaauuuugauuggaguaauuaucacauggauaggcaugaacucuaggucuacaucguugucaguaucgcuuguacucgucggaauuguaacacuauaucuaggaguuaugguacaggccgauucggguuguguaguaagcuggaaaaauaaagaauuaaaaugugggucuggaauauucauuacugacaacgugcauacauggacagaacaguacaaauuccagccugagagcccaagcaaacuggccagugccauucaaaaagcacaggaggagggaauaugugguaucagaucggucacgaggcuagagaaccuaauguggaaacaaaucacaccagagcuaaaccacauuuuagcagaaaaugagguaaaauugacaaucaugacaggugacaucaaaggaaucaugcaagcagguaaaaggucacucagaccgcaacccacagaauuaaaauacaguuggaaaacaugggguaaagcaaaaaugcuaagcacagagagccauaaccaaacauuucugaucgauggaccagagacagcggaaugucccaacacaaauagagcauggaacucacuugagguugaagauuauggguuugggguauuuacaacaaacauuugguuaaaauuaaaagaaaagcaagaugcauucugcgauagcaaguugaugagcgcagcuaucaaggacaacagagcgguccaugcggacaugggguauuggauagaaagcgcccuaaacgacaccuggaagaucgagaaagcaucauucauagaaguuaaaaacugucacuggcccaaaagucacacuuugugguccaauggaguccuagaaagugaaaugaucauacccaaaaaucuagccgguccaguaagucaacauaauuaccguccaggauaucacacucagauugcagggccauggcauuuaggaaaacuggaaauggacuuugacuucugugacggaacuacagucguagugacggaagacuguggaaaucgaggaccuagucuuagaacaaccacagcuucaggaaaacuaauuacagaguggugcuguagaucaugcacucuaccaccuuuaagauacagaggagaagauggauguugguacgggauggaaauacgaccauuaaaggaaaaagaagagaaccugguaaauagucuugucaccgcgggacaggggcagaucgacaauuuuucuuuaggaguucucgggauggcauuauuccuagaagaaauguuacgaacaagaguaggaacuaaacaugcaauacuuuuagucgcgguuucauucgugacccugauuacaggcaacaugaguuucaaagauuuggguagagucguuguaauggugggugcaaccaugacagacgauauagggauggguguaaccuauuuagcgcugcuagccgcguucaaaguuagaccuacuuucgcagcaggauuauuacuucgaaaacugacaagcaaagaauuaaugaugacgaccaucgguaucguucuauugucccaaucaaccauaccagagacaauucuagaguugacugacgcgcuugccuuagggaugaugguacucaaaaucgugcgagauauggaaaaauaucaacuugcaguaacaaucauggccauauuauguguuccaaacgcuguuauauugcaaaacgcauggaagguuagcuguacgauucuugcuguuguuucugucaguccucugcuauuaacaucaucccagcagaaaacagauuggauaccgcuagcguuaacaauaaaggggcuaaacccaacggcuauauuuuugacuacacugucucggacaaauaagaaacgaucauggccuuugaaugaagcaauaauggcgguuggaauggugagcauacuagcaagcagccuacuaaagaacgacauuccgaugacaggaccuuuaguagcuggcggguuauuaacaguaugcuacguucuaacaggaagaagugccgacuuggaguuagagagagcgaccgauguaaaaugggaagaucaagcagaaauuaguggaucaagccccauacuauccauaacaauaucugaagaugguucaaugagcaucaaaaaugaagaagaagaacaaacuuuaacaauacugauucgcacgggacuccuaguaaucucaggucuauuuccgguaucgauaccaauuacggccgcggccugguacuuaugggagguuaaaaagcaaagggcuggaguauuaugggacgugccguccccaccucccaugggaaaagcagaacuggaagauggagcauaccggauuaaacagaaaggaauacuaggauacagccaaaucggcgcuggaguauacaaagaaggaacguuccacaccauguggcacguuacuagaggagccguguugaugcauaaagguaaacguauugagccaucuugggcugaugucaagaaagaucuuaucaguuaugguggaggcuggaaauuagaaggugaauggaaagagggugaggagguacaaguauuagcauuggagcccggaaagaauccaagggcuguacaaacuaaaccgggucucuuuaaaacaaacacgggaacuauuggugccgugucauuggacuucagccccggaacaagugguagcccgauaauugacaaaaagggcaaagucguaggcuuauacggcaacggaguagugacuaggagcggagcauauguauccgcgauagcucaaaccgaaaaaucaauagaagacaacccggacaucgaggaugacauauuucggaaaaggagauuaacgaucauggaccuacauccaggcgcaggcaagaccaagcgcuaucugccugccauaguccgagaggcuauaaagcguggguugaggacacuaaucuuagcucccacacgggugguagcggcggaaauggaagaagcacuaagagguuugccuauaagguaucaaacucccgcaauaagagccgaacauacgggucgcgaaauaguagaccuaaugugucacgcaaccuucacaaugcgauugcuaucaccaguuagaguaccgaacuacaacuuaauuauaauggacgaagcacauuuuacagacccagcuucuauagcugccaggggauauauaucuacaagagucgaaaugggggaagcggcaggcauauucaugacagcaaccccaccaggaucgagggauccuuuuccucaaucuaaugcaccuauaauugacgaggaacgcgaaauaccugaacggagcuggaacucaggucaugagugggugaccgacuucaaaggcaaaaccguuugguucguaccaucaauuaaagcggggaaugacauagcugccugccucaggaaaaauggaaagaaagugauccaauuaucacgaaaaacauuugauagcgaauaugugaaaacaaggacaaaugacugggacuuuguaguuacaacagacauuagugaaaugggggcaaacuuuaaagccgaaaggguaauagaccccagaagauguaugaaaccaguaauucuuacugacggagaagaaagagucauauuagcaggaccuaugcccguuacacacucgagugcggcacaacgucgaggcaggauuggaaggaaccccaaaaacgaaaaugaucaauauaucuacaugggugagccguuagaaaaugaugaggauugugcucauuggaaagaagcgaagauguuacuugacaacauaaauacaccggaagggauaauuccaaguauguuugagccagaaagggagaagguggacgcuauagauggagaauauagauugcgaggagaggcacguaaaacguucguugaucucaugcgacgaggggaccuucccguguggcuagcauacaaaguagcggcagaagguauuaacuacgcagauagaagauggugcuuugauggaauaaagaauaaccagauauuggaagaaaauguagagguagaaauauggaccaaggagggagagagaaagaaacuuaaaccaagauggcucgacgcaaggauuuauagcgacccauuggcgcuuaaggaguuuaaagaauuugcagcgggacgcaaaaguuuaacucugaaccuaauaaccgaaauggguagauuaccuacauuuaugacucagaaaacuagagaugcgcuagacaauuuagccguacuucauacagcggaagccggagguagagcuuacaaccacgcucuaagcgaacuaccagaaacgcuagaaacgcuucuacuccugacgcuauuagccacagugacuggaggaauauuuuuauucuuaaugucuggaagaggaauuggaaagaugacuuuaggaaugugcugcauuguuacggcauccauacuauuaugguaugcacaaauacaaccucauuggauagcagcguccauuauauuagaguucuuucuaauaguguuguugauaccggaaccggagaaacagagaaccccacaagacaaucaacuaacauaugucguuauugcuauacuaaccgugguagcggccaccauggcuaacgagauggguuucuuagagaaaaccaagaaagaccugggucugggaaguaucgccacgcaacagccagagaguaauauacuagauauagaucuucgacccgcaucugcuuggacauuauacgcuguagccacaacuuuuguuacuccaaugcuccggcauuccaucgagaacaguagcguaaacguuucacucacggcaauagcgaaccaagcuacuguauuaaugggucuagggaaggguuggccccuuucuaaaauggacauaggugucccauugcuggcaauaggcugcuauucacaagucaauccaauaacauuaacugcagcucuauuguuauugguagcccauuacgcaaucauaggaccggguuuacaagcaaaagcaacaagagaagcucagaaaagagcagcggccggaauuaugaaaaacccaacuguggauggcaucacaguaauagauuuggacccaauacccuaugauccaaaguuugaaaaacaauugggucaagugaugcucuuaguacuaugcgucacucaagucuugaugaugcgaacaacuugggcauugugugaagcacucacguuagcgacaggacccauaaguacccuaugggaaggaaacccuggccgauuuuggaauacuacuaucgcugugaguauggcuaauauuuuccguggguccuaccuagcuggagcaggucuacuauuuucaauaaugaagaacaccacgaacacucgcagaggaacagggaacauaggagaaacucuaggggaaaaauggaagucgaggcugaaugcacuuggaaaaucggaguuccaaauauauaaaaagagcgggauccaggaaguggauaggacccuugcaaaagaaggaauaaaaagaggggaaacggaucaccaugcagucucucggggcagcgcuaaauuacgcugguuuguggaaagaaacauggucacgccugaaggaaaaguuguagauuuaggauguggacgaggaggcuggagcuacuauugcggcgggcuuaaaaauguucgagaaguuaaaggccuaaccaaagggggucccggccaugaagaaccaauacccaugucaacauauggauggaaucuaguucgauuacaguccggcguagacguauucuuuauuccaccggaaaaaugugacacauuacugugcgauauuggcgagucaaguccuaacccaacgguagaagcugguagaacauuaaggguuuuaaacuuagucgagaacuggcugaacaauaauacucaauuuugcauaaaagugcuuaaucccuacaugccaucagucaucgagaaaauggaaacuuuacaacggaaauaugggggagcccuuguuagaaacccucuuucacgaaauaguacucaugaaauguacugggugucuaacgcgaguggaaacaucguaucgaguguaaacaugaucaguaggaugcucauaaaucgauuuacuaugagacacaagaaagcaacauaugaaccggacguagacuuggggucaggcacccggaacauugguauagagagugagauaccuaauuuagacauaauuggaaaaagaauugagaagauaaaacaggaacaugaaacuucauggcacuaugaccaagaccaucccuauaagacgugggcauaccacgggagcuaugaaacaaaacaaacuggaucagcaucgucuaugguaaauggaguaguuagauuauuaacaaaaccaugggauguccugcccacuguuacgcaaauggcuaugacugauaccacacccuuuggucaacaaagaguauucaaagaaaaagucgauacacguacacaagaaccaaaagaaggaacuaagaaacugaugaaaauuacugccgagugguuauggaaggaguuggguaagaagaaaacuccgagaaugugcacgcgugaagaguuuacucguaaaguccguaguaaugcugccuuaggagcaaucuucaccgaugagaacaaauggaaaucagcgagggaagcagucgaagauagucgauuuugggaacugguagacaaagaacgaaacuugcaucuagaaggaaaaugugaaacguguguauauaauaugaugggcaaacgagaaaagaaauuaggagaauuugguaaagcuaaaggcucaagagcaauuugguacauguggcuaggagcacguuuucuugaauuugaagcauuaggauuucuaaacgaagaccacugguucaguagagaaaauucacuaucaggcguugaaggggaggggcuauauaaacucggauauauucuacgcgaugugagcaagaaagagggcggcgccauguacgcagaugacacggccggaugggauacacgcaucacauuggaagaccucaaaaacgaagaaauggucacgaaucauauggagggagagcauaagaaauuagcugaagcuauauucaaacugacguaccaaaauaaaguuguacgaguucaacguccaaccccacgcgggacuguaauggacauaaucaguagaagagaucagagaggaaguggucaaguagguacuuauggacuuaacaccuucaccaauauggaagcucaguugauaagacagauggaaggugaagggguauuuaagaauauacagcauuuaacuguaacggaggagauugcaguacaaaauuggcuagcaaggguuggacgugaacgacuaucuagaauggcaauaucaggugaugacugugucguuaaaccgcuagaugaccgcuucgcaagugcucugacggcauuaaaugauauggggaaaauaagaaaagacauacaacaaugggaaccaagcagggguuggaaugauuggacacaaguaccauuuugcucucaucacuuucaugaauuaaucaugaaggauggaagggucuuagugguucccugccggaaucaagaugaacucauugguagagcuagaauaucacagggcgcaggcuggaguuuacgggaaacagcgugucucgguaaaucguacgcacaaauguggucgcuaauguauuuucauaggagagaucucagacuagcugcuaacgcaauuugcucugcgguuccaucucacugggucccuacaucgaggacuacauggucaauacaugcaaaacaugaauggaugaccacugaagauaugcugacaguguggaaucgaguuuggauacaagaaaacccguggauggaagacaaaaccccagucgaaaguugggaggaaaucccauacuuggguaaaagggaagaucaguggugcgggucgcugaucggauuaacaucccgcgccacaugggcaaagaacauucaagcagcuauaaaucaaguaagaucuuuaauuggaaaugaagaauacacagacuauaugccgucuaugaaacgauuucggagagaggaagaagaagcuggcguacuaugguaa

SEQ ID NO: 22522 - RNA, 9876 nt, Artificial Sequence
  derived and/or modified CDS sequence (opt6) from DENV-2__GQ868545__SS-prME
ucugcaggaaugaucauuauguuaauacccaccguuauggcuuuucacuugaccacacgaaauggagaaccccauaugauaguaaguauacaagaaaaaggaaaaaguuuguuguuuaaaacagaagauggaguaaauauguguacauuaauggcaauggauuuaggagaacuaugugaagacacuaucacauauaaaugucccuuguugagacaaaacgaacccgaagacaucgacuguugguguaauagcacaaguacauggguaacuuaugggacauguaccacaaccggagaacacagacgugagaaaagaucgguggcacuugucccucauguaggaaugggacucgaaacgcggacagaaacguggaugaguucggaaggugcuuggaaacaugcgcaacgaauugaaacauggauccuaaggcauccuggauucacaauaauggcagcaauacuagcuuauaccauagguacaacgcauuuucaaagggcauugauauuuauauuacugacagccguagcaccuagcaugacaaugagauguauagguaucagcaaucgggauuucguugaaggcgugucggguggcaguugggucgauauaguuuuagaacaugggucaugugugaccacaauggccaaaaauaaaccaacauuagacuuugaacucauaaaaaccgaagccaaacaaccagcuacucuaagaaaauacuguauagaagcaaaacuaacaaacaccacaacagaaucucgaugcccgacgcaaggggagcccagcuugaaagaagaacaagacaaacguuucguuugcaaacacucaauagucgauagagguuggggcaauggguguggauuauucggaaaagguggaauaguaacuugugcaauguuuacauguaagaaaaacauggagggaaaaauagugcaaccagaaaauuuagaauauacgauagucguaaccccacacucgggagaagaacacgcaguagggaaugauacaggaaaacacggcaaagaaauaaaagucacaccacaaagcucgguuaccgaagcagaauuaacuggcuaugggacaguaacuauggaauguaguccucguacugggcuagacuuuaacgaaaugguauugcuacagauggaaaacaaggcuuggcuagugcaccgacaaugguuucucgauuuaccuuuaccguggcuuccuggcgcugauacacagggaucaaauuggauucaaaaagagacauuaguuacguucaaaaauccucacgcaaagaaacaagacgugguuguauugggaucacaagagggugcaaugcauacagcgcugacaggagcaacggagauucaaaugagcucugguaaccuccuauuuacaggacauuuaaaaugucgucuaagaauggauaaauuacaacuaaaagggaugucauacaguauguguacugguaaauuuaaagugguaaaagaaaucgcugaaacacaacaugggacuauugugauacgugugcaauacgagggagacggcucaccguguaaaauaccauuugaaauaauggaccuggagaaaagguaugugcuagguaggcuuauaacugucaaucccaucgucacugagaaagauucccccgugaacauagaagcggaaccaccguuuggggauaguuacauaauaauaggggucgaaccgggucaacuaaaauuaaauugguucaaaaagggaaguaguauaggacagauguuugaaacgacgaugagaggagccaaaaggauggcuauucuaggagacacagcaugggacuucggaagccugggagguguauucacaucuaucggaaaagcauuacaucagguauuuggagccauuuauggggcagcauucucgggugucuccuggacuaugaaaauacugauuggaguaaucauaacauggauuggaaugaacucuagaucaacaagccuuucgguaucuuuaguccuugugggcauaguaacacuguaucugggcgugaugguacaagcugacucagggugcgucgucucauggaaaaauaaggagcugaaaugugguucugguauauuuauaacugacaacguccauacuuggacugaacaauauaaauuccaaccugagucaccuucuaaguuagcuucugcgauccaaaaagcacaagaggaagguaucugugguauaagguccguaacaagguuagaaaaccuaauguggaaacagauaaccccagaauuaaaucauauacucgcugaaaaugaaguuaaauuaaccauaaugacuggugacauaaaagguauaaugcaagcuggaaagcguucgcuacguccacagccaacagaauuaaaauacagcuggaaaaccugggggaaggcaaaaauguuaucuacggagagccacaaccagacauucuuaauagacgguccugagacugcagagugccccaauaccaauagagcguggaacucgcuggaaguugaagauuauggauuuggcgucuucacuacgaauauauggcucaaacugaaagaaaaacaagaugcauuuugugauucgaaacuuaugucagccgcaauuaaggauaaucgagccguucacgcagauaugggauauuggauagaaagugcacuuaaugacacauggaaaauugaaaaagcaucauuuaucgaaguuaaaaauugucauuggcccaagucacauacauuauggucaaacgggguccuagaaagcgaaaugauaauacccaagaauuuagcuggaccugugucccaacauaauuauagaccaggauaccauacccaaauagcaggaccuuggcaucucggaaaauuggaaauggauuucgacuucugcgauggcacaacaguaguaguuacagaagacuguggaaauagaggaccaagucuaagaacaacuacagcuucuggcaagcuaauuacugagugguguugcagaagcugcacuuuaccaccauuaagguaccguggagaggauggauguugguauggaauggagauaagacccuuaaaagaaaaggaagaaaaucuggucaacagucucgucacagcaggucauggccagauagacaauuuuaguuuaggaguuuuagguauggcuuuauuuuuagaagaaauguugagaacgaggguaggcacgaaacacgccauucuauuaguugcagugaguuucgugacuuuaaucaccggaaauaugaguuucaaggacuugggaagaguuguuguaauggugggcgcaacaaugacagaugacauugguaugggcgugaccuacuuggccuuauuagcugccuucaaagugagaccaacacuagcugccggucuauugcuucguaaauuaaccaguaaagagcuuaugaugaccacuauuggaaucguauugcuaagccaaagcaccaucccugaaaccauauuagaauuaaccgaugcacuugccuuaggcaugaugguccugaaaauuguuagagauauggagaaguaccagcuagcuguaacgauuauggcuacucucuguguaccgaaugcaguaaucuugcaaaaugcuuggaaaguuaguuguacaauucuggcaguugugaguguaagccccuuacugcuaacguccucacagcagaaaacugauuggauaccauuggcacuuaccauaaagggccuaaacccaacugcaauuuuccuaaccaccuugucaagaacuaacaaaaagcgguccuggccacugaaugaagcaauuauggcggugggaauggucucuauuuuagcgucaagucuauuaaagaaugacauaccgaugacaggaccauuaguggcagggggccuuuugacaguuuguuauguuuugacaggcaggucugcggaucuagagcuagaaagagcgacagacguaaaaugggaggaucaggcagaaauaaguggcaguucgccaauacucucuauaaccauaagugaagaugguagcaugucaauuaaaaaugaagaggaggaacaaacauuaacaauacuuaucagaaccggcuuguuaguuauuuccggacuguuuccuguaagcauacccaucacggcugcugcgugguaccuaugggaggugaagaaacagcgcgcugguguacucugggacgucccaucaccaccgccaaugggaaaagcugaacuagaagauggagcauaucgcauuaaacaaaaaggcauucuuggauacucgcaaaucggugcaggcguauauaaagaggguacguuucacacgauguggcauguuacacguggcgcuguacugaugcauaagggaaagagaauagaaccuuccugggcagaugucaagaaagaccuaaucucauaugguggugguuggaaguuagaaggagaauggaaggaaggagaagagguacaaguuuuggcguuagaaccaggcaaaaacccaagagcaguacagacuaaaccaggguuauuuaaaacgaacacugguacgauaggggccguaucgcuggauuuuucgccaggcaccucggguucacccaucauagacaagaaagggaaggucgugggcuuguauggaaacgggguaguuacgagaaguggcgcuuacguuucagcgauagcacaaacagagaaaaguauugaggacaacccagauauagaagaugauauuuuucguaaaaggcgccugaccauuauggacuuacacccuggagcagggaaaacaaagcgauacuuaccugcaaucguacgcgaagccaucaagcgagggcucagaacuuuaauacuugcaccgacacguguaguagcagcagaaauggaggaggcacuacgcgguuuaccuauacgauaccaaacacccgcaauacgagcagagcauacaggaagagaaaucguagacuugaugugucacgcuacuuuuaccaugcgucuacuaagcccuguccgcguuccaaauuauaaucuaauuauuauggaugaagcucauuuuacagauccagcaucuauagccgcuagaggcuacauuucuacacguguagaaaugggcgaggcagcuggaauuuucaugacagcaacaccaccugguucccgcgauccuuuuccgcaaucuaaugcuccgauaauugaugaagaacgcgagauccccgaacgcaguuggaacucuggacacgaaugggucacagauuucaagggaaaaacggugugguucguaccuaguauuaaagcgggaaacgacaucgcugccugccuccgcaagaaugguaagaaagucauacaauuaucgcguaaaacauucgauagcgaguauguuaaaaccaggacuaacgacugggauuuugugguuacaacugauauuucugaaaugggagcgaauuuuaaggcugaaagagugauagacccaagaaggugcaugaaaccuguuauauugacugacggggaagaacggguaauuuuagcagguccgaugccuguuacccauaguuccgcagcucaacguaggggcagaaucgggagaaacccaaagaacgagaaugaccaguacauuuacaugggugaaccauuagaaaaugacgaagauugugcacauuggaaagaagccaagauguuauuagauaauauuaacacacccgaaggcauuauaccaucaauguuugaaccugagcgagaaaaaguugaugcaauagauggugaauaccgauuacguggugaagcgcgaaaaacuuuuguagaucucaugagacgaggggaucuucccguuuggcuagcuuacaaaguugcagccgaagggaucaacuaugccgauagaagaugguguuucgaugguaucaaaaacaaucaaauucuagaagaaaacguagaaguagaaauuuggacuaaggagggagaacggaagaaauuaaaaccgcggugguuggaugcaagaauuuauagugauccucuagcucucaaagaauuuaaagaguuugcagccggacgaaaaagucuaaccuuaaauuuaauuacagaaaugggcagguugccaacauucaugacacagaagacccgggacgcauuagacaauuuagcgguguuacauacagcagaggccggugggcgagccuauaaccacgcuuugucagaacuaccagaaacauuagaaacccuucuccucuugacucugcuugcuaccguaaccgguggcauauuccucuuccucaugucaggaagagggauagggaaaaugacguuaggaauguguuguauaauaaccgccucaauucuauugugguaugcccaaauucaaccccacuggauagccgcaaguaucauacuagaguuuuucuuaauugugcuucucauaccagaacccgaaaaacagagaacgccacaagauaaucaacuaacuuacguggucauugcaauacugaccgugguugcugcaacaauggccaacgaaaugggauuucucgagaaaaccaagaaagaucucggauuggguagcauugcaacucaacaaccugaaucaaacaucuuagacauugaucuaagaccggcuucugcguggacccuauacgcuguggccacaacguuuguaacuccaauguugcgucauaguauagaaaauucaagugugaauguaucucuuaccgccaucgcaaaucaggcaaccguucucaugggacucgguaaaggauggccccugaguaagauggauaucggugugccauuacuagcaauagggugcuauucacaggugaacccuauaaccuuaacugcagcguuacuauuacuuguagcucauuacgcgauaaucggacccggucugcaagcaaaagcaacuagagaagcacagaaaagagcagcggcuggaauuaugaagaaucccacaguagauggaauaaccguaauagaccuagaccccaucccuuaugauccuaaauucgagaagcaacugggacaagugauguuacuuguguugugcgugacucaaguuuugaugaugcggacaacuugggcuuuaugcgaagcgcuaacauuggcaacagguccuauaucuacauuaugggaagguaauccggggcgauucuggaacacuacuauagccgugucaauggcuaacauauuuagagguucauauuuagcaggcgcuggacuacuauuuaguauuaugaaaaauacuacuaacacuaggagggggacaggcaauauaggcgaaacauuaggagaaaaguggaaaucccgccuuaacgcuuuaggcaagucagaguuucaaaucuacaaaaaguccggaauccaggaagucgacagaacgcuggcgaaagaagguauaaaacggggugagacggaccaucaugcagugucacgagggucggccaagcuaagaugguucgucgagagaaauauggugacaccagaaggaaaagugguagaucucgguugugguagaggugggugguccuauuacugugguggacuaaagaaugucagagaaguaaaagggcuaaccaaaggagguccugggcaugaagaaccuauuccaaugucgacauauggauggaauuuaguuagguuacaaucggguguagacguauucuuuaucccuccagaaaaaugcgacacacugcugugugauauaggugagagcagcccaaaucccacaguugaggcuggaagaacguuacgagucuuaaaucucguagaaaauugguuaaauaauaauacacaauuuugcauaaagguacuuaauccauauaugccuagcgucauugagaaaauggagacacuacagcggaaguaugggggagccuuaguaagaaauccgcuaagucggaacaguacucacgaaauguauuggguaucgaaugcuagcgguaauauaguuucaaguguaaauaugauuaguagaaugcucauaaauagguuuacuaugagacauaagaaagcuaccuacgaaccugauguggaucuuggaucaggaacaagaaauauugggauugaaagugaaauuccaaaucuagacauuauaggcaaaaggaucgaaaagauuaaacaagagcaugaaacaagcuggcauuacgaucaagaucacccauauaaaacuugggcauaucauggcuccuacgaaacuaaacaaacuggaucagcgaguucaaugguuaacggcguaguacgccuguugacuaaacccugggauguuuuaccaacgguuacucagauggcaaugaccgauacuacgcccuuuggacagcaaagaguuuuuaaagaaaaggucgacacgaggacgcaagaacccaaagagggaacuaaaaagcuaaugaaaauaacagcagaaugguuauggaaggagcucggcaagaaaaagaccccaagaaugugcacgcgugaggaauuuacacguaaaguuagaucuaacgcagcucucggcgcgauauucacggaugaaaacaaguggaaguccgcgagggaagcaguagaggauaguagauucugggaguuagucgacaaagaaagaaagcuacauuuagaaggaaaaugugaaacgugcguuuauaacaugaugggaaaaagagagaagaaacuuggagaguuuggcaaagcuaaaggauccagggccaucugguacauguggcuuggugcaagauucuuggaauuugaagcucuaggcuuucuaaaugaagaccauugguucaguagagaaaauagccuaagcgguguagaaggcgaaggauuacacaaguuaggauacauauuaagagacguaaguaagaaagaagggggugcaauguaugcagacgacacagccggaugggauacaagaauaacacuugaagauuugaaaaaugaagagaugguaacuaaucacauggaaggugagcauaagaaacuagcggaggcuauauucaaacuaacauaccaaaauaaaguaguuagaguacagcggccuacaccacgaggaacaguuauggauauaauaucgagacgagaucaaagaggaucaggacaaguaggaacauauggccuaaacacauuuaccaauauggaagcucaacuaauuaggcagauggaaggagaaggcgucuuuaaaaacauccaacacuugacugugaccgaggaaaucgcaguacaaaauugguuagcuagaguaggacgagagcguuuaagcagaauggcgaucagcggagaugacuguguugucaagccauuggaugauagauuugccagugcacugacagccuuaaaugacauggggaaaaucaggaaagauauucaacaaugggaaccaucccgcggguggaacgauuggacacaaguuccguucugcagccaucacuuucaugaauuaauaaugaaagacgguagagugcuaguagugccguguagaaaccaagaugaauugauaggcagagcuagaauaucacagggagcagguuggucuuuaagagaaacagccugucugggcaaaucuuacgcccaaauguggaguuuaauguauuuccaccgucgagauuuaagacuugcagcaaacgcuaucugcucugcaguuccgagccauuggguccccacaagcagaacaacuuggaguauucaugccaaacaugaguggaugaccaccgaagauaugcugacaguguggaaucgcguauggauucaagaaaaucccuggauggaagacaaaacaccaguggaaaguugggaagaaaucccuuaucucgguaaaagggaggaccaauggugugggucguugauaggauuaacuuccagagcgacgugggcgaaaaacauucaagccgccauuaaucaaguacgaucgcuaauaggcaaugaagaauacacugauuauaugccuucuaugaaaagguuuaggagagaagaggaggaagcaggaguacuuugguaa

SEQ ID NO: 22523 - RNA, 9876 nt, Artificial Sequence
  derived and/or modified CDS sequence (opt6) from DENV-2__GQ868543__SS-prME
uccgcuggcaugauaaucaugcuuauuccaacaguaauggcuuuucaucuaacaacgagaaacggggaaccacauaugaucgucgguauccaagaaaaaggaaaaucacucuuauuuaagacagaggacggcgucaauauguguacacuaauggcgauggacuugggagaacuuugugaagauacaauaacauauaaaugcccuuuacuuagacaaaaugaaccugaagauauugacugcuggugcaauagcacaaguacauggguaacuuauggaacuuguacuacaacaggugagcaucgcagggaaaaaaggagcguugcacuuguaccucacgucggcaugggauuggagacacgaacggaaacauggaugagcagugaaggagcguggaaacacgcacaaagaauagagacauggauccugcgucaccccgguuuuacaauaauggcugccauuuuagcguacacaauagguacaacgcacuuucagagagcacucauauuuauauuguugacggcggucgcacccaguaugacaaugagguguauuggaauuaguaaucgugacuucguagaaggaguaagcggcggaucguggguagacauuguauuagagcauggguccugugucacuacgauggcgaaaaacaaaccuaccuuagauuucgaacuaauuaaaacggaagcaaagcagccagcgacccuuaggaaauacuguaucgaagcaaaauugacuaauacaacaacugaaucuaggugcccaacacaaggagaaccgagucuaaaggaagaacaagauaaaagguuuguauguaaacauaguaugguugacagagguuggggaaacggcugcgggcuauucggaaaaggagggauuguaacgugugcaauguuuacguguaaaaaaaauauggaaggaaaaauaguacaacccgaaaaucuagaguacaccauuguaguuaccccccauagcggagaggaacaugcuguaggaaaugacacuggcaagcaugggaaagaaauaaagguuaccccacaaucuucaaucacagaggcagaguuaacaggauauggaacgguaacaauggaauguuccccaaggaccggcuuagauuuuaacgaaauggugcuauugcagauggaaaacaaggcauggcuaguucacagacaaugguuucuagaccucccccucccaugguugcccggcgcagauaaacaagguagcaauuggauccagaaggaaacuuuggucacauucaaaaacccucacgcgaaaaaacaagacguuguaguacuuggaagucaggaaggugccaugcacacagcacuuacgggagccacggaaauccaaaugucaucagggaauuuacucuucacuggacaucucaaaugcagauugagaauggauaaguuacaauuaaagggaauguccuauucuauguguacgggaaaguucaagguaguuaaagaaauagcugagacucaacacgggacaauagugauacgaguacaauacgagggagauggaucaccuuguaaaauacccuuugaaauaauggaccuagaaaagagauauguauuaggaagauugauuacaguaaauccuauugucacugaaaaagacagucccgugaacauagaagcggagccuccuuucggugacucauacauuauuauagguguagaaccuggucaauuaaaauuaaauugguuuaaaaaaggaucaagcauuggacaaauguuugaaacgaccaugagaggugcuaaacguauggcaauacuuggagauacggcuugggauuuuggcucccucgguggaauguuuacuaguauuggaaaagcucuccaccaaguauuuggggcgauauacggggcugccuucucuggcgugaguuggacaaugaaaaucuugauuggaguaauaauaacauggaucgguaugaauucacguucgacuagucuuagcgucucucucgugcuagugggcaucgucacuuuauauuugggaguaaugguacaagcugacagcggauguguaguuagcuggaaaaauaaagaguuaaaaugcggcucagggaucuuuauuaccgacaauguucauaccuggacagaacaauauaaauuucaaccagaaaguccgaguaaguuagcaagugccauccagaaagcgcaagaggagggaauaugugguauacgcucuguuaccagacuggaaaaucuuauguggaaacaaauaacaccugaauuaaaccauauacuugcugaaaaugagguuaagcucaccauaaugacaggagauauaaaagguauuaugcaggcugguaaacgcaguuugcgcccucaacccacggaauuaaaauacuccuggaaaacuuggggaaaagcuaaaaugcuaucuacggaaagucauaaccaaacguuuuugauagaugggccagaaacugcagaaugcccaaacacgaacagggcauggaacucucucgaagucgaggauuacggauuuggaguguucacaacaaacaucuggcuuaaguuaaaagaaaaacaagaugcguuuugugacucaaaacuuaugagcgcggcuauaaaagacaacagagcaguucacgcugauaugggcuacuggauagagagcgccuuaaaugauacuuggaaaauagaaaaagcgucauuuaucgaaguuaagaauugccauuggccaaaaucucauacacuguggaguaaugggguccucgaaucggaaaugaucaucccuaagaacuuggcggggccaguuagucaacauaauuacaggccgggcuaucauacacaaauugcggggcccuggcauuuagguaaacuagaaauggacuuugauuucugcgauggaacaacuguuguaguaacggaagauugcgguaauagaggaccaucucuaagaaccacaacggccagcggcaaauuaauuacagaaugguguuguagaucaugcacacuaccuccauuaagauaccgaggagaagauggcuguugguaugguauggaaauaagaccgcucaaagaaaaggaagagaauuuggugaacuccuugguaacagcagggcauggccagguugauaauuucucacuuggaguauuaggcauggcacucuuucuggaagagaugcuccgaacacgcgucggaaccaaacaugcaauauuacugguagcuguaucauuuguuacccucauaacagguaacauguccuucaaagaucucggaagagugguagucaugguaggggcuacuaugaccgaugacauaggaaugggugucacguaccuagccuuacuugcagcguuuaaaguaagaccaacuuuugccgcaggacuacuacuccguaaguuaacgucaaaagagcucaugaugacuaccauuggcaucguauugcugucccaaaguaccauuccagagacaauuuuggaauuaacugaugcauuggcucuugguaugauggugcuaaaaauuguucgaaauauggagaaauaccaauuagcaguaacaauaauggcgauucuuugcgugccuaaugcagucauccugcagaaugcguggaaaguaucaugcacaauacuugcaguagucaguguaagcccguuguuauugacgaguucacaacagaaaacagauuggaucccacuggcacuaacuauaaaaggccuaaauccaacagccaucuuuuuaacaacuuuguccaggacgaacaaaaaacgcucauggcccuuaaacgaagcuauuauggcgguugggauggucucuauuuuagcuagcagcuuacuaaagaaugauaucccaaugacuggaccacugguagcuggcggacuacugacuguaugcuacguccugaccggccguagugccgauuuagaauuagaacgagccacugacguaaaaugggaagaucaagccgaaaucagcggaucaucccccauucuauccaucacuauauccgaagauggcucgaugucaauaaaaaacgaagaagaagaacaaaccuuaacaauacuaauaagaacgggacuauuaguuauaagcggguuauuucccgucucaauaccgauuacagcagcagcaugguaccuaugggaagucaagaaacaacgcgcgggagucuuaugggacguaccuaguccaccuccaaugggcaaagcugaauuggaggauggagcuuaccgaauuaaacaaaaagguauccucgguuauucucagauuggggcaggcguauacaaagagggcacuuuucacacaauguggcauguaacaaggggugcaguuuugaugcacaaaggaaaacgaauagaaccaagcugggccgacguuaaaaaagaucuaauaucauaugguggagguuggaaacuugaaggagaauggaaggaaggcgaagaaguucaaguacuggcauuagaacccggcaaaaacccaagagcuguacagacaaaacccgggcuauuuaagacuaacacaggcacaauuggugcaguaucgcuagacuuuagcccaggaacuucaggcucuccaauaaucgauaagaaaggcaaaguaguaggucuguacgggaaugggguagucacuaggaguggagcuuacguaagcgcaauugcccaaacugagaaaaguaucgaagauaauccagaaaucgaggacgacaucuuucgaaaacgcaggcuuacgaucauggaucuacacccaggcgccgguaagacaaagcgguacuuaccugccauuguacgugaagcaaucaaacggggauuacgaacauuaauucuagcaccaacaagagucguugcagcggaaauggaagaagccuugcguggucucccuauucgauaccaaacgccggcgauaagagcggaacacacaggucgagaaaucguagaucugaugugucacgcaaccuuuacaaugcgccugcuuagcccaguacgaguacccaacuacaaucuuauaauaauggacgaagcgcacuuuaccgaccccgccucuauugcagcucggggauacaucagcacuaggguagaaaugggugaagcugcaggaaucuuuaugacagcgacacccccaggcucucgggauccuuuuccccaaucaaaugcaccaauuauagaugaagaacgagaaauaccagagagaucauggaacuccggacaugaaugggugaccgauuuuaaagguaagacgguaugguuuguaccgaguauaaaggcuggcaacgacauugccgcauguuugaggaagaacggaaaaaaagucauacaauuaaguagaaaaaccuuugauagugaauaugugaaaacaaggaccaaugauugggauuucguggucacaaccgauauuuccgaaaugggagcuaauuucaaagcagagagaguuauagacccuagaagguguaugaaaccagugauacuaacugacggcgaggaacgaguaauacucgcuggucccaugccagucacacauucaucugcagcacagagacgaggcagaaucggaaggaacccaaagaacgaaaacgaucaauacauauacaugggcgaaccacuggaaaaugacgaagacugugcccauuggaaagaggcaaagaugcuauuagauaauauaaauacuccagaagguauuauaccgucaauguucgaaccagaacgagaaaaggucgacgccauagauggugaauacagauuacgcggggaggcgagaaagaccuuuguagauuuaaugcgacguggagaucuucccguaugguuagccuacaaagucgcggccgaggguauaaacuaugcggacaggagguggugcuuugaugguauuaaaaacaaccaaauacuagaagaaaauguagagguagaaauauggacaaaggaaggagagagaaaaaaauuaaaaccgcggugguuagaugcgcggaucuauucggauccauuagcauuaaaagaguuuaaggaguuugcugcgggaagaaagucuuuaacccuuaaccucauaacagaaaugggaagacugccgacuuuuaugacucagaaaacgcgggaugcccuugacaacuuagcaguccuucauacugcugaagcaggggggagggcauacaaucaugcucucagugaauugccugaaacccuagaaacuuuauuacuucuaacccuauuggcaacagugacuggaggcauuuucuuauuuuuaaugucggggagagggaucggcaaaaugacuuuagggaugugcugcauuauaacagcaucaauacuacuuugguaugcgcagauucaaccacacuggauagcugccuccauuauauuagaauuuuuuuuaauuguauuauuaaucccagaaccagaaaaacaaagaacaccacaggacaaucagcuuaccuauguagugauagcaauauuaacaguaguagcugcuacgauggcaaacgagaugggauuucucgaaaagacgaaaaaagaucuuggucucggauccauagcuacgcaacaaccugaaaguaauaucuuagauaucgaccuaagacccgccucagccuggacauuauaugcuguugcuacaacguuugugaccccaaugcuaaggcacucuauagaaaauucaagcguaaacguaucguuaacggcaauugcaaaucaagcuacaguucuaaugggucuaggaaagggauggccuuugucaaagauggauauaggggucccauuauuagcaaucgguuguuacucccaaguaaauccgauaacccugacagccgcacuauuacuacuuguggcccauuaugcaaucauuggccccggguuacaagcaaaagcaaccagagaagcacaaaagagagcugcugccgguauuaugaaaaauccuacuguugauggaauuacggugauugaccucgacccaauacccuaugacccaaaauuugagaaacaauuaggacaaguaauguuguugauuuuauguguaacacaggugcuuaugaugcgaacuaccugggcauuaugcgaagcauugacucugguuacgggccccaucucuacccuaugggaagguaauccaggcagauuuuggaauacuacaauagcggugaguauggcgaacauuuuccgggguaguuaucuugcaggugcaggacuacuauucucaaucaugaagaacacaaccaacacacggcgaggaacggguaauauuggggagacauugggcgaaaaauggaagucaagacuaaacgcccuaggcaaaucagaauuucaaauauauaaaaaaucaggaauccaagaaguagacaggacacuagcaaaagaaggcauuaaaagaggugagacagaucaccaugcugucucgagaggcucagccaaacuacggugguucgucgaaagaaauauggugacucccgaaggaaaaguuguagacuuagguugcggaagggguggauggucguacuauugcgggggccugaaaaacguuagagaagugaagggucugacaaaagguggaccaggacaugaagaaccaauaccgauguccacuuauggauggaaucuuguaagguuacaaucaggagucgauguauuuuucaucccaccggaaaaaugugacacguuauugugugauauaggugaaaguagccccaaccccacaguagaagccgggaggaccuuacgcgucuugaacuuaguagaaaauugguuaaauaauaauacacaauucugcauaaaaguguugaacccuuauaugccaucugugaucgaaaagauggaagcacugcaacggaaauaugguggugcucuaguaagaaauccauuaagccgaaacucaacucacgaaauguacuggguuucaaaugcaucagggaauaucgugaguaguguuaauaugauaucacgaauguugauuaacagauucacgaugcgacauaaaaaagcgacguaugagccugacguggauuuagguagcgguacaagaaauaucgguauugaaagugaaauucccaacuuagacauuauaggaaaacgaauagaaaaaauaaaacaggaacaugaaacaucauggcauuaugaccaggaucauccuuauaaaacuugggccuaucacggaucuuaugaaacaaaacaaaccgggucggcaucgaguaugguuaacgggguaguacgauuauuaacgaagcccugggacguacucccaacugucacucagauggcuaugacagacacaaccccuuuuggacaacaaaggguuuuuaaagaaaaaguagauacacguacacaagagcccaaggagggcacuaaaaaacuaaugaaaauaacugcugaauggcuauggaaggaacuuggaaagaaaaaaaccccccgaauguguacgagagaagaguuuacgagaaaaguccgaaguaaugcggcgcucggcgcaauuuuuacagaugaaaauaaauggaaauccgcaagagaagcaguggaggacucgagguuuugggaauugguggacaaagaaagaaaccuacauuuagaggguaaaugugagaccugcguauacaauaugauggguaaacgcgaaaaaaaacugggagaauuuggaaaagccaaaggaagcagggcuauaugguacauguggcuuggugcaagauuuuuggaauuugaggcauuaggauuuuuaaaugaagaucauugguuuagcagagagaauucguugucgggaguugaaggggagggucuacacaaacuugguuauauccuuagggacguuucaaagaaagaagguggcgcaauguaugccgaugacacugcggggugggacacucggauaacucuggaggacuuaaaaaacgaagaaauggucacaaaccacauggagggagagcauaaaaaauuagcugaagcuauauuuaaauuaacauaucaaaauaaagugguaagaguucaaagaccaacuccacgugguaccguaauggacauuauaagccggcgagaucaacgcggaagcggacaaguuggcacguauggacucaacacauucacuaauauggaagcacaacugauuagacaaauggaaggagaggggguauucaaaaacauacagcaucucacaguaaccgaggaaguugcaguacagaauuggcuagcccgcguuggaagagaacgacuaucccgaauggcaaucucuggagaugacugcguuguaaaacccuuggacgauagauucgcuaacgcacuaaccgcuuuaaacgauaugggcaaaauacgaaaggauauacaacaaugggagcccucaaagggguggaaugacuggacgcaaguacccuucugcucacaucacuuccaugaacucauuaugaaagauggcagaguccuuguugucccaugcagaaaucaagacgaauuaauaggacgagcuagaauaucccaaggagccggauggucguugagagaaaccgcaugccugggaaaaucauaugcucaaauguggagccugauguacuuccaucgaagagaccuuagauuagcggccaacgcaauuuguagcgccguacccagccacuggguacccaccucacgcacaacaugguccauucaugcaaaacacgaguggaugacuaccgaggauaugcuuacaguauggaauagaguuuggauacaagaaaacccuuggauggaggauaaaacaccaguagaaucgugggaagagauaccuuacuuaggcaaacgcgaagaucaguggugcggcucgcucauagguuuaacuagucgagcaacuugggcaaagaauauucaagcggcuaucaaucaaguacgguccuuaauugggaacgaagaauacacagauuauaugccaucuaugaaacgauuuaggagagaagaggaagaagcugguguuuuaugguaa

SEQ ID NO: 22524 - RNA, 9876 nt, Artificial Sequence
  derived and/or modified CDS sequence (opt6) from DENV-2__EU482544__SS-prME
acagcgggcguuauaauuauguuaauuccaacggugauggcauuccacuugaccacgcgaaauggagaaccacauaugauuguaggcagacaagaaaaaggaaaaucgcuauuauucaaaacugaagauggaguaaauauguguacacugauggcaauagauuuaggugaacuuugugaagauaccauaacuuacaaauguccacuacuaagacagaaugaaccagaagacauugauugcugguguaauaguacauccacauggguaacauauggaacaugcacaacaacaggugaacaccgacgagaaaaacgaucgguagcauuaguuccacauguuggaaugggguuggaaacacguacagaaacauggaugucaagugaaggugccuggaaacacguccaacgaauagaaacuuggauauuaaggcauccgggauuuacaauaauggccgcaauucuggcauauacaauagggaccacucacuuccaacgugcacucaucuucauccuucuaacugcgguagcaccaucaaugacuaugagaugcauagguauaaguaacagagacuucguagagggcgucuccggagggagcuggguggauauuguauuagaacacgguucuuguguaacaacgauggcgaaaaauaaaccuaccuuagacuucgaguugauuaaaaccgaagcgaaacaaccagcuacauugcguaaauacuguauagaagcuaaacugacgaauaccacgacagaaaguagaugucccacacaaggagagccaucauuaaaugaagaacaagacaaaagguucauaugcaaacauaguaugguagaucgaggcuggggaaauggcugugguuuauuugggaaaggaggaauagugacuugugccauguuuacauguaagaaaaacauggaaggcaaaguaguauugccugaaaaccuagaauauacuauagucauuacaccucauaguggggaagaacacgcaguagggaaugauacagggaaacacggaaaagaaauuaaaaucacgccccaaucaucuauaaccgaagcagaacuaacagguuacggcaccgucaccauggaauguaguccaagaaccggccuagauuuuaaugaaaugguacuacuccaaauggaagacaaagcaugguuaguucacagacaaugguuuuuagaucugccacuccccuggcucccgggggcggacacacaaggaagcaauuggauacaaaaagaaacacuuguaacauucaaaaauccucaugcuaagaaacaggauguaguaguccuugggucccaagaaggggcgaugcauacugcacucacaggagccacugaaauucaaaugaguuccggaaaucugcucuuuacgggacaccuaaaauguagauuaagaauggacaaauuacaauugaaaggaaugucguauucgaugugcacggguaaauuuaaaauagucaaagaaauagcagaaacgcaacacgguacaauugucauuagaguucaauaugagggagacggguccccaugcaaaauuccauucgaaauaauggaucuggagaaaaggcacguacugggaagauuaauaacgguaaacccaaucguaacugagaaagauucucccguaaacauagaagcugagccaccauucggagacucuuacauaaucauagguguugaaccaggucaacuuaaacugaauugguuuaaaaagggaucgaguauuggccaaauguuugaaaccacaaugcgaggagcgaagagaauggcaauacuaggugauaccgcaugggauuuugggucucuuggaggcguguuuacgaguauuggaaaagcauugcaucaggucuuuggagcuauauacggagcagcuuuuagcggaguaaguuggacgaugaagaucuugauuggagugauuauuaccuggaucggcaugaacagucggucgacuucacuaucggugucacucguccuagucggaguuguuacacuuuaucugggaguuauggugcaagcugacacuggaugugugguuagcuggaaaaacaaggaacuaaaaugcgguuccgguauuuuuaucaccgacaaugugcauacauggacagaacaauacaaguuucagccagaaaguccaucaaaauuggcaucugcaauccaaaaggcccaugaggaaggcaucugugggauacgaucugucacaaggcucgaaaaucuuauguggaagcaaauaacuccagaauugaaccacauuuugucugagaaugaagucaaauuaacaauaaugacuggugauauaaagggaaucaugcaagccggcaaacgaucucuucguccucagccgacugagcucaaauauuccuggaaaacuugggguaaagcaaagaugcuaaguacggaaagucacaaucaaacauuccuuauagaugguccagaaaccgccgaaugccccaauacgaaccgagccuggaacucacuagaaguugaggauuacgguuucggaguauucaguacgaauauauggcuaaaacuacgugaaaaacaagauguuuucugcgacucuaaauuaaugagugcagcaaucaaagacaauagagcaguccacgcggacaugggauacuggauagaguccgccuuaaacgacacuuggaaaauggaaaaggcgaguuuuaucgaaauaaaguccugccauuggccuaaaucgcauacucucugguccaauggaguacucgaaagugaaaugaucauccccaaaaauuucgcaggaccgguuucucaacauaacuauagaccgggauaucauacgcaaaccgccgguccauggcauuuagguaaacuggagauggauuuugacuuuugugagggcacaacgguuguagugaccgaagacugcggaaauagagguccuagccugagaacaacaacggccucagguaaacugauaacagagugguguugucguucgugcaccuuacccccauugcguuaucguggagaggacggcuguugguauggcauggagauccgcccccuaaaagaaaaggaagaaaaccuaguuaacaguuuaguaaccgcuggacacggucaaauagacaacuuuagucugggcgugcuugggauggcguuauuucuagaggaaauguugcgaacccgcguuggaacuaaacacgcgauucuacucguugccguuagcuuuguuacauuaauaacgggaaauaugaguuuucgcgaccuaggucgagugaugguaaugguuggggcaacuaugacugaugacauaggcauggggguaacauacuuagcguugcuugcggcuuuuaaaguccgaccaacauucgcugcagguuuacuucuucgaaaacuaacaucuaaagaauuaaugauggcgacaaucggcaucgccuugcuuucucaaucgacaauaccagagacgauccuugaacuaaccgaugcacuugcacuaggaaugaugguucuuaaaaucguaagaaauauggagaaauaucaacuagcaguaacgauuauggcuauuucuugcguuccgaacgccgucauacuucaaaaugcuuggaaaguuagcugcaccauucuugcggcaguguccguaucaccccuccuccuuacuuccagucagcagaaagcagauuggauaccauuagcauuaaccauaaaggguuuaaauccgaccgcgauauuuuugacaacccugagccguacgucuaagaaaaggucuuggccauuaaaugaagccguuauggcaguuggcaugguaucuauacucgcaucuagccuacucaaaaacgacauuccaaugacagguccauugguagccggcggauuauugacuguuuguuacguauuaacaggaagaagugcugaccuugaguuagaacgagcggcugauguuaagugggaagaucaagcugagauaucagguucuucaccgauucuuucuauuaccauaucugaagauggaagcaugucuaucaaaaaugaagaagaagaacauacccucacaauucucauucgcaccggucuauuaguuaucaguggagucuuuccuguaucaauaccgaucacggccgcugcgugguauuuaugggagguuaagaaacaaagggcaggaguguuaugggacgugccauccccacccccaguagguaaggccgaacucgaagauggugccuaucgaaucaaacagagaggcauuuuuggauauagccagauaggagcggggguauauaaagaagguaccuuucauaccauguggcaugugacacgaggagccgugcuaaugcacagagguaaacgaaucgaaccguccugggccgaugucaagaaagaucuaaucucguacgguggcgguuggaaacuagaaggagaauggaaagaaggagaagaaguacaaguucuagcucuagaaccaggaaagaacccgcgagccguucagaccaaacccggacuauucaagaccaauaccgguacgauaggagccguaaguuuagacuucuccccugguaccucugguucuccaaucguagaccgcaagggaaagguaguagguuuauaugguaacggaguugugacgcgcucuggagcguacgucagugcuauagcccagacagaaaaaucgauugaagacaauccugaaauugaagaugauauauuccgcaagaaaaggcuaaccauaauggacuuacacccgggcgcgggaaaaaccaaacgguacuuaccagcaauuguacgugaagcaauuaaacgaggucuacguacgcucauacuugcucccacacggguagucgccgccgaaauggaagaagcucuaagaggccugccuauacgauaccaaacaccagccauaagagccgagcauacaggaagagaaauaguagaucuaaugugccacgcaaccuuuacgaugagauuguuauccccaguuagaguuccaaauuauaacuuaaucaucauggacgaagcucauuucacagacccagcuagcauagcugcacgugguuacaucucaacacgaguagaaaugggugaagcagcaggaauauuuaugacugcuacacccccuggguccagggauccuuuuccacaaucgaacgcaccaauaauggacgaagaacgcgagauccccgaaagaagcuggaacucaggucacgaauggguaacagauuucaaaggcaaaaccguuugguucguaccuucuauuaaggcagguaaugacauugccgcuugcuuaaggaagaaugggaaaaagguaauacaacucagucgcaagaccuuugauuccgaguauguaaaaacuagggccaaugauugggauuuuguaguaaccaccgacaucagugaaaugggugccaauuuuagagcagaacggguaaucgauccucgaagguguaugaaaccgguuauuuugacugauggagaagaacguguuauauuagcggggccuaugccaguuacucauucuuccgcugcgcaacggcgugguagaauagggcggaauccuaagaaugaaaacgaucaauacaucuacaugggggaaccauuagagaaugaugaagauugugcucauuggaaagaagcaaagauguuacuggauaacauaaacaccccugagggaauuauuccaagcauguuugaaccagaacgugaaaaagucgacgcgaucgauggagaauaccgacugaggggugaagcucgcaaaacguuuguagauuuaaugagacguggggaccugccgguauggcuagcguaucgagucgcagcggaaggaauaaacuacgcugaccguaggugguguuuugaugggauaaagaacaaucaaauuuuagaagaaaauguagaaguugaaauuuggacgaaagaaggugagcgaaagaaacuaaagccucgauggcuagacgcuaggauauauucggauccccuagccuuaaaagaguucaaagaauuugcggcggggagaaaaagccugacgcuaaauuugauuacagaaaugggaagauugccaacguucaugacucagaaggcuagagaugcacuugacaaucuggcuguuuuacauacugcugaaguaggaggaagggcauauaaucacgcauugagcgaacuaccagaaacguuagaaacucuuuuauuauugacucugcuugcuaccguaaccggugguauauuuuuauuccuaaugucuggaaagggaauaggaaaaaugacuuuaggcaugugcuguaucauaacagcaucuauccuucuuugguaugcucaaauucaaccacauuggauugcagcaaguauuauacucgaguucuuuuuaauaguauuauuaauaccggaaccggaaaaacaacguacgccacaagauaaucagcuaaccuauguaguuauagcaauccuuacuguugucgcggccacaauggcgaaugaaaugggcuuuuuggagaaaacgaaaaaggaccugggcuugggaagcauaacaacacaagaaagugaaucaaauauacuggauauugaucuaaggccugccucagccuggacgcuauaugccguagcaacaacauuuguaacaccgauguuacgucacaguauagagaauagcucgguaaauguuagcuugacagcuauagcaaaucaagcaacuguacuuaugggauuagggaggggcuggccuuuaucaaaaauggacauuggaguuccacuuuuagcaauagggugcuauagccaagucaacccaauaacacuuacagcugcguuacuguuauuagucgcacauuacgcaauuauaggaccaggcuuacaggccaaagcaacuagggaagcgcaaaaacgaacugcugcagguauaaugaagaacccuacuguagaugggaucacaguaauagaccuagaaccaauacccuacgauccuaaauuugaaaaacaguuaggccaaguuaugcuauuaguguuauguguuacgcaaguacuaaugaugcgcacaaccugggcucuaugugaagcauugacacuagcuacugggccaauuaguacacucugggaggggaacccuggaagguuuuggaauacuacaauagcagucucgauggcaaacauauuccgcggaucauaccuagcuggugcagguuuacuauucucuaucaugaagaacaccaccaacacaagaagaggaacgggaaacauaggggaaacuuuaggagaaaaguggaaaagcagacuuaacgcccucggaaaaagcgaauuucagauuuauaagaagucaggaauccaagagguagaucgaacacuagcgaaagaagggaucaaacguggggaaaccgaccaccaugcuguaagcagaggcucagcgaaauuaagaugguuuguagagagaaauaugguaacuccagagggcaaaguuguagaucuuggaugugguaggggugguuggucuuauuacuguggcgggcucaaaaauguacgugagguaaaagguuuaacaaaaggagggccggggcacgaagaacccaucccuaugagcaccuauggguggaauuuaguucggcugcaaucaggcguugauguauucuuuacgccaccggaaaaaugugauacccucuuaugcgacaucggagaaucuucuccgaacccaacuauagaagcuggaagaacacuucgcguauuaaacuuaguggaaaacuggcugaauaauaauacgcaauuuuguguaaaaguuuuaaacccauauaugccaucaguaauugagaaaauggaaacuuuacaacguaaauaugguggcgcacuuguacgaaauccacuaagucgcaacucaacacacgaaauguauuggguuucgaacgcuacuggaaauauaguaaguaguguaaauaugauaucucgaauguuaauaaacagauucacaaugaaacauaagaaagccacuuaugaaccagauguggauuuggguucuggaacccgaaauauagggauugaaaaugaaauaccuaaucuggauauuaucggaaaaagaauagagaaaauuaaacaagaacacgagaccucuuggcacuaugaccaagaucacccauacaagacgugggcuuaucacgggucuuaugagacgaaacaaacaggaagugccagcucgaugguaaaugguguaguuaaauuacucacuaagcccugggacguagucccgaugguuacacaaauggcgaugaccgauacgaccccguucggccagcaaagaguauuuaaagagaagguugacacuagaacgcaagaacccaaagaaggaacaaagaaacugaugagaaucacggcagaaugguuauggaaagaauugggcaaaaagaaaacaccacggaugugcacaagagaagaauuuacgcggaaaguacgaucaaaugcagcacuaggagcaauauuuaccgaugaaaauaaguggaaaucagccagagaagcgguggaagauucaagauuuugggaguuaguagacagagaacgcaacuuacaccuggaaggaaagugugaaaccugcguuuauaauaugaugggaaaaagagaaaagaaacugggagaauuuggaaaggcaaagggaucacgagcgauuugguacauguggcuaggggcaagguucuuggaguucgaagcauuagguuucuuaaacgaagaucauugguuuaguagaggaaauucucuaucaggcguugaaggcgaaggcuuacauaaacuaggcuauauucuacgcgacgugucuaagaaagaaggcggggcaauguaugcggacgauacugcagggugggauacgcgaauaacucuugaagaucucaaaaaugaagaaaugguaacgaaccacaugaagggagaacauaagaaacuagcugaagcgauauucaaacuaacauaucaaaauaaaguugugagaguccaacgaccgacacccagaggaacaguuauggacauaauuagccgcaaagaucaaaggggaucagggcagguaggcacauaugggcuaaacacguuuacaaacauggaggcucaguugauaaggcaaauggagggcgaaggaauuuucaagucgauacagagauuaaccgucacugaagaaauugcaguccagaacuggcuugccagaguaggaagagaaaggcuaaguaggauggcgauuucaggugaugacugcguuguuaagccguuagacgauagauucgcaagugccuuaacugcacuuaaugacaugggaaaaguaaggaaagauauucaacaaugggaaccaagccgugguuggaaugacuggacgcaaguaccguuuuguucucaucauuuccacgagcuaguuaugaaagacggacgaguuuuagucguuccaugcagaaaucaagacgagcugauaggacgugcaagaauuagucaaggagcaggauggagucuaaaagaaacugccugucuagggaaaucguacgcgcagauguggacucuuauguauuuccaucgacgggacuuaagacuggcagcaaaugcuauuuguucagcagugccuucucauuggguaccaacaucgagaaccaccuggucaauacacgcaaagcacgaauggaugacaacagaagauaugcuugcuguauggaaucgaguuuggauacaagaaaacccauggauggaggauaaaacacccguggaaaguugggaggaaguccccuaccuuggaaaaagagaagaccagugguguggaucucuaauaggcuugacaucacgagcuaccugggcuaagaacauacagacagcaauaaaccaaguacgaucacuaauagggaacgaagaauauaccgauuauaugccgaguaugaaaagguuucgaaaagaagaagaggaagcaggaguauuaugguaa

SEQ ID NO: 22525 - RNA, 9876 nt, Artificial Sequence
  derived and/or modified CDS sequence (opt6) from DENV-2__EU482545__SS-prME
acugcaggaguaauaguaauguuaauuccaacagcgauggcauuucauuuaacuacccgaaacggagaaccucauaugauuguaggucgucaagaaaaaggcaaaucacucuuguuuaaaacagaagauggcgugaauaugugcacccucauggcuauagaucucggcgaauuaugugaagacacuauaacauauaaauguccucuacuccggcagaacgaaccugaagacauagauugcuggugcaauaguacaaguacuuggguaaccuauggaacauguacgacgacuggagaacacagaagagaaaaacguaguguggcgcuaguaccgcauguaggcauggggcucgaaacgcgaacugaaacguggaugucaucagaaggagcuuggaaacacguucagcggauagaaacuuggauacuacggcaccccgguuucacaauuauggccgcaauacuagcauauaccauaggaacgacacacuuucaacgugcccucaucuuuauacuuuugacagcaguagcucccuccaugacaaugcgaugcaucggaauaucuaaucgagauuuuguugaaggaguaucagggggaucuuggguugauauaguauuggaacaugguuccugcgugacaacaauggcgaaaaauaaaccaacauuggauuucgaacuaauuaaaacugaagcaaaacaaccagcgacauugcguaaauauuguauagaggcuaaauuaacuaauacuacaacagaaagucguugcccaacgcaaggugaaccaucuuuaaaugaggaacaagacaaaagguuuauauguaaacauucuaugguggacagaggauggggcaaugguugugguuuauuuggaaaagguggaauuguuacaugcgcgauguucacuugcaagaaaaauauggaaggaaaaauaguacaaccggaaaauuuggaauacaccauaaugauuaccccgcauagcggugaggaacaugcaguaggcaacgacaccgguaaacauggaaaagaaaucaaaauaacaccgcaaucuucuauuacagaagcugaacuuacugguuaugggacaguaacgauggaauguaguccucgaacggguuuggacuucaaugagauggugcuccugcaaauggaagacaaggcuuggcuaguacauagacaaugguuucuugacuuaccucuaccauggcuuccgggugcagauacucagggaaguaauuggauucagaaagaaacacuuguuacauucaaaaacccccaugcuaagaaacaagacguuguuguacuaggaucacaagaaggagcaaugcauacagcucugaccggugcuacggaaauccaaaugaguuccggaaaucuauuguucacuggacaucugaaauguaggcuccgcauggacaaauuacaguuaaaagggaugagcuauagcauguguacaggcaaauuuaaaaucguuaaagaaaucgcagaaacacaacaugguacaauagugauuagaguucaguaugagggcgacggaucaccauguaaaauaccguucgaaaucauggaucuggagaaaaggcauguauugggaagauugaucacuguaaacccuaucgucacggaaaaagauaguccggucaacauagaagcagaaccaccauuuggagacucauacaucauuauuggaguagaacccggacaacuaaaacuaaacugguucaagaaaggaucuucaauaggacagauguuugagacuacuaugagaggagcaaaacguauggcgauacucggagauaccgcaugggacuucggaaguuuagguggugucuucacuucugucgggaaagcacuacaccaaguuuuuggcgcuauuuacggugcugcuuucaguggggugucuuggaccaugaaaauucuaaucggagucauaauaacguggauugguaugaacagucguucaacaagucucagcgugucuuuaguuuugguaggaguaguaacacuauaucuaggagcgaugguucaagcagacucaggaugcguagugucguggaaaaacaaagaacuuaaauguggaucagggauuuuuaucacagacaacguacacaccuggacugagcaauauaaauuucaaccggaaagcccuucgaaacuggcaagcgcaauccaaaaagcacaugaagaaggaauauguggaauacgcucaguaacaagauuagaaaacuuaauguggaaacaaauuacgccggaguuaaaccacauacucagcgaaaacgaagucaaacuaaccauuaugacuggagacauaaaaggaauaaugcaagcagggaaacguagucuuagaccccaacccacugaacucaaauauucauggaaaacuugggguaaagcgaaaauguuaucaacagaaucccauaaucagaccuuucucauagaugggccagaaacagcggaaugcccgaauaccaauagagcuuggaacucucuagaagucgaagauuacggguuuggcgucuuuacgacaaauauaugguuaaaacuucgagaaaaacaggaugucuuuugugauaguaaauuaaugucugcugccauaaaagauaaccgagcgguacacgcugauaugggguauuggauagagagugccuuaaacgauacuuggaaaauggagaaagcauccuucauugaagucaaaucuugucauuggccgaaaucacauacacuauggaguaauggaguauuagagagugaaaugaucauacccaaaaauuuugcuggaccaguuagccaacacaacuaccgaccagguuaucauacgcaaacagcaggcccuuggcauuuaggaaaacuggaaauggauuuugauuuuugugaaggaaccacaguaguaguaaccgaggacuguggaaacagaggacccucguuacgaacaacaacagcaucugguaaacuuauaacugaauggugcugcagauccugcacccuuccuccacugagguauaggggagaagauggaugcugguacggaauggaaauacgaccacuuaaggaaaaagaagagaaccuuguuaauucauugguuacugcuggacauggucagauugauaauuucucauugggagugcuggguauggcacuauucuuagaagaaaugcugaggacaagaguuggaacuaagcacgcgauuuuguuaguugcaguuuccuuuguuacacuaauuacagggaauaugucguuucgggauuuaggccggguaaugguuaugguaggcgcaacaaugacugacgauauaggaaugggaguaacauacuuagcucugcuagcugcauuuaaagucaggccaacguucgcggcaggacugcugcuucgaaaacugaccaguaaagagcuaaugauggcuacuaucgguaucgcccuucuaucacagucgaccauaccagagacaauccucgaacuaacagaugcacuagcgcuagggaugauggcuuuaaaaauugucaaaaacauggaaaaauaucagcuugcaguaacuauaauggccauaucgugcguaccaaaugcaguaauucuucaaaaugcauggaaaguauccuguaccauauuggcagcuguaagcgugagcccucuuuuacugacgagcagccaacaaaaggcugauuggauucccuuagccuuaaccaucaagggacuuaauccuacugcaaucuucuuaacaacuuuaucaagaacuucaaagaagaggaguuggccucuuaacgaagcaauaauggcgguuggaauggugucaauauuagccagcagcuuacugaaaaacgauauccccaugacaggaccucuaguagccgguggucuacuuacgguuugcuaugucuugacaggaagaagugcggacuuagaacuugagagggccgcagaugucaaaugggaagaucaagcugaaauaucaggcuccucuccuauauuaucuauaaccauauccgaagauggcucaaugucaauaagaaaugaggaagaagaacaaacuuuaacaauuuuaauacgaacugggcugcuagugaucucagguguguuuccuguuucaaucccuguaacagcggcggcaugguaccucugggaggugaaaaagcaacgagcgggaguccuuugggauguaccgucgccaccaccugucggaaaggcggaacuagaagauggagcauauaggaucaagcaacgugguauacugggguacagucaaauuggagcggggguuuacaaagaagggacauuccacacaauguggcauguuaccaggggugccguauuaaugcacagagguaaacgaauugaaccuucgugggccgacgucaagaaagauuugguaucguaugggggaggguggaaauuggaaggugaauggaaagaaggcgaagaaguacaagucuuggcucuggagccuggcaaaaauccccgcgcuguacagacaaaaccagguaucuuuaagacgaacacaggaacaaucggugcugugagucuugacuuuuccccaggaacaagugguagucccaucguagacagaaagggaaaagucguaggccuauaugggaauggaguaguaacacguucuggagcuuauguaucagcaauugcucaaacagagaaaaguauagaagacaauccagaaauagaggacgauauauuuagaaagaaaagauuaacaauaauggaccuucaucccggagcugguaaaacaaaaagguaccuuccagcgauagugcgugaagcuauuaaacguggacucagaacauugauacuugcacccacuaggguaguggcugcagaaauggaggaagcacuccgagguuuaccaauacgauaccaaacacccgcaauccgagcugaacacacuggacgagaaauaguagaccuaaugugccaugcaacauuuaccaugcggcuauuaagccccguaaggguucccaauuauaaucugauuauuauggacgaagcgcacuucacugauccugcgucaauagcagcuagaggcuauauauccacucgugucgagaugggagaagcugcaggcauuuucaugaccgcgacaccaccagguaguagggauccguucccacaaucgaaugcgcccauaauggaugaggagcgcgagaucccugaacgaaguuggaauagcggccaugaauggguuacagacuuuaaggggaagacuguaugguuugucccaaguauaaaagccggcaacgacauugcagcuuguuuaaggaaaaauggcaagaaaguaauacaacucucacguaaaacauucgacagugaauauguaaaaacacgugccaaugacugggauuuuguaguaacaacagauauauccgaaaugggagcgaauuuuaaagccgagcgaguaauagauccacguagauguaugaaacccgucaucuugacugauggagaagaacgcgucauacuugcuggaccaaugccugugacacauuccucggccgcacaacgaagagggcggauagggagaaauccgaaaaaugagaacgaucaauacaucuauaugggagagccguuggagaaugaugaagauugcgcgcacuggaaagaagcgaaaaugcucuuagacaacauaaacacuccggaaggaauaauaccaucuauguuugaacccgaacgagaaaagguagacgcaauugauggggaguaucgucuaagaggggaagcucgaaaaaccuuuguagauuuaaugcggagaggagaucucccaguauggcuagcuuacaaaguagcugccgaaggaauaaauuacgcugaucgaaggugguguuucgacggcaucaaaaauaaccagauucuagaggagaauguggaaguggaaauauggacaaaagaaggggaacguaagaaacuuaaaccgagauggcuagaugcgaggauuuauucugacccacucgcucuaaaagaguucaaagaauuugcagcuggaaggaaaucgcuaaccuuaaaucuuauaacugaaaugggaagacugccaacauucaugacacaaaaagcacguaaugcuuuggauaacuuagcggugcugcauacagcagaagcggguggaaaagcguauaaccaugcuuuaucagaauuaccagaaacauuagaaaccuuacugcuguugacuuuauuggcaacaguaacugggggaaucuuucuguucuugaugucugguaaaggcauagggaagaugacccucgguaugugcugcauaauuacugcaaguauucugcuuugguaugcucaaauucaaccccacuggauagcagccaguauuauacuagaguucuuucuaaucguguuguugauaccagaaccagagaagcaacgaacgccucaagacaaucaacuaaccuacguggucauagcgauauuaacaguugucgcggcaacaauggcuaacgaaauggguuuccuagagaaaacgaagaaagauuuaggcuuagggagcaucacaacacaggaaagcgaaucuaauauuuuagauauugacuugagaccagcuucugcguggacacuuuacgcaguugccacaacauuuguaacacccauguugagacauuccaucgaaaauuccucgguaaacguuucucuuacggccauagcaaaccaggcuaccguacucaugggauuaggcaaaggauggccauuaucuaaaauggauauuggcguuccucuacuagccauagguugcuauagccaggucaauccaauuacccuaacagccgcauuauuauuauuaguagcucauuacgcgauuauaggacccggacugcaagcaaaagcaacacgcgaggcucagaaaagagccgcagcaggaauuaugaaaaaucccacaguagauggcauuacugugauagaucuagagccaauuccauacgauccaaaauuugaaaaacaacuaggucaggugaugcuacuuauacuuuguguaacacaaguacuaaugaugagaaccacaugggcacuaugcgaagcccugacuuuagcgacgggaccaauaaguacauuaugggaaggcaacccaggacgauuuuggaauacuacgaucgcagugaguauggcaaauauuuuuaggggaaguuaucuggccggugcgggguuauuauuuaguauaaugaagaauacuacuaacacaagaagaggaacggggaauauuggugagacucuaggggaaaaguggaaaucccgauuaaaugccuugggaaaaagugaauuucagauauauaaaaagucgggcauacaagaaguagaucguacccuugcaaaagaggguauuaaaagaggugagacagaccaccacgcuguuucuagaggcucggccaaauuacgcugguucguagaaaggaacaugguuacacccgaaggcaagguaguagaucuagguuguggccgaggaggauggucuuacuauuguggugguuugaaaaauguaagagaagugaaaggacuuacuaaaggugggccaggccacgaagaaccgauacccaugucgacuuacggguggaauuugguucgacuucaaucagguguagauguguuuuucacgccaccggaaaaaugugauacacuguuaugugauauuggugaaucgaguccgaauccaacaauagaagccggccggacauuaagaguacuaaacuugguagaaaauuggcuaaacaacaacacacaauuuuguauaaaaguacuaaauccauacaugccuucggucaucgagaaaauggagacauugcagaggaaauaugggggcgcuuuaguaagaaauccccugagccgaaacaguacccacgaaauguauugggugaguaacgcaaccggaaauauuguuaguucaguuaacaugauuucgagaaugcuuauuaauagguucacuaugaaacacaagaaagcuacguacgagccagacgucgaccucggauccggaacgagaaauauuggaaucgaaagcgaaaucccaaacuuggauauaauaggaaagcgaaucgagaaaauuaaacaggagcacgaaacuucuuggcauuacgaucaagaucacccuuauaagacgugggcauaccauggaucauacgaaacaaaacaaacuggcagcgccucaaguaugguaaacggcguaguacggcugcuaacaaaaccuugggacgugguaccaaugguaacacaaauggcuaugacagauacaacgccauuuggacaacagagaguauuuaaagagaaaguagauacaaggacucaagaaccaaaagaaggcaccaaaaaguuaaugaaaaucacagcagaguggcuuuggaaagaauuagggaagaagaaaacaccaaggaugugcacucgggaagaauuuacucggaagguaagaaguaaugcugcucuaggagcaauuuucaccgacgaaaauaaauggaaaucugcccgagaggcaguagaggauggccgcuuuugggaguuaguugacagagagcgcaaucuacaucuagaaggaaaaugugaaaccuguguauacaauaugaugggaaagcgggagaagaaacuaggagaguuugguaaagcaaaaggaaguagggcaauuugguacauguggcuaggagcaagauuucuagaguucgaagcacuuggguuccucaaugaagaucauugguuuucgagagggaacucacuuuccgguguagaaggugaaggacugcaucgguuaggauacaucuugcgagacgucaguaagaaagagggaggagcaauguaugcggaugacaccgccggcugggacacgagaauuacauuggaagacuugaagaaugaagaaaugguaacgaaucacaugaagggagaacauaagaaacucgcagaagcuauauucaaauuaacauaccaaaacaaaguuguccguguacaaagaccgacaccgaggggaacagugauggacauuauaagccguagagaccagagggggucaggucagguaggaacguauggucuaaauacauuuacaaauauggaagcacagcucauaaggcagauggaaggugaaggcaucuucaaaucaauacagcacuuaacagucacugaagagauugcgguacaaaauuggcuggccagaguggguagagagcggcuuaguagaauggcgaucucuggcgaugacuguguaguuaaaccuauugaugauagauuugccagugcucugacugcacuaaacgauauggguaaagugagaaaagacauacaacaaugggaaccgucgcgaggauggaaugacuggacacaaguaccguuuuguagccaucacuuucaugaacugguaaugaaagauggaagagucuuaguaguaccuugucggaaucaagacgaacuuaucggacgagcacgcauaucucaaggagcggguuggucguuaaaggaaacagcaugucuaggaaaaucuuacgcccaaauguggacccuuauguauuuucauagacgagauuuacguuuggcagccaaugcgaucugcagugcuguacccucgcacuggguccccacuagcagaacgacuuggucaauucacgcaaaacaugaauggaugacaaccgaagacauguuagcuguauggaauagaguguggauacaggaaaauccauggauggaagauaagacuccaguggaaagcugggaagagguuccauauuugggcaaaagggaagaucaauggugcggaagccuaauuggucucacaagucgugcuacuugggcaaagaauauacagaccgcuauuaaucaaguaagaagucuaauagguaacgaggaguacacugacuacaugccaaguaugaaacgauuuagaagagaagaggaagaagcaggcguguuaugguaa

SEQ ID NO: 22526 - RNA, 9876 nt, Artificial Sequence
  derived and/or modified CDS sequence (opt6) from DENV-2__EU482546__SS-prME
acugcggggguaauagugauguugauacccacuguaauggcguuccaucuaacaacaagaaauggagaaccccauaugauuguuggaagacaagaaaaagguaagagcuugcuauuuaaaacggaagauggaaucaacauguguacguuaauggcaaucgacuuaggcgaacucugugaagacacgauuacuuauaaauguccacuccuaaaacaaaacgaaccagaagauauugacuguuggugcaauucaacuucaaccuggguaacauacggaacaugcaccacgacaggugaacaucgucgagaaaagagaucaguagcucugguaccgcacgugggcauggggcuugaaacgcgaacagaaacuuggaugaguucagaaggagcguggaaacacguccaacggauugaaacauggauccuaagacacccaggguuuacaauaauggcggcaauauuggcuuacacaauagguacaacacauuuucaaagagcgcuaaucuuuauccuuuuaacagcaguagcuccgucgaugacgaugcggugcauugguauaucaaacagggacuucguugaaggagucucuggaggauccuggguugacauuguacucgaacacggcucaugcguaacaacaauggccaaaaauaaaccuacgcucgauuuugaauuaauaaaaaccgaagcaaaacaaccugcaacacucaggaaauacuguauagaagcuaaacugaccaacacaacuacugaaagccguuguccaacccaaggugaaccgucacucaaugaagaacaggauaaacgcuuuaucugcaaacauagcaugguggauagagggugggguaaugguuguggacuauucgggaaaggugguauaguaacuugugcuauguucacgugcaagaaaaauauggaaggaaaagugguucaaccugaaaauuuagaauauacuauuguaauaacuccucauucuggagaagaacaugcagugggaaaugauacuggaaaacacggcaaagaaauaaaaauaacgccacaauccucaauuaccgaagcggaauuaacgggauauggcaccguaaccauggaaugcagcccucggacgggccuugauuuuaaugagaugguauuauugcagauggaggauaaagccugguugguacaucgccaaugguuuuuagaucuaccauuaccaugguuaccuggagcugacacgcaggggaguaauuggauacagaaagagacguuaguaacauucaaaaacccccaugcaaagaaacaagaugugguuguuuuggggucucaagaaggagccaugcauacagcauuaaccggugcaaccgaaauacaaauguccuccgguaaucucuuauuuacuggacaccuuaaauguagguuacguauggauaaauugcaacuaaaaggaauguccuauucaauguguacaggcaaauuuaaaauaguaaaagaaauagcugaaacucaacauggcaccauaguaauuagagugcaauaugaaggagacggcaguccuuguaaaauuccguucgagauuacagaccuagagaaaagacacgugcuaggucgccugauuacagucaaucccauagugacagaaaaagauucaccaguuaauauugaagcggagccgccguuuggcgauagcuacauaauuauuggcguagagccuggucaacuaaaacuaaauugguucaaaaagggaagcuccauaggccaaauguuugagaccacaaugcgaggagcaaaaaggauggcaauacuaggggauacggccugggauuuuggaucacuuggagguguauuuacauccaucggcaaagcacugcaucaaguauucggugcaauuuauggcgcugcguuuucaggaguuaguuggaccaugaaaaucuugauaggaguaaucauaacguggaucggaaugaacucacggaguacaucacuauccguaagucugguuuugguagggguaguuacucuauaucuaggcgccaugguacaagcugauuccgguuguguaguaucauggaaaaauaaagaacuaaaauguggcucaggaauauuuaucaccgauaauguucacacuuggaccgagcaguacaaguuucaaccagagucacccucaaagcuagcuucugccauccagaaagcgcacgaggaaggaauauguggaauacggucaguaacucguuuagaaaauuuaauguggaaacaaauaacgccagaacugaaccauauacucucugaaaaugaggucaaauuaacaauuaugacaggagauauaaaggguauaaugcaagccggaaagagaucucuaaggccucaaccaacagaacugaaauacucauggaaaacauggggaaaggcgaaaauguuaucaacugaaagucacaaucagacauuucucauugacggaccagaaacagcugaguguccaaacaccaacagagcauggaauagucuagaagucgaagauuacggauucggaguauuuacaacaaauaucuggcuaaaguuaagggaaaaacaggaugcauucugcgacucaaaacuuaugagcgcggcuauaaaagacaaccgggcaguacaugccgauaugggguauuggauagagucugcauuaaaugacacauggaaaauggaaaaagcaucuuuuauugaaguaaaaucaugccauuggccgaaaucucacacacucuggaguaaugguguacuagaaagcgagaugauuauaccaaagaauuuugcuggccccguaucgcagcacaaucauagaccaggauaccauacucaaacagccggaccguggcauuuaggaaaacuggaaauggauuuugauuuuugugaagguacgacggugguaguaaccgaagauugcggaaacagaggcccaucacugagaaccaccaccgcaucagguaaguugauuacagaaugguguuguagaagcuguacucuuccacccuugagguaucgaggggaggauggauguugguaugguauggaaaucagaccacuuaaagaaaaagaggaaaaccugguaaauucuuuagucacggccgggcacggccaaaucgacaacuuuaguuuaggcguucuagguauggcauuauuucuggaggaaauguuaaggacaaggguuggaaccaagcaugccauacuauugguagcuguaucuuucgucacccugauuacugguaauaugucauuuagagacuugggccgcgugaugguuaugguuggugcuacaaugacugaugauauugggaugggagucacguaccuggcauuacucgcagcuuucaaggugcguccaacuuucgcagcaggacuauuauugaggaaauugaccagcaaagaacuuaugauggcaacgaucgguauagcauuacuaagccaaaguacuauaccugagacaauauuagaguuaacggaugcacuugcguuagggaugaugguucuaaaaauagugagaaauauggaaaaauaucaguuggcaguaaccauaauggcaauaaguugugugccaaacgcaguuaucuuacaaaaugcuuggaaagucucuugcaccauccuggcagcgguuagugugucaccgcuucuuuugacaagcagucaacaaaaagccgauuggauaccauuagcuuuaacgauaaaaggacuaaauccuacugcgauauuuuuaacuacacuaagcaggacuucuaagaaacguaguuggccauugaaugaagcuauuauggccgucgggaugguuagcauacuugcgucauccuuguugaagaaugacauuccuaugacgggaccgcucgucgcaggcgguuuacuuacugucuguuacguuuugaccggaagaagcgcggaccuugaacuagagcgugcggccgacguuaaaugggaagaccaagccgaaaucucugguucuaguccuauccuguccaucaccauuagugaagacggaaguaugucaauuaaaaaugaggaagaagaacaaacccuaaccauuuuaauacgcacaggucuucuggugauuucugguguauucccagucaguauuccuauaaccgcagcugcaugguaucugugggaagucaagaaacaacgcgcuggcgugcugugggauguaccaucaccaccuccuguuggaaaggccgaauuagaagauggugcguaucguauuaaacaacgaggauuuuuaggauacucacaaauaggagcaggaguuuauaaagaaggcacauuucacaccauguggcauguaacccgaggggcaguacugaugcauagaggaaagaggaucgaaccaucaugggcagaugugaagaaagacuuaauaucuuauggaggaggcuggaaguuggaaggugaguggaaagagggagaggagguacaagugcucgcuuuagaaccggguaaaaaccccagagcuguccagacaaaaccuggaauauuuaagacuaauacgggaacgauaggagcagucagccuugauuucucaccaggaacuucaggcucuccaauaguggaucgaaaaggcaaaguuguuggauuauauggaaacggaguggucacacgaucaggugcuuauguuagcgcaauugcucaaacugaaaaaucaauagaggauaaucccgaaauagaagaugacauauuucggaagaaaagguugacgaucauggauuugcacccuggagcagggaaaacaaaacgauauuuacccgcgauugugagagaagcaauaaaacgagggcuccgaacacuuauauuggcaccaacaaggguaguagccgccgaaauggaggaagcauuaaggggccugccgauacgauaucaaacuccggcaauaagagcagagcauacaggaagagaaaucguagauuuaaugugccaugcaacauuuacuaugcgucuauuauccccggucaggguucccaauuacaauuuaauaauaauggaugaggcucauuucacugacccggcaucaauagcagcaagggguuauauuagcacaagaguagaaaugggcgaagcggcagggauuuucaugacugcaacgccacccggcaguagggauccuuucccucaaaguaaugcgccaauaauggaugaagaacgcgaaauuccagaaagaagcuggaacucaggucacgaauggguaacugacuucaaagguaagacagucugguuugucccguccauaaaagccggaaaugacaucgcagcaugccuaaggaaaaacggcaagaaaguuauacaauuaucccgaaaaacauuugacagugaauauguuaaaacucgagcaaacgauugggauuuuguuguaacaacugacauaucagaaaugggggcaaauuucaaagccgagagaguuaucgauccaaggagguguaugaaaccuguuauauuaacagacggagaagaacgugucauauuggcuggacccaugccugugacacauagcucggcagcucaacggagaggacgcauaggucgcaaccccaaaaacgaaaacgaucaguauauauacaugggggaaccgcuagaaaacgacgaagauugugcacauuggaaagaagcgaaaauguuauuggauaauaucaacacaccagaaggaauuaucccgucuauguucgaaccagaaagagaaaaaguggaugcaauagauggugaguacaggcuacguggagaagcaaggaaaacauucguagaucuuaugcgacgaggagaucuacccguuuggcuagcguacaagguggcugcggaaggaaucaauuacgcggauagaaaauggugcuucgaugguauuaaaaauaaucaaauacuagaagaaaacguagaagucgaaaucuggacuaaagaaggcgaaaggaagaaauuaaaaccuagaugguuggacgcacguaucuacagugacccacuugcauuaaaagaguucaaggaguucgcagcaggacgaaaaucuuugacuuuaaaccucauuacagaaaugggaagacuaccaaccuucaugacccaaaaggcgagaaaugcgcuagacaaccuugcaguuuuacauaccgcggaggcggguggcagagcuuacaaucaugcacucucagaacuuccagagacauuggaaacauuacuccuucucacguuauuagcaacagucacuggaggaaucuuuuuauucuuaaugaguggaaaaggcauaggaaagaugacauuagggauguguuguauaaucacagcgucgaucuuacucugguacgcacaaauacaaccccacuggaucgcagcgucaauaauuuuggaauuuuucuuaauuguguuguuaauaccugaaccugaaaaacagcguacaccgcaagacaaccaguuaacauacguagugauagcuauauuaacgguaguugcagcgacaauggcaaaugaaaugggguuccuugagaaaaccaagaaagacuugggacuggguaguaucacaacucaagaaucagagucgaauauucuagacauugacuugcguccugccagcgcguggaccuuguacgcggucgccacuacguucguuacaccuauguugagacacaguauugagaacaguuccguaaacguaucguuaacagcaaucgcuaaccaagcgacaguacuaauggguuuagggaaaggauggccauuaucaaaaauggauauagggguaccucuuuuagcuaucggcuguuacucccaaguaaaccccauaacauuaaccgcugcgcugcuacuccuaguugcacauuaugcuauaauaggaccagguuuacaagcuaaagcuacuagagaggcacaaaagagggcugcagcaggaauaaugaaaaacccaacaguagacgggauuacugucauagacuuggaaccgauucccuacgaucccaaguuugagaaacaacuuggccaaguaaugcuauuaauuuuauguguaacacaaguauuaaugaugcguacuacaugggcccuuugugaagcacuuacacuagccacagguccgauaucuacccuaugggaaggaaacccaggaagauuuuggaauacgacaauagcuguaucuauggccaacauauuucgcggguccuaccuggccggugccgggcuuuuguucucaauaaugaaaaauacaacgaauacaagacguggcacagguaacauaggugagacuuugggagaaaaguggaaaucuagauuaaacgcccucggcaaauccgaauuucaaauauacaagaaaucagguauucaagaagucgacaggacauuagcuaaagaaggcauaaaacguggcgaaacagaccaccaugcgguauccagaggcagugcuaaacucagaugguucguggaacgaaauauggugacaccugagggaaaagugguagacuuaggcugcggccguggaggauggaguuacuacuguggaggacucaaaaauguucgcgaaguuaaagguuuaacaaaagggggaccgggacaugaagaaccuauucccaugucaacguauggauggaacuuaguacgguuacagagugggguugaugucuuuuucacaccuccagaaaaaugcgauacucuguuaugcgauaucggggaaaguaguccaaauccaacaauugaggcaggaagaacccuuagaguauuaaacuuaguggaaaauuggcuuaacaauaauacucaauucugcauuaaaguguuaaaucccuauaugccgagcgugauagagaagauggaaacguuacaaagaaaauacgguggcgcacuuguaagaaauccccuaucacguaacuccacgcaugaaauguauuggguaagcaacgccacugggaauaucguaagcagugucaauaugauaucaagaaugcuuaucaaccgguucacaaugaagcauaagaaagcaacauacgaaccagacguagauuuggguagcggaacccguaauaucgguauagagagugaaaucccaaaucuugauauuauuggaaaacguauagagaaaauaaaacaagaacaugaaaccucuuggcauuaugaucaagaucauccuuacaagacaugggcauaccauggaucauaugaaacaaaacaaacagggucugcaucgucuaugguuaauggugucguccgacuccucaccaaaccgugggauguaguuccuaugguaacucaaauggccaugacugacacgacuccuuuugggcaacaacggguuuuuaaagagaaaguagauaccagaacacaggaacccaaggaaggcacuaaaaagcucaugaaaauaaccgcggaauggcucuggaaagaauuaggcaagaagaaaacaccaagagucugcacgagggaagaguucacaagaaaaguuagauccaacgccgcacuaggagcaauuuuuaccgaugagaacaaauggaaaucugcaagagaagcaguggaggauggacguuucugggaacuuguagaucgagagagaaauuugcacuuagagggaaaaugugagacauguguauauaacaugaugggaaagcgagagaagaaacuaggugaauuuggaaaagccaaagguagccgagccaucugguacauguggcuuggcgcuagauuccuugaauuugaagcauugggauuccuaaaugaagaucacugguuuuccaggggaaauucauuaucaggaguugaaggcgagggucuucaucguuugggauacauacuaagggauguaggcaagaaagaagggggcgcgauguacgccgacgacacugccgggugggacacacggauaacuuuagaagacuugaagaaugaggaaaugguaacaaaucacaugaaaggggagcacaagaaacuagcagaagcuauauuuaaauugaccuaucaaaauaaaguagugagaguccaaagaccaacaccaagggguaccgugauggacauuauaucaaggcgggaccaaagaggaucuggacaaguggguacauauggccuuaacacuuucacaaacauggaggcacaguuaauucgacaaauggaaggagaaggaaucuuuaaaaguauucagcaccucacugcgacugaagaaaucgccgugcaaaauuggcucgcuagaguaggccgugaacgacucagccguauggccauuucuggagacgauugugugguuaaaccaauagacgaccgauucgcuagugcacugacggcauuaaaugauauggggaaagugcguaaagacauacagcaaugggagccgucaagaggauggaaugacuggacgcaaguaccauuuugcagucaucacuuccaugagcuaguaaugaaagauggacguguccuaguuguaccaugccguaaucaagacgaauuaauaggccgagcgaggauuucgcagggcgccggauggucccucaaagagacugcuugucuuggaaaaaguuaugcccaaauguggacauuaauguauuuccauagaagagaucuaagacuugcugcuaaugccauuuguagcgccgugccaucgcacuggguaccaacuucacgcacaacguggucaauccaugccaaacacgaauggaugacaaccgaggacaugcuagcaguguggaaucgaguuuggauacaagaaaauccuuggauggaagacaaaacaccuguagaaucaugggaagaagucccuuauuuagggaaacgcgaagaccaauggugugguucacuaauuggacuuaccagcagagcaacgugggccaaaaauauacaaacagcaauuagccaggugcgaucacuaaucgguaacgaagaguauacagauuauaugccaucaaugaagagguuuaggagggaagaagaagaggccgguguauuaugguag

SEQ ID NO: 22527 - RNA, 9876 nt, Artificial Sequence
  derived and/or modified CDS sequence (opt6) from DENV-2__EU482550__SS-prME
acugcugggguuauuauaaugcuaauuccgacagcuauggcauuccaucuuacaacucgcaacggagaaccacauaugauuguaggacgacaagaaaaagguaaaucauuauuauuuaaaacugaagacggaguaaacauguguacauuaauggcaauugauuugggagaauuaugcgaagauacaaucacauauaaauguccauugcuaaggcagaaugaaccagaagacauagauugcugguguaauucaacgaguacauggguaacguauggaaccugcacuacaacgggagaacauagaagagaaaaacguagcguugcacuuguaccucacguagguaugggauuagaaacaagaaccgaaacuuggaugagcuccgaaggugcauggaaacacgugcaaaggauugaaacuuggauucuaagacauccaggauuuacaaucauggccgccauuuuagcuuacacaauagggacaacucauuuccaacgugcauugaucuucauccuacuuacugccguagcacccucaaugacaaugcgaugcauaggaauuucuaauagagacuuuguagaaggugucaguggagggagcuggguugauauuguacuagaacacggaucuuguguaacaaccauggccaaaaauaaaccuacgcuugauuuugaauugauuaaaacggaagcuaaacagccagcaacccuacgaaaauacuguauagaagcaaaacuaacaaauaccacaacggaaagcagauguccaacccaaggugaaccuucuuuaaaugaggaacaagauaaacgcuuuauauguaaacauucgaugguugaucgcggauggggaaaugggugcgggcuuuuugguaaaggagguauaguuacaugcgcuauguucacuuguaagaaaaacauggaaggaaaggucguauugcccgagaacuuagaguauaccauaguuauaacaccgcauuccggagaagaacaugcaguuggaaaugauacagguaaacacggaaaggaaauaaagauaaccccacagagcaguaucaccgaagcagaguugacggguuaugggacuguaacuauggaauguucaccaaggacggguuuggauuuuaaugaaaugguacuacuacagauggaggauaaagcauggcuaguucauagacaaugguuuuuagaucuaccacuaccaugguuaccaggggcugacacucaagguaguaacuggauucagaaagaaacccuaguuaccuucaaaaacccacacgccaagaaacaagacgucguaguuuuaggaagucaggagggggcaaugcacacagcauuaacaggagcaaccgagauccaaaugucaagcggaaauuuacuauuuacggggcauuugaaaugucgccuaaggauggacaaacuucaacuaaaggggaugucauauucaaugugcacagggaaauucaaaauaguuaaagaaauugcagaaacucaacacggcaccauugucauaagaguacaauaugaaggagaugguaguccauguaagauucccuuugaaauaauggaccuggaaaaacgcuauguuuugggaagacuaaucaccguuaaucccauaguaacagaaaaagacucgcccguaaacauagaagcugaacccccguucggagauuccuauauuaucauuggcgucgaaccagggcaguuaaaguuaaacugguucaagaaaggaagcuccauagggcagauguuugaaacaacuaugagaggugcaaaacgcauggcgauucugggagauacagcgugggauuuuggcagcuugggagggguauuuacaaguauugggaaggcgcugcaccaaguauucggggccauauauggggcagcuuuuucuggugugaguuggacaaugaagaucuuaaucggcguaauaauaaccuggauuggcaugaacucccgauccacaucauugaguguaagucucguucugguaggaguggucacauuauaccuaggaguaaugguacaagcagacagcggaugugucguaucguggaagaauaaagaauuaaaaugcggauccggaauauucauaacagacaauguccauacuuggacugaacaguacaaauuccagccagagucaccaucaaaauuagcuucggcaauucaaaaagcgcaugaagaagguauuugcggcauucguucuguaacaagacuggaaaaucucauguggaaacaaauuacgccagaauugaaucacauauuaucggaaaacgaaguuaaguuaacuauaaugacaggagauauaaaaggaauaaugcaagcagggaaaagaucucugcguccacagcccaccgaacuaaaguauaguuggaaaaccugggguaaagcaaagaugcucagcacagaaagccacaaucaaacguuuuugauagaugggcccgaaacugcggaaugcccuaauaccaauagagcuuggaacucauuagaagucgaggacuaugguuucggaguauuuucaacaaauauauggcucaaacuaagagaaaaacaagauguauuuugugacaguaagcuaaugucugcggcuaucaaagacaaucgagcgguacaugccgacaugggauauuggauugaaagugcacugaaugacacuuggaaaauggagaaagcuaguuuuauagaagucaaaucaugccacuggccgaaaagucauacauuguggagcaauggaguacuagaaagcgaaaugauuauccccaaaaauuuugcaggcccagugucgcagcauaacuauagaccaggcuaucauacgcaaacagccggucccuggcaucuaggcaaguuggaaauggacuuugauuuuugcgagggaacgaccgucguaguuacagaggacuguggcaaccgagggccgagucucaggacaacaaccgcgucugggaaauuaauuacagaauggugcugcagaucuugcacccugcccccacuacguuauaggggugaggauggaugcugguacggaauggaaauuagaccgcuaaaagagaaagaggaaaaucuaguaaacucauuaguuacagcuggucauggucaaauugacaauuuuaguuuaggcgucuugggcauggcuuuauucuuagaggaaaugcuacguacucguguaggaacuaaacacgcgauucuauuaguagcugucagcuuugugacuuugauaacaggaaacaugaguuucagggacuuagggagaguuaugguaaugguaggugccacaaugacugacgacaucgguaugggcgucaccuaccuggcacuacuggcggcguuuaaaguacgcccuaccuucgccgccggccuccucuuaagaaagcuaacaaguaaagaacuaaugauggcaacuaucgguauugccuuauuaucccaauccaccauaccagaaaccauucucgaauuaacagaugcacuggcauuaggcaugauggucuuaaaaauuguucgaaacauggaaaaauaccaauuagcugucacuauaauggcuauacugugcguaccuaaugcaguuauuuuacagaaugcauggaaagucuccugcaccauacuagcagcagucuccguuucaccucuacuucuaacgucuucgcaacaaaaggcagauuggauacccuuagcgcugacaaucaaaggcuuaaacccaacggcgauuuuucugacaacguuaaguagaacaucgaaaaagcguaguuggccccuaaacgaagcuguaauggcagucgguaugguaaguauacuggcgucuucauugcucaagaaugacauuccaaugaccggaccucuuguagcuggaggacuacucaccgucuguuaugugcugacuggacgauccgcugauuuagaauuggaaagggccgccgaugugaaaugggaggaucaagcagaaauaucagguucaucaccgauuuuaucaauaacaauaucggaagaugggagcaugaguauaaagaacgaagaagaggagcaaacauugacuauucucauaagaacaggauuauuggucauuucgggcgucuuuccuguaucuauuccaauaacugcagcagcuugguacuuaugggaggucaagaaacaaagggcuggcguacugugggacgugcccagcccuccaccugugggaaaagccgaacuugaggauggagcguauaggaucaagcaaagaggaauauuugguuacucacagauaggagccggcguuuacaaagagggaacguuucauacaauguggcaugucacaagaggagccguuuuaaugcauagggguaaaagaauugaacccucaugggcagaugucaaaaaggauuugauaucauacggaggcggauggaaguuagaaggugaauggaaggagggagaagaaguacaagugcucgcuuuagaaccgggcaaaaauccaagagcuguucagaccaaaccaggacuauuuaaaacuaauacagggacuauaggcgcagugagcuuagauuucucuccggggacuucugguucaccuauaguagacaggaaaggaaaaguaguuggguuauaugggaauggagucgugaccagaucuggcgccuacguaucagcuaucgcccaaaccgagaaaaguauagaagauaauccugaaauugaagaugauauuuuuaggaaaaagcgauuaacgauuauggaccugcauccaggcgcuggaaaaacgaagcguuaucucccagcaauuguaagagaggccauuaaaagaggacucagaacauuaaucuuagcgccgacgagaguaguagccgcugaaauggaggaagcauuacggggacuucccauuagauaccagacucccgccaucagagcggaacauacggggagggagauaguagaucugaugugucaugcaacauuuacaaugagauugcuaaguccaguuagagucccgaauuacaaucuaauuauaauggacgaagcacauuuuacagacccggcgucaauagcagcacguggauauaucagcacacguguggaaaugggugaggcggcgggaauauucaugacagcaacuccaccuggaucuagggauccguucccucaaucaaacgcacccaucauggacgaagaacgugaaauuccagaacgaaguuggaacaguggacaugaguggguuacggauuuuaaaggcaaaaccguaugguucgucccuucaauaaaagcuggaaacgauauagcggcgugucugcguaaaaacggcaagaaaguaauacaacugucgagaaaaacauuugauuccgaauacguuaaaacuagggcgaaugauugggauuuuguaguaacgacggacauaucugaaaugggugcaaacuucagagcagaacgaguaauagauccaagaagaugcaugaaaccaguaauucuuacagauggugaagaaagagucauacuagcaggucccaugccggugacacauagcagugcggcacaaagacgagguaggauaggaagaaauccaaagaacgaaaaugaucaguacauauauaugggagaaccauuagaaaaugaugaagacugugcgcacuggaaagaagcaaaaaugcuacuugauaacauaaacacuccugaagguauaaucccuucaauguuugagccggaaagagaaaagguagaugcaauagauggagaauaucgacuaagaggggaagcacgcaaaacauuugucgauuuaaugagaagaggggaccucccgguguggcuagcauauaggguggccgcagaaggcauuaauuacgcagauagaagguggugcuucgauggaaucaaaaauaaucagauccuugaagagaauguugaaguagaaauauggacgaaagagggagaacguaagaaauuaaaacccagaugguuggacgcacgaaucuauucugauccauuggcuuuaaaggaguucaaagaauuugcugcuggucgaaagagccuuacccuaaacuugaucacggaaaugggccgacuuccuacauuuaugacccaaaaagcaagggacgcacucgacaauuuagcaguacuccauacggcagagguaggagggagagccuauaaucaugccuuaucagaacuccccgagacgcuagagacuuuguuauugcuaacccuauuggcuacagugacaggcggcauauuucuuuuccuaaugagugguaaggguaucggaaaaaugacacuagggaugugcuguaucaucacagcuagcauccuauuaugguaugcacaaauacagccccauuggauugccgcaucuauaauucuggaguucuuucucauuguacuucucauaccggaaccugagaaacaacguacaccccaggauaaucaacuaacauauguugugauugcuauucuuacaguaguggcugcaacaauggcaaaugaaaugggauucuuggagaaaacuaagaaagauuugggauugggaucuauuauaacacaggaaucagaaagcaacauuuuagauauagauuuaaggccggcuucugcuuggacacuauaugcaguugcaacgaccuuuguaacgcccaugcugcgacauaguaucgaaaauaguagcguaaacguaagccuaaccgcgauagcaaaucaagcaacuguccuaaugggauugggaagaggcuggccacuaucuaaaauggacauuggaguaccacuacuugcuauuggauguuauagccagguaaauccaauuacauuaacagcagcccuacuucuucuugucgcccauuaugcuauaauaggaccugguuugcaagcuaaggcaacaagagaagcucagaagcgagccgccgcaggaauaaugaaaaacccuacaguugacgguauaacagucaucgacuuagaacccauaccuuaugauccaaaguuugagaaacaguugggacaagucaugcuguuaguccuuugcgugacucagguacuuaugaugcggacaacaugggcacuaugugaagcacuuacacucgcgacuggacccauuucaaccuuaugggagggcaauccagggagguucuggaauacaaccauugccguaucaauggcgaauaucuuuagaggaucguacuuagcuggcgcugggcugcucuuuuccauuaugaagaauacgacuaauacacgcagggggacagggaacaucggugaaacacuaggcgaaaaauggaagucaagguuaaaugcucuagguaaaagugaauuucaaauuuacaaaaagucaggaauacaagagguugaucgcacccuagcaaaagaagguauuaaaaggggugaaacagaccaccacgcggugagccgugggagugcaaaauuaagaugguucguggaacguaauaugguaacuccagaaggaaaaguugucgauuuaggguguggcagaggaggauggagcuauuacugugggggcuugaagaacguaagggaagugaaagguuuaacuaaagggggaccagggcaugaggagcccauaccgaugaguacauaugguuggaacuuagugcgauuacaaucaggcguugacguuuucuuuacgcccccagagaaaugugacacucugcuaugcgacauaggggaaucuagcccaaacccuacaauagaagcagggaggacauugaggguccuuaacuuaguugaaaauuggcuaaauaauaacacccaauucuguauuaaaguacuuaauccauauaugcccagugucauagagaaaauggaaacacugcagcggaaguacggaggagccuuaguacgcaauccuuuaucacguaacucaacacacgaaauguacugggucaguaacgcaaccgguaauauaguuagcuccguuaauaugauuucucggaugcuuauaaaccgauuuacaaugaagcauaagaaggcaacuuaugagccagaugucgauuuaggaucugggacgagaaauauaggcauugagaacgaaauuccaaauuuggauauuauaggcaaaaggaucgagaaaauaaagcaagaacacgaaaccagcuggcacuacgaccaagaccauccguauaaaacaugggcauaucaugggucauacgaaacuaaacagacggggagugcaucguccaugguaaacggaguuguuaaguuacucaccaaacccugggacgucguucccauggugacgcagauggcgaugacagacacaacacccuuuggacaacaaagaguauuuaaagaaaaagucgauacaaggacucaagaacccaaagaagguacuaaaaagcugaugcguauaacagcugaauggcuuuggaaagaguuaggcaagaagaaaacaccucguauguguacacgagaagaguucacaaggaaaguacggagcaacgcagccuuaggagcaauuuuuaccgaugaaaacaaauggaaauccgccagggaagcgguagaagauaguagguuuugggagcuaguugauagagaaagaaaucuccauuuagaaggaaaaugcgagacuugcguauacaacaugauggggaaacgugagaaaaaguuaggagaguucggaaaagcaaaggggucgagggccauaugguacaugugguuaggugcacgauuucuugaauuugaagcacugggauuccuaaacgaagaccauugguuuaguagagguaacagucuaucgggaguugaaggcgaaggauugcauaaguuagguuacauauuaagggauguaucaaagaaagaagguggagccauguaugcagaugacacagcagggugggauacgagaauuacuuuagaggaccucaaaaacgaagaaauggucacaaaccacaugaaaggagaacauaagaaacucgcugaagcgauuuuuaaguuaacauaucaaaauaagguaguaagaguccaaagaccaacaccacggggcacuguuauggauauaaucucuagaaaagaucaaagagguagcggacaagucgguaccuauggucuaaacaccuuuacaaauauggaggcccagcuuauaaggcagauggaaggagaaggaauauucaagagcauucaacaucugacggugacagaagaaauagcaguucagaauuggcuugcacgaguuggaagggaacgacuuucucgaauggcaauaagcggagaugauuguguuguaaaaccguuggaugauagauuugcaucagcauuaaccgcuuugaaugauaugggcaaaguuagaaaagauauccaacaaugggaaccaucuagaggguggaacgacuggacacaaguaccauuuuguucucaucauuuucaugaguugguaaugaaagacggucgcguacucguuguuccuugcaggagucaagaugaauuaauuggucgagcaagaauaucgcaaggcgcuggcuggucccucaaggaaaccgcaugucucggaaaaagcuaugcacagauguggacccuaauguauuuucacagacgugaucugagacuugcggcuaacgccauuugcucggccgucccaagucauugggugccaacaagucgaacaacguggucuauacacgcaaaacacgaauggaugacaaccgaagacauguuagcuguguggaaucggguguggauacaagaaaauccauggauggaagauaaaacacugguugaaaguugggaagaaguaccauaucucggaaagagggaggaccaaugguguggcagcuugaucggccuaacaaguagagcaacuugggcaaagaacauucaaacugcaaucaaccaaguaagaagucuaauuggaaaugaagaauacacagauuauaugcccaguaugaaacgauuucgaaaagaagaagaggaagccggaguacuaugguag

SEQ ID NO: 22528 - RNA, 9876 nt, Artificial Sequence
  derived and/or modified CDS sequence (opt6) from DENV-2__EU482551__SS-prME
acagcuggugucaucaucaugcuaauuccuacugcaauggcuuuccaucuuacuacaagaaauggagaaccgcauaugauaguuggaagacaggaaaaaggaaaaucuuuacuuuuuaaaacagaagauggaguuaacauguguacacuaauggcaauugaucuuggcgaguuaugcgaggauaccauuacauacaaauguccuuuacuaagacaaaacgagccugaggacauagauuguuggugcaacucaaccucaacauggguaacauaugggacauguacaacaaccggugaacauagacgagaaaaacgaucaguagcauuaguaccccacguugggaugggacuugagacaaggaccgagacauggaugucgagcgagggagcuuggaaacacguucaaagaauagaaaccuggauucucagacaccccgguuucacuacuauggcggcgauucuggcauauaccaucgguacaacucauuuucaacgaguacuaauauucauacuucuaacugcuguagcucccucaaugacuaugagaugcauaggaauuaguaauagggauuucguugaagguguguccggagggucauggguugauauaguauuagaacacggaagcugugucacaacgauggccaaaaauaaaccgacacuagacuucgagcuaauuaaaacagaagcaaaacaaccagcuaccuuacgaaaauacugcauagaagcaaaacuaacaaacaccacuaccgaaucacguugucccacucaaggugagccaucauuaaacgaagaacaagauaaaagauuuauaugcaaacacuccauggucgacaggggauggggaaauggaugugggcuguuuggaaaaggagguauugucacaugugcaauguuuacaugcaagaaaaauauggaagggaaagucguccuaccagaaaaucucgaauauaccauuguuauuacuccacacucuggggaagaacaugcaguuggaaaugauacgggaaaacauggaaaagaaauuaaaauaacuccccaaucuaguauuacugaggcagagcucacaggguacggaaccguaacaauggaguguaguccuaggacagggcuagacuucaacgaaaugguccuguugcaaauggaggauaaagcaugguuaguucaccgucagugguuucuagaucugccguuacccuggcuaccgggggccgauacucaaggaucuaauuggauacagaaagaaaccuuaguuacuuuuaaaaauccacaugcuaagaaacaagauguaguaguacuuggaagccaagaaggagccaugcacacugcacuaacuggugcaacggaaauucagauguccaguggaaaccuauuauucaccgggcaucuuaaaugucgucucaggauggauaaauuacaacucaaaggaaugaguuacucuaugugcaccgguaaauucaaaauagucaaagagauagccgaaacccagcacggaacaauuguuauucgcgugcaauacgagggcgauggguccccguguaaaauaccauuugaaaucauggaucuagaaaaacgccacguauugggaagauugauaacugugaauccaauugugacagaaaaagauucaccagugaauauagaggccgagccgccauuuggggauaguuauauuauuauuggggucgaaccaggacaacuaaaauuaaacugguuuaagaaagggucaucaauagggcaaauguuugaaacuaccaugcgaggcgcuaaaagaauggcgauccuaggcgauacugccugggauuuugggucacuagggggagucuucacuucgauaggaaaagccuuacaccaaguauuuggugcaaucuacggcgcugcauucucaggagucaguuggacuaugaaaauuuuaauaggagucauaauaaccuggaucgggaugaauagcagaucaaccucucuuucuguaucauuaguccuaguagggaucguaacuuuauaccuaggcguuauggugcaagcugacacaggcugugugguuucuuggaaaaacaaagaacuuaaauguggcucaggcaucuucauuacggauaauguccauacauggacagaacaguauaaauuucaaccagagagcccuucaaaacuggcuagugcaauucaaaaagcacaugaggagggcauaugcgggauucguucuguuacuagacuugaaaauuugauguggaaacaaaucacaccagaauuaaaucauauuuugucugaaaacgaagugaaacugacaaucaugacuggcgacaucaaaggaauuaugcaagcaggcaagagaagccugcguccucaacccacugagcuuaaauacaguuggaaaacuugggggaaagcaaagaugcuaucaacugaaucgcacaaucagacauuccuaauagacggaccagagacugcggaaugcccgaacacuaaucgggcguggaacucgcuugaaguggaagacuauggauuuggaguguuuaguaccaauauaugguuaaaacugagagaaaaacaagauguauuuugcgacucgaaacuaaugagcgcugcuaucaaagauaaucgagcagugcacgcggauaugggcuauuggauugaaucggcccucaaugauaccuggaaaauggaaaaagcaucauucauagaaauaaagucaugucauuggcccaagucccauacgcuuugguccaaugguguacuagaaucagaaaugauaaucccuaaaaauuuugccggaccugugucgcagcauaauuaucgucccggauaccacacccaaacagcgggaccuuggcacuuaggaaaguuggaaauggacuuugacuucugugaaggaacgacagucguaguaacggaagauugugguaauagaggaccgagcuuaaggacuacgacagcuagcggaaaauuaauaacugaaugguguugccgaucuuguacgcuuccuccgcuaagauauagaggcgaggauggcuguugguauggaauggaaaucagaccucuuaaagaaaaagaggaaaacuuaguaaauucuuuagucacagcaggccauggacagauugauaauuuuaguuuagguguucuaggaauggcgcuauuccuagaagaaauguuacggacucggguagggacaaaacacgcaauacugcuaguugcgguaaguuucguaacacucauuacaggaaacaugaguuucagagauuuggggagaguaaugguaaugguaggugcaaccaugaccgaugacauaggcaugggagugacauauuuggccuuguuggcagcauucaagguaagacccacguucgccgcuggacuauuacuaagaaagcuaacaucuaaggagcucaugauggcaacgauugggauugcacuacuaucacaaucaacuaucccagaaacgauacuugaacuaacagaugcacuugcacuuggaaugaugguauuaaaaauaguacgaaacauggaaaaauaucaauuagccgugacgauuauggcgauaucaugugucccgaacgcaguaauacuucaaaacgcuuggaaaguaucauguacaauacucgcagccguuucugugucaccucugcuacuaacgagcucacaacaaaaagcggauuggauaccuuuggcacuaaccaucaagggccucaauccgacugcaauauuccucacgacauuaucucgcacaagcaaaaagaggucguggccacuuaacgaagcaguaauggcaguaggcauggugucgauauuagcaucuagucuucuaaagaacgauauaccuaugacaggcccacuugucgcgggagggcugcuaacuguauguuaugugcuaacugguagaucagcugaccucgaauuagagaaagcagccgauguuaaaugggaagaucaagcugagauuaguggaaguaguccuauauuaucgauuacgauaucagaagacgguucaaugucaauuaaaaacgaagaagaagaacacacguugacaauacuuaucagaacaggauugcuagugauaagugggguauuuccggugagcauuccaaucacagcggcagcaugguaucuaugggaagucaagaaacagagagcgggcgucuugugggauguacccucuccgccaccuguaggaaaggccgagcucgaagauggagcguacagaauaaagcaacgcggcauauucgguuacucgcaaauaggugcuggaguauauaaggagggaacuuuucauacaauguggcacguaaccaggggagcaguauuaaugcacagaggaaaaagaauugaaccgucaugggcggacguaaagaaagauuugauuucauacggaggagguuggaaguuagagggggaauggaaagaaggcgaagaaguacagguauuagcauuagaaccaggcaaaaauccucgggcaguacaaacgaagccagguuuauuuaagacgaauacuggaacuaucggagcgguuucacuugauuucuccccagguacaagugguucaccuauuguggaccgcaaaggaaaaguugucggguuauauggaaacggcguggucacacgaagcggagcauaugucucagccauagcucagacagaaaaaucaauagaagacaauccagaaauagaagaugauauauucaggaagaagagacuaacaauuauggaccuccaccccggagcggguaagacgaaaagauaucuuccagcgauagucagagaagcaauuaaaaggggcuugagaacucuaauacuggcaccuaccagagucguugcggcagaaauggaagaagcacuuagaggauugcccauuagauaccaaacuccugcuauaagagcugagcacacuggaagagagauaguggacuuaaugugccacgcuacguuuacgaugagacucuuaucuccuguacgagucccaaauuacaaccucauaauaauggacgaagcacauuucacagauccggcaaguauagcugcccggggauauaucuccacccguguagagaugggagaagccgcaggcauauucaugacagcuacaccacccgguucaagagaccccuuuccgcagucaaacgcacccaucauggacgaagaaagagaaauaccugaacgcaguuggaacagugggcacgaaugggugaccgacuucaagggaaaaacagugugguucguuccaagcauaaaagcuggaaaugacaucgcagcauguuuacguaagaaugguaagaaaguaauccaauuaagccgcaaaaccuuugauagcgaauacguaaagacccgagcuaaugauugggacuuugucguaacaacagacauuagugaaaugggagcaaauuuccgagcagaaaggguaauugauccgcgacgauguaugaaaccggugauacuaacagauggagaagaacgcguaauccuagccggacccaugcccguaacacauucaucagcagcucaaagacggggucggauagggcguaaucccaaaaaugaaaaugaccaauauauauacaugggagaaccacuugaaaaugaugaggauugugcacacuggaaagaagcgaagaugcuacuagauaauauuaacaccccagaagguauaauacccagcauguuugaaccugaaagggagaaagucgacgcaaucgauggagaauauagacucagaggagaagcucgcaaaacauuuguagaucuaaugcgucgaggugacuuacccgucugguuagcuuaccgaguagcugcugaagguauaaacuaugccgaccgacguugguguuuugaugggauuaaaaauaaucaaauacuagaggaaaacguugagguagagauauggacaaaagaaggcgaaaggaagaaacugaaaccuagguggcucgaugcgcggaucuauucugacccccuggccuuaaaagaauuuaaggaguucgcugcugggagaaaaaguuugacuuuaaauuuaauuaccgaaauggggagauugccaacauuuaugacgcaaaaagcgcgagacgccuuagacaacuuagcagugcuacauacugcggaaguugguggacgugcauauaaccacgcacuguccgagcuaccugaaacacuagaaacguuacuucuguuaacccuccuugcuaccguuaccggcggaauauuucuauuuuuaaugaguggcaagggcauaggaaaaaugacuuuagggaugugcugcauuauaacggcuagcauacugcuaugguaugcccaaauucaaccccauuggauagcagccucaauaauauuagaguucuucuuaaucguacuucuuauuccugaaccggagaaacaacggaccccacaagacaaccaacugaccuacguggugauugccauacucacgguuguagcggcuacaauggcuaacgaaaugggauuuuuggagaaaacuaagaaagauuuaggauuaggaucuauuacgacacaggaaucugaaucuaauauucuagacauagaccuacgucccgccucugccuggacuuuauaugcagucgcaaccacuuuuguuaccccaauguugaggcauuccaucgaaaacucuucgguaaaugugucuuuaacugccaucgcuaaccaggcaacuguauugaugggucuugggcgaggcuggccucugagcaaaauggacauaggaguaccuuuacuugcuaucggauguuauucgcaaguuaauccaaucacuuuaaccgccgcacuucuauugcucguagcccauuaugcaauaauaggaccaggcuuacaagcaaaagcaacgagagaagcacagaaaagaacagcggcaggaauaaugaaaaacccuacaguagaugguaucacugugauugaucuugaaccgauaccuuacgauccuaaauuugaaaaacaauugggucaaguaaugcuacugguuuuaugcguaacgcaaguauugaugaugagaacaacgugggcucuuugugaagcauuaacguuagcuacaggaccaauuucaacucuuugggaaggcaaucccggaagauuuuggaauacgacaauagcuguaucgauggcaaacaucuuucgugguucuuaucuagcgggugccggacucuuauuuagcauuaugaaaaauacaacaaauacaagacgagguacagguaauaucggagaaacauuaggagaaaaguggaaaucccgccugaaugcgcuaggaaaaagcgaguuccaaauuuacaagaaauccggcauacaagaaguagacaggacccuggcaaaagaaggaauaaaacgaggagaaacugaucaccaugcgguaaguagagggucugccaaacuaagaugguuuguggaacgaaauaugguaacacccgagggaaaaguagucgaucuuggaugcggucgaggaggcugguccuacuacuguggcggucuuaaaaauguaagagagguuaagggucuaacaaaaggugguccaggucaugaagaaccgauaccaaugagcacguauggcuggaaccuuguccgccuccaaagugggguagauguuuucuucacuccgccagagaagugugauacauugcuuugcgauauaggugaaucuagcccuaauccuacaauagaagcaggcagaacguuaagagucuuaaauuuaguagaaaacuggcuaaauaacaauacacaauuuuguguuaaaguauuaaauccuuacaugccaagugucaucgagaaaauggagacuuugcaaagaaaauacggaggugcauuaguucgaaacccauuaucaagaaacucuacacaugaaauguauuggguaucaaaugcuacuggaaacaucguaucaucgguaaauaugaucucacguaugcuaaucaaucgauuuacaaugaaacauaagaaagccacguaugaaccggauguagaccuggggagugguacaagaaacauuggcaucgaaaacgaaauaccuaauuuagacauaaucgguaaacguauagagaaaauuaaacaagaacaugaaacgucauggcauuaugaucaagaccacccuuauaaaaccugggcauaccauggcaguuaugaaacaaaacaaaccggaucugcaaguaguaugguaaauggggucguaaaacucuuaaccaaaccuugggacguuguuccuaugguaacgcagauggcaaugacagauacaacgccauuugggcaacaacgaguauuuaaagaaaaaguagacacacgcacacaagaaccuaaagaagguacuaagaaacuuaugaggauuacggcugaauggcuuuggaaagaauuaggcaaaaagaaaaccccuagaauguguacacgcgaagaguuuacacggaaaguuaggaguaaugcagcacucggcgcaaucuuuacugacgaaaauaaauggaaaagcgcuagagaagcuguggaagacucacgguuuugggagcuaguugauagggagcggaaucuccauuuggagggaaaaugugaaacuuguguguauaauaugaugggaaagagagagaaaaaguuaggcgaguucggaaaagcuaaaggaucgcgugccaucugguauaugugguuaggugcuagauuucuagaguuugaagcucuaggguuuuuaaaugaagaucacugguuuagucgugguaacucacucagugggguagaaggggaggggcuucauaaacuggguuacauucugcgugacguaaguaagaaagagggaggagcgauguaugcggaugauacugcuggaugggacacacgaauaacgcuggaggaucucaaaaaugaggaaaugguaacgaaccacaugaaaggugaacauaagaaacuagcagaagcaaucuuuaaacuaacuuaucaaaacaaaguagugcgaguucagaggccuacgccuagagguacuguaauggacauaaucuccagaaaggaccaaagagguucuggccaaguaggaaccuacgguuugaauacauuuacaaauauggaagcacaauuaauucgucaaauggaaggcgaaggaauuuucaaguccauacaacgccuuaccguaacagaagaaauagcaguacagaauugguuggcacgaguuggccgagaaagacugucacguauggcgauaaguggggaugauugcgugguaaaaccauuagaugaucgauuugcaucagcucuuaccgcucuaaaugauaugggcaaagugcguaaagauauacaacaaugggaaccaucacgaggauggaaugacuggacucaaguaccuuuuuguucacaccacuuccaugaacuugucaugaaagacggcagaaugcuuguaguuccuugcagaaaucaagaugaguugauagguagagcacgcauuagccaaggcgcaggguggucacucaaagagacugcaugccucggaaagucauaugcacaaauguggacacuaauguacuuucaucgaagggauuuaagacuagcagccaaugccauauguucugcuguaccgagccacugggugccaacuucaagaacuacauggagcauacaugcaaagcaugaguggaugacgaccgaagacaugcuugcuguauggaauagagucuggauacaagagaacccauggauggaagauaaaaccccaguagaaagcugggaagaagucccauacuugggaaagagagaagaucaguggugcgguaguuuaaucggauuaacaucacgagcuacgugggccaaaaacauacagacagcgauaaaccagguacgcaguuuaaucggcaacgaagaauauaccgacuacaugccauccaugaagcguuuccgaaaagaagaagaagaagcaggaguuuuaugguaa

SEQ ID NO: 22529 - RNA, 9876 nt, Artificial Sequence
  derived and/or modified CDS sequence (opt6) from DENV-2__EU482552__SS-prME
acagcagggguaaucauaauguugauaccuaccgcaauggcauuccauuuaacgacgaggaauggggagccacauaugauugucggcagacaagaaaaagguaaaucauuacuauucaaaacugaagacggcgucaacaugugcacacuuauggcgauugacuuaggagaacuaugugaagauacaauuacuuacaagugcccguuacuaagacaaaaugaaccagaggauauagacuguugguguaauuccacaucaacuugggugacuuaugguaccuguacaacaacgggcgaacacagacgagaaaaaagaagcguggcccucguaccacacgucggaaugggcuuggaaacuagaaccgaaacuuggaugucgucagaaggugcauggaaacauguacaaagaauagaaaccuggauacuacggcauccaggauuuaccauaauggcagcaauucuagcguauacaauugggacaacgcacuuucaaagggcacuaauauuuauucuauuaacggccguagcaccuaguaugacuaugagguguauagguauaucaaaucgcgacuuuguggagggcgugagcggggguucguggguagauauaguauuagaacauggaucaugugucaccacaauggccaaaaauaaaccgacgcuugauuucgagcuuauaaaaacagaagcuaagcaaccagcgacucuacgaaaauauuguauagaagcgaaacuaacuaauacuacuacggagagccguugcccaacacaaggugaaccuagccuaaaugaagaacaagauaaaagauuuaucuguaaacacucgaugguagauagaggauggggcaacggaugcggcuuauuuggaaaaggagggauaguaacuugcgcuauguucacuugcaagaaaaauauggaaggcaaagucgugcucccagaaaauuuagaauacacuauaguaauuacgccgcauuccggggaagaacaugcagucgguaaugauaccggaaagcaugggaaagaaauaaaaauuaccccccagucaucgauuacugaagcggaauuaacaggcuacgguaccguaacaauggagugcucaccaagaacuggauuagacuuuaaugaaauggugcuauuacaaauggaggauaaagcguggcugguacauagacaaugguuccuugacuuaccucuaccuugguuacccggggccgauacacaaggcucgaacuggauucaaaaagaaacccuagucacuuuuaaaaauccccacgccaaaaaacaggauguaguaguacugggaucucaagaaggugcgaugcacacggcucuuacaggugcaacagaaauacaaaugucgagcggaaaucuacuuuuuacaggacacuuaaaauguagacuccgcauggacaaacuacaacuaaagggaaugaguuauaguaugugcacgggaaaguucaaaauaguaaaagagaucgcugagacacaacacggaacuauugucauuagagugcaauaugaaggagacgguagcccauguaaaauaccauucgaaauaauggacuuagaaaaaagacauguuuugggaagguuaauuacugucaauccaauuguuacugaaaaagauaguccaguuaauauagaagccgaaccaccauucggagauucauacauaauuauagguguugaaccugggcaguuaaaacucaauugguuuaagaaggguucaagcauaggucaaauguuugaaacuacgaugagaggagccaaaaggauggccauucugggggauacagcuugggauuucggcucacugggagguguuuucacgucuacaggcaaagcgcuacaucaagucuucggcgcaauuuauggcgcagcuuuuucagguguuaguuggacaaugaagauacugauuggcgugauaauaacguggauaggaaugaauaguagaucuacuucuuugucuguaagccuuguauuaguagguguaguaacacuguacuuaggaguaaugguucaagccgauacagguuguguuguaaguuggaaaaauaaggaacuaaagugugguagcgguauuuucauaacggacaacguucauacguggaccgaacaauacaaauuucagcccgaaaguccauccaaauuagcaucggcgauucaaaaagcucaugaagagggaaucugcggaauaagauccguaacccgguuagaaaaccugauguggaaacaaauaacaccagaauuaaaucacauauuaucugaaaacgaaguaaaacuaacaauaaugacaggggacauuaaagguauaaugcaggcaggcaaacgaagucuaagaccucaaccaaccgaacuuaaauauuccuggaagaccugggggaaagcuaaaaugcucucaacagaaucacauaaucaaacuuuuuuaauagaugguccggaaacugcagaaugcccaaacaccaauagagcauggaauagucuagaagucgaagacuauggguuugggguauuuucaacaaacaucugguugaagcuacgagagaagcaagacgucuucugugauucuaaacucaugagugcagcgauaaaagauaaccgugcuguacaugcggacaugggauacuggauugaauccgcucuaaacgauacauggaaaauggaaaaagcaucguucauagaaauaaagucuugucauuggccaaaaucucacacccuauggaguaaugguguucuggaaucugaaaugauaauaccaaaaaauuucgcaggccccgucucacaacauaacuacagaccugguuaucauacacaaaccgcuggacccuggcaccuaggaaagcuugaaauggauuucgauuucugcgaaggaacaacaguuguaguaacugaggauugcggaaacagaggucccagucuacguacgacuaccgcaaguggaaaguugauuacagaaugguguugcaggagcuguacucucccgccucuucguuaccguggagaggacggauguugguaugguauggaaauaaggccguuaaaggaaaaagaagaaaaccuugucaauucauugguaacugcuggguauggacagauagacaacuucagcuuaggcguccuggggauggcgcuuuuucuagaagagaugcugaggacacgagucgguaccaaacaugcgauacuacucguggcgguuucauuuguaacucuaauaacaggaaauaugucguuuagagaucuaggucguguaaugguuauggugggcgcgacuaugacggaugacauaggcaugggagugacauaccuggccuuauuagcggcguuuaaaguacguccuacauucgcggccggcuuguuacuaaggaaauuaacauccaaagagcuuaugauggccacuauagguauagcguugcuaucacaaucaacaauaccggaaacuauccucgagcugacugacgcauuagcccuaggaaugaugguacuaaaaauuguacguaacauggaaaaauaucaacuggccguaaccauaauggcaauaucguguguaccaaaugccguaauauuacaaaaugcguggaagguaucaugcacuaucuuagccgccguaagcgugaguccuuuauuauuaaccucuagccaacaaaaagcugacuggauuccauuagcguuaacuaucaaagggcucaauccgaccgcaauuuuucugacuacuuuaucccgcacaucaaaaaagagauccuggccccucaaugaagccauuauggcaguuggaaugguaaguauacuugcuucuagccuguuaaagaaugacaucccuaugacaggaccgcuaguggcggguggccuacucacaguauguuacguauuaacgggucggucugcagauuuagagcucgaaagagcugcggauguuaaaugggaagaucaggcagaaauuagcggaaguagcccaauccugucaauuacaauaagugaagaugggucuaugucaauaaaaaacgaggaagaggagcauacccugacaauccugauacgcacgggcuuacuaguuauuucggguguguuuccaguaucuauacccauaacagcugccgcuugguaucuaugggagguaaagaaacaaagggcggguguuuugugggauguuccuagcccaccgccaguugguaaagcagaauuagaggauggugccuaccgcauaaaacagagagguauauuuggcuacagucagauaggugcugggguuuauaaggaaggaacuuuccauacaauguggcauguaacaagaggagcugucuuaaugcacagggggaaacggauagaaccgucgugggcagauguaaaaaaggaccuaaucucguaugguggagguuggaaauuggaaggagaguggaaagagggagaagaaguccaggucuuagcucuagaaccaggaaaaaacccgagagccguacaaacuaagcccggccucuucaaaacaaauacggguacaauuggagcuguuucacuagauuucagcccuggaacaucgggaaguccaauaguagacagaaaaggcaaagucguaggccuauaugggaauggcguugucacuagauccggugcguacgugucggcaauagcacaaacggagaaaagcauagaagauaauccugaaauagaagaugacauauuucgaaaaaagcgauuaacuauaauggaucuucauccgggagcaggaaagacaaaacgauauuugccagccaucguucgugaagcaauaaagcgaggccuacggacuuuaauccuagccccaacccgaguaguugcugcugaaauggaagaagccuuaagaggcuugccgauaagauaucaaacaccggcaauccgagcagagcacacgggaagggaaaucguagaccuaaugugucaugccacuuuuacuaugcguuuguugaguccaguaaggguaccuaauuauaauuuaauaauuauggaugaggcccauuuuaccgacccagcaucaauugcugcaagggguuauauauccacacggguggaaaugggagaagcugcuggcauuuucaugacugccacaccucccgguucaagagacccuuucccucaaucuaaugcuccuauuauggaugaagagagagagauaccagagaggagcuggaauagcggucacgaguggguaacggauuuuaaaggaaaaacagugugguuugucccgucuauaaaagcaggaaaugauaucgcugcaugcuuaagaaaaaacgguaagaaaguaauucaauuaucacgaaaaacauucgacucagaguauguaaagacuagggccaaugauugggacuucgucguaacaacugauauuucagaaaugggagcaaacuucagggccgaaagaguaaucgauccuagacgauguaugaaaccaguaauauuaacugauggagaagagcgaguaauccuggccggaccaaugcccguuacgcacuccagcgcugcgcaaagaagggguagaaucggacguaauccuaaaaacgaaaacgaccaauacauuuauaugggagaaccacuugaaaaugacgaagacugcgcucauuggaaagaggcaaaaaugcuauuagacaauauaaauacaccagaaggcauuauaccgucaauguuugaaccagagcgggaaaagguagacgcaauugauggagaauauaggcucagaggcgaagccagaaagacuuuuguggacuugaugcgucgaggagacuugcccguguggcuagcuuaucguguggcagcugaaggcauuaauuaugcugaccgaagguggugcuucgaugguauaaagaacaaucaaauauuagaagaaaauguugaaguagaaauauggacaaaggaaggcgaaagaaagaaacucaaaccccgguggcuagaugcucgaauauacagcgauccucuugcacuaaaagaauucaaggaguucgcagcuggaagaaaaagucuaacguugaaccuuaucacugaaaugggcagacuuccaacuuuuaugacccaaaaagccagagacgcacuugacaacuuggccguucuacauacggcagaaguaggagguagagcauauaaucacgcacuaucugaacuacccgaaacauuagaaacauuauuacuguugacacuauuagcuacaguaacaggcgguauuuuucuuuuucugaugagcggaaaagggauaggaaagaugacauuagggaugugcugcauaauaacagcaucaauacuacucugguacgcacaaauucaaccccacuggauagccgcaagcaucauccuagaguuuuuuuuaauaguauuauuaaucccagagccagaaaaacaacguacaccgcaagacaaucaacugacguauguaguaauagcuauucuaacagugguugcagcgaccauggcuaaugaaauggguuuccuagaaaaaacgaagaaagaucugggacuaggcucaauaacuacgcaagaaagcgaaucaaacaucuuagauauugaccuuagaccggccucagccuggacacuguaugcuguagcgaccaccuucguuacucccauguuaaggcacucaauagaaaauuccagcguaaauguaucucucaccgcaauugccaaccaagccacaguacuaaugggacuugggagaggauggccccugucuaaaauggacauagguguaccauuacuagcaauaggaugcuacucucaggucaauccaaucacucuaacagcugcuuuacuccuacuaguagcgcacuaugcaauaauaggucccggacugcaagcuaaggccacgagagaagcccagaagagaacagcggcuggcauaaugaagaaucccacagucgacggaauuacugucauugaucuugagccuauccccuacgacccuaaauuugaaaaacaacugggucagguaaugcuucuaguucuaugugucacacaaguacugaugaugcgcacaacuugggcauugugcgaagcacuaacauuagccaccggccccaucuccacccuuugggaaggaaacccgggacguuuuuggaacacaacuauagcagucucaauggccaauaucuucagaggaucauauuuagcaggugcuggguuauuauuuagcaucaugaaaaauacgacaaauacaagaagagguacggguaacauaggcgaaacgcuuggagaaaaauggaaaucacgucucaaugcacuugguaaaagcgaauuucagaucuauaaaaaauccggaauacaagaagucgauaggacauuagcuaaagaagguauaaaaagaggagaaaccgaucaucaugccguuucuagaggcucugcaaaguuacgcugguuuguagaaagaaacauggugacgccugaaggcaagguaguugacuuagguugcggacgcggagguuggucauauuacugcggcggguuaaaaaacguaagagagguaaagggcuuaaccaaagguggaccuggccacgaagaacccaucccaaugucaacuuauggcuggaauuugguucggcuucagucuggaguggauguauuuuuuaccccaccugaaaaaugcgacacuuuacugugcgauaucggagagucgucaccgaacccaacgauagaggcagguagaacacuacgcgucuugaauuugguagaaaacugguugaauaauaauacucaauucugugucaaaguguuaaauccguacaugccgaguguaauagaaaaaauggagacucuacaaagaaaguaugguggagcuuuggucagaaacccguuaucaaggaacucaacacaugaaauguacuggguuagcaacgcgacugguaauauaguuuccagugucaacaugauuaguagaaugcuaauaaacagguucaccaugaaacacaaaaaagcgacauaugagccggauguugacuugggcaguggcacucgcaacaucgggauugaaaaugagaucccuaaucuagauauaaucggcaaaagaauugagaaaauaaaacaagaacaugaaaccaguuggcauuaugaucaagaccauccauauaagacaugggcuuaucaugggaguuaugagacaaaacaaacagguuccgcaucgaguauggucaaugguguagugaaacuccuaacaaagcccugggaugugguaccaaugguuacacaaauggcaaugacagauacaacaccauuuggccagcaacggguauuuaaagaaaaaguagacacgagaacacaagaaccaaaggaagggaccaaaaaacucaugcggaucacggcugaaugguuauggaaagaacuaggcaaaaaaaaaacuccacgaaugugcacuagggaagaauuuacccggaagguucgaaguaacgcagcucuuggcgcaaucuucacagaugagaauaaguggaaaagugcaagagaagcaguugaggauagucgauuuugggagcuuguugauagagaacguaacuuacauuuagaagggaaaugcgaaaccuguguauauaacaugaugggcaaaagagaaaagaaacuaggagaauucgguaaagcuaaaggauccagggcgauuugguauaugugguuaggagcaagauucuuagaguucgaagcacuuggauuucuuaacgaagaucauugguucagcagaggcaauagcuugaguggcguagaaggugaaggguugcauaaacucggguauauacuccgagacgugucaaagaaggaagguggggcaauguaugccgaugacaccgcagguugggauacacgaauaacacuagaagauuugaaaaacgaagagaugguuaccaaucauaugaaaggugaacauaaaaaacuugccgaggcaaucuuuaaguugacauaucaaaauaagguaguccgggugcaacgaccaacgccaaggggcaccgugauggauauuauaagucgcaaagaccagagaggcucuggacaaguuggaacauacggauuaaacacuuucacaaauauggaagcacaacucauacgucaaauggagggcgaaggaauuuuuaaaucuauucaaagacuuaccguaaccgaagaaauagcuguucaaaauuggcuugcccgagugggccgagaaagauuaagucgcauggcaauuaguggcgaugauugugugguaaaaccauuagaugaccgguucgccucagcucugacugcauuaaacgauauggggaaaguacgcaaagauauacaacaaugggaaccgucccgcggguggaacgauuggacccaaguuccauucuguucacaccacuuucacgaauuaguaaugaaagauggacgaguccucgucguacccuguaggaaccaagacgagcuuauagggcgagccagaauaucacaaggcgcaggcuggucacuaaaagaaacugcuuguuuaggcaaauccuaugcucaaauguggacguugauguacuuccacagaagagauuuaagacucgcugccaaugcaauaugcagugcaguacccucacacuggguccccaccagucgaacuacauggaguauacaugccaaacacgaauggaugacgaccgaagauaugcuagcuguuuggaacaggguuuggauucaggaaaacccuuggauggaagauaagacaccgguagaaucgugggaagaaguuccauaccuuggaaaaagagaagaccaauggugcgggucacuuaucgguuugaccucccgggcgacuugggcgaagaauauucaaacggcaaucaaccagguacgaagcuuaaucggcaaugaagaauauacagauuacaugccaucaaugaaaagauuuagaaaagaagaagaggaagccggaguccuuugguaa

SEQ ID NO: 22530 - RNA, 9876 nt, Artificial Sequence
  derived and/or modified CDS sequence (opt6) from DENV-2__EU482554__SS-prME
accgcgggaguaauuauuauguuaauacccaccgcaauggcauuucauuuaaccacacgcaauggagaaccgcauaugaucguuggaaggcaagaaaaaggaaaaucccuauuauuuaaaacugaagaugggguaaauauguguacacuuauggcuaucgauuuaggagaacuaugugaagauacgauaacguauaaaugcccccuauugagacaaaaugaaccagaagauauugacugcugguguaauuccaccucaacauggguaacuuauggaacuugcacuacaacgggggagcaccgcagggagaaaaggucaguagcuuuaguaccacaugucgggaugggauuagaaacaagaacugaaacuuggaugucuuccgaaggugcuuggaaacauguucagcgaauugaaacauggauacuucgacauccaggcuuuaccaucauggcagcaauucuugcauacacaaucggaacuacccauuuucaaagggcacugaucuuuauucugcuaacagcaguugcuccaagcaugacuaugaggugcauugggaucagcaacagagacuucguagaagguguaagugguggaagcuggguagauauugugcuagaacauggaucauguguuacgacaauggccaaaaauaaacccacuuuggauuuugaguuaaucaaaaccgaagcaaaacaaccugcaacucuuagaaaauauuguauugaagcuaaacuaacaaauacuacuacugaaaguagauguccuacucaaggagagccaucucuaaacgaagaacaagauaaacgauuuauauguaaacacucaaugguggacagaggauggggaaacgguugcgguuuauuugggaaaggcggaauagugacaugcgcuauguuuacauguaagaagaauauggagggaacagucguauuaccagagaaucuagaguauacgauaguuauaacaccgcacaguggcgaagaacaugcuguggguaaugauacgggaaaacauggaaaagaaaucaaaaucacuccacaaucuucuauuacagaagcugaacuaacagguuacggaacagucaccauggagugcucaccgagaacuggacuagacuuuaaugaaaugguucuauugcaaauggaggauaaagcgugguuggugcaccgacaaugguucuuagaucugccgcuuccauggcugccaggcgcugauacacaagguucaaauuggauacagaaagaaacgcuuguaacauuuaaaaauccucaugccaagaaacaagacgucgucguauugggaagucaggagggggcgaugcauacagcacuaacgggagcuacugaaauacagaugagcucuggaaaccucuuauuuacaggucaucuuaaaugucgacuaagaauggauaaauuacaauuaaaaggcaugucauacucuaugugcacaggaaaauuuaaaauaguaaaagaaauagcagaaacacaacauggaacuaucguaauuagaguacaauaugaaggugaugggucgccaugcaaaauaccauucgaaauaauggaucucgagaaaagguacguguuaggcagacugaucacugugaauccaauuguaacagagaaagauucgccagugaacauagaggcugaaccuccauucggugacuccuauauuauaaucggugucgaaccgggacagcuaaaacuaaauugguuuaagaaaggaagcagcauaggacaaauguucgaaacgacgaugagaggggcuaaacgaauggccauauugggugauacagcuugggauuucggaucgcuaggugguguuuucacaagcauuggcaaggcuuugcaucagguuuuuggagcaauauauggugcugcauuuucaggaguuagcuggacgaugaaaauucucauaggcgugauaauaacauggaucgggaugaacucgcgcucaaccucucuaucaguuagccuaguccuaguaggaguagucacucuauaucuuggcguaaugguccaggcugacaguggaugcguuguaucauggaaaaauaaggaacuaaagugcggaucgggcauauuuaucacugauaauguucacacguggacugagcaauauaaauuucaacccgaaucaccaucaaaguuggcaucagccauacaaaaggcacaugaggaaggcauuuguggaaucaggaguguaacccgacuagagaacuuaauguggaaacaaauuacuccagaacuaaaccauauucucuccgagaaugaagucaaacuaacaauuaugacaggcgauauaaaaggaaucaugcaagcagguaaacgaaguuuacggccacaacccacggaacuaaaauauaguuggaaaacuuggggaaaagccaaaauguugucuacugaaagucacaaucagacguuuuuaauugauggaccagaaacagcagaaugucccaauacaaauagagcguggaacucucuugagguugaggacuacggcuuugguguuuuuaguacuaacaucuggcuaaaguuaagggaaaagcaagacguguuuugcgacucgaaacuaaugucagcggcaauuaaagauaauagggcaguacaugcagauaugggauauuggauagaaagcgcccuaaaugacacguggaaaauggagaaggcuucauucauagaaguaaaaagcugucauuggccaaaaagccacacacuauggucaaauggagugcuagaaagugaaaugauuauacccaaaaauuucgcaggacccguuucacaacauaacuaccggcccggcuaucauacacagaccgcggggccuuggcacuuagggaagcuggaaauggacuucgauuucugugaagguaccacaguaguuguaacagaagacuguggcaauagagggccgucacuacgaacgacaacagccucuggaaaacuaauuacggaauggugcuguaggucuugcacauugccuccccuuagguauaggggugaagacggaugcugguaugguauggagauacggccacugaaagaaaaagaagagaacuuggucaauagucuagucaccgcaggccauggacaaaucgauaacuuuucacugggcgucuuggguauggcgcucuuuuuggaagaaaugcuuagaacuaggguuggcacuaagcaugcaauacuauugguugcaguuaguuuuguaacauuaauaacggggaauaugucauuccgggauuuggguaggguaaugguaaugguaggagcaacaaugacggacgauauugguaugggcguaacuuaucuagcuuuacuugcagccuuuaaagugagaccaacguuugccgcuggguuacuacuaaggaaacuaacaucaaaagaacucaugauggccacaauaggaaucgccuuacuaucgcaaagcacaauuccagaaacaauuuuagaauugaccgaugcgcuggcguugggaaugaugguccucaaaauuguucgaaauauggaaaaauaccagcucgcgguaacuauaauggccauacucugcgugcccaaugcagucauacuucaaaaugcuuggaaagugaguuguacaauacucgcggcuguuagugucaguccauuguuauuaacgagcucucagcaaaaggcggacuggauaccuuuggcauuaacgaucaaagggcuuaacccuacugcaauauucuugacaacgcuaucucguacaucaaagaaaagaucauggccacuaaacgaggcggugauggccgucggcaugguuucaauucuggcaucuucuuuacugaaaaacgacauuccuaugacaggacccuuaguggcugguggucuuuuaacggucuguuauguuuuaacaggcagaucugcugaccuagaacuagagagagcugcagacgugaaaugggaagaucaagccgaaauuaguggaaguagcccuauacuaaguauuacaauuucagaagacgguagcaugucuaucaaaaaugaagaagaagaacaaacacugacaauacugauacgaaccggacuauuagucauaucgggcguauuuccagucucuaucccuauuacggcagcugcuugguaucuaugggaggucaagaaacaaagagcugguguccuaugggaugugccuucaccaccacccguaggcaaagcagaacuagaagauggugcauauagaauuaaacaacgcgguauauuuggauacagccagauaggcgcaggaguuuauaaagaagggacuuuucacacgauguggcauguaacaagaggagcaguauugaugcaucgcggcaagagaauugaaccgaguugggccgacguuaagaaagaccuaauuucauacggagguggauggaaauuagaaggggaauggaaagaaggagaggaaguacaaguacucgcucuagagccaggcaaaaauccgagagcaguacagacaaaaccaggauuauucaagacuaacacgggcacaauaggagcagugagucuugacuuuucaccaggaaccucggguucgccgaucguugaucgcaaggguaaaguuguaggauuauaugguaauggagucgugacaagaucaggugcauacgugagugcuauugcacaaacugagaaaucaauagaggauaauccagaaauagaagaugauaucuucagaaagaaacgucuaacuaucauggaucuacauccgggagcuggaaagacuaaaagauauuugccagcaauaguaagggaagcuaucaagcgaggucuaagaaccuuaauacuugccccuacuaggguuguugcugcagagauggaggaagcacuucgaggccuaccuauucgguaccagacgccagcuauccgcgcugaacacacagguagggaaauuguagaccuuaugugucacgcuacuuucaccaugcgauuacucuccccuguacgugucccaaauuauaaucuaaucaucauggaugaagcgcauuuuacugauccagcgaguaucgccgcgagaggauacaucagcacuagaguugagaugggugaagcggcaggaauauuuaugacugcuacgccuccagguucgcgggacccauucccccaaagcaaugccccgauaauggaugaagaaagggaaauaccugaaaggagcuggaauaguggucaugaauggguaacagacuuuaaagggaaaaccguaugguuugucccuagcauaaaagccggaaacgauauagccgcgugcuuacggaaaaauggcaagaaagugauacaauugucaagaaaaacguucgauagcgaauacgucaaaacuagggcaaaugauugggacuucguagucacgaccgauauuucagagaugggggcaaauuuuagggcagaacgaguuauugauccucgccgguguaugaaaccuguuauauuaaccgacggugaagaaagaguaaucuuagcagggcccaugccagucacucauucuucagcagcccagcgucgagguagaaucggccgcaaccccaaaaaugagaaugaucaauauauuuauaugggugaaccauuagaaaacgaugaggacugugcacauuggaaagaagccaaaauguuacuugauaacaucaauacgccugaaggaauaauaccuucuauguuugaaccagaaagagagaaaguagaugcgaucgacggggaguacagacuuagaggagaagcaaggaaaacuuucguugaccuaaugaggcguggugacuuaccaguuugguuagcauauaggguagcugccgaagggauaaacuacgcagauagaagaugguguuucgaugggauaaagaacaaucaaauucuggaagaaaacguugagguugagauuuggacaaaagaaggggaacgaaagaaacugaaaccacggugguuagacgcaagaaucuauagugacccccucgcccuaaaagaguucaaagaauuugcagcuggcagaaagagcuuaacauuaaaccugauaaccgagaugggaagacugccaacauuuaugacgcaaaaagcaagggacgcucucgauaaccuugcugugcuccauacugcugagguagguggcagagcauacaaucaugcccuaucugaguuacccgagacucuagaaacacuuuuacuacugacgcuacuggcaacaguuacuggggguauauuccuauuucuaaugucaggaaaaggaauagguaaaaugacgcucggaauguguuguauaauuacggcuagcauuuugcucugguaugcccaaauacaaccacauuggauagcagccucaauaauauuagaguucuuucuaauagugcuuuuaauaccugaaccggagaaacaaagaacuccucaggacaaccaacucacauauguugucauugcuauucuuacuguagucgcggcaacaauggccaacgaaaugggauuccucgagaaaacaaagaaagacuuaggacugggauccauuauuacacaagaguccgaaucuaacauccuugacaucgaccuuagaccagccucugcauggacacucuacgcagucgcuacuaccuuugugacgccuauguugagacauucaauagaaaacaguagcguaaaugugucguuaacagcaauagccaaucaagcuaccguacugaugggauuagggcguggauggccauuaucaaagauggauauagguguuccucuauuagcuauaggcugcuacagucagguaaauccuauaacccuaacagcugcucuauuacuccuaguagcucacuaugccauaauaggcccagguuugcaggcaaaagccaccagggaagcccagaaaagggcagccgcagguauuaugaaaaacccaacgguagacgguauaaccguuauagaucuagaaccuauacccuaugacccgaaguucgaaaaacaauuggggcaagucaugcuccuaguguuauguguuacacaagucuuaaugaugagaaccacaugggcccuaugugaagcacugacgcuugccaccggacccauuucaacauuaugggaaggaaauccagggagauucuggaauacaacgaucgcuguuucaauggcaaacauuuuccggggaucauacuuagcgggcgcaggauuacuauuuucaaucaugaaaaacacuaccaacacaaggagagguacagggaauauaggcgaaacauugggugaaaaguggaaaucgcgauuaaacgcacuugguaaaucggaauuucaaauuuauaagaaauccgggauacaggaggucgauagaacgcuugcaaaagaaggcaucaagagaggagagacggaccaccaugccgucagucgcgggucugcuaaauuaagaugguucguagaacgaaacaugguuacuccagaagguaaggugguagaucuaggauguggcagaggggguuggaguuacuauugcggaggauugaaaaaugucagagagguaaagggguuaacuaaaggaggaccugggcaugaagaaccuauaccuaugucaacauacgguuggaacuuaguccguuugcagucaggaguggauguguuuuucacaccuccugaaaaaugcgauacgcugcucugugauauaggggagucaucaccuaacccgaccauagaagcggguaggacuuuaagaguccuaaacuuaguagaaaauugguugaauaacaacacacaauuuugcauaaaaguuuuaaacccuuauaugccaagcgucauugaaaagauggaaacacuacaaagaaaauaugguggagcacugguacgaaauccauuaaguagaaacucaacccacgaaauguacugggugagcaaugcgacaggaaauaucguuucgagcgugaauaugauuagccgaauguuaauaaaccgauuuacuaugaaacauaagaaagcaacauaugaacccgauguugauuuaggcagcgguacgcgaaauauugguaucgaaaacgaaauaccaaacuuagauaucauugggaaacgaauagagaaaauuaagcaggagcaugaaacaaguuggcacuaugaucaagaccacccauacaaaacaugggcauaccaugguucguaugagacuaaacaaacaggaagugccagcagcaugguaaauggugucguucgacuccuuacgaaaccuugggacguggugccaauggugacccaaauggcaaugacugauacaacaccauuuggucaacaacgaguguuuaaggaaaaaguugacacaagaacgcaagaaccgaaagagggaaccaagaaauugaugcgcaucacagcggaauggcuuuggaaagagcucggcaagaagaaaaccccaagaauguguacucgggaagaauuuacacgcaaggucagaucgaaugcagcuuuaggggcaauauuuaccgaugaaaacaaguggaaaucggcaagagaagcggucgaagacagucgauucugggaauugguggacagagaacggaaccuccaucuagaagggaaaugugaaacaugcguguacaacaugauggggaaaagagaaaagaaacuaggagaauuugguaaagcaaaggguaguagagcuaucugguacauguggcuaggagcccgauucuuggaguucgaagcauugggguuccuaaaugaggaccacugguuuuccagaggaaauagccuaagcgggguggaaggagaaggacuucacaaauuggguuacauacuacgagaugucucaaagaaagaaggaggugcuauguaugccgaugauacugcugggugggauacgcgaauaacuuuagaagaucucaaaaaugaagaaaugguuacaaaccauaugaaaggugagcacaagaaauuagccgaagcaaucuucaaacuuacuuaucaaaauaaaguaguuagaguccaacgcccaacgccuagaggcacaguuauggauauaauaagcagaaaagaucaacgugggucaggacaaguagggacauacggacuaaauacuuuuacaaacauggaggcucaacucauuaggcaaauggagggcgaaggaauauuuaaaucaauacagcaucuaacagugacagaggaaauagcuguacagaacuggcucgcaagaguagggagggagagacuaaguagaauggcaauaucgggugaugauuguguaguuaaaccccuugacgaccgcuucgcaucugcacucacagcuuuaaaugauaugggaaaaguucguaaggacauccagcaaugggaaccgucacgaggauggaacgacuggacucaggugccuuuuuguucucaucacuuucaugaacucgucaugaaagauggaaggguacucguaguaccaugccgaucacaggaugaacuaaucggacgagcacgaauaucacaaggagcugguuggucccugaaagagacagcuugccuuggaaaaaguuacgcucaaauguggacacuuauguauuuucacagacgugaucugcgcuuggcggcuaacgcuauaugcucugcggugccaucgcauuggguaccgacaagcagaacaacauggucuauacaugcuaaacaugaguggaugacuacugaggacaugcuagcagucuggaauagggucuggauacaagaaaauccguggauggaggacaaaacucuagucgaaucaugggaagaagugccauaucucggcaagcgggaggaucaguggugcggaagucuuauagggcuuacaucaagagcgaccugggcuaaaaauauacaaacagcgauaaaucagguucguucauugauaggcaacgaggaauauacggacuacaugccaucuaugaaaagauuccgaaaagaagaggaggaggcuggaguacuaugguga

SEQ ID NO: 22531 - RNA, 9876 nt, Artificial Sequence
  derived and/or modified CDS sequence (opt6) from DENV-2__EU482556__SS-prME
accgcaggaguaauaauuauguuaauaccuaccgcaauggcuuuccaccuuacaacucgaaacggagaaccacauaugauagugggacgacaggaaaaagguaaaucuuuacuguucaaaacugaagauggaguaaauauguguacuuuaauggcaauagaucuuggugaacuuugugaagacacuauaaccuauaaauguccacuucuacgacaaaaugaaccugaagacauagacugcuggugcaauagcacaucaacauggguuacguauggaacuuguacuacgacaggcgaacacagacgagaaaaacgaaguguugcauuagugccacauguugguaugggccuggaaacgaggacggaaacguggaugagcuccgaaggggcauggaaacauguccaaagaauugaaacauggauacucaggcauccaggauucaccauaauggcugcgauuuuagcauacaccauaggaacaacucauuuccaacgagcccucauuuuuauauugcuuacagcugucgcaccuaguaugacuaugcgauguaucggaauaucgaaucgugauuuugucgaagguguaucaggaggcaguuggguagacaucguauuagagcauggaagcuguguaacaacgauggccaaaaacaaacccacccuagauuucgaauuaauaaaaacggaggccaaacaaccagcgacauuacgcaaauauuguauugaagcaaaauuaacuaauacaacaacugaaagucgaugcccuacccaaggggaaccaaguuuaaacgaagaacaggauaaacguuuuauaugcaaacauucaauggucgaucgagguugggguaauggauguggacuuuuuggcaaagggggaauuguuacgugugcaauguuuaccugcaagaaaaauauggaagggaaaguuguacuuccagagaaccuggaauauacaauuguaauaacaccacacucaggagaagaacacgcuguggguaaugauaccgggaaacauggaaaagagauaaaaauaacaccacaaaguuccauaacugaagcagaguuaacuggguauggaaccgucacuauggaaugcagcccacguaccggauuagugucucacgaaauggucuuauuacaaauggaggauaaagccuggcuagugcaccgccaaugguuccuugaccuaccgcucccaugguuacccggagccgauacacaaggaagcaauuggauacaaaaagagacccuaguuacauuuaaaaauccccaugccaagaaacaggacguggugguccuugguucacaggagggugcgaugcauacagcgcuaacuggugcuacugaaauucagaugaguagcgggaaccuucuauuuacaggacaccucaaaugcaggcuacgaauggacaaacuucaacugaaagguaugucauauucaauguguacagguaaauuuaaaauaguaaaagaaauugcagaaacacagcacggcacaauagucauacgaguucaauacgaaggggacgguagcccaugcaaaauuccauuugaaaucauggaucuugagaaaagacauguacuaggaagauugauaacagucaacccuauaguuaccgagaaagauucuccuguuaacauugaagcugaaccaccauuuggggauucuuauauaauaauaggcguagagccaggacaauuaaaauuaaacugguucaagaaagggucaucuauaggacaaauguucgaaacaacaaugcgaggggccaaaagaauggcgguccugggugacacugcuugggauuucgguagccugggaggaguauuuaccuccauuggcaaagcucuacaucaaguuuucggcgccauauauggcgcugccuuuucgggugucucuuggacuaugaaaauucuaauaggaguaaucauaacauggauaggaaugaacucgaggucuacaagucuauccguaucacuuguucuggucggcguuguaacucuuuacuuggguguaaugguacaagcagacacagggugcgucguuucguggaaaaacaaagagcuaaaaugcgggagcgguaucuucauaacugauaacguucauacuuggacugaacaauauaaguuucagccggagucaccuucgaaacuugcaagcgcaauucaaaaagcccacgaagaaggaauaugugggauacggucagucaccagauuggaaaaucuaauguggaaacaaauaacaccggagcugaaccauauucuaucagaaaaugaggucaaacuaaccauaaugacuggugauauaaaaggaauaaugcaagcgggaaagaggucccuucgaccgcaaccuaccgaguuaaaauauucauggaagaccuggggaaaagcaaaaaugcugucuacagaaucacauaaucagacuuuucuaauugaugguccagagacggcggagugucccaauacaaauagagcuuggaacucccuggaaguugaggacuacggauuuggaguguuuucgacgaacauauggcuuaaauuaagagagaaacaagauguauuuugugauucaaaacugaugagugcggcuaucaaggauaauagagcaguucacgccgauaugggcuacuggauugaauccgcuuuaaaugauacauggaaaauggagaaagcgaguuuuauugaaauaaaaagcugucauuggccaaaaagccacacacuauggaguaacgguguucuagaaucugagaugauuauaccuaaaaacuucgcaggcccagucagucaacauaacuauagacccgguuaccauacacaaacugcagggccauggcaucuaggaaaguuagaaauggauuucgauuuuugcgaagguacaacaguaguagugaccgaagauugcgguaaucgaggcccuucucuaagaacgacaacagcuucuggaaaauugaucacagaauggugcuguagaagcugcacuuuaccaccuuuacgauaccgaggugaggauggauguugguauggaauggaaauacguccauuaaaagaaaaagaagaaaacuugguaaauagccuagugacagcugggcacggucaaauagacaacuuuucucuaggaguccuggguauggcacucuuuuuagaagagaugcuaaggacuaggguaggaacaaaacaugcaauccuccuaguugccguaaguuucgucacauuaaucacaggcaauaugagcuucagagauuugggaagaguaaugguaaugguuggagcaacaaugaccgaugauauagguaugggaguaaccuacuuagcacuacuagcagcuuuuaaaguuaggccuacauucgcugcggggcuauuacuacgaaaacuaacaucuaaagaauuaaugauggccacuaucggaauugccuuguuaagccaaucgacaauuccugagacgauucuagagcucacugaugcacuugcacuaggaaugaugguucugaaaauagugaggaauauggaaaaauaucagcuugccgucacaauaauggcuaucucaugugugccgaaugcuguuauuuuacaaaacgccuggaaggucaguuguacuauccuagcagcaguaucagucucaccuuuacugcucacuucgucgcaacaaaaagccgacuggaucccauuggcgcuaacuauaaaagggcucaacccaacggcgauauuucuaacaacucucucacgcacuucaaagaagcgaaguuggccauuaaacgaggcugugauggcagugggcaugguuucgauauuagcuaguagucuccuuaaaaacgauauaccaaugacuggaccauuagucgcgggaggauuauuaacgguaugcuauguacucacuggucgaagugcagauuuagaauuagaaagagcagcagaugucaaaugggaagaccaagcagagauuagcggaucgucgccuauauuaucaauaacaauuucugaagaugguagcaugucaaucaaaaaugaagaagaagaacauacacuaacuauccuaauacgaaccggauuguuaguaauaucaggagucuucccaguaucgauuccaauuacagcugcagcuugguaucuaugggaaguuaaaaagcagagagcggggguacugugggauguaccaagcccuccaccuguagggaaagcagaauuagaggauggugcauaccgaauaaaacaaaggggaauauuugguuacagucaaauaggagcaggagucuauaaagaagggacguuucauacgauguggcaugugacccguggugcaguuuugaugcauagaggaaagaggaucgaaccaucaugggcagaugugaagaaggaucugauaagcuauggaggaggauggaaauuagaaggugaauggaaagaaggagaagaagugcaaguucucgcucuugaaccaggcaagaauccacgcgcaguacaaacuaaaccagggcuuuuuaaaacaaauacgggaacaaucggugcagucucgcuggacuuuucaccaggcacaucugguucaccaauaguugaucgaaaggguaaagugguaggguuauaugguaacggugucguuacgcgaucaggagccuaugugucugcgauagcacagaccgaaaaguccauagaagauaauccggaaauagaagacgauauauucaggaagaaacgguuaacaauaauggaccuccacccaggagcagggaaaacaaaaagauauuugccagccauagugagggaagcgauaaaacgcggccuuagaacacucauacuagcaccuacaaggguuguugccgcagagauggaagaagcauugagagguuugccaauuagauaccaaacuccagccaucagggcagagcacacuggccgagaaauuguggaucuaaugugucaugccacauuuaccaugcggcuccugaguccaguaagaguaccaaauuauaacuuaaucauaauggacgaggcacauuuuacugacccagcuaguauugcugcucggggauauauaucuacacgaguugagaugggcgaagcagcuggaauuuucaugacagcaacucccccuggaucgcgagacccguuuccucaguccaaugcgccuauuauggaugaagaaagagaaauaccggaaagaagcuggaauagugggcaugaaugggucacagauuuuaagggcaaaacgguaugguuuguuccauccaucaaagcugguaacgauaucgcagccugcuuaaggaagaaugguaaaaaggucauacagcuaagccgcaaaacauucgauucugaauaugugaagaccagagcaaacgacugggauuuugucgugacaacagauaucucagagaugggugcuaacuuucgagcggagagaguuaucgauccaagaagguguaugaagcccguuaucuuaacugauggagaggagagaguaauacuugcuggaccaaugcccguaacacacucuagcgccgcacaaagaaggggaagaauaggucgaaauccgaaaaaugaaaacgaucaauauaucuauaugggggaaccauuagaaaaugacgaggauugugcucacuggaaggaggcgaaaauguuauuggacaacauuaacacuccagaagggauuauaccgucaauguuugaacccgaacgcgaaaaagucgacgcgauagauggagaauaucgauugagaggggaagccaggaaaaccuuuguggaucuuaugcgcagaggggaucuaccgguuuggcuugcauaucgaguggcagcggaagguauaaauuacgcggaccgaagaugguguuucgauggaauuaaaaacaaucaaauauuggaggaaaacguagaaguagagaucuggaccaaagaaggcgaaagaaagaaauuaaaaccacgauggcuggaugcaaggaucuauuccgacccacuagcacuaaaagaguucaaggaauuugcugcgggacguaaaucucuuacauuaaacuuaaucacugaaaugggacgucuuccaacauuaaugacacaaaaagcaagagaugcuuuggacaaucuagcaguucuucauacagcggaagugggagguagagccuauaaccaugcauuaagcgagcuaccugaaacauuagaaacacuacucuuacuuacacuuuuggcuacagucacuggaggaauauuucucuucuuaaugucagguaaggguauagguaaaaugacucucggaaugugcuguauaaucacagcaaguauccuauuaugguaugcucagauacaaccucauuggauugcggcauccauuauacuggaguucuuucuaauaguuuuguuaauaccggaacccgaaaaacagcgaacuccacaggacaaccaguugacauaugucgucauugccauauugacgguaguugcagcaacaauggcaaaugaaauggguuucuuagaaaagacuaagaaagaucuaggccucgguaguauaacgacccaagaauccgaaucaaauauucuggacauugauuuaagaccagcaucugcauggaccuuguaugcggucgcgacuacuuuuguaacucccauguuaagacacaguaucgaaaauucaagcgucaacguuucauugaccgcgauugccaaccaagccacagucuugaugggucuagggagaggguggccucuuucuaaaauggacauaggagucccuuuacuagccauuggcugcuauucacaaguaaaccccauuacgcugacugcggcauuacuuuuauugguagcccacuacgcuauaauuggucccggauuacaagcuaaagcuacaagagaagcgcaaaaacgaacggcugcgggaauuaugaagaacccaacaguugaugguauuacagugauagaccuggaaccaauaccauaugaccccaaauucgaaaagcaacuaggacaaguaaugcuccuuguucuaugcguaacacaaguguuaaugaugaggacaacaugggcauuaugugaggcuuuaacauuagcaaccggaccaauuucgacauugugggaagggaacccaggaagauucuggaauacaacaauagcagucuccauggccaauauauucagaggaucauaccuggccggagccgguuuguuguuuagcauaaugaagaauacuacuaacacuaggagaggcacgggaaacauuggagagaccuuaggagaaaaguggaagucuagauugaacgccuuagguaagagugaguuucagaucuauaagaaaaguggaauacaagaaguagaucgaacguuggcuaaagagggaauaaagcguggagaaacugaucaccaugcuguaagcagaggauccgcaaaauuacguugguucguggagcggaauaugguaacgccugaaggaaaggucgucgacuugggaugugggagaggaggauggucauacuacugcggcggccucaaaaacgugagagaaguaaagggauuaacaaagggugggccuggucaugaggaaccaaucccaaugaguacuuacggauggaaccucgugcgcuugcaaaguggcguagacguauucuuuacaccuccugaaaaaugugacacacuauuaugcgauauaggggaaaguaguccaaauccuacuauagaagcugggcgcaccuuaagaguucuuaaucuugucgaaaacuggcuuaauaacaauacucaauucugugucaaaguacuaaaccccuauaugccaagcgucauagagaaaauggaaacccuacaacgcaaauacgguggagcucugguucguaauccacugagcaggaacuccacacacgaaauguacuggguuaguaaugcuaccgguaacauaguuucaaguguuaacaugauuucgagaauguuaaucaauagauucaccaugaaacauaaaaaggccacauacgaaccugauguugaccuaggcucaggaacucgaaacauaggaauagaaaaugaaauaccaaacuuggauauaaucgguaagagaaucgagaagauuaaacaagagcaugagacaaguuggcauuaugaucaggaucaucccuacaagaccugggcauaccaugguuccuaugaaacaaaacaaaccggcucagccucgucaaugguaaaugguguaguaaaauugcuaacuaagccaugggauguuguaccaauggugacccagauggcuaugacagauacaacucccuuuggccaacaacggguauucaaagaaaaaguagauacuaggacacaagaaccaaaagagggaacaaagaaguuaaugaggauuacagcagaguggcucuggaaagaacuagguaagaagaaaacuccucguaugugcacaagagaagaauuuacgagaaagguaagaaguaaugccgcucugggugcgauauuuaccgaugaaaauaaauggaaaucugcgcgcgaagccguggaagauagcagauucugggaguuagucgauagggagagaaauuugcaucuugaaggaaaaugcgagaccugcguauacaauaugauggguaaaagggaaaagaaauuaggcgaauuuggaaaagcaaaagggucucgugcgauuugguauaugugguuaggcgcaagauuccucgaauuugaagcacuuggauuucuuaaugaagaucacugguuuucacgcggaaacagucuaaguggaguggaaggugaagguuuacauaaacuagguuauauuuuaagagauguaagcaagaaagagggaggagcgauguaugcugacgauacagcaggaugggacacuaggauaacacucgaagauuuaaagaaugaagaaaugguuacaaaucacaugaagggcgaacacaagaaauuagcagaagcaauauucaaguugacguaccaaaacaaaguagugagaguccaacgcccuacaccccggggaaccgucauggacauuaucucuagaaaagaccagcgaggaaguggucaaguaggaacguauggacuaaacacuuucacuaacauggaggcacagcuaauaagacaaauggaaggugaagggauauucaagucaauacagagauuaaccguaacagaggaaauagcaguccaaaauugguuaguaaggguaggacgcgaacgauuauccagaauggccgugaguggagaugacugcguaguaaaaccacuggaugauagguuugcuagugcauugaccgcauuaaaugauauggggaaaguucgaaaggauauccagcaaugggaaccaucccgaggguggaaugauuggacacaggucccauucuguagucaucauuuucaugaauuaguaaugaaggauggucgaguauugguaguccccugucguaaccaggacgaacuaauaggcagagcacguauuagucagggagcgggauggucccuaaaagaaacagcgugcuuagguaaaagcuaugcccagauguggacacuuauguacuuucacagaagggaucuucgauuagcggcuaaugcgauauguucagcggugcccucacacuggguacccacuucacguacaacauggucaauccaugcuaagcaugaauggaugacgacagaagacaugcuagcuguauggaacaggguuuggauccaagaaaacccuuggauggaagacaaaacuccgguagaaaguugggaagagguaccuuacuuagguaaaagggaagaucaauggugcggcagucucauagggcuaacaagccgagcaacaugggccaaaaauauccaaacagcgauaaaccagguucgaagccugaucggaaacgaagaauauacagacuauaugccgaguaugaagagguuucggaaggaggaagaagaagcugguguucuuugguga

SEQ ID NO: 22532 - RNA, 9876 nt, Artificial Sequence
  derived and/or modified CDS sequence (opt6) from DENV-2__EU529693__SS-prME
acagcaggaguuauaauaauguuaaucccuacagcuauggcguuccauuuaacaacacgaaauggagaaccucacaugauuguuggacgacaagaaaaagguaaaucucuguuauuuaaaaccgaagacggagugaacaugugcacucugauggcuauugauuuaggagaauuaugugaagacacuauuaccuacaaaugucccuuauuacgacaaaaugaaccugaagauaucgauuguugguguaauucuacaucuacaugggugacuuauggaacuuguacaacuacaggcgaacacagaagagagaaacgaagcgucgcacuugucccgcaugucgguauggguuuagaaacacgaacagaaacuuggaugagcucagaaggugcauggaaacacguacaacggauagaaaccuggauauugagacaucccgguuucacaacaauggcagcaauacuagcauacacuauuggaacaacucauuuucagcgagcacuaauauucauacuguuaacagcgguagcaccaaguaugacgaugagauguaucgggauaaguaacagagacuucguagaaggagucucagguggaaguuggguggauauuguucuagaacauggaucuugugucaccacaauggcuaaaaauaaacccacacuagacuuugaauugauaaaaacggaagcuaaacaaccagcuacuuuacgaaaauauugcauagaagccaaacuuaccaacaccacaacagagagccgauguccaacccaaggagaaccuucauugaaugaagaacaagauaagagauuuaucuguaaacacucuaugguugacagaggcuggggaaacgguuguggauuguuuggaaaaggcgguauuguaacuugugccauguuuacaugcaagaagaauauggaaggaaaaguagucuuaccggaaaaucuugaauauacaauaguuauuacaccacacucaggagaagaacacgcagugggcaaugauacugggaagcacggaaaagagaucaagauuacaccccaaaguucgaucacggaagccgaacuaacagguuauggcacagucaccauggaauguagcccuagaacgggacuggacuuuaacgagaugguuuuacuacaaauggaagacaaggcuuggcuuguucaucgucagugguucuuggaucugccguuaccauggcuaccaggagccgacacgcaagguucuaauuggauacagaaagaaacguuagucacuuuuaaaaauccucacgccaagaaacaagacgucgugguacugggaucgcaagagggagccaugcacaccgccuugacgggggccaccgaaauucaaaugucaagugguaaccuauuguucacuggacauuuaaaaugcagacuacgaauggacaaauuacaguugaaaggaaugagcuauucgauguguacgggaaaauuuaagaucguaaaggaaaucgccgaaacacaacauggaacgauuguuauaagaguacaauacgagggugauggcucgccgugcaagauccccuuugaaauaauggaccuagagaaaaggcauguacuagguagguuaaucacuguuaaccccaucguaacugagaaagauucuccagugaauauugaagcggaaccacccuuuggcgauucauauauaauuauagguguagaaccgggacaacuaaaacuaaauugguuuaaaaagggaucgagcauuggccaaauguuugagacuacaaugcguggagccaaacgaauggcaauacuaggggacacagcaugggauuucgggucacuaggggguguauuuacguccauaggaaaagcauugcaccaaguauuuggggccauuuauggggcugcauucagcgguguaucguggacaaugaaaauccuaauuggaguuauuauuacauggauaggaaugaacucgcgaaguacaagucuaaguguaucguuaguucucguuggaauugucacacucuacuuaggcguaaugguacaagcagauacaggauguguagucaguuggaagaacaaagagcuaaaguguggaucaggaaucuuuauaaccgauaauguucauacguggacagagcaguauaaauuucagccagaaaguccgaguaaacucgcuagcgcaauacaaaaagcccaugaagaagguauuugcgggauccgaucugugacccgacuggaaaauuuaauguggaaacaaaucaccccagaauuaaaccacauauuaucagaaaacgaggugaaacuaaccauaaugacgggagacauuaaagggauuaugcaagcgggaaaacggucccugagaccacaaccaacggagcuuaaguauucguggaagacgugggggaaagcuaaaaugcuuuccacagagucacauaaucaaacauuuuugaucgacggucccgagacggccgaaugcccaaacaccaauagagcauggaacucacuggagguagaggauuacggauuuggaguauuuuccacuaauauauggcuaaaguuaagagaaaaacaagacguauucugugacucaaaauugaugucagcugccauaaaagacaaucgugcgguccaugcagauauggguuacuggauagaaucagccuuaaacgauacuuggaagauggagaaggcauccuuuaucgaaaucaagucaugucacuggccgaaaucacauacacuuuggucaaauggagugcuugagagcgagaugauaauaccuaaaaauuucgcgggaccaguaucgcaacacaauuauagaccgggauaucacacacaaacagcaggcccuuggcauuuaggcaaacuugaaauggauuucgacuucugugaagguacuacaguugucguaacugaagacugugggaauaggggcccaucacuccgcaccaccacggcgaguggaaaacuaauuacugagugguguugcagaucaugcacccuaccgccucuacgauaccguggugaagaugguuguugguaugguauggagaucagaccucucaaagaaaaagaagaaaaucuagucaauucuuuaguuaccgccggacauggacaaaucgacaauuucucucuuggggugcuggggauggcacuauuucuagaagagauguuaagaacuagaguagguacuaaacaugcaauacugcuagucgcagucaguuucguuaccuuaauaacagggaauaugagcuuuagagacuuaggacguguaauggugauggucggagcaacaaugacagaugauaucggaaugggagucacauaucucgcauuauuagcagcauuuaaaguuaggccuacauuugcugccggucuauugcuuagaaaauuaacaaguaaagaauugaugauggcuacuauugggauagcuuuguuaucucaguccacaauaccagaaacuauauuggaauuaaccgaugcucuagcgcucgguaugauggucuugaaaauugucagaaauauggaaaaguaccaacuugcugucacuauaauggcuauauccugcguuccaaaugccguaauacuacagaacgcauggaaaguaaguugcacgauauuggcugcaguuagugugucuccauuguuauuaacuucaucacagcagaaagcugauuggauucccuuggcgcuaaccauaaaaggguuaaaucccacagcaauauuccuaacaacguuaaguagaacuucaaagaaaagguccuggccccuuaacgaagcagucauggccgucgggaugguuagcauacucgcaucuucacuacuuaaaaaugacauucccaugacaggaccguuaguugcaggaggccuauugacagucuguuacguuuugacuggacgaagugcugacuuagaacuagagagagcggccgauguuaaaugggaagaucaagcagaaauuaguggcuccaguccaauuuugucaauuacaauuuccgaagaugguagcaugucaauuaaaaaugaggaagaggaacauacacuaacuauacugauccggacugguuugcucguaauuagugguguuuuuccaguaucaauaccaauaacagcugccgcuugguacuugugggaaguaaagaaacaacgagcuggagugcuuugggacguuccuucuccgccucccgucggaaaagcugaauuagaagacggagcuuaccgaaucaaacaaaggggcauauuuggauauucacaaauuggcgcugguguauacaaggaggguacauuucauacaauguggcaugugacuagaggcgcuguuuuaaugcaucgaggcaaacggauagaaccguccugggcugauguaaagaaggauuuaaucucauauggaggaggguggaaauuagaaggugaguggaaagagggcgaagaaguccaaguacuagcguuagaaccuggcaaaaauccaagagccguacaaacaaaaccuggacucuucaagacaaauaccggaacgaucggugcgguaucacuggacuuuucgcccgguacaucaggcaguccuauuguugacaggaaaggcaaaguuguuggacuauaugguaacggcgugguaacacgaucgggagcauaugugucggcuaucgcgcaaaccgaaaaaucaauagaagacaauccugaaauugaagacgauauuuucagaaagaaacgauugacgauaauggauuuacacccuggcgccggaaaaacuaaacgauaucuuccagccauaguaagagaagcgauaaagagaggccuuaggacgcucauuuuggccccaacacgaguugucgccgcugaaauggaagaggcuuuaagaggacugccgauuagguaucaaacgccugcuauaagggcagaacauacgggacgagaaauuguagacuuaaugugucaugcaacauucaccaugcgccuuuugaguccugugcgggugccaaauuauaaccuaauaauuauggaugaagcgcacuucacugacccagcgucaauugcagcucguggauauauaucgacgcgagucgaaaugggagaagcagcaggaauuuucaugaccgcaacgccaccugggaguagggauccuuuuccucaaagcaaugcacccauuauggaugaagaacgggaaauacccgaaagaucauggaacucaggccacgaguggguaacagacuuuaaaggaaaaacgguuugguuuguaccgucaauaaaagcaggaaaugacauagcggccugccuacguaaaaauggcaaaaaggugauacaguuaucaagaaaaacauuugauagugaauauguaaaaacacgugccaaugacugggauuuuguaguuacuaccgacauaucugagaugggggcaaauuuuagagccgagcgaguaauugacccacgacgaugcaugaaaccagucauuuugaccgauggugaagaacgggucauacuagcagguccaaugccaguuacacauucaucagccgcucaaagacgaggaaggauugguaggaauccuaaaaacgaaaacgaccaauacauuuauaugggugaaccucuagagaacgacgaagauugugcucauuggaaagaagcgaaaaugcuuuuagauaacauaaauacgccggaagguauaauaccaaguauguuugagcccgaacgggaaaagguggaugcuauugacggggaauaucguuuaaggggagaagccagaaagacauucguagaccuaaugagaagaggugaccuuccaguuuggcuugcuuacagaguugccgcugaaggcauaaauuaugccgauagacguuggugcuucgauggaaucaaaaacaaucagauccuugaagaaaacguggagguagagauauggacgaaagaaggugaacgaaagaagcugaagccacguugguuagacgcaagaauauauucagauccacuagccuuaaaagaauuuaaagaguucgcagcgggacguaaaagucuuacacucaauuuaauaacugaaaugggucgauugccaacauucaugacccagaaagcuagagaugcauuagauaauuuggccgucuugcauacugcugaggucggaggacgagcauauaaccacgcauugucagagcuucccgaaacacuagagacgcuacuuuuauuaacucuuuuggcuacugucacaggcggcauauuuuuauuccuaaugucaggcaaagguaucggaaaaaugacuuuaggcaugugcuguauaauuacagcaucaauauuacuuugguacgcccaaauucaaccgcacuggauagcugcauccauuauacuagaguucuuuuuaauuguacuacuaaucccggagccugagaagcagcgaacuccacaagacaaucagcucacuuacguagugauugcaauacuaaccguaguagcagcuacuauggcgaacgaaaugggauuccuagagaaaacuaagaaagaccuuggacuuggaucgauaacgacacaagaaucggaaagcaacauacucgacaucgaucuaagaccggcuucugcuuggaccuuauaugcaguggcuacaacguuuguuacgcccauguugcgucauucaaucgaaaauaguucaguuaauguaucauuaacagcuauugcaaaccaagcaacugucuuaaugggguugggacgaggauggccucuaaguaagauggauauaggcgugccacuauuggccauuggaugcuacagccagguuaauccgauaacacuuacagcagcacuauuauugcuuguugcgcacuacgcaauaauaggaccaggacuucaagccaaggcaacgagagaggcucagaagcggaccgcagccggaauuaugaaaaaucccacagucgauggaaucacagucaucgauuuggaaccaauaccuuacgacccaaaauuugagaaacaguuaggacaagugauguuguuaguacuaugcgugacccaaguucugaugaugcguacaaccugggcacuaugugaggcccugacauuagccacuggcccuauaucaacacucugggaaggaaauccaggacgauucuggaauaccacgauagcaguaucaauggcgaacaucuucagagggagcuauuuagcuggagcgggguuacuauuuuccaucaugaaaaauacgacuaacacgagaagaggcacugguaauauuggcgagacauugggcgaaaaguggaagagucguuugaacgcccuugguaaaucugaauuucaaauuuauaagaaaucgggaauacaggaaguggacaggacauuagcgaaagaggguauuaaacguggagagacugaucaucaugcaguaucacgagguagugcgaaacuaagaugguuuguagaaaggaacauggugacucccgaggguaagguuguagauuuagguuguggacgaggcggguggucuuauuacuguggaggacucaaaaacguccgagagguaaaaggcuugaccaaaggagguccgggccaugaagaaccuauaccgaugucuaccuacgguuggaacuugguaagacuucaaucagggguagauguauucuuuacgccaccagaaaagugugacacucuacuaugugauauuggagaaucaucaccuaacccuacuaucgaagcaggucgaacguuaagaguucucaaccuaguagagaauugguuaaauaacaauacucaguuuuguguaaaagucuuaaauccauacaugccuucgguaauagagaaaauggaaacacuucaaagaaaguaugguggggcguuaguaaggaaucccuuaucucgcaauucaacccacgaaauguacuggguaagcaaugcuaccgguaacauaguuucaucaguuaauaugauaucgagaaugcugauaaauagauucacaaugaaacacaagaaagcaaccuaugaaccugauguggacuuaggaucaggaacuagaaacauagggaucgaaaaugaaauuccaaaccuugauaucauugguaaacguauugaaaagaucaaacaggagcacgagacauccuggcauuacgaccaagaccacccauacaaaacuugggcuuaucacggaucauacgaaaccaaacaaacagguuccgccucgaguaugguuaauggcgucguaaaacuacugacgaaaccaugggaugucguacccaugguaacacaaauggcaaugaccgacacuacgccauucggacagcaacgaguauuuaaggaaaagguagacacaagaacccaagagcccaaagaggguaccaagaaacugaugagaauaacggcugaauggcucuggaaagaacuuggcaagaagaaaacuccacgaaugugcacaagggaagaguuuacaagaaaaguccgaucaaaugcagcauuaggagccauauuuacagaugaaaacaaguggaaaucagcgagggaagcagucgaagauucuagauuuugggaguugguugauagggaaagaaaccuacauuuagaaggaaaaugugaaacuugcguauacaauaugauggguaaacgagagaaaaaguuaggugaauuuggcaaagccaaaggaucaagagcaauaugguacaugugguugggagcuagauuccuugaguucgaggcgcuugguuuccugaaugaggaucauugguucucgagaggcaauagccuaagugguguagagggugaagggcuucacaaguugggauacaucuugagagacguaaguaaaaaggaaggcggcgcaauguacgccgaugauacagcaggcugggacacacgaauaacauuagaggaucucaaaaaugaggaaaugguaacuaaucacaugaaaggggaacauaaaaagcuagcagaggcuauauuuaaacuuacauaucaaaacaaagucguaagaguacaacgaccuaccccacgaggaacaguaauggauaucauaucacgaaaagaucagaggggaagugggcaaguagguacuuacggauuaaacaccuuuacgaauauggaagcccaauugauacgacagauggaaggagaaggaauauuuaaaucuauacaacggcugacuguaacagaagaaauagcuguccaaaauugguuagcaagaguuggacgugaaagacucucuaggauggcuauaaguggagacgauuguguugugaagccuuuggaugauagguucgcauccgcacuuacggcacuaaacgacaugggaaagguucgaaaagauauacagcaaugggaaccuagucgagguuggaaugauuggacucagguaccguucuguucacaucacuuccaugaauugguuaugaaagacggaagaaugcuaguuguuccgugucgaaaucaagacgaacuaauuggaagggccagaauuagucaaggcgcgggauggucauuaaaagaaacagcuugcuuaggaaaaagcuaugcccaaauguggacacuaauguauuuucauaggagagaccuacgucuagccgccaaugcaaucugcucagcagucccuucacacugggucccuaccucaagaaccacauggagcauacaugcuaaacacgaauggaugaccacagaggauaugcucgcgguuuggaauaggguauggauccaagaaaacccauggauggaagauaaaacaccggucgaaaguugggaagaaguccccuaucuagguaaaagggaggaucaauggugugggucacuuauuggauuaacaucacgagcaaccugggcgaagaauauucaaacagcuauuaaucaaguucgaucauuaauaggaaacgaagaguacacugauuacaugccaaguaugaaacgauucaggaaagaagaagaagaagcaggaguucuuugguaa

SEQ ID NO: 22533 - RNA, 9876 nt, Artificial Sequence
  derived and/or modified CDS sequence (opt6) from DENV-2__EU482557__SS-prME
acggcuggcguaauaauaaugcuuauaccuaccgcaauggcauuucaccuaaccacaagaaauggugaaccgcauaugaucguugggcgucaagaaaaaggcaaaucuuuauuauuuaaaacagaagaugguguaaauauguguacacuuauggcuauugauuuaggugaauuaugugaagauacgauaacauacaaauguccacuacugagacaaaaugaaccagaagacauugacugcugguguaacagcacgucgacguggguaacauacggcacuuguacuacaaccggcgaacauaggagagagaaaagaagcguagcauuagucccccaugucggcaugggguuagaaacuagaacggaaacauggaugucuucagaaggagcauggaaacacguccaacgaauugaaacauggauucugcgacaucccgguuuuacaauaauggcggcaaucuuagcauacacuauagggacuacacacuuucaaagagcucuaaucuuuauacucuugacagcaguagcaccuucaaugacuaugagauguauaggaauuucgaaccgagauuucguagaaggcguaucugguggaucaugggucgacauaguacucgaacacgggucaugcguuacaacaauggccaaaaauaaaccaacuuuggacuuugaacucauaaaaacggaagcaaaacaaccagcaacguugagaaaauacuguauagaagccaaacucacuaauacaacaacagagucccgcugcccuacucaaggagaaccuaguuuaaacgaagaacaggauaaaagguuuauaugcaaacauagcaugguugaccguggaugggguaacgguuguggacuguuugguaaaggaggaauugucacaugcgcgauguucacauguaagaaaaauauggaaggcaaaguggugcuaccagaaaaucuagaauauacgauagucaucacaccccacucaggagaagaacacgccgugggcaacgacaccggaaaacacggaaaagaaauaaaaauaacaccucagucauccauuacugaagccgaauuaacgggauaugguaccgucacuauggaaugcucgccaagaacuggacuugacuuuaaugaaaugguauuauuacaaauggaggauaaagccuggcuaguacauagacagugguucuuggaucuaccucuuccauggcuaccuggcgcagacacucaaggcuccaauuggauccaaaaagaaacuuuggucacuuuuaaaaacccucaugcuaagaaacaggauguaguaguuuugggaucacaagaaggggcgaugcauacugcccuaaccggagcgaccgaaauacaaauguccucuggaaacuuacuauuuaccggacaucuaaaaugcagacuucgaauggacaaauugcaauuaaaaggcaugucguauucaaugugcacaggcaaauuuaaaaucguaaaagagauagccgaaacacaacauggaacaauuguuauacggguacaguaugaaggugacgguucaccuugcaaaauucccuucgaaauaauggaccucgagaaaaggcacguauuagggcgauugaucacugugaacccuauaguaacagaaaaagauucgccugugaauauagaagcagaacccccuuucggcgauucauauaucauaauugguguagaaccgggacaauuaaaauugaauugguucaaaaagggaucuucaauaggacaaauguucgaaacuacuaugcgaggugcgaaacgaauggcgauccugggggacacagccugggauuucggaucauugggaggaguuuuuacaucaauaggcaaggcacuucaucaaguguuuggugcaauauacggcgcggcauucucgggaguaucguggaccaugaagauacucauuggcgucauaauuacguggauugggaugaacucaaggucuacgagucuaucagugagccucgucuuaguuggaguuguaacucucuacuugggaguaaugguucaagcagauucaggauguguuguaaguuggaaaaauaaagaguugaaaugcgguagugggaucuuuauuacagauaauguacacacuuggacugaacaauacaaauuucaaccugagucaccgaguaaauuagcauccgcuauccaaaaagcacacgaagagggcauuuguggaauaagaucagucacgcggcuugaaaaucuuauguggaagcaaauaaccccugagcucaaucauauacucagcgagaaugagguaaaacuaacaauaaugacaggugauauaaaagguauaaugcaagcaggaaaaagaaguuugcgaccacagccgaccgaacugaaauauucuuggaaaacuuggggaaaagcaaaaaugcuuucaacagagucacacaaucaaacguuuuuaauugaugguccggaaacugcugaaugccccaauacuaauagagcuuggaacucgcuggagguggaagauuacggauuuggaguauucucuacuaauauuuggcuaaagcuaagagaaaaacaagauguauucugugauucaaaacuaaugucagcugcuaucaaggacaauagagcaguccaugcugauaugggauauuggauugagagugccuugaaugauaccuggaaaauggaaaaagccucuuucauagaaguaaaaucgugucauuggccgaagucucauacacuauggagcaauggaguuuuagaaucugaaaugauuauaccgaaaaauuucgcagguccaguuucccagcauaacuacagaccuggcuaucauacccagacugccgggccauggcaccucggaaagcuggaaauggauuuugacuuuugugaagguacuaccguaguggugacggaagauuguggcaacaggggccccucucuuagaaccacaacagcaucaggcaaguugauaacagaaugguguugcagaucaugcacuuugccaccauuacgauacagaggagaggaugguugcugguacggaauggaaauacgaccacugaaagaaaaggaagaaaacuuaguaaauucacugguaacagcaggacacggacaaauugauaacuuuucccuugguguguuaggaauggcucuauuuuuagaggaaauguuacgaaccaggguagguacgaaacaugcaauccuauugguggcggugagcuucguaacgcugauaaccgguaauaugucuuuccgugaucuaggaagagugaugguuaugguaggagcaaccaugacugaugauauaggcauggguguaacuuacuuagcacuauuagcugcuuuuaaagucaggccaaccuuugcugcagguuuguugcuccgaaaguuaacgucaaaagaauugaugauggcgacgauaggcauagcacuacugucccaaucuacgauuccagaaacuauacuugaauugacagaugcuuuagcuuugggcaugaugguacuuaagauuguucgaaauauggaaaaauaucaguuagcugugacaaucauggcaauaucaugcguucccaaugcagucauucuucaaaaugcauggaagguaucuugcacaauuuuagcagcaguaucaguauccccauuauuacuuacaucaucucaacaaaaagcagauuggaucccacuagcuuuaacaauuaaagguuugaauccaacugcuauauuucuaacgacccuaucacgaacuuccaagaaacguagcuggccgcugaaugaagcaguaauggcuguuggcaugguuaguauucuugcgucaucacuccugaaaaacgauauaccuaugacggguccacugguugcaggcggauugcuaacaguuuguuauguuuuaacaggaagaucagcugaucuagaacuagaaagagcugcggaugugaagugggaagaucaagccgaaauaucagggucuucuccuauacuaaguauaacaauaucugaagauggaucaaugaguaucaaaaaugaagaagaagaacacacgcucacaauccuuauuaggaccggacuauuagugauaucuggcguuuucccggugagcauuccaauaacagcugcagccugguauuugugggaagucaagaaacaaagggcugguguucuaugggacguaccuucgcccccaccggugggaaaagcagagcucgaagauggagccuauaggauaaaacaacgcgggauauuuggauauucucaaauaggcgcuggaguauacaaggagggcacauuucacacuauguggcacguaacacgaggcgccguacuaaugcauagggggaaaagaauagagccaucgugggcggauguuaagaaagaccugauauccuacggaggaggauggaagcuagagggggaauggaaagaaggagaagaaguacagguucuagcgcuagagccagguaaaaauccgcgagcaguacaaaccaaacccgggcucuuuaaaacuaauacugguacaauuggagcaguaaguuuggauuuuagcccagggacaagcggcagcccaauuguggaccgcaaaggaaaaguaguuggauuguacggcaauggcguaguuacuaggucuggugcguacguaagcgccauagcacagacugaaaagucuauagaagauaacccagagauagaagaugauauauucaggaagaagcgucuuaccauuauggaccuucauccaggggcagggaaaacuaaacgauauuuaccagccauuguucgggaggccauuaagagaggucuacggacauuaauauuagcgccuacaagaguggucgcagccgagauggaagaagcucuaaggggccuaccuauacgauaucaaacuccagcaaucagagcugaacacaccgguagggaaauaguugauuuaaugugccaugcaacuuuuacgaugcgacuacuaagucccguacgcguccccaauuauaacuugauaaucauggacgaagcacacuuuacagaucccgcaaguauagccgcacgaggauacauuucaacucggguggaaaugggagaagcagcagguauauucaugacggcgacaccgccagggagucgggacccauuuccacaaucaaacgcacccauuauggaugaagaacgugaaauuccagaacguucauggaauaguggccacgaauggguaacagacuucaaaggaaaaacugucugguucguaccuagcauaaaagcugggaacgacaucgcagcuugucuacguaaaaauggcaagaaaguaauacaacuauccaggaaaacauuugauucugaauauguuaaaacuagggcaaaugacugggauuucguaguaaccacagauauaagugagaugggugcuaacuucagagcagaacgugugauagauccaagacgguguaugaaaccugucauucuuacagauggugaagaaagaguuauacuugcggguccuaugccgguuacacauucuucagcagcucagagaagaggcagaauagguaggaauccuaaaaaugagaaugaccaauacauauauaugggagagccacuggaaaacgacgaggauugcgcccauuggaaagaggcgaaaaugcuauuagauaauauaaacacgcccgaaggaauuauacccuccauguucgaaccugaacgagaaaagguagaugccauagacggagaguaccgauuaagaggagaagcacgaaagaccuucgucgaucugaugcggagaggagaccuuccgguuuggcuugcauaccggguagcagcugaaggaauuaauuaugcugaccguagguggugcuuugacggaauaaagaauaaccaaauuuuggaggaaaauguagaaguugagauuuggacaaaagaaggugaaaggaagaaauugaaaccgagauggcuagaugcaagaaucuacagugauccgcuugcauuaaaagaauuuaaagaguucgcggcugggagaaaaucacuuacuuuaaaccuaaucacggagaugggcaggcuccccacauuuaugacccaaaaggcacgagacgcuuuggacaaccuugcugucuuacacacagcagagguaggggguagagcuuacaaucaugcuuuguccgaguugccagaaacucuagaaacccuacuacuacuaacuuugcuggcgacagucaccgggggaauauuuuuauuucuaaugagcggaaaaggaaucgggaaaaugacccuugguaugugcuguauaauaacggcuucaauucuccuuugguacgcacaaauucaaccacacuggauagcugcaagcauaauacuagaguucuuccuaauaguacucuugauacccgaaccagaaaaacaaagaacaccucaagauaaccaacuaaccuauguaguaauugcgauucugacugugguggcggcuaccauggcgaaugagaugggcuuucuggagaaaaccaagaaagauuugggauuaggaucaauaaccacacaggagucugagucaaauauacuagauauagaucuccguccagccagugcuuggacguuguaugcgguagcaacuacuuuuguaacuccaaugcugcgucauagcauagaaaauaguagugucaacgugaguuugacagcaauugcgaaucaagcaacuguucugauggggcugggaaggggauggcccuuaaguaagauggauaucggggugccguuauuagcgauagguuguuauagucaaguuaaucccauaacccuaacagcggcuuuacuauuauuaguugcgcauuaugcuauaaucggaccgggauugcaagcaaaagcaacgcgggaagcgcagaaaagaacggcagccggaauaaugaaaaauccuacugucgacgguaucacagucaucgaucuugaaccaaucccguacgauccaaaauuugagaagcaauugggacaaguaauguuacugguacuauguguuacacaaguucugaugaugcguacgacuugggcacuaugugaggcacuaaccuuagcaacggggcccaucucaacgcucugggaaggaaauccuggucguuucuggaauacaaccauagcuguuucaauggcgaacaucuucagggguaguuaccuugcgggagcuggucucuuguuuaguauaaugaaaaauacuacgaauacaagacguggaaccggaaauauuggcgagacguuaggggaaaaguggaaaagcagauugaacgccuuagguaaaucagaguuccaaauuuacaaaaagucggguauucaagaaguagaucguaccuuagcaaaagaaggcaucaaaagaggagagacagaccaucaugccgugaguagaggcucugcuaaauuacguugguucguugaacgcaacaugguuacaccagagggcaaaguaguagauuuaggcuguggaagaggugguuggucauauuauugcggugggcuuaaaaaugugcgggaaguaaaagguuugacaaagggugggccuggacacgaagaaccaauaccaauguccaccuacggauggaaucuugugagacuacaaucgggaguagauguauucuuuacaccaccggagaaaugugauacacugcugugugacauaggcgaaaguucacccaauccuacuauagaagcaggucguacuuuacgugugcuaaauuuggucgagaauuggcuuaauaauaacacgcaauucugcauuaaaguuuuaaacccauacaugccuagcguaaucgaaaagauggaaacacuacagagaaaguauggaggagcccuaguaagaaauccguuaaguagaaauucaacccacgaaauguauugggugucuaacgccacagguaacauugugagcucuguaaacaugaucucucguaugcuuauaaauagguucacuaugaaacacaaaaaggcaaccuacgaacccgauguggaucuagguuccgggacacguaauaucggcauagaaaaugaaauaccuaacuuagauauaaucgguaaaagaaucgaaaagauuaagcaagaacaugaaacuucuuggcauuaugaucaagaccacccauacaaaacuugggcauaucacgguaguuaugaaaccaaacagacaggcuccgcuucuucaaugguaaacgggguagucaaauuauuaacuaaaccgugggacgugguaccgaugguuacccagauggcaaugacugauacaacuccauuuggucagcaacggguuuuuaaagaaaaaguggauacaagaacacaagaaccaaaggaaggaacuaagaaacuaaugcgaauaacagcugaauggcuauggaaggaauuagguaagaagaaaacuccgagaauguguacucgagaggaguuuacgcgcaagguacguagcaacgcagcccuuggugcaauauucacggaugaaaacaaguggaagucagcgagggaagcuguagaagauagucguuucugggaguuaguagacagagagaggaacuuacauuuagaggguaaaugcgaaacaugcguauacaauaugauggggaaacgugagaagaaauuaggcgaauuuggaaaagcuaaaggaagccgggcuaucugguacaugugguuaggagcaagauuuuuagaguuugaagccuuagguuucuuaaacgaagaucauugguuuucgcgaggaaauagccuaagcgggguugaaggugaaggauuacauaaauuaggguacauauugcgggacguaucaaagaaagaaggcggagcaauguaugcagaugauacugcagggugggauacgcguaucacccuagaggaucugaaaaaugaagaaaugguaaccaaccacaugaagggcgaacacaagaaauuagccgaagcaauauucaaacuaacauaccagaacaaagucgugagaguacaacggccaacgccgaggggaacaguuauggacauaauuucuagaaaggaucaaagagguagcggucaagugggaacuuauggucuuaauacuuuuacaaacauggaggcacagcuuauacggcaaauggagggugaagguauauuuaaaucgauacaacgucuaacaguaacggaagagauagcgguucaaaacugguuagcuagaguaggaagagaaagauuaucacgaauggccauauccggagaugauugcguaguaaaaccguuagaugacagauuugcgagugcacuuacagcacuuaacgauaugggcaaggugaggaaggauauccagcaaugggaaccaucuaggggauggaacgauuggacacaaguaccauucugcucacaucauuuucacgagcuugucaugaaggacgguagaguucuuguaguaccgugcaggaaucaagacgaacucaucggucgcgcccgaauaucacaaggagcgggcuggaguuuaaaggaaacggcgugucucggaaaaucauacgcgcagauguggacuuuaauguauuuucaucguagagaucucagauuggcugccaaugcgauauguagcgcaguuccaucgcacuggguaccgacaucgagaacuacauggagcauacaugcaaaacacgaauggaugacaacagaagacaugcucgcugucuggaacagaguauggauacaagagaauccauggauggaagauaagacacccgucgaaucuugggaggagguaccauauuuggguaaacgagaagaucaaugguguggaaguuugauuggauuaacaagucgagcaacaugggcuaaaaauauacagacggcgauaaaccagguaagaaguuuaauagguaaugaggaauacacggacuacaugccaucgaugaagagguuucgaaaagaagaagaggaagcugguguacuuugguga

SEQ ID NO: 22534 - RNA, 9876 nt, Artificial Sequence
  derived and/or modified CDS sequence (opt6) from DENV-2__EU482560__SS-prME
acugcaggaguaauuguuaugcuaaucccaacugucauggcuuuccacuuaacgacucgaaacggugaaccucacaugauuguaggacgucaagaaaaagguaaaucgcuucucuucaaaacugaagacgguaucaacauguguacguuaauggcgauugauuugggagaacugugcgaagauaccaucacauauaaaugcccccuauuaaaacaaaacgaaccugaagacaucgacuguuggugcaauuccacaucaacauggguuacguacgggacgugcacaaccacgggugaacaucggcgagagaaaagaaguguugcauuaguaccacauguugguaugggauuggaaaccagaacugaaacuuggauguccagugagggagcuuggaaacauguacaaaggaucgaaacauggauucugaggcauccugguuucacuaucauggcagcuaucuuagcauauacaauagguaccacacauuuccaacgagcacuaauuuuuauucuguuaacggcaguagcaccuucaaugacaaugcguuguaucggaauaucuaaucgugauuuuguagagggaguuucugggggauccuggguugauaucgucuuagaacacggcaguugcguuacgacaauggccaaaaauaaaccaacucuagacuucgaacucauuaaaaccgaagcuaaacaaccagcaacacuucgaaaauauuguauagaggcuaaauugaccaauacaacuacggagucgagauguccuacgcaaggagagcccucuuuaaaugaagaacaagacaaacgguucaucugcaaacauagcaugguugacaggggcuggggaaacggaugcggucuauucggaaaaggcggaauagugacuugugccauguucaccuguaagaaaaauauggaggguaaaguaguacagccggaaaaccuggaauauacaaucguaauaacaccacauagcggagaagaacacgcagucggaaaugacacuggcaagcaugguaaggagauuaaaauaacuccacagaguaguauaacagaagcagaauuaacagguuauggaacaguuacaauggaauguaguccacggacaggauuagacuuuaacgagaugguauugcuccaaauggaagacaaggcauggcugguacaucgucaaugguuccucgacuugccauuaccgugguuaccaggagcagacacccaagguaguaacuggauucaaaaagagacguugguaaccuuuaagaacccacacgcuaagaaacaagauguggucguacucggaucacaggaaggugccaugcacacugcacuaacaggagcuacagaaauacaaaugagcuccgguaauuugcuauucacuggacaucuaaaaugcagauugcgaauggauaaacuacaguuaaaggguaugucguauucaauguguacuggaaaauuuaaaauaguaaaggaaauagcugaaacgcaacauggaacaaucguaauaagagugcaauacgagggugacggaucaccauguaaaauaccauucgaaauaaccgaucuagagaaacgacacguacuggguagacuaauaaccguuaaucccauuguaacggaaaaagacucaccuguaaauaucgaggcagaaccgccguuuggcgauucauauauaaucauaggcgucgaaccggggcaacucaaauuaaacugguuuaagaaaggaucgaguauaggucaaauguucgagacgacuaugaggggagcuaagcggauggcaaucuuaggcgauacugcgugggacuucgguaguuuagguggcgucuucacuuccaucggaaaggcacuacaccaaguauucggugcgauuuauggagcggcauucucuggcgugaguuggacgaugaagauuuugauuggcgucauaauuacuuggauaggaaugaacucacguucgacaaguuuaaguguuagucuaguuuuaguaggcguugugaccuuauaccuaggcgcaaugguucaggcugauucugggugcguaguuuccuggaaaaauaaagagcugaaaugcggaucaggaaucuuuauaaccgacaauguacacacuuggaccgaacaguauaaauuucaaccagaaagucccucuaaauuggcauccgcaauacaaaaagcucacgaagaagggauuugcggaauuagaagugugacgaggcuagaaaaccuuauguggaaacaaauuacuccugaacuuaaccauauacuaucagagaaugaggugaaauugacaauuaugacaggagauauaaagggaauaaugcaagcaggcaaacgaucacugagaccgcaaccaacagaauugaaauauuccuggaaaacuugggguaaggcuaagauguuauccaccgaaagucauaaucagacauuucuaaucgauggcccagaaaccgcugaaugccccaacacaaacagagcuuggaauaguuuagagguagaagauuacggguuugguguuuucacuacgaauaucuggcuuaaauuaagagaaaaacaagacgcuuuuugcgauucaaaacuuaugagugcagcaauaaaggauaauagagcuguucacgcagacauggguuauuggauagagagcgcauuaaaugauacguggaagauggaaaaagccagcuuuauagaagucaaaucaugccauuggccaaaaagucauacucugugguccaauggaguccuagaaagugagaugauuaucccaaagaauuucgcgggaccggucucgcaacauaaucaucgcccaggcuaucauacucaaacagcgggaccguggcaccuaggcaaacuggaaauggauuuugacuuuugcgaagguaccacgguagucguaaccgaagacuguggaaauaggggacccagcuugagaacuaccacugcuucuggcaaacuuaucacagagugguguugucggucuuguacacuaccuccguuacguuacagaggggaagaugggugcugguauggaauggagauucgcccuuuaaaagaaaaggaagagaauuuaguaaacagucuuguuacggcaggacacggccaaauugauaacuuuucuuugggaguguuaggaauggcauuauuuuuagaagaaauguuacgaacgaggguugggaccaagcaugcaauccuauugguagcuguaagccuagucacccuaauuacagguaacaugaguuuuagagacuugggaaggguaaugguuaugguuggggcaacaaugacagaugacauagguaugggaguaacuuauuuggcguugcucgcggcuuucaaaguacgucccacauuugcugcuggauuauuacuucgaaaguuaacaaguaaagaacuuaugauggcuacaauaggcaucgcacuccuaucccaguccacgauaccggaaacaauucuagaauuaaccgacgccuuagcuuuagggaugaugguauuaaaaauaguaaggaauauggaaaaauaccaacuggcaguaacuauaauggcaauaagcugugugcccaacgcaguaauacuccagaaugcauggaaagucucauguacaauacuagccgcaguaucggugucaccucuuuuacuaacaucaagucaacaaaaggcugauuggauacccuuagcacuuaccauaaaaggauuaaacccuacagcuauauuuuuaacuacguuaucuaggacaagcaaaaagagaucguggccuuuaaaugaagcaauaauggccguagguaugguaucgaucuuggcgagcucauuacucaaaaaugauaucccuaugaccgguccgcuaguugcagggggucuacuuacaguuuguuauguucuuaccgguagaucagcagaccuagagcuagaaagagcugcggacguuaaaugggaagaucaagccgaaauaagcggaagcaguccuauacuaucaauaacuauuagugaagauggaucuaugagcauuaaaaaugaagaggaggaacagacucuaacuauacuuauuaggacuggucugcuagugauaucugggguguuuccaguuuccauaccuauaacagccgccgccugguacuugugggaaguuaagaaacagagggccggcguacuaugggauguccccaguccaccaccuguagagaaagcggaguuagaagacggugccuaucguauaaagcagcgaggauuucugggcuauagucaaauaggcgcaggaguauauaaagaagguacauuucauacuauguggcacguaacaagaggagcagucuuaaugcacagaggaaaacguaucgaaccaucuugggcugacgugaagaaagaccuaauaucauauggggguggauggaaacuagagggagaauggaaagaaggugaagaagugcagguucuagcauuagaaccagguaagaauccaagagcuguacaaacuaaaccaggcauauucaaaacaaacacaggaacuauaggcgcaguaagucuagauuuuucaccaggcacaaguggcucaccuauuguggaccgaaaagguaaagucguaggacuuuacgguaacggaguaguuacuaggucuggagcuuauguuucggcaauugcacagacggagaaaagcauagaaaauaauccagaaauugaagacgauauauuucggaagaaacgucucacgauuauggaucugcauccaggagcuggaaaaacaaaacguuaucuuccagcuaucguucgagaggcaauaaaaagaggucuaagaacauuaaucuuggcaccaacucguguuguggcagcggaaauggaggaagcucugagaggcuugccuauaagauaccagacuccagcaauuagggcagagcauacagggagagaaauaguggaccuaaugugccaugcuacauuuacaaugagauugcuaucucccgucagagucccaaacuacaaccucaucauaauggaugaagcucauuucacugauccggcaagcauagccgcccggggguacaucaguacacguguagagaugggagaagcagcgggcaucuucaugacugcuacuccucccgguucaagagauccauuuccccaaaguaacgccccuauuauggacgaagaacgugaaauaccggaacgaaguuggaacaguggccaugaguggguaacagacuucaagggaaagacuguaugguucguaccgaguauaaaagcuggaaaugacauagccgcuugccuuagaaagaacgguaaaaaggucauucaacuuagucgaaaaacguucgacagugaauauguaaaaacaagggccaacgauugggauuuuguaguuacaacugauauuucagaaaugggcgcgaacuucaaagcagagagggugauagaucccagaagauguaugaaaccuguuaucuugaccgauggagaagaaagagucauauuggcugguccaaugccgguaacucauucaucagcagcccagcgacgggguagaauaggacgaaaccccaaaaaugaaaaugaucaauauauauauaugggagaaccucucgagaaugaugaagauugugcacacuggaaagaggcgaaaaugcuuuuagacaauauuaauacuccugaaggaaucauacccucuauguuugaaccagagcgcgaaaagguggacgcaauagauggagaauaucgauuaaggggagaagcuaggaaaacauuuguugaccuuaugagaagaggugaucuucccguguggcuagccuauaaagucgcugcagaaggcauaaauuaugcggacagaaaaugguguuucgaugguaucaaaaauaaucaaauauuagaagagaacguagagguugaaaucuggacaaaggaaggggaaaggaagaaacuaaaaccaagguggcucgacgcuagaauauacagugauccacuagcguugaaggaauuuaaagaguucgcggcuggucggaaaucauuaacacucaauuuaaucacggaaaugggcagacugccuacuuuuaugacacagaaagccaggaaugcauuggacaaucuagcaguccuacacacagccgaagcugguggcagagcauauaaccaugcucuaucagaacuucccgaaacacucgaaacacugcuuuuauuaacacuacuagcuacaguuacaggcggcauauuuuuauucuuaaugucuggaaaggggauuggcaaaaugacauuaggcaugugcuguauaauaacggccaguauucuucuaugguaugcucagauucaaccucacuggauugccgcgucuauaauacuagaguucuuuuuaauuguacuacuaauaccugaaccagaaaagcagaggacuccgcaggacaaucaauuaacauacguaguuauugcaauucucacagugguugcggcuacaauggccaacgaaauggguuuucuagagaaaaccaagaaagaccuaggucuaggauccauaacaacccaagaaucugagucaaauauccucgauauugauuuacgaccggccuccgcauggacucuauacgcaguugcgacgacuuuugugacuccgaugcuaagacauaguaucgaaaacagcagugucaauguaagccuaacagcaauagcuaaucaagcgacaguauugaugggccuugggaaaggauggccacuauccaaaauggauauaggaguaccguugcuagcuauaggauguuauagccagguaaauccgauaacacuaacggccgccuuauuauuacuuguggcgcauuacgcaauuauuggaccaggucuccaggccaaagccacgcgagaagcccaaaaacgagccgcugcgggaauuaugaaaaauccaacggucgacggaaucacaguaaucgacuuagaaccaauacccuaugacccuaaauucgaaaaacaacuaggccaagucauguuauuaauuuuauguguaacucaaguuuuaaugaugagaaccacuugggcuuuaugcgaagcgcuuacacuagcuacaggaccuauaaguacgcucugggagggaaacccugggcgguucuggaauacuacaauagcaguaucaauggcgaauauuuuucggggaucauaccuggcaggcgcgggauuacuuuucaguauuaugaaaaauacaacgaacacucgacgcgguacaggaaauaucggugaaacuuuaggggaaaaauggaaaucgcgucucaaugcucuggguaaaucagaguuccaaauauauaagaaaaguggcauucaagaaguugaucguacauuagcaaaagaaggcauaaaaaggggcgaaacagaucaucacgcagugucaaggggaucugcuaaauuaagaugguucguugaaagaaauaugguaacgccugaggguaagguaguagacuugggaugcggacgaggcgguuggucuuacuacuguggugggcugaaaaauguaagagagguaaaaggguugacaaagggagguccaggacacgaggagccaaucccuaugagcacauauggguggaacuuaguaaggcuacaaaguggcguagacguuuucuuuacgccuccugaaaagugcgauacacuguuaugcgacauuggugaaagcaguccgaauccaacgauagaggcagguagaacacuaagaguuuuaaauuuaguagagaauuggcuaaacaauaacacccaauuuuguauaaaagucuugaacccuuauaugccauccgugaucgagaaaauggaaacccuacagcgcaaguauggcggugcucuugugagaaacccauuaaguagaaauagcacacaugaaauguacuggguuaguaaugcuacagguaacauagugagcucaguaaauaugauaaguagaauguuaauuaacagauuuacaaugaaacauaagaaagcuacuuacgaaccagauguagaccuaggaucagguaccagaaauauaggaauugagagcgagauuccgaaucucgauauuauaggaaaacgaauagagaaaauaaaacaggaacacgaaacaaguuggcacuaugaccaagaucacccauauaaaacgugggcauaccacggcucguacgaaacaaagcaaacaggauccgcaagcagcauggucaauggaguaguacgacugcuuacaaagccaugggacgugguuccaaugguuacucaaauggcuaugaccgacacaacuccauucggacagcagagaguuuucaaagaaaaaguggauacaagaacccaagagccgaaagaggguacuaagaaauuaaugaaaaucacugcugaaugguuguggaaagagcugggaaagaagaaaacuccaagaguuugcacaagagaggaguucacaagaaaaguuagaucaaaugcagcacucggagcuauuuuuaccgaugaaaacaaauggaaaucagcacgugaggcgguagaggacgggagguuuugggagcuaguugauagagaaagaaaucuacacuuagaaggaaaaugugagacauguguauacaacaugaugggaaaacgagagaagaaauuaggagaauuuggaaaagccaaggggaguagggcaauaugguauauguggcugggagcucgcuucuuagaguuugaagcacuaggguuucuuaacgaagaccauugguuuucaagaggaaacucacucucaggaguagaaggagagggacugcaccgacuaggcuacauccuuagagacguagggaaaaaggaaggaggggccauguacgcugaugacacggcuggaugggacacuagaaucacuuuggaagaccucaaaaaugaggaaauggugacuaaccauaugaaaggcgaacauaagaaacuugcggaagcgauauuuaagcugacauaccagaauaaaguagugcgcguucagagacccacuccccgagggacgguaauggauauaauuucgagaagagaccagagaggaucaggacaaguggguacuuauggauuaaacacauucacuaauauggaagcucagcuaauuagacaaauggaaggcgaaggaauauuuaaaaguauccaacacuugacggccacugaagaaaucgcugugcaaaauugguuagcacguguaggaagagaaagacucucgagaauggcaauaaguggcgaugacugcguaguaaaaccuauagaugaccgcuuugcaagcgcucugaccgcacuuaacgauauggguaaagugaggaaggacauucagcaaugggaaccaaguaggggauggaaugauuggacgcagguuccauuuugcucgcaucauuuucacgagcuaguuaugaaggacggaaggguccuagucgucccuuguaggaaccaagaugaguuaauuggacgugcgagaauaucucagggugcugguuggucauuaaaagaaaccgcaugcuuaggcaaaagcuaugcacagauguggacccuaauguacuuucacagacgcgaucuacgucuugcugccaaugcaauaugcuccgcuguaccgucucauuggguuccgaccucgagaacgacguggucuauacaugccaaacacgaguggaugacuacagaggauaugcuggcuguauggaacagagucuggauccaggaaaauccauggauggaggacaaaacaccuguagaaagcugggaagaagugccguaucuuggcaaacgagaggaccaauggugcggcagccucaucggacugaccagcagggcuacuugggcuaaaaacauacagacagcgauaagccaagucagaucucuaaucggaaaugaagaauauaccgacuacaugccaaguaugaaacgauuccgccgagaagaagaagaagcgggaguuuugugguaa

SEQ ID NO: 22535 - RNA, 9876 nt, Artificial Sequence
  derived and/or modified CDS sequence (opt6) from DENV-2__EU482561__SS-prME
accgcugguguaauaaucaugcuuauaccuaccgcuauggcauuccauuugaccacaagaaacggagaaccacauaugauaguagguagacaagaaaaaggaaaaaguuuauuauucaaaacagaagauggaguuaauaugugcacacuaauggcaauagaucuaggggaauuaugcgaagauacaauaacuuacaaauguccgcuacugcggcaaaaugaaccggaagauauagacugcugguguaacaguaccaguacuugggugacguauggaacaugcaccacaacaggggaacacagacgggaaaaacgaucagucgcgcuagugccacaugucggcaugggccuggaaacaaggacagaaacauggaugagcucagaaggugcauggaaacauguacaaagaauugaaacguggauuuuaagacacccaggauucacgaucauggcagcaauuuuagcuuauacgauuggcacaacccacuuccagagagcgcuuauauuuauacuucugacagcaguugcaccguccaugacaaugaggugcauagggauaucuaaccgagauuuuguugaaggcgucucuggcggaucuuggguggauauaguacuagaacauggguccugcguaacgacgauggccaaaaauaaaccaacacuggauuuugaauuaauaaaaacagaagcuaaacagccggcaacgcucagaaaauacugcauagaagcaaaacuaacuaauacuacaacagaaucaagguguccaacacaaggagaaccaagucuaaaugaagaacaggauaaaagguucguguguaaacacucuaugguagacaggggauggggaaacggguguggacuuuuuggcaaagggggaauuguaacuugugcaauguucacaugcaagaaaaauauggaaggaaaagugguacuuccggagaaucuagaauauacgauaguuauaaccccgcauaguggagaagaacaugcaguuggaaacgauacggguaaacacggaaaagaaauaaaaauuacuccacaaaguuccauaaccgaggcagagcuuaccggauaugguacaguaaccauggaaugcaguccgcguacggguuuagauuucaaugaaaugguauuauuacagauggaagauaaggcuugguuaguacacaggcaaugguuccuugauuuaccauuacccugguuaccuggcgcugauacucaaggauccaauuggauucagaaagagacauuaguaacguucaaaaauccacacgcuaagaaacaagacgugguaguauuggggagucaagaaggggccaugcauacggcguugaccggugcaaccgaaauccaaaugucgucaggaaauuuacucuuuacgggucacuuaaaaugcagacugagaauggauaaauuacagcugaaagguaugagcuacaguauguguacaggaaaauucaaaauagucaaagaaauugcagaaacacagcauggaacaauuguaauaagagugcaauacgaaggagaugguaguccauguaaaauuccauuugaaauaauggacuuagaaaagcgccauguucuuggaagacuaauuacuguaaacccaauagucgcggaaaaagauucaccugucaauauagaagccgaaccaccauuuggugacagcuauauaauaauuggcgucgaaccggggcaacuaaaacuaaacugguuuaagaaaggaaguucgauuggacaaauguuugaaacgacaaugagaggugccaagcgaauggcgaucuuaggugauacagccugggauuuuggaucccuugguggagucuucaccagcauaggaaaagcacuucaccaaguuuucggggcuauauauggagccgcauuuaguggggugucguggacaaugaagaucuuaauuggaguaauuauaacauggauugguaugaauagccguuccacaagucugucagucagucuaguccugguaggcguagucaccuuauauuuaggcgcuaugguacaggcagauucugggugugucguaaguuggaaaaguaaagaguuaaaaugcgguucggguauuuuuauaacagacaaugugcacacauggacugaacaguauaaguuucaaccggaaucaccaaguaaauuggcaucugcgauacaaaaagcccaugaagaagguauuugugggauuagaucuguuacuaggcuugagaauuuaauguggaaacagauaacgccagaacuuaaccacauacugucggaaaacgaaguaaaacucacuaucaugacuggugauaucaaagggauaaugcaagcagguaaaaggagucuaagaccucaaccuaccgagcuuaaguacaguuggaaaacuuggggaaaagcaaaaauguuauccacagaaagucacaaccaaacguuucuaauagaugguccagagacggcagaauguccaaauacuaauagggcauggaacucacuagaaguagaggauuauggauucggaguauucaccacuaauauuuggcucaaauuaagggaaaaacaagacguguucugcgauagcaaacuuaugagcgcugcaauaaaggacaacagagcgguccaugcagacaugggauauuggauugaaucagcucuuaaugauacuuggaaaauggagaaggccucauuuauugaagugaagucgugccacuggccaaagucucauacccuauggaguaauggcguauuagagucggaaaugauaauuccaaagaauuucgcaggacccguuucucaacauaauuauagaccgggguaucacacucaaacugcagggccguggcaucuaggcaaacuagaaauggauuucgacuuuugcgaggguacaacaguaguaguuaccgaagauuguggaaauagaggcccuucacuucggaccacgacggcaucgggcaaacuaauaacagaaugguguugucgaagcuguacccucccgccacuuagguaccgaggagaagaugguuguugguacggaauggagauaaggccuuuaaaagagaaagaagaaaaucugguuaacucgcugguuaccgcaggucauggucaaauagacaauuuuaguuugggagugcuaggcauggcauuauuucuagaggaaaugcugagaacccggguaggaacaaaacacgcuaugcuguuggucgucguguccuucguaacauuaauuacugggaacaugagcuuuagagaucuagguaggguuaugguuauggugggagcaaccaugacggaugauauagguaugggaauaacguacuuagcucucuuagcugcauuuaaaguaagacccacguucgcugcgggacucuuauuaagaaaguugacaaguaaagaauugaugauggcaaccaucgguauugcacuuuuaucccagaguacaauuccagagacuaucuuagaacucacagacgcacuagcacuagggaugaugguucucaagauaguaagaaauauggaaaaauaccaacuagcaguaacgaucauggcgauuucaugugugccaaaugcgguaauauuacagaacgcguggaaagucucaugcacgauacuugccgcaguaagcguaucaccauuacuguuaacaagcucacaacagaaagcagacuggauuccacucgccuuaaccauuaagggauuaaaccccacugccauuuuccuaaccaccuuaucuagaacaaguaagaaaagauccuggccacuaaaugaagcuaucauggcuguagguauggucagcauuuuggcaagcucauuauugaaaaacgacauaccuaugacugguccucuaguugccggcggacuucugacuguuuguuacguauuaacaggccggucagcagauuuagaauuagaaagagccgccgauguaaaaugggaagaccaagcggagauaucugguuccaguccaauauugaguauaacaauauccgaggauggaaguaugucuaucaaaaacgaagaagaggagcagacguuaacaauacuaauacguacaggguuauuaguuaucaguggaguauuuccggugucaauaccuauaacggcggccgcaugguaccuuugggaagucaagaaacagagggccgguguucuuugggauguacccagucccccuccgguugggaaagcugaauuagaagacggugcguaccguauuaaacaaagagggauucuagguuauucccaaauaggggccgguguauacaaggaagguacuuuccauacaauguggcauguaacaagaggagcaguauuaaugcauagaggaaagcgaauagaaccauccugggccgauguaaagaaggaucuaauaaguuacgguggaggcuggaagcuggagggcgaauggaaagaaggggaagagguccagguuuuagcacuagagccugguaagaacccacgagcuguucaaacaaaaccaggacuuuuuaagacaaauacuggaaccauaggggcagucucacucgauuucucgcccggaacgucuggaagcccuaucgucgauaggaaagguaaaguaguuggcuuauacggcaacggcguaguaacuagaagcggggcuuacgugucagcaauagcccaaacugagaaaaguauugaagacaauccagaaauugaagaugauauauuucguaagaaaagacuaacaauaauggauuuacacccaggugcggggaagacuaaaagguaucuucccgcaauuguaagggaagcgauaaagagaggauuacguacgcuaauacucgccccaacacgaguaguggcugcggaaauggaagaagcauuaaggggucuuccgauaagguaucagacaccagcuauacgugcugaacacacgggcagagaaauaguugaucugaugugucacgcaaccuucacaaugagacuucuaagcccuguacgggucccaaauuauaauuugauaauaauggaugaagcacacuuuacggacccugcaaguaucgcagcucgaggauauauuucuacgcguguagagaugggugaagcagcuggaaucuuuaugacagcaacaccgccugggucucgugacccauuuccgcaaaguaaugcuccuauaauggaugaagaacgagaaauuccugaaagaucguggaacucaggucaugagugggucacugauuuuaaagguaaaacagugugguucguaccauccauaaaagcaggaaaugacaucgcggcauguuugaggaaaaauggcaagaaaguaauucaauuaagucgaaaaaccuucgacagugaauaugucaaaacgcgggcuaacgauugggacuuuguaguaacuacagauauuucagaaaugggcgcuaauuucaaagcagagagaguuauagacccacggcgaugcaugaaaccuguaauccuuacugauggugaagaacgcguaauucuagccggaccuaugccuguaacacacucaagugcggcucaaagaagaggaagaaucggacgaaaucccaaaaaugaaaaugaccaauacaucuacaugggagagccucuugaaaacgaugaagacugugcucauuggaaggaagcuaagauguuacuugacaacauaaauacaccugaggggauaauuccaucuauguucgaaccggaaagggagaaagucgacgcaauagauggcgaauauaggcuaagaggagaggcgagaaagacauucguagacuuaaugaggagaggagaccuaccaguuugguuagcauaccgaguugcagccgagggaauuaauuacgcugacaggagaugguguuuugauggaaucaaaaauaaccaaauucuugaagaaaacguggaaguggaaauuuggacgaaagaaggcgaaaggaagaaacuaaaacccagauggcucgaugcuagaauuuacucagauccauuagcacugaaggaauuuaaggaauuugcugcaggacgaaagagucugacgcuaaaccuaauaacggaaaugggaagacugccgaccuuuaugacccagaaagccagagacgcacucgauaaccucgcgguccuacacacugcugaagccgguggccgggccuacaaccaugcguuaagcgagcuuccugaaacacuggagacguuacuacuguuaacuuugcucgccacggugacggguggaauuuucuuauuccucaugucagggaaaggaauagguaaaaugacucucggaauguguugcaucauuacagcauccauauuauuaugguaugcucaaauucaaccacauuggauagcagccucuaucauucuugaguucuuucuuauaguacuacugaucccggaaccagaaaaacagaggacgccacaagacaaccaacugacauauguugugauagcuauauuaaccgucgucgcugcaaccauggcaaacgaaaugggcuuucuagagaaaacaaagaaggacuuagguuuaggaucaauagcuacgcaggagagcgaaagcaacauacuagacauagaucuuaggccggcaucugcguggacuuuauacgcagucgccacaacuuucguaacaccgaugcugagacauaguauagaaaacaguagcguaaacguuucgcuuacagcuaucgcgaaccaagccaccgugcuaaugggauugggcaaaggauggccgcucaguaagauggacauaggagucccuuuguuagccauuggauguuauucacaggucaacccaauaacuuugacggcugcacuacugcuccucguggcacacuaugcgauaauaggaccgggucugcaagcgaaagcaacaagagaagcccagaaaagggcagcagcggggauaaugaagaauccuacaguugacggaauaacagugauagauuuggaaccaauacccuaugauccaaaauuugaaaaacaauugggucaagucauguuacugauucucuguguuacacaaguacugaugaugagaacaacgugggcccucugcgaggcuuuaacauuagcgacagggccgauaagcacuuuaugggaagguaauccaggaagauuuuggaauacgaccauugcaguuucuauggcaaauauuuuuagagguucauaccuugcuggugcuggguuacuauuuucuauaaugaagaauaccacuaauacacgucgaggcacaggcaauauuggagaaacauuaggagaaaaauggaaaagcagacuuaaugcuuugggaaaaucugaauuucaaauauauaagaaaucagggauucaagagguagauaggacccuagcuaaagaagggaucaaaaggggugaaaccgaccaccaugcuguaucacgugguucagcaaaacuaaggugguuuguugaacguaauaugguaacccccgaaggaaaaguggucgauuuaggauguggaagaggagggugguccuacuauugcgggggccuuaaaaacgucagagaaguaaaaggauuaacaaaaggaggaccagggcaugaggaaccaauaccaaugaguacguacggauggaaccuugugagauuacagucagggguagauguauucuucacuccacccgagaaaugugacacauuauuaugugauauaggagaaucgagccccaacccaacaauagaagcaggacgcacucuuagaguacuaaacuuaguugaaaauugguuaaacaacaacacgcaguucuguauaaaagucuugaacccuuacaugccaucugugauagaaaagauggaaacauuacaacgaaaauaugggggagcccuaguaagaaauccuuuaagucguaacaguacccacgaaauguacuggguuucaaacgcgacugggaauauugugaguaguguaaauaugaucaguagaauguuaauaaauagauuuacaaugaagcacaagaaggcgacuuaugaaccagauguagaucucgggucugguacacgaaauauagggauagagagugaaauacccaacuuagacauuauuggcaagagaauugagaagauaaaacaagaacaugagacaucauggcacuacgaucaggaccacccguacaaaacgugggcauaccacggaucauaugagacaaaacaaacagguucggcguccucgauggucaacggcgucgucaggcuucuaacuaaaccuugggauguuguuccgaugguaacacaaauggcgaugacagauacgaccccauucggacagcaaagaguguuuaaagaaaaaguugacacaagaacccaagagccuaaagaagguacuaagaaauuaaugaaaauaacagcugaaugguuauggaaagagcuaggcaagaagaaaacaccucggauguguacucgagaagaauuuacacgcaaagugaggaguaacgcggcauuaggugcaauauuuacagacgagaauaaauggaaauccgcaagagaagcuguagaggacucaagauucugggaacuaauugaucgcgaaagaaaccuacaucucgaaggcaagugugaaacauguguuuauaauaugaugggcaaaagagagaagaaauuaggcgaguucggaaaagcaaagggcucuagggcaauuugguauauguggcuaggagcgcgauuccuugaguucgaagcccugggauuccugaacgaggaucacugguuuucgcguggcaauaguuuaagugggguagaaggggaaggacuucaucgucuaggcuacauauuaagggacguuucuaagaaagaagguggugccauguaugcagaugacacagcugggugggacaccagaauaacacuugaggaucucaaaaacgaggaaaugguuacaaaccauaugaagggagaacacaagaaauuagcagaagcuaucuuuaagcucacauaccagaauaagguuguaagagugcaaaggccaacaccacgggguacagucauggacauaauuucgagacgagaucaaagggggucuggucaagugggaacguauggccucaauacauuuacuaauauggaagcccaacuuauacgacaaauggaaggagaagggauauucaaaucgauacagcaucuaacgguuaccgaagagauagcuguucaaaacugguuagcacguguuggacgggaacgauuaagccgaauggccauaucgggggaugauuguguaguuaaaccgcuagacgacagauuugccucugcauuaaccgcucuaaacgauaugggaaagguacggaaggauauucagcagugggaaccaaguagagguuggaacgacuggacacaagucccauucuguucacaucacuuucacgaacucaucaugaaagacgggaggguacucgugguuccaugucgaaaccaagacgaacuaauaggaagggcaagaauuucucaaggagcggguuggaguuuaaaggaaacagcgugucuugguaaaucguaugcgcagauguggacucucauguacuuucaccgaagagauuugagacucgcagcaaaugcaauauguucagcaguaccgucccauugggucccaacaucgaggacuacguggucaauccacgcuaagcaugaauggaugacaaccgaggacauguuggccguauggaaucgcguuuggauccaagaaaacccauggauggaagacaaaacaccgguugaaucaugggaggaaguuccguauuugggcaaaagagaggaucaauggugugggucauuaaucgguuugacgucacgagcgacaugggccaaaaauauacaaacagccauaaaccaaguaaggagcuuaauaggcaaugaagaguacacagauuauaugccgagcaugaaacguuuuagacgugaagaagaagaagcgggaguucucugguaa

SEQ ID NO: 22536 - RNA, 9876 nt, Artificial Sequence
  derived and/or modified CDS sequence (opt6) from DENV-2__EU569703__SS-prME
acggcaggaguuaucaucaugcuuauaccuacagcaauggcauuucaucuuacuacuagaaacggagaaccucauaugauagugggacgucaagaaaaaggaaaaucgcuacucuuuaaaacagaagaugggguaaauaugugcaccuugauggcgauagauuugggagaauugugugaagacacaauuacauacaaauguccccuacuacgccaaaacgaacccgaagauauugacuguuggugcaacucaacaaguacuuggguuacauauggaaccugcaccacuacaggugaacaucgucgggagaaaagaagcguagcauuaguaccccauguaggaaugggcuuggaaaccagaacggaaacauggaugucuagcgaaggcgcguggaaacacguacaacgcauagaaacguggauacuuagacaucccggguuuacaauaauggcagccauucuugcauacacaauuggaaccacucauuuucaaagagcucuaaucuucauccuccucacggcuguugccccgagcaugacaaugagauguauaggaauaucaaauagagauuuuguagaaggcgugucagguggcuccuggguugauauuguacuugaacacgguucgugcgucacaacgauggccaaaaauaaacccacgcuagacuuugaauuaaucaaaacggaagcaaaacaaccugcaacgcuuagaaaauauuguauagaagcaaaauugacgaauacaacaacugaaagcagauguccuacccaaggugaacccagcuuaaaugaagaacaagauaaaagguucauauguaaacauagcaugguagacagaggaugggguaacgguugcgggcuuuuuggaaaaggaggaauugucacgugugcaauguuuacuuguaagaaaaacauggaaggaaaaguugugcuuccagaaaaucuagaguauacuauagugauaacgccacauucuggcgaagaacacgcggucggaaaugacacaggaaaacaugggaaagaaauuaaaauuacuccucagaguucaauaacagaggcagagcugacaggcuaugggacgguaacaauggaguguaguccaagaacaggucuugauuuuaacgaaaugguuuuacuccagauggaagauaaagcauggcuaguacaucgacagugguuccuugaccuuccguuaccauggcuaccaggagcugacacacaggggagcaauuggauacaaaaagaaacauuaguaacauucaaaaacccacaugccaagaaacaggaugucgugguguugggaagucaggagggggcgaugcauacggcucuaacaggagcaacagaaauucaaaugaguucgggaaaucugcuauucacagggcaucucaaauguagguuaaggauggacaaacuacaacuaaaagggaugaguuauucaauguguacaggcaaauuuaaaauagugaaagaaauugcggaaacgcaacacgggacuauaguuaucaggguacaguaugaaggugaugguucgcccuguaaaauuccauuugaaauaauggaucuagagaaaagacaugugcuaggccguuugaucacuguaaaucccauugucacugaaaaagauucuccgguaaacauagaagcagaaccacccuucggcgacagcuauauuauuauaggugucgaaccuggacaauuaaaacuaaacugguuuaagaaaggaucuaguauuggacaaauguuugaaaccacaaugcgcggagcaaaaagaauggcgauccuuggagacacugcaugggauuuuggaucacuagguggaguuuuuacaucaauagggaaggcuuugcaccaaguuuucggcgcuauuuacggugcugcauucucugggguuaguuggacaaugaaaauuuugauagggguaauaauaaccuggauaggaaugaacagucgaucaacgucacucucagucucguuagucuuaguuggaguggucacacuauaccugggggugaugguccaagccgauaguggaugugucguaucauggaaaaauaaagaacuaaaauguggaucagguaucuuuauaaccgauaauguacauacuuggacagagcaauauaaauuucaaccagagucaccaucaaaacuggcuuccgcuauacaaaaagcgcaugaggaagguauaugugguauaagauccgucacucgucuagaaaauuuaauguggaagcagauaacacccgaacugaaccauauauuauccgaaaacgaaguaaaauuaacaauuaugacuggcgauauaaaaggaauuaugcaagcaggaaaaaggucucuuaggccacagcccacugaacuaaaauauaguuggaaaacguggggaaaagccaagauguuaaguacggaaucccacaaccaaacguuccuaaucgacggcccagaaacugcagaaugcccgaauaccaauagggcuuggaacucacucgaaguagaagauuauggauucggcgucuucucgacuaacaucuggcuuaaauuaagagagaagcaggauguauuuugugauucaaaacugaugagugcggcaauaaaggauaauagagcagugcaugcugacaugggauauuggauugaaagugcucugaacgauacauggaaaauggaaaaggcaaguuucauagagguuaaaucaugccacuggccaaagagccauacguuauggagcaacggaguccuagaaucugaaaugauaauuccgaaaaauuucgcagggccagucagucaacauaacuaucgaccaggauaucauacacaaacggccgguccauggcaucuuggcaaacuugaaauggauuuugacuucugugaagguacaacgguuguugugaccgaagacugcggcaauagggguccuucccuacgaacgacaacugcgucuggaaaauugauaaccgaaugguguugucguagcugcacuuugccuccguuaagauaccguggagaggacggguguugguacgguauggaaauaagaccuuuaaaagagaaagaagagaaucuaguaaauucucuaguaacggcaggccaugggcagauagauaauuucuccuuagguguucuugguauggcuuuauucuuagaagaaaugcuaagaacucgcguuggcacaaaacacgcuauauugcuuguagcuguuagcuucguaacacucauuacaggcaauauguccuuucgagaucuugguagaguaaugguuaugguaggugcaaccaugaccgacgauauuggcaugggcguaacauaccuggcguuguuggcugcauuuaaaguuagaccaacguuugcugcaggacuucuauuacgaaagcuaacuuccaaagaguuaaugauggcaacuauaggaaucgccuuacuaucacaaaguacuauaccugagacaauacucgaguuaacugaugcccuagcuuuaggaaugaugguccugaaaauaguuagaaacauggaaaaauaccaacucgcaguuacuauaauggcuauaucuuguguaccaaacgcggugauucuacaaaacgccuggaaagucuccuguaccauacuagcggcugucaguguaucucccuuacucuugacaaguucgcaacaaaaagcagauuggaucccucuagcacuaacaaucaagggucuuaauccuaccgcaaucuuucuuacaacgcucucucgaaccaguaagaaaagaucuuggccccugaaugaggcagucauggcugugggaaugguuucuauacuggcaagcagcuuauuaaagaacgauaucccaaugacagguccguuaguggccggaggccuucugacuguauguuauguuuuaacaggaaggagcgcggaccuagaacuggaacgagccgcugaugugaaaugggaggaccaagcagaaauuagcggcucaagcccaauacugaguauaacgauuagugaggacggcuccaugucaauuaaaaacgaagaggaagaacacacucugaccaucuuaaucagaacugggcuccuaguaauaaguggagucuucccaguaucgauuccaauaacugcggcagcgugguacuugugggaggucaagaaacaaagagcuggaguguuaugggacgugccuucaccaccacccgucggaaaagcugaacuggaagacggagcauaucguauuaaacaaagaggcauauucgguuauucccaaaucggcgcugggguuuauaaagagggcacuuuucauacuauguggcacgugacucgaggggccgugcucaugcacagggguaaacgaauagaaccuagcugggcagacguuaagaaagaucuaauuucauacggcggcggauggaaauuggagggugaauggaaagagggggaagaaguucagguauuagcauuagagccuggaaagaauccgcgugcuguccaaacuaaaccgggcuuauucaaaacaaauacaggaacgaucggcgcaguuaguuuagacuuuaguccugguacauccgguucacccauaguugacaggaaagguaagguuguuggucuguacgguaauggaguaguaacaagauccggagcguacguuucagcaauagcucaaacagagaaaagcauagaggauaaucccgaaauugaagaugauauauuuagaaagaagagauugacgauaauggaccugcaucccggagcuggcaaaaccaaaagauacuuaccagcuauagucagagaggcgauaaaaagggguuuacguacucuaauuuuggcaccuacucguguaguggcagcugagauggaggaagcacuuagaggccuuccaauccguuaccaaacuccugcaauuagagccgaacacacugggagagaaauaguugauuuaaugugucacgcgacauucacuaugagauuauuaagcccuguccgagucccaaacuacaaccuaauuauuauggaugaagcacauuuuacggaccccgcuaguaucgcagcaagaggguauauuucaacacgaguugaaaugggagaagcagcuggaauauucaugacugcuacacccccuggaucgcgagauccauucccccaaagcaaugccccaauaauggacgaagaaagggagauaccggagagaagcuggaauagcggacacgaguggguuacagacuucaaaggaaaaacgguaugguuuguacccuccauuaaagcugguaaugacaucgcagcuugucuaagaaagaaugggaagaaaguuauacagcuuucucgaaaaacguucgacucugaauauguuaaaacaagggcuaacgacugggacuuugucguaacaacggauauaucggaaaugggugcaaauuuucgagcagaaagagugauagacccacgcagauguaugaagccuguaauauuaacugauggagaggaaagagucauuuuagcaggaccaaugccuguaacacauucuucugcagcgcaaagaagaggaagaaucggccgaaauccuaaaaaugagaacgaucaauauauuuacaugggagaaccacucgaaaaugacgaggacugcgcgcauuggaaagaagcaaagaugcuucuugauaauauuaacacuccagagggaauuauaccaucgauguuugaacccgaaagggaaaagguagaugccaucgacggugaguauaggcuacgaggcgaagcacgaaaaacuuucgucgauuuaaugaggcguggggaccugccaguaugguuagcuuaccgaguggcagcagaaggaauaaauuacgccgaucgucgaugguguuuugauggaauuaaaaacaaucaaauuuuggaggaaaaugucgaaguggagauauggacaaaagaaggggagaggaagaaacuaaagccgagauggcuggaugccagaauuuauucugauccuuuagcuuugaaggaguuuaaagaauuugcagcggggcgcaaaaguuuaacauuaaaucugaucacagaaaugggaagauuaccaaccuuuaugacacagaaagcacgcgaugcuuuagauaauuuagcugucuuacauacagcggaaguaggcggacgugcauacaaucacgcccugucagaauugccggaaacauuagaaacacuauuauuguuaacauuguuagcgaccguaacaggggguaucuuuuuauuuuugaugaguggcaagggaauuggaaaaaugacauugggcauguguugcauuauaacagcaucaauacuauuaugguaugcacaaauucagccucacuggaucgccgcaagcauaauacuagaguucuuuuugauaguacuucuaauaccagagccagaaaaacaaagaacuccgcaagacaaccaacugaccuauguuguuaucgccauacugaccguagucgcagcaacgauggcaaaugaaaugggcuuccuggaaaagacaaagaaagaucuaggcuuagguucgauaacgacacaagaaagcgagaguaauauuuuggauaucgaccuccgacccgcguccgcuuggacacuuuaugcaguugccacgaccuuuguaacaccgaugcuacgacacaguauagaaaauucaaguguuaacguuucacuaacggcgauagcaaaucaggcgacaguuuuaaugggccuaggccgaggguggccguuauccaaaauggauauagggguuccauuacucgcuauugguugcuauagccagguaaacccaauaacacuuacugcagcccuuuuguuauuagucgcucauuacgcgauaauuggacccggacuucaagcuaaagccacuagggaggcacagaaaagagcagcugcugggauuaugaaaaauccgacaguggacgguaucaccgucauagaucuagaaccuauaccauacgauccaaaauuugaaaaacaacuaggccaaguaauguuguuaguguuauguguaacucaaguacugaugaugcgaacuaccugggcacucugcgaggcacuuacccuggccacaggaccaauaucaacguuaugggaaggaaacccuggccgguucuggaauaccaccauagccguauccauggcaaauaucuuccgagguaguuacuuagcuggagcgggucucuuauuuucgaucaugaaaaacaccacaaacacucgaagaggaacugguaauauaggggaaacucuuggagaaaaauggaaaucgagauuaaacgccuugggaaaaucugaguuucaaaucuauaagaaaagcgggauacaagaaguggaccgaacauuagcgaaggaaggcauaaaaagaggagaaacagaucaucaugcaguguccagagguuccgcaaagcuaagaugguucguggaaagaaauaugguuacaccggaaggaaaagucguagaucuaggaugcggcaggggcggguggagcuacuacuguggaggcuuaaagaacgucagagaaguaaaagggcuuacuaagggugguccaggacacgaagaacccauccccaugucuacauauggauggaaucucgucagacuacaauccggugucgaugucuuuuucaccccuccggaaaaaugcgauacgcuuuuaugcgacaucggugaguccagcccaaaccccacaauagaagcgggacggacgcucagagugcugaauuuagucgagaacuggcugaacaauaacacacaauuuuguauaaaaguacuaaauccauacaugccaucuguuaucgagaaaauggagacccuucagagaaaauauggcggcgcauuaguacguaauccauuaagucgaaauagcacccaugaaauguauuggguuagcaacgcuacaggaaacauaguaucauccguuaauaugaucucacggaugcugaucaacagguucaccaugaagcauaagaaagcuacauacgaaccggacgucgauuuaggaucagguacaagaaauauagguauugaaaaugaaauuccaaaccuggacauaauaggcaaaagaauugagaaaauuaagcaagagcaugaaacaucauggcauuaugaucaagaucacccauauaaaacaugggcauaucauggauccuacgaaaccaagcaaacugggucagcaucaucaaugguaaacggaguuguacgguuauugacgaaaccaugggacgucgugcccauggugacccagauggcuaugacggauacaacaccuuucggccagcaacgugucuucaaagaaaaaguagauacgcgcacacaagaacccaaagaagggacgaagaaauugaugcguauaacggcugaaugguuguggaaggaauuagguaagaagaaaacaccuagaauguguacgcgagaagaauuuacaagaaaaguucggucgaacgcagcccuaggagcaauauuuaccgaugaaaauaaguggaaaucugccagagaagcaguagaggauucuagauuuugggaauuaguggauagagaaagaaaucuucaucuggaaggaaaaugugaaacgugcgucuacaauaugauggguaaacgagagaagaaauuaggagaauuugguaaagcgaaagguucacgagcgauaugguacauguggcuaggugcuagauuucuggaauuugaggcuuuaggauuccuaaacgaggaucacugguuuaguagaggaaauucacuguccggaguugaaggugaagguuugcacaaacucggguauauuuuaagggacgugucuaagaaagagggcggagcaauguaugcagacgacacggcagguugggacacgcguauuacacuagaagaucucaaaaaugaggaaauggucacgaaccacaugaaaggugaacauaagaaacuagccgaggcaauuuucaaauuaacguaccaaaauaagguggugagaguacaaagaccaaccccgcgaggcacaguuauggauauaauuucacggaaagaucaacguggaucuggacaagucggaaccuacggguuaaauaccuucacuaauauggaggcacaacucauuagacagauggaaggggaagguauauuuaaaaguauccagagacuaacuguaacagaggaaauugcaguucaaaauugguuagccagagugggaagagaacgacucucuagaauggcuauauccggagaugacuguguagucaaaccauuggaugaucgauucgccucagcguugaccgcauuaaaugauaugggcaagguucgcaaagauauucaacagugggaaccgucaagaggguggaaugauuggacccaggucccauuuugcagccaccauuuccacgagcuagugaugaaggauggcagaguccuaguuguaccaugucgaaaucaagaugaacugauagggcgugcaagaaucucccaaggagcggguuggagccuaaaagaaacugccugccuggguaaaagcuacgcacaaauguggacucuaauguacuuccaucgaagagaccuacgauuagcagcgaaugcaauaugcagcgcugucccaucacauuggguccccacgucacgcacuaccuggucaauucaugcgaaacaugaauggaugacuacggaagauauguuggcagucuggaaucggguauggauucaagagaacccuuggauggaagauaaaacaccuguagaaagcugggaggaaguuccuuauuuaggaaaaagagaggaucaauggugcggaagccugaucgguuuaacaagcagagcaacaugggccaaaaacauacaaacagcaauuaaccaaguucgcucuuugauaggaaaugaagaauacacagacuauaugccaagcaugaaacgguuuagaaaggaagaagaagaagcaggaguauugugguaa

SEQ ID NO: 22537 - RNA, 9876 nt, Artificial Sequence
  derived and/or modified CDS sequence (opt6) from DENV-2__EU529694__SS-prME
accgcuggagucuuuaucaugcuuauuccaacugcaauggcuuuucaucugaccacuaggaacggagaaccgcacaugauagugggaagacaagaaaaaggaaagagucuguuauuuaagacagaagaugggguaaacaugugcacccuuauggcaauggaucugggggaauuaugcgaggacacaauaacauauaaaugcccguuacuuagacaaaaugaacccgaagacaucgauugcugguguaauucuacuucaacuuggguaacuuauggaacauguacuacuacaggugaacauagaagagaaaaacguucuguggcauuaguuccucauguuggaaugggccuagaaacacguacugaaacauggaugucaagcgagggugcauggaaacauguacaacggauagaaacauggauuuuacggcauccuggcuuuaccauaauggcggcaauacuugcuuauaccaucggaacaacccacuuccaaagagcauuaauauucauauuauugacagccguagcaccuucgaugacaaugcgauguauuggaauuucaaauagagauuucguagaagggguguccggggggucuugggucgacauuguucuggaacaugggucuuguguaacaacgauggcgaagaacaaaccuacacuugacuuugaauuaauaaaaacagaagcaaagcaaccagcaacguugaggaaauacugcaucgaagcaaaguugacaaauacaacaacagaaagcagauguccaacucagggagaaccuagucuuaaugaggaacaggacaaaagauucguauguaaacacagcaugguagauagggguuggggaaaugguugcggacuguuugguaaaggaggaaucguuacaugugcuauguuuaccugcaagaagaauauggaggguaaaguaguucuaccugagaauuuagaauauacuauaguaauuacgccacauagcggagaagaacaugcugugggaaacgauacgggaaaacacgguaaggaaauuaaaauuacaccacaaucauccauaacagaggcugaauuaacuggauacgggacggucacgauggaauguagccccagaacaggccucgauuuuaaugagaugguauuacugcagauggaagauaaggcuugguuaguacacagacagugguucuuggaucuuccuuuaccuugguuacccggugcagauacacaagguucaaauuggauacaaaaagaaacguugguuacuuuuaaaaauccacacgcaaagaagcaggauguuguuguauuagguagucaggaaggggccaugcauacagcacugacuggugcaacugaaauacaaaugucaaguggcaaccuacuuuucacuggucauuuaaaauguaggcuaagaauggacaaguuacaacucaaggggaugucauauucaauguguacuggaaaguucaaaauagucaaagaaauagcugaaacucagcaugguacaauuguuauucgaguucaauacgaaggagaugguagucccuguaaaauuccuuuugaaauaauggaccuugaaaaaaggcacguauuggguaggcucaucacuguuaauccuauaguagcggaaaaagacaguccuguuaacauagaagcggaaccaccauucggcgacucguacaucauaauaggaguagagccaggacaacucaaacuaaacugguuuaagaagggaucuucaauaggccaaauguucgaaacaacaaugcgaggagcuaaacguauggcaauccuaggggacacagcgugggauuuugguuccuugggaggaguguuuacgagcaucggaaaagcacuacaucaaguguucggagcaauauauggagccgcauucucuggugugucauggacgaugaagauacucaucggaguaauuauaaccuggaucggaaugaacaguagaucaaccucacuuagcgugucuuuaguacuaguuggggucgucacauuauaucuaggugcaaugguacaagcggacucaggaugugugguaagcuggaagaguaaggaacuuaagugcggaagcggcauuuuuauaacugauaauguacauacauggacugaacaauacaaguuucagccagagucaccuaguaaauuagccucagcaauucaaaaagcacaugaagaaggcaucuguggaauacguucaguaacgagauuggaaaauuuaauguggaagcaaauaacuccugaguugaaucauauauuguccgaaaaugaagucaaauugacgauaaugaccggugacauaaaaggcauuaugcaagccggaaagagaucacuuaggccacaaccuacggaguuaaaauauucuuggaagacaugggggaaggccaaaauguuauccacugaaagucauaaccagacauuuuuaauugacgguccagaaacagcugagugcccaaauaccaaccgcgcuuggaacaguuuagaagucgaagauuaugguuuuggaguauuuaccacgaauauuuggcuaaaacuacgugaaaaacaagauguuuuuugugauaguaaguuaaugagugcggcuaucaaagacaauagggcaguucaugcggauaugggcuacuggauagaaucagcacuaaaugacacuuggaaaauggaaaaagcgagcuucauugaagucaaaucgugucauuggccaaaaucacauacacuauggaguaauggcguauuagaauccgagaugauaauuccgaaaaauuuugccggucccguaucucaacacaauuacagacccggauaccauacccagacagccggaccguggcaccuagguaaauuagaaauggacuuugauuuuugcgaaggaacaaccguaguaguaacggaagacuguggaaaccgaggaccaucucuaaggacaacaacggcaagcggaaaguugauuacugaaugguguugucggaguugcaccuugccaccacuacgcuauagaggugaagacggcugcugguaugguauggagauucggccguugaaagaaaaagaggaaaacuugguaaauagccucguuacugcgggucacggacaaauagacaauuuuaguuuaggcguguuagguauggcucucuuuuuagaagaaauguuacgcacgagagugggaacuaaacacgcaauguuacugguagcaguaucuuuuguuacccugauuacgggaaauaugucauuccgagauuuaggccguguaaugguaaugguuggggccacgaugacagaugauauugguaugggaaucacauauuuagcccugcuggccgcauucaaaguaaggccuacuuucgcagcuggccuguuauuacguaaacuaaccuccaaggaacuaaugauggccacaaucggaauagcgcuuuuaucacaaucaacuauaccugaaacuauacuagaauuaacagaugccuuggcccuaggaaugaugguauuaaaaauaguaagaaauauggagaaauaucaacuagcgguaaccauuauggcaauuucuugcguuccaaacgcgguaauacuacaaaacgcuuggaagguaucaugcacuauccuggcugcugugagcgucucuccgcuucuuuuaaccagcagccaacaaaaggcagauuggaucccauuggcucuaaccauaaaaggucuuaaccccacggcaauauuuuugacuacccuaucacguacaucuaaaaagagaucguggccucuuaaugaagccauuauggccguugggauggucucaauacuugcaucaagucucuuaaaaaacgacaucccaaugacaggccccuuaguugcaggaggguuacugacaguuuguuauguauugacaggccgcucggcugaucuagaacuugaaagagccgcugacguaaaaugggaagaucaagcagaaaucagugguaguucuccuauacugucgaucacuaucucggaggauggaucaaugucaauaaaaaaugaagaagaagaacaaacccucacuauauugauaagaaccgguuuacuaguaaucagcgguguauuuccaguaucuauacccauaacagcagcagcaugguauuuaugggagguaaagaaacagagagcuggaguguugugggauguaccgucaccaccaccuguugguaaagcugaauuagaagauggggcauaucgaauaaaacaaagaggaauacuaggguauucacagauuggagcagggguuuacaaagaggggaccuuucauacgauguggcauguaacacguggugcaguguuaaugcauagaggaaagaggauagaaccuagcugggcagauguaaaaaaggacuuaauaaguuauggaggaggauggaaauuagagggcgaauggaaagagggggaagaaguccaaguacuugcuuuggaacccggaaaaaauccacgagcuguucagacaaaaccuggccucuucaaaaccaauacuggaacaauaggcgcagucucccuagauuucucucccggcacaagcggcaguccaauaguugauagaaaaggaaaagucguaggucuguacgggaauggagugguaacccgcagcggagcguacgugucugcuauagcacagacagagaaaagcauugaagauaauccugagauagaagaugacauuuuuagaaagaagcgauuaaccaucauggaccugcauccuggugcaggaaaaacaaaacgauauuugccggcaauagucagagaagcaauaaaaagggggcuucgaacauuaauacuggcucccacuagagugguugcugcagaaauggaagaagcucuaagaggacucccaauucgauaucagacaccggccauucgagcagaacauacaggccgagagauaguagaucuaaugugucaugcuacauuuacaaugcggcuguugucuccaguacgcgucccaaauuacaaucugauaauaauggacgaagcacacuucacagaucccgcgucgauagcagcacgaggauacauaucgacaagaguggaaaugggggaggccgcaggaauauuuaugacagccacgccucccggaucaagggauccauuuccucagucaaacgccccuaucauggacgaggaacgagaaauuccagagagauccuggaauaguggucaugaguggguuacugauuuuaaaggaaaaaccguuugguucguaccaucaauaaaagccggaaaugacaucgcggcuuguuuaagaaagaauggaaaaaaaguaauacaguuaucaaggaagacauuugauucugaauaugugaagacaagggcgaacgauugggauuucguagugaccacggacauaucggaaaugggggcaaacuuuaaagccgaacgcguaauugacccaagaagauguaugaaaccaguaaucuuaacggauggugaagaaagaguaauccuagcuggcccaaugccgguaacacauucgagcgcugcacaacgaagaggucggauagggcggaacccaaaaaaugaaaaugaucaauauaucuacaugggagagccauuagaaaaugaugaagauugcgcucauuggaaagaggccaaaauguuguuagacaauauuaauacuccagaagguaucaucccuaguauguucgaaccagaaagagagaaaguugaugcaauugacggagaguauagacuacgcggugaggcacguaaaacauuuguugauuuaaugcgcaggggagauuugccuguauggcucgcguauaggguagcagcagaaggaauaaauuaugcggaccgcaggugguguuuugauggaauuaaaaauaaucaaauauuagaagaaaauguagaaguagagaucuggacaaaagaaggagaaaggaagaaauuaaaacccagaugguuagaugcacguauuuauagcgauccacuugcacucaaagaguucaaagaauuugcugcaggacgaaagucguuaacuuugaaucucauaacagaaauggggagauugcccaccuucaugacucaaaaggcaagagacgcauuagacaaucuugcuguguuacacaccgcagaagcaggcggcagggcuuauaaucaugcucuaucagaauuaccugagacauuggagacauuauugcuuuuaacacuauuagcaacggucacaggaggcauauuucuuuuucucaugucgggaaaaggaauaggaaaaaugacccuaggaaugugcugcauaauaacggcuucuaucuuacugugguacgcacaaauacaaccccauuggauugccgcaaguauaauuuuggaauucuuccuuaucguccuccuaaucccugaaccagaaaaacaaagaacaccgcaagauaaccaauuaacuuaugugguaaucgcaauacugacaguaguagccgcuaccauggcaaacgaaaugggauuucuggagaaaacuaaaaaagaucuuggccuaggcucuauagcaacucaagaguccgaaucaaauauuuuagauauagaucugagaccugcaucagcauggacccuauaugcuguggcuaccacuuucguaacaccuauguugagacacucuaucgaaaauagcagugucaacgugaguuuaaccgcuauugcgaaucaagcgacaguacuaaugggauuaggaaaaggcuggccuuugucgaaaauggauauaggaguaccucuccuggcuauugguuguuauagucaaguuaauccaauaacgcuaacagccgcuuuauuacuacuaguagcacauuacgcaauuauaggaccuggacuucaagcaaaggccacaagagaagcucaaaagagagccgcagcuggaauaaugaaaaacccaaccguagaugguauuacaguaauagauuuagagccaauaccuuacgaucccaaguuugaaaaacaguugggacaaguaauguugcucauuuuauguguaacacaaguauugaugaugcgaacaaccugggcacugugugaggcacuuaccuuggcaacgggaccgaucucaacccugugggaggguaacccagggagauucuggaacacgacuauugcaguuagcauggcuaacaucuuccggggaaguuauuuagcgggggcuggucuacuauucucaaucaugaaaaacacaaccaauacgagaagagguacuggaaacauaggagagaccuuaggcgaaaaauggaaaucaagacugaaugcccuuggcaaauccgaauuccagauuuauaaaaagucaggaauacaagagguagacagaacacuagcaaaagaggguauuaaacgaggugagacggaucaucacgcgguaagucguggaagcgcgaaacuaaggugguucguagagcggaauauggugacacccgaagguaaaguaguagaucuaggguguggcagaggggguuggaguuauuauugcggaggauuaaaaaauguucgagaagucaagggucucaccaaaggcggaccaggacaugaagagcccauaccaaugucaacuuacggcuggaacuuaguaagacuucaaucaggaguggacguauuuuucaccccgccagaaaagugcgacacuuuguugugugauauaggugaaagcucgccaaauccgacgauugaagcuggaagaacgcuaaggguccuaaauuuagucgaaaauuggcuuaacaauaacacccaauuuuguauaaaaguguuaaacccauacaugccuuccguuauagaaaaaauggaaaccuugcaaagaaaauauggaggagcacuaguacgcaacccccucucaaggaauucaacacacgaaauguauuggguuucaaacgcaacgggaaacauugucagcucuguuaauaugauaagccggauguuaaucaaucguuuuacaaugaaacauaaaaaagccacuuacgaaccagacguagaccugggaucaggcacucguaauauaggaaucgaaucugaaauacccaaccucgauauaaucggcaaacguaucgagaaaauaaaacaggaacacgaaacaaguuggcauuacgaccaagaccauccuuacaaaacaugggcuuaucaugguaguuacgaaacgaaacaaaccgggucugcuucaucaaugguaaacgguguaguacgauuauuaacgaagccuugggacguugugccaaugguuacgcagauggcaaugacagauacuacuccauucggccaacagagaguguuuaaggaaaaagucgacacucggacgcaggaaccgaaagagggcacaaaaaaauuaaugaaaauaaccgcagaauggcuauggaaggaauuaggcaaaaaaaagacgccaaggauguguaccagagaagaauuuacacguaaagugagaagcaaugcagcauuaggugcaauauucacagacgaaaauaaauggaaaagugcucgggaagcuguagaagauaguagguucugggaauuaauagaucgagaaagaaaucuccaccuugagggcaaaugugagacuuguguauauaauaugaugggaaaaagggagaaaaaauuaggagaauucggaaaagcaaaaggaucaagagcuauuugguacauguggcuuggagcaagguuucucgaauucgaagcacugggcuuucugaacgaagaccauugguucucucggggaaacucuuugucagggguugaaggagaaggccuacauagacuaggcuacauucuuagagacguaucaaaaaaggaaggcggugcuauguaugcugacgacacggcaggaugggacaccaggauuacacuggaagacuugaaaaaugaagaaaugguuaccaaccacaugaaaggggagcauaaaaaguuagcugaagccauauuuaaacuaacauaccagaauaaaguaguuagaguacagcgaccaacuccuagagguacaguuauggacauaauuaguaggagagaucaacgcggguccggccaaguuggcacauauggccucaauacauuuacuaacauggaggcucaacuuauccgccaaauggagggagaagguauuuucaaaucgauacaacauuugacagucacagaagaaauugcaguacaaaauuggcucgcacgagucgguagggaacgacuaaguagaauggcaaucucaggcgacgacugcguaguaaaaccacucgaugaucgauucgccuccgcacuaacagcacucaacgauaugggaaaaguacgaaaagauauacaacaaugggaaccuaguagaggguggaaugauuggacacaaguaccguucugcucacaccacuuccaugaauuaguaaugaaagacggaaggguauuaguaguacccuguaggaaucaagacgaacuaauuggaagggcgaggauaucgcagggagcuggauggaguuuaaaagagacagcaugucucgggaaguccuaugcgcagauguggacccugauguacuuucaucggcgagaccuaagacuagcagcuaaugcaaucugcucagcggucccaucacauuggguaccuacuagcagaacaacaugguccauacacgcuaagcaugaauggaugacuacugaggacaugcuugccguuuggaacaggguuuggauacaagaaaaucccuggauggaggauaagacaccaguugagucgugggaagaggugcccuauuugggaaaaagagaggaucaaugguguggaagccucaucgggcucacaucgagagcuacuugggcaaagaauauucagacggcaauuaaucaaguuagaucccuuaucggaaaugaagaauauacagacuauaugcccucaaugaaaagauuucguagagaagaagaagaagcuggaguguuaugguaa

SEQ ID NO: 22538 - RNA, 9876 nt, Artificial Sequence
  derived and/or modified CDS sequence (opt6) from DENV-2__EU529695__SS-prME
acagcuggcguaauaauaaugcuuauuccgacagcuauggcauuucacuuaacuacgaggaauggagaaccacauaugauugucggaaggcaagaaaaggggaaaagccuccuguuuaaaacggaagacggagugaauaugugcacucuuauggcaauagauuuaggagaauuaugugaagauacgauaacauauaaauguccucuuuugaggcaaaaugaaccagaagacauugacuguugguguaacagcacaucuacauggguuacauacggaacgugcacuaccacgggagaacauagaagagaaaaaagaucaguagcucuuguuccucauguugggaugggucuugaaacgcgcacggagacguggaugagcagugagggagcuuggaaacauguccagcgaauagaaacuuggauucuuagacauccaggauuuacaauuauggccgcaauucuggcuuauacaaucggaacaacgcauuuucagcgcgcuuugauauuuauucucuugacagcuguagcucccuccaugacaaugcgguguauagggauuucaaaucgagacuuuguggagggcguaucuggcgggucuuggguugauauaguacucgagcacggaaguuguguuacuacgauggcaaagaauaaacccacacuagacuuugaguuaaucaaaacggaagcgaaacaaccugcaacucugcgaaaguauuguauugaagcaaaauuaacuaauacuacuacagaaucacguuguccuacccaaggggaaccuucucuaaaugaggaacaagauaaacgauuuaucugcaaacacagcaugguugauagagguugggguaacgguuguggacuuuuugggaaagguggcauuguaacgugcgcaauguuuacgugcaaaaaaaauauggagggcaaaguaguucuccccgaaaauuuagaauauacaauuguuauaacgccacacaguggagaggaacacgcaguaggcaacgauacaggcaaacauggaaaagaaauaaaaauuacaccacaaaguucgauaaccgaggcugaauuaacgggcuacggaaccguaacgauggaauguucaccaagaacuggacuugacuuuaaugaaaugguuuuguugcaaauggaagacaaggcaugguuaguucaccgacagugguuucuagaccugcccuuacccuggcuucccggagcugacacccaaggauccaacuggauacaaaaagaaaccuuagugaccuucaaaaauccucacgcuaaaaagcaagauguugucguauuagggagucaggaaggagcaaugcauacagcauuaacaggagcaacugaaauacagaugucuucgggaaaucuuuuauuuaccgggcaccuuaaauguagauuaagaauggauaaguugcaauuaaaaggaaugucguauucaauguguacaggcaaguuuaagauuguuaaggaaauagccgaaacacaacauggcacaauuguuauucgaguccaauaugaaggggaugguucccccuguaagauucccuuugaaaucauggacuuagaaaaaagacacguacuagggagauugauaacaguuaauccaauaguaacugaaaaagauucaccaguaaauaucgaagcugaaccgcccuuuggggacucuuacaucauaaucgguguagagccuggucaauuaaagcucaacugguucaaaaagggaagcucuauaggacaaauguuugaaacaacaaugagaggagcaaagcgcauggcuauauugggggacacugccugggauuuuggaagccuugguggaguauucaccuccauaggaaaagcacuccaccaagucuucggggcaauauauggugcugcuuucucagguguaucguggaccaugaagauucuuauuggagucauaauaacuuggauuggaaugaacucccgaaguacuagucucagcgucagcuugguauuagucggaguuguaacauuauacuuaggugucaugguucaggcagacucagguuguguaguuucguggaagaauaaagaauuaaaaugcgguucagguauuuucauuaccgacaauguacauaccuggaccgaacaauacaaguuucagccagaaucaccaaguaagcuggcaucugccauucaaaaggcccacgaagaaggaauauguggcauccguagcgugacgaggcucgaaaaucuaauguggaaacagauaacgccagaacuuaaucacauucuaucggaaaacgaaguaaaacuaacaauuaugacaggagauauaaaaggaaucaugcaagcagguaaacgaagucugagaccucaacccacagagcucaaauauucauggaaaacguggggaaaagcuaaaauguuauccaccgaaucgcacaaucaaaccuuuuugauagacgggccagaaacagcagaauguccuaauaccaauagagcauggaacucacuugagguugaggauuauggguuuggaguguuuucaacaaauauaugguugaagcuucgagaaaaacaagacguguuuugugauagcaaauuaaugagugcagcuauaaaagauaaccgugcuguacaugcggacaugggauauuggauagaaagcgcacuaaaugacaccuggaaaauggagaaagcuucguucauugaaguaaaaucaugucauuggccaaaaagucauacuuuauggagcaacggagugcuugagagugagaugauaauaccgaaaaauuucgcugguccuguaucacaacauaauuacagaccggguuaucauacacaaacagcuggaccauggcaccuagggaaguuagaaauggacuucgacuuuugugagggcaccaccguuguggucacagaagacugcggaaaccguggucccucuuugcgaacuacaacugcuagugggaaacuuaucacggaauggugcuguagaucguguacacuuccuccauuacguuacagaggugaagaugguugcugguacggaauggaaauacguccacuuaaggaaaaagaagaaaaccuaguuaacagucuggucacagcagggcacggacaaaucgauaauuucucccuaggagugcugggaauggcucuauuuuuggaggagauguuaaggacaaggguagguacaaaacacgcaauucuauuaguugccguuucuuuugugacgcuuauuacagguaauaugucauuucgagaccuagggagaguaauggugauggucggagcaacuaugacagacgauauuggaauggggguaacauaccuagcucuccuagccgcauuuaaagugcgucccacuuuugcagccgguuugcugcuaagaaaacuaacaagcaaagaguugaugauggcaacaauugguauugcucuauugagccaguccacaaucccugagacaauucuggaauuaacagaugcacucgcucuugguaugaugguuuuaaaaauaguacgaaauauggaaaaauaccaauuggcuguuacuauaauggccauaucuugcguaccaaaugcaguaauacuucaaaacgcguggaaaguuaguugcacaauauuagccgccguuucaguaucaccgcuauuauuaacgagcagucaacaaaaggcugacuggauuccauuagcuuuaaccaucaagggucuaaauccgacggcaauauuuuuaacgacucuaucacguacaucuaaaaagcgaaguuggccuuugaaugaagcugucauggcaguugguaugguuucaaucuuagcaucauccuuacugaaaaaugauauuccgaugacaggaccuuugguugcaggcggacuacuuaccguuuguuacgugcuaacgggacggucugcugaucuagaacucgagagagccgcugauguaaaaugggaagaccaagcagaaauuucagguagcagcccaauccugaguauaaccauauccgaagacgguucuaugucgauuaaaaacgaagaagaagaacaaaccuugacuauccuuaucagaacuggccuuuuaguuaucucagguguuuuccccguaucuauuccaauuacugcugcagcaugguaucuaugggaagucaaaaaacaaagagcugguguccugugggacguacccucaccaccaccuguuggcaaagcagaauuggaggauggugcauaucgaaucaaacaacgggggauauucggguauucucagauaggagcaggugucuacaaagagggcacauuucauaccauguggcauguaaccagaggcgcuguauugaugcaucgaggaaaaagaauugaaccuaguugggcugauguaaaaaaagaccuaauuucuuaugguggaggauggaaacuugagggagaauggaaagaaggugaagaaguacaagugcuagcacuagagccagggaaaaacccacgugccguacagacaaaaccaggauuauuuaaaacaaauacaggaacgauuggagccguaucucuagacuuuucaccaggaacgucaggcucaccaauuguagauagaaaagggaaagugguuggcuuauacgggaaugguguaguaacuagaaguggggccuauguaucggcgauagcacaaacggagaagaguaucgaggauaaucccgaaauagaagaugauauauuccguaagaaacggcuaacaaucauggauuuacauccaggagccggaaaaacaaaaagguaccuacccgcuaucguaagagaagccauuaaaaggggauugagaacguugauauuagcaccaacucgagucguagcagccgaaauggaagaagccuuaagaggauuaccuaucagauaccaaacaccagcaauaagagccgaacacaccggaagagaaauuguugaccuaaugugccaugcaacuuucaccaugagacucuuaagcccaguuagagugccaaacuauaaccuuauuauuauggaugaagcccauuuuaccgauccagcuucaaucgccgcaagagguuauaucaguacacgaguagaaaugggagaagcagccggaauauuuaugaccgcgacaccaccgggaaguagagauccauuuccgcaauccaaugcaccaaucauggacgaagagcgagaaaucccggagcguucauggaacucuggucaugagugggugaccgauuucaaagggaaaacagucugguuugugccaagcauuaaggcuggaaaugauauugcagcaugccuaagaaaaaauggaaagaaagugauucaacuaucgcgcaagacuuuugacucugaguacguuaaaacucgugcuaacgacugggauuucguugucacaacagauauuucugaaaugggggccaauuuucgugccgaacguguaauagauccaagacguuguaugaaaccggucaucuuaacggacggugaggagagaguaauauuagccggcccaaugccggucacucauucgagcgcugcucaacgcagagggcggauaggccgaaaucccaagaacgagaacgaccaauauauuuacaugggagaaccgcuagaaaaugacgaagauugugcucauuggaaggaagccaaaaugcugcuagauaacaucaauacaccagaggggaucaucccaaguauguucgagccagaacgugaaaagguagacgcuaucgacggggaguauagauugcgcggagaagcaagaaaaacauuuguagacuugaugcggcguggugauuuaccugucuggcuugcauauagaguagccgcagaagguauaaacuacgcagauagaagguggugcuucgaugggauaaaaaacaaccagauacuggaagaaaauguagaaguggaaauauggacuaaagaaggagagcguaagaaguuaaagccaagguggcucgacgcgcgcauauauagugacccacuugcgcugaaagaauucaaggaauucgcagcuggcagaaaaagcuugacccucaauuuaaucaccgaaauggguaggcucccuacguuuaugacucagaaagcucgugaugcccuagauaaucuugcaguucuacacacugcggaagugggaggacgggcauauaaucaugcucuaucggaauuaccagagacguuggagacccuacuccuauuaacgcuauuggcuaccguaaccggagggauauuucuauuucuuaugagugguaagggaauaggaaaaaugacucuuggaauguguugcauuauuaccgcgucgaucuugcucugguaugcucaaauacagccacacuggauagccgcaaguauuaucuuggaauuuuuucuaauaguguuauuaaucccagaacccgaaaaacagagaacgccgcaagauaaucaacucacauacgugguuauagccauuuugacagucguugcggcuacaauggcuaacgaaaugggauuucuugaaaagacaaaaaaagacuuggggcugggaaguauaauuacacaagaaagugaaucaaauaucuuagauauugauuuaagaccugcuuccgccuggacuuuauaugcaguagcuacaacuuucguuacaccgauguugcgccauucuauagaaaacagcagugugaauguuucuuuaacugcaauugcaaaccaagcgacaguucucaugggauugggccgagguuggccguuaucgaaaauggacaucggaguuccauugcuggcuaucggcugcuacucgcaaguaaauccgauaacacucacugcagcccucuuauuacucguugcucauuaugcaaucaucggaccaggucuacaggcgaaagcaacaagagaggcucagaaacgagcggcagcgggcauaaugaagaacccaacagucgaugggauaacggugauagauuuagaaccuaucccauaugacccaaaguuugagaaacaauuaggacaaguuaugcuucugguguuauguguaacucaagugcugaugaugcguacuacaugggcgcuuugugaagcauuaacauuagccacugggccaauauccacacuuugggaaggaaacccggggagguucuggaauacuacaauagccgucucuauggccaacauuuuccguggauccuaucuggcaggcgcugguuuauuguuuaguaucaugaaaaauacuacgaacacuagacgcggcacugguaauauuggugaaacauuaggugaaaaguggaaauccagacuaaaugcauuagguaaaagugaauuccagauauauaagaaaucaggaauacaggaaguagauagaacccuggcgaaagaaggaaucaaacgaggagaaacagaccaccacgcuguaagcagaggaucagcaaaauuaaggugguucguagaacgaaauaugguuacaccugaaggaaaagugguugauuuagggugcgguagaggaggauggucauacuacugcggaggacugaaaaauguacgugaaguaaaagguuuaacuaagggaggaccaggccaugaagagccaauaccaauguccacauacgguuggaaucugguuagguuacaaucaggagucgacgucuucuuuacaccaccugagaagugugacacucuauugugugauauuggagaaucuagcccgaauccaaccauagaagcaggaagaacucuaagaguacucaauuugguugaaaauuggcuaaauaauaauacccaguuuuguaucaaaguucuaaauccuuauaugccuagcguaauugagaaaauggagacucugcaaagaaaguacgggggagcucuugugaggaacccuuuaucgagaaacucgacucaugaaauguacugggucucgaaugcgacuggaaacauaguaucauccguaaauaugauauccagaauguugaucaacagguucacaaugaaacauaaaaaagcaacauaugaaccagacguagaucuggguucaggcacccgaaauauugguauagaaaaugaaauuccaaacuuggauaucauagguaagagaauugaaaaaaucaaacaggaacaugaaacaaguuggcacuaugaccaggaucaccccuauaagacuugggcuuaccaugguucauacgaaacgaaacagacaggaagcgcgucuucaaugguuaaugguguagucagauuacuuaccaagccaugggacguaguaccaaugguaacccaaauggccaugaccgauacgacuccauuuggacaacaacgaguauuuaaggaaaaaguugauacaaggacacaagaaccgaaagagggaaccaaaaaauugaugcgaauuacagcugaauggcuauggaaggaauuaggcaaaaaaaagacaccaaggauguguacacgggaagaguuuaccagaaaaguuagaucgaaugcagcguuaggcgcaauauucaccgacgaaaauaaauggaaguccgcaagagaggcaguagaagauucgcgguucugggaacuuguugacagggaacguaauuuacacuuggaagggaaaugcgaaacuuguguguauaauaugauggguaaacgagagaaaaagcuaggagaauucggaaaagcgaaagggucgagagcaauaugguauaugugguuaggcgcacgauuuuuagaauuugaagccuuaggguuuuuaaacgaagaccauugguuuagucggggcaauucacugagcggcguagaaggagaaggacuacauaaacuuggauacauuuuaagagacguaaguaaaaaggagggaggggcuauguaugcagacgauacggcugggugggauacaagaauaacacuggaagauuuaaaaaacgaagagauggugacgaaucauaugaaaggggagcacaagaaauuagcagaagcgauuuucaaacuuacauaccagaauaaggucguccgaguacaacggccuacuccacgggguacuguaauggauauaauaucacgaaaagaucaaagagggucgggacagguggguacauauggguugaacacguuuacaaacauggaagcucaauuaauucgucaaauggagggugagggaaucuucaaaaguauacaacaccuuacaguuaccgaggagauagcaguacaaaacugguuagcgaggguaggacgggaaagacugagcagaauggcuaucuccggugaugauugcguaguuaaaccucuugacgaccguuucgcgagugcccucacggcauuaaaugacaugggcaaaguuaggaaagauauacagcaaugggagccaaguagggguuggaaugauuggacacaagucccuuucugcucccaucacuuccaugagcucguuaugaaagauggccgcguucuuguaguaccguguagaaaucaagaugagcuaauugguagagcuagaauaucucaaggugcagguuggucauuaaaggaaacagccugucuaggaaaaucguacgcacagauguggacucucauguauuuucauaggagagacuugcgacuagcagcaaacgccauaugcagugccguaccuagucauuggguuccuacgagucgaacgaccuggagcauucaugcaaaacaugaauggaugacaacagaagauauguuagccguguggaaccgaguauggauacaggaaaaccccuggauggaagacaaaacuccaguggaaucgugggaggaggucccauacuuggggaaacgugaagaccagugguguggauccuuaauugggcuaacgaguagagcuacgugggccaaaaauauacaaacggcuauuaaccagguaagaucauuaauugggaaugaagaauauacggauuacaugccgaguaugaaaagauuucguaaggaggaagaagaagcagguguuuuaugguaa

SEQ ID NO: 22539 - RNA, 9876 nt, Artificial Sequence
  derived and/or modified CDS sequence (opt6) from DENV-2__EU482562__SS-prME
acagcugguguaauuaucauguuaauucccacugcaauggcauuucaucuuacuacuagaaauggggaaccucauaugauuguuggucgccaagaaaaagguaaaucauuauuauuuaaaacagaagacgguguaaauaugugcacauuaauggcaauugacuuaggagaacugugcgaagauacaauuacauauaaauguccucuguugagacaaaacgaaccagaagauauugauuguugguguaacagcaccaguacaugggugacguauggaacauguacaacuacuggagaacacagacgugaaaaacgaaguguggcauuaguaccucacguaggaaugggacuagaaacacguacagaaacuuggauguccagcgagggggcauggaaacaugugcaaagaauagaaacguggauacuacgacacccagguuuuacaauuauggcagcaauucuugcguauacuauuggaaccacccacuuucaaagagcacuuauuuuuauauuauuaacugcgguagcgccaucuaugacuaugcgcuguauuggaauuucaaauagagauuuuguagaaggggugucuggagggucauggguggacauagucuuagaacauggcucauguguaacaaccauggccaaaaacaaaccaacguuggacuucgaauuaauuaaaaccgaagcaaaacaaccugcuacucuacggaaauauuguauagaagcaaaauuaaccaauacaacaacagaaucuagauguccaacacaaggugaaccguccuuaaacgaagaacaggacaaacgauucguuuguaaacauucaaugguugaccguggaugggguaacggauguggacuuuuugguaaaggagguauagucacaugugcuauguucacgugcaagaaaaacauggaagggaaaguaguucuaccggagaacuuggaauacacgauuguaaucacaccccacagcggagaagaacaugcgguaggaaacgacaccgggaaacaugguaaagaaaucaaaauaacuccgcaaucaucaauaacugaagcagagcuaacugguuacgggacgguaacgauggaaugcaguccuaggacaggguuggauuuuaaugagaugguccuauuacaaauggaagacaaagccuggcuuguacauagacagugguuucuagauuuaccgcucccauggcugcccggagccgacacgcaaggcucuaacuggauacaaaaagaaacacuugucacauucaaaaauccgcaugcaaagaaacaagacguggugguauuagggucccaagaaggagcaaugcacacagcucucacuggagcaacagaaauucaaaugucgagugggaaucucuuguuuacaggucaccugaaauguaggcuaagaauggauaagcuacaauuaaaggguaugucauauagcaugugcacgggaaaauucaaaauuguaaaagaaauagcugagacccaacacggaacuauagucauuagagugcaguaugaaggugacgguucaccuugcaaaauuccguuugagauuauggaucuagagaagagacauguccuugguagauugauaacuguaaauccaaucguuacagaaaaggauucuccuguaaacauugaagcggaaccaccuuucggagacucuuauaucauuauaggcguagaaccgggacagcuuaaacugaacugguucaagaaaggaucaucuaucggucaaauguuugagacuacaaugaggggagcaaaacguauggcuauccucggugacaccgcuugggauuuuggaucccuaggcggcguuuucacaaguauaggcaaagcccugcaucaggucuuuggagcaauauacggcgcagccuucucagggguuucauggacaaugaagauuuuaaucggugugaucauaaccuggauaggaaugaauagucggaguaccucacuuucugucucgcucguucucguugguguagugaucuuauaucuaggagcuaugguacaggccgacuccgguugcguagucucauggaaaagcaaagaacuaaagugugguucagggauauuuaucaccgauaacguucacacauggaccgaacaauacaaguuucagccugaaucacccucuaaauuggcgucggcaauacaaaaagcacaugaggaagguauaugcgguauaagaucagugacucgauuagaaaaccucauguggaaacaaaucaccccggaacuaaaucauauauuaagugaaaaugaaguaaaacuuacaauaaugacaggagauauaaaaggcauaaugcaagccggaaaaagaagucuacgaccccaacccaccgaacuaaaauauagcuggaaaacauggggaaaagcuaaaauguuaucgaccgaaucacauaaucagaccuuucugauagaugggccugaaacugcugaaugccccaauacuaauagagccuggaauagcuuggagguugaagauuauggauuugguguuuuuacgacaaacaucuggcuaaaacugagagaaaaacaagacguuuucugcgauuccaaguuaauguccgcugcaaucaaagauaauagggcaguacaugcugauauggguuauuggauagaaucggcguugaaugauacauggaagauggaaaaagcaucguuuauagaaguaaaaaguugucauuggccuaagucccacacgcucuggucaaacgguguacuggaaagugaaaugauuauaccaaagaauuuugcggggccuguaucccaacauaauuaucgaccaggauaucauacucaaacagcagggccauggcaccuaggcaaacucgagauggacuucgauuuuugugaggggacuacgguugugguaacagaagacuguggcaaccgagggccaucauugagaacgacuacagcaagcgguaagcucauuacagaguggugcugcagaaguuguacucuaccuccauuaagguaucgcggugaagauggguguugguacggaauggaaaucagaccacuuaaggagaaagaggagaacuuaguuaacagcuuaguuaccgcuggacaugggcaaaucgauaauuuuucgcuaggaguucucgguauggcccuauuucuggaagaaaugcucagaacgagaguaggcaccaaacacgcaauacuauuaguugcggucagcuuuguuacguugauaacugguaauaugucuuuucgugaccuugguagagugauggucauggucggagcaaccaugacugacgacauuggaaugggggugacuuaucuagcauuacuagcagcauucaaagugaggccaaccuuugcagcgggucuacuacuaagaaaguugaccaguaaggaauuaaugauggcaacgauaggcauagcacuccuaagucaaucaacuauaccugaaacgauauuggaauugacugaugcgcuggcuuuaggcaugaugguacugaaaaucguacggaauauggaaaaguaccaauuagccguuaccauaauggcuauuuccugcgugcccaacgcugucauacugcaaaacgcuuggaagguaucgugcacgauccuugcagcagugaguguuagcccauuacuauugacaucuagucaacaaaaagcggauuggauaccacuggcacucaccauaaaaggacuuaacccaacagcaauuuucuuaaccacgcugucuagaaccucuaagaaacgaucuuggccacucaaugaggcaauaauggcuguaggaaugguuuccauacuagcuaguucucuccucaaaaaugauauaccuaugacagguccucugguggccggugguuugcugaccguaugcuacgugcuaacagguagaucagcagaccuagaauuggaacgggcagcagaugugaaaugggaagaccaggcggagauaucuggaucaucaccuauacucucaauaacuauuucugaagauggauccauguccauuaaaaacgaagaggaagaacaaacccugacaaucuuaauaagaacuggacucuuaguuauuucagguguauucccggucucuauccccaucacagccgcagcaugguaucucugggaaguaaagaagcagagagcagggguauuaugggauguaccaucuccuccgccaguaggcaaagcagagcuugaagauggagcuuaucgaaucaaacaacguggaauauuaggauauagucaaaucggcgcugggguauacaaggagggaacauuccacaccauguggcacguaacaagaggcgcgguauugaugcaccggggaaaaagaauagaaccuaguugggccgacgucaagaaagaccugaucucauaugguggugguuggaaacuagaaggagaauggaaagaaggggaagaaguacaaguuuuagcguuggaaccugggaaaaacccaagggcaguacaaacaaagcccggacuguucaagacuaauaccgguacaauaggugcaguuucacuugacuuuaguccagguacaaguggcaguccuauuguugauaggaaagggaaaguaguggggcuuuacggcaacggugugguuacgcgcucuggagcauauguaucagcgauagcacaaacggaaaaaucgauugaagauaacccagaaauagaagacgacauauuuagaaagaaacgguugaccauaauggaucuucacccaggagcaggcaaaaccaaacgauacuugccagcaauaguaagagaagcaauaaaacgaggauuaaggacauuaauacucgcuccuacaagaguaguagcggcugaaauggaggaagccuuacgagggcuaccuaucagauaccaaacuccugcaauacgcgcagaacauacggggagagaaauaguugaucuuaugugccacgcgacuuuuacuaugagacuuuuaaguccuguacgagucccaaauuauaauuuaauaauaauggacgaagcgcacuuuacggaucccgcaaguauagcugcaaggggcuauaucagcacaagaguagagaugggggaagcugccgggauauucaugacggccacaccacccggcagcagggacccauuuccacagagcaacgccccgauuauggacgaagaacgagaaauaccggaaaggagcuggaacaguggucacgaaugggucacugauuucaaaggaaaaacaguaugguucguuccaagcauaaaagcuggaaaugacaucgcagcuugcuuaaggaaaaacggaaagaagguuauccaauuaucgagaaaaacauuugauucugaauaugucaagacucgugcuaaugacugggauuuugugguaacgacagauauaagcgaaaugggagcuaacuuuaaggcugagcgaguuauugauccacgucgauguaugaaacccguaauauugacugacggggaagaaagaguaauucucgcgggaccgaugccaguuacucauucgucugcugcgcagaggagaggaagaauaggaagaaauccgaaaaacgaaaaugaccaguacauuuauaugggcgagccguuagaaaaugacgaagauugcgcacacuggaaagaagcgaaaaugcuacuagauaauauuaauaccccggaagggauaauaccaucaauguucgagccugaacgggaaaagguggaugcaauagauggugaguaucgcuuacggggagaagcgagaaaaacuuucguugaucuuaugagaagaggggaccuucccguauggcuagcauauagagucgcugccgaaggaaucaauuacgcggauagacgcugguguuuugauggaaucaaaaauaaucaaauacuggaggagaacguagaagucgaaauuuggacaaaagaaggggaaaggaagaaacugaaaccgagauggcucgacgcuaggauauauagcgaucccuuagcacuuaaggaauuuaaagaauuugcagcaggcaggaaaucuuuaacgcuuaaccugauaacugagaugggacguuuaccuacauuuaugacacaaaaggcccgugacgccuuggacaauuuggcuguauuacauaccgcugaagcuggagggcgcgcguauaaccaugcauuaucugaauuaccugaaacauuagaaacuuuacugcuauuaacuuugcuagcgacugucacgggugguaucuuuuuauuuuuaauguccgguaaaggaauuggcaaaaugacacugggaaugugcuguauaauaacagcuaguauauuauugugguacgcacaaauacaaccucauuggauagccgcauccauuauacucgaguucuuucuaauaguuuuacuaauaccggaaccagaaaaacaaagaacuccgcaggauaaucaauugacuuaugucguaauugcaaucuuaacgguaguugcagcuacaauggcgaaugaaaugggguuuuuagagaaaacgaagaaggauuuaggauuagguucaauaaccacacaagaaucggaaaguaacauucuagacauagaucuccgaccugcuagugcuuggacacuauaugcaguagccacuaccuucguaacaccaaugcugcggcauucaauagaaaacagcagugugaaugucucucugacugcaauagcaaaccaagcgacaguauuaaugggauugggaaaaggauggccgcuaagcaagauggauauagguguaccacuucuagccauaggauguuacucacagguaaacccgauaacacuaacagcggcacuacuauuauuaguagcacauuacgcuauuauagggcccggguuacaagcuaaagcaacccgggaagcacagaaaagagccgcugcagguauuaugaagaaucccaccguagaugguauuacaguuauugauuuggagccaauaccauaugacccaaaguuugaaaaacaacuaggccaagucauguugcucauacuaugcguuacucagguucuaaugaugagaacgacaugggcacuuugugaagcucuuacguuagcuacaggaccaauaucaacauugugggaaggaaaccccgggagauucuggaacacgacgauugcgguaaguauggcgaauauauuccgugguagcuacuuagccggagcuggguuacuguucucuauuaugaaaaacacuacgaacacgaggagaggaacuggaaacaucggggaaacguuaggggagaaauggaagucaagauugaaugcauuaggaaaaagugaauuucagauauauaagaaaaguggaauccaagaaguugaucgaacuuuggcaaaagaaggcauaaaaagaggggagacagaccaccaugcagucucacgggguuccgcgaaacugcgaugguucguagaacgaaacaugguaacacccgaaggcaaaguaguugaucuagguuguggcagggguggauggucuuauuauugugggggacuaaagaacguaagggaaguaaaaggguuaacaaaaggaggucccggccacgaagaaccuauaccgaugucgacuuauggcuggaacuuagugagauuacaaucaggaguugacguguucuuuaccccaccugaaaaaugugauacucuucucugugauaucggagaaaguucacccaauccaacaauagaagccggaaggacucugcgagugcuaaauuuaguugaaaauugguugaauaauaauacgcaauucuguaucaaaguacugaacccauacaugcccucaguuauagagaaaauggagacgcuacaaagaaaauauggaggggcguuagucagaaaccccuuaucccguaauuccacccacgaaauguacugggucucaaaugcaaccgguaacauuguuaguagcgucaacaugauaucacgaaugcuaauaaacagguucacgaugaaacauaagaaagcuacauacgagccagauguggaucuugggaguggcacaagaaauauagggauagaaucugaaauuccuaacuuagacauuauaggcaaaaggauagagaaaauaaagcaagagcaugaaacuucguggcauuaugaucaagaccauccauauaaaacaugggcauaucaugguaguuaugaaacaaaacagacaggaagcgcaucuuuuaugguaaauggagugguaagacuacucacuaaaccuugggacgucguaccuauggucacgcaaauggcaaugacggauacaacaccauuuggccaacagaggguguucaaagaaaagguggacacaaggacgcaagaaccuaaagaagggacuaagaaacuuaugaaaauuaccgcugaauggcuauggaaggaacuggggaagaagaaaacgccgagaauguguacuagggaggaauuuacccguaaaguuagaaguaacgcggcauugggggcgauauuuacagaugagaauaaguggaaaagcgcgagagaggcaguggaagacucaagguucugggaguugauagaucgagaacggaaucuacaucucgaaggaaaaugugaaacuugcguuuauaacaugauggguaaacgagagaagaaauuaggggaguucgggaaagcgaaagguagcagagcaauaugguauaugugguuaggugcaagauuccuagaauuugaggcccuaggcuuccuaaaugaagaccauugguucucacgcggcaacucccucagugguguugaaggcgaaggauuacaucgcuugggauauaucuuaagagaugucaguaagaaagaaggaggugcuauguacgcagaugacacagcagggugggacacccguauaacuuuagaagauuuaaagaacgaagagaugguaacaaaucacaugaaaggggaacacaagaaauuagccgaagcgauuuuuaaacugacauaucaaaauaaaguaguacgaguacagcggcccacuccccguggcacagugauggauauaaucucacgaagagaccaacggggaagcggacaaguagguacuuacggacuaaauacauuuaccaauauggaggcacagcuaauccgacaaauggagggcgaaggcauauucaaaaguauacagcauuuaacaguuacagaagaaauagcaguacaaaauuggcuugccagaguggguagagaacgguuaucccguauggcaauuucgggcgacgacugugucgucaaaccauuagaugacagauucgccagugcgcuuacagcuuuaaacgauauggggaaaguacgcaaagacauucaacagugggaaccgucuagaggauggaaugauuggacacaagucccguuuugcagucaccauuuccacgaguuaguaaugaaagaugguagaguccuugucguuccauguagaaaccaggaugaacugauaggacgagcccgcauuucccaaggugcagguuggagcuuaaaagaaacagccuguuugggaaaaucauacgcucaaauguggaccuuaauguacuuucaucguagagaucugagacucgcugcaaacgcuauaugcagugccguaccaagccauugggucccgaccagccguacaacauggaguauacacgccaaacaugaauggaugacaaccgaggacaugcuagccguauggaaucgcguuuggauacaagaaaaccccuggauggaggauaaaaccccuguugagagcugggaggaaguacccuaccuaggaaaacgggaagaucagugguguggaucuuuaauuggauugacaaguagagcaaccugggccaaaaauauucaaacagccauaaaucaaguaagaaguuuaauaggcaacgaagaguauaccgacuauaugccuuccaugaagagauuucgucgagaagaagaagaagccgguguacucugguaa

SEQ ID NO: 22540 - RNA, 9876 nt, Artificial Sequence
  derived and/or modified CDS sequence (opt6) from DENV-2__EU482565__SS-prME
acagcgggaguuauaauaaugcuaaucccaacagcaauggcauuucaccuaaccacaagaaacggagaaccacauaugauaguuggaagacaagaaaaagguaaaucauuacuauuuaaaacggaagauggaguuaacaugugcacacuaauggcaauugacuuaggcgaauugugcgaagauacaauaacauacaaauguccacuccuucgccaaaacgaaccugaagauaucgacuguuggugcaacucuacauccacuuggguuacuuauggaacaugcacaacaacuggugagcacagaagagagaaaagaucuguagcauuaguaccucacguggguaugggauuagaaaccagaacagaaacuuggaugucuagugaaggugcuuggaaacacguccagaggaucgaaacauggauuuuaagacacccaggauucacuauuauggcagcuauucuagcuuauacaauuggcaccacgcauuuucaacgggcuuuaaucuucauauugcuuaccgcgguggcaccuaguaugacaaugcgguguauugguauuaguaaucgggauuucguugaagggguuucuggugguaguuggguggauaucguuuuggaacauggcucauguguuacaacaauggcgaaaaauaaaccgacccucgauuucgaacuuauaaaaacagaagcaaaacaaccagcuacauuaaggaaauauugcauagaagcuaaacuaacgaauacuaccacagaaucucgauguccaacacaaggggaaccaucacuaaacgaggaacaagauaaacgauuuaucugcaaacauagcaugguugacagagguuggggaaaugguugugguuuauuuggaaaagguggaauaguaacaugugcgauguucacguguaagaaaaauauggaagguaaaguggucuuaccugaaaaucuagaauacaccaucgugauaacuccacauaguggcgaggaacacgcgguaggaaacgauaccggaaaacauggaaaagaaauaaaaaucacaccucaauccucaauaaccgaggcugaguuaaccgguuauggaacaguaacaauggaguguuccccucgaacggggcucgauuuuaacgaaaugguccuacuccagauggaagauaaagcauggcugguacaccgccaaugguuucuagaccuuccacugccguggcugccaggugcugacacucaaggcucgaacuggauucagaaagagaccuuaguaaccuuuaaaaauccacaugccaagaaacaagauguuguaguccucggcagucaagaaggcgccaugcauacugcccuaacaggagcaaccgaaauacaaauguccucugggaauuuauuauucacgggucaccuaaagugucguuugaggauggacaaauugcaacuaaaagguaugaguuauaguauguguacuggaaaauucaagauaguaaaggaaauagccgaaacacagcaugguacaaucgugauucguguacaauaugaaggugauggcucaccaugcaaaauuccauuugagauaauggauuuagagaaacgacacauccuaggacgucuaauaaccguaaauccaauaguaacugaaaaagauucacccgugaauauugaggcggaaccuccuuucggugacaguuauauuauuauaggcgucgagccaggacaauuaaagcuaaauugguucaagaaaggaucaaguauagggcaaauguucgaaacaacaaugaggggcgcgaaacgaauggcgauauugggcgauacagcuugggacuuugguagccugggaggaguauuuacaucuauuggaaaagcccuucaccaaguauuuggugcaauuuacggugcugcuuuuucaggcguauccuggacuaugaaaauacuuauaggaguaauuauuacauggauagguaugaacucgaggaguacaucauuaucaguuucccuaguauuaguuggcguuguaacgcuguaucugggcguuauggugcaagcagauaguggaugcgugguuagcuggaaaaauaaggaacucaaaugugguagugguauuuuuauaacugacaauguacauaccuggaccgaacaauauaaauuccaaccagaaucuccaccaaagcuagcuucugcaauccagaaagcgcacgaagaagggauaugcggaauaagaagcguuacaagacuggaaaauuuaauguggaaacagaucacaccggaguugaaucacauccuaucagaaaacgaaguaaaacucacgauaaugacaggcgauauaaaaggcauaaugcaagcaggaaaaagaaguuuacggccacaaccgacagaacuaaaguauaguuggaaaacuuggggaaaggcaaaaaugcuaagcacagagucucauaaccagacauuuuuaauugauggaccagaaacagcagaguguccgaauaccaaccgagcauggaacucauuggaaguggaggacuauggauucggaguauuuagcaccaauauuuggcuuaagcucagagagaagcaagauguauuuugcgacagcaaauuaaugucugcagcgauaaaagacaauagagcuguccaugcugacaugggcuacuggauugaauccgcgcucaaugauaccuggaaaauggagaaggccagcuucaucgagguuaaaaguugucauuggccgaagucacauacguuauggucaaaugguguguuggaaagcgagaugauuauccccaaaaauuuugccggcccaguaagccaacauaauuauagaccugguuaucacacgcagacagccggaccuuggcaccugggcaaauuggaaauggacuuugauuuuugugaagguacaacaguuguuguuacagaagauuguggaaaccguggccccagcuuacguacuaccaccgcuucgggcaaacuaauuacugaaugguguugucguucuuguacguuaccaccguuaagguauaggggagaagauggauguugguaugguauggagauaagaccccuuaaagagaaagaagaaaaccuagucaacagccuuguaacagcgggucacggucaaauagacaauuuuucacuuggcgucuuagguauggcucuauuccuugaggaaaugcucagaacucggguaggcacgaagcaugcaauccuauuaguagccgucagcuuuguaacacuaaucacaggaaacaugaguuuccgugaucugggccgaguaaugguaaugguaggagcaacuaugacugacgacauaggcaugggaguuacauauuuagcuuuacuagccgcauuuaaaguccgaccgaccuuugcagcugggcuacuguuaagaaaauugaccagcaaggaacuaaugauggccacaauagguaucgcucuacuaucgcaaucuacuauuccagaaacgauucuugaauuaacugacgcacucgccuuaggcaugauggucuuaaaaauagugcgaaauauggaaaaauaccagcuggcagucacaaucauggcuauaagcugcguaccuaacgccguaauucuacagaaugcuuggaaagucagcugcacuauacuagcugcugucucaguuagcccucuucuacucacuuccucacaacaaaaagcagacuggaucccauuagcacucacaauaaagggacugaauccuaccgcgauauuuuuaacuacucuuucgaggacuucgaagaaaagaaguuggccauuaaaugaagcggucauggcaguaggcauggugaguauacuggcuucgagccuccugaaaaaugacauuccaaugacaggaccauuaguugcagggggacuacuaacugucugcuauguguugacugguagguccgcugaucuagaauuagagagagcagcugauguaaaaugggaagaccaagcggaaauaucuggaucaucacccauucuaucaauaacuauuuccgaagacgguucaaugagcaucaaaaaugaggaagaagaacacacccuaacaauucuuauuagaacgggccuucuagugauuucgggcguauucccugucucaauaccgauuacugcugcagcuugguaucuuugggaggucaagaaacaacgagcagggguuuuaugggauguuccaucacccccuccgguggguaaagcagaacuagaagauggagccuaucgaaucaaacaaagggguauauuuggauacucacagauaggugcuggaguguauaaagaaggcaccuuccacacgauguggcauguaacgagaggagcaguauuaaugcaucgaggaaaacgaauugaaccuucaugggcugaugucaagaaagaucuuauaagcuacggcggaggauggaaacuagagggcgaauggaaggaaggagaggaggugcagguucucgcuuuggaaccaggaaagaauccaagggcaguccagacaaaaccuggacuguucaaaaccaauacagguacaauaggggccguuaguuuagacuucagcccugguacaaguggauccccaaucguugauagaaagggcaaagugguaggucuauacggcaauggaguagugacacggucaggugcuuacguaucagcaaucgcacaaacagagaaaagcauagaggauaauccagaaauugaagaugacauuuuuagaaagaaacggcugacaauaauggaccuacauccaggggcuggaaaaacaaagagguaucuacccgcaauaguaagagaagcuauaaaaagaggcuugcgaacauugauacuagcaccaacgaggguagucgcagcagaaauggaagaagcgcuaagaggccuaccgauucgauaucagacuccugcuauccgugcagaacacacagggagagaaauuguagacuugaugugucaugccacauuuaccaugcgauuacuuucaccagucagaguuccaaauuacaauuuaauaauuauggaugaagcccauuuuacggacccagcgucuauugcagcgagaggauacaucuccacacguguugaaaugggggaagcagcugguauuuuuaugacagcaacuccgcccggaucccgggauccguuuccacaaaguaaugcgccuauuauggaugaagaaagagaaauccccgaaagauccuggaacucgggacaugaauggguuacagauuucaaaggaaaaacaguuugguucgugccuuccaucaaagcagguaaugauauagcugcauguuuaaggaaaaaugggaagaaaguuauucaauuaucuaggaaaacguuugauucagaauacgugaaaacuagggcuaaugauugggacuuuguaguuacuacugacauaucagagaugggagcaaauuucagagcggaaagaguuaucgacccucgcagauguaugaaaccaguaauucuaacagacggagaagaacgaguaauauuagcgggcccuaugcccguuacacacucuucagcagcacaacggagagggcguauaggucguaauccaaagaaugagaaugaucaguauauauacaugggcgagcccuuagagaaugaugaagacugugcacauuggaaagaagccaaaauguuacuugauaauauuaauacuccugaaggcaucauuccaucuauguuugagccugaaagagagaaaguggaugcaaucgauggggaguacagauuacgaggcgaggcuagaaaaaccuucguagauuuaaugcgucgcggagacuuaccaguaugguuagccuacagagucgccgcagaaggcauuaauuaugccgauagacgauggugcuucgacggaauuaagaauaaucaaauucuagaagaaaacguugaaguugagaucuggacgaaagagggagaacggaagaaacuaaaaccccgaugguuggacgcucgaauauauagugauccgcuagcgcuuaaagaguuuaaagaauuugcagcggggagaaaaagccuaacacucaaucugauaacugaaaugggaagauuaccaacguuuaugacgcaaaaagcaagagacgcguuggacaauuuggccguuuuacauacagcagaaguagguggcagagcuuacaaucaugcauugucggaacuccccgagacccuggaaacacuccuauuacucacucuauuagcaaccguuacaggcgguauauuucuuuuucuaaugucagguaagggaauaggaaagaugacgcuggggaugugcugcauuauaaccgccuccauacuauugugguacgcacaaauucaaccacauuggauugcagcuucaaucauacuugaguucuuucuaaucgugcuacuaauuccggaaccugaaaaacaaagaacaccacaagauaaccaauuaacauacguaguaaucgcaauuuuaacuguuguagccgcaacaauggccaacgaaaugggauuccuugagaaaacgaagaaagauuuggggcuuggaaguauuacuacccaagaaccagaaucaaauauucuugacauagacuugagacccgcauccgcauggacucuauaugcaguugcaaccacauuugugacaccaaugcugagacacagcaucgaaaauaguagcguuaauguaucgcuaacggcgauagcuaaucaagcuacuguuuuaaugggucuaggacgaggguggccauuauccaaaauggauauugguguccccuuacuagccauaggcuguuacucacaagucaacccaaucacacucacugcagcauuguuacuccuaguugcacauuacgccauaauugguccaggacuacaagcgaaagcaacuagagaggcucaaaagagagccgcggccgguauuaugaaaaauccuaccguagaugggauuaccguuauugacuuagaacccauaccauaugacccaaaguuugagaaacaauugggucaaguuauguuauuggucuuaugugugacacaaguauuaaugaugcgcacuaccugggcacuaugugaagcauuaacauuggcaacggguccaaucuccacuuuaugggaagguaacccaggacgcuucuggaauacuacaaucgcaguuucgauggcaaauauuuuccgcggauccuauuuagcgggggcaggacuuuuauucucaauuaugaagaauacuacuaacacacgacgggggaccggaaauauaggugaaacguuaggagaaaaguggaaaucuagacuaaacgcucuagggaaaagugaguuucagauuuauaaaaagucuggcauccaagagguagauaggacccucgcuaaagaagguauaaaaagaggggaaaccgaucaccaugcaguaucuagagguagugcaaaauugagaugguuuguagaacgcaauauggucacucccgaagggaaaguuguggacuugggauguggacgaggcgggugguccuauuacugugggggacuaaagaauguuagagaaguaaaaggacucacuaaaggagggccaggucacgaggaacccauacccaugucaacguauggguggaacuuagucagguugcaaucgggcguggacguauuuuucacacccccugagaaaugugauacacuauuaugugauauuggugaguccaguccgaacccaacaauagaagcugggcgaacuuuaagaguguugaaccucguggaaaauuggcuuaacaauaacacgcaauuuuguauuaaaguuuuaaauccauauaugccaagcguaauagaaaagauggaaacacuucagcguaaauacgguggcgcuuuaguucgaaauccauuaaguagaaauucgacucaugagauguauuggguuucaaaugcuacaggaaauauagucaguucaguaaacaugauaucucgaauguugauaaacagauucacuaugaaacauaagaaagcgaccuacgaaccugauguagaucucgguaguggaaccagaaacguggggauugaaaacgaaauacccaauuuagauaucauaggaaaacguauagagaaaauaaaacaagagcacgaaacguccuggcauuacgaucaagaccacccauacaaaacgugggcguaccacgguucauacgagaccaaacaaacgggaucggcuagcagcauggucaauggcguaguacgauugcuaacaaaaccaugggaugucguuccgauggugacacaaauggccaugacggauaccacucccuuuggucaacaaaggguauucaaagaaaaaguagauacuagaacucaggaaccaaaagaggguacgaagaagcucaugagaauaacggcugaauggcuguggaaagaauuagguaagaagaaaacaccgagaauguguacacgggaagaauuuacccguaaaguacgaucaaaugcagcacuaggugcaauauucacggacgagaauaaguggaaaucugcacgagaagccguugaagacucccgguucugggaauuggucgaucgagaacggaauuugcauuuggaggguaaaugcgagacaugcguauacaauaugauggggaaaagggagaagaaauuaggggaguucggcaaagcaaagggaucaagagcaauuugguauauguggcucggagcucgcuuccuagaauuugaggcacucggguuucuaaaugaagaccauugguuuagcagaggaaauucacuaaguggagucgaaggugagggccuccacaaacuagguuauauacuccgagaugugucaaagaaagagggaggagcaauguaugcagacgauacagcaggaugggacacuagaauaaccuuggaagaucucaaaaaugaggaaauggucacaaaucacaugaaaggagaacauaaaaagcuagcagaagcuauuuucaaacuuacauaccaaaacaaagugguucgaguccaaaggccuacgccccguggaacaguaauggauaucauuucgcgaaaagaucaaagaggaucaggccaaguugguacauacgggcuaaauacuuuuacuaacauggaagcccaguuaauacggcagauggaaggggaaggcauuuucaaaucaauacaacgauuaacgguaaccgaagagauugcgguucagaauuggcuagcccgagugggucgcgagcguuuaucgaggauggcaauaagcggagaugauugcguaguaaaaccacuugaugaucgguuugcaagugcauuaacugcacuuaacgacaugggaaagguacguaaagauauacaacaaugggaaccaucaagggguuggaaugacuggacucagguaccuuuuuguagccaucauuuccaugaacuggugaugaaagaugggagaguucucguaguucccugcagaaaccaagaugagcugauaggacgggcucggauuagucaaggugccggauggagcuugaaagaaacagcuugucuuggcaaaagcuaugcccaaauguggacucucauguauuuccacagacgagaucuucggcucgcugccaaugcgaucuguucugccgugccaucucauuggguaccgacaucgagaacuacauggucuauccaugcaaaacacgaauggaugacaacagaggacaugcucgcggucuggaauagaguauggauccaagaaaauccuuggauggaggacaaaacaccaguggaauccugggaagagguuccauaccugggaaaaagggaagaccaaugguguggcagcuugauuggucugacaagucgugcaaccugggccaaaaauauacaaacagcaauaaaccagguucguaguuuaauuggaaacgaagaguacacagauuacaugcccaguaugaaaagguucaggaaagaggaggaagaagcagggguucuaugguaa

SEQ ID NO: 22541 - RNA, 9876 nt, Artificial Sequence
  derived and/or modified CDS sequence (opt6) from DENV-2__EU529700__SS-prME
acugcgggaguuauuauaaugcuaauuccaacggcuauggcuuuccaucugacgacacgaaauggugaaccgcauaugauaguaggacgacaggaaaaagguaaaagucuuuuguucaaaaccgaagauggagugaauauguguacuuuaauggcaauagaucuaggugaauugugugaagauaccauaacauauaaaugcccucuccuccgacaaaaugaaccagaagauauagacuguuggugcaacucaacgucaaccugggugacauacggaacguguacaacaacaggugaacacagaagagagaaaagaucaguugcucuuguuccgcaugucgggaugggacucgaaacaagaacagaaacuuggaugagcucagagggggccuggaaacacgugcaaagaauagaaacuuggauucuacgccaucccggauucacaauaauggcggcgauucuagccuauacgauagggacaacgcauuuucagagagcgcuaauuuuuauucuacuuacggccguagccccuucaaugacuaugcgguguaucgggauauccaacagagauuucguugagggcguaaguggcgggaguugggucgauauuguccuugaacauggaucauguguaacgacaauggccaaaaauaaacccacauuagauuuugaacuuauuaaaacugaagcuaaacagcccgccaccuuacgcaaauauuguaucgaagccaaauuaacuaauacaacaacagaaucuagaugcccaacacagggagaaccaagccuaaacgaagaacaggacaaacgauuuauaugcaaacauucgaugguagacagggguuggggaaacgggugcgggcucuuuggaaagggaggaaucgugaccugcgccauguuuacguguaagaaaaauauggaggggaaaguuguccugcccgagaauuuagaguacacaaucguaaucacgccucacagcggggaggaacacgcaguaggaaacgauacaggaaaacacggaaaagaaauaaagauaaccccucaaagcaguauuacagaagcagaacugacagguuacgguacaguuacuauggaguguucuccaaggaccggacuugacuucaacgagauggugcuguuacaaauggaagauaaagccugguuaguacaccgacaaugguucuuggaucucccauuaccauggcuccccggagcugauacccaaggaucaaauuggauacaaaaagagacgcuuguuaccuucaagaauccccacgcuaaaaagcaggaugucguuguccuuggaagucaagagggagcuaugcacaccgcgcucacaggagcuaccgaaauucaaaugucuaguggcaaucuuuuguucacgggucaucucaaauguagacuuagaauggacaaauuacagcuuaagggaaugucuuauucaauguguacagguaaguucaaaauuguaaaagaaauagcagaaacucaacaugguacgaucgucauuaggguccaauacgaaggagaugggucaccauguaaaaucccauuugagauuauggaucuugaaaaacggcacguccuaggaaggcuaauaacaguuaaucccaucguaacggagaaagacagcccugugaauauugaagcagaaccaccuuuuggagacaguuauauaauaauaggaguagaaccaggacaacuuaaauuaaauugguucaagaaaggguccucuauaggacaaauguucgaaacaaccaugcguggagccaagagaauggcaauauuaggagacacagcaugggauuuuggcaguuugggaggcguauuuaccucaaucgggaaagcauugcaucaaguuuuuggagcuauauacggcgcggcuuuuucuggaguuaguuggacaaugaaaauuuuaauugguguaauuaucacauggauaggcaugaacucgaggucuaccucguugagcguaagccuaguccuagugggcguaguaacuuuauauuuagguguuaugguccaagcugacucuggaugcguugucaguuggaaaaacaaggaauugaaauguggaagugguaucuuuauuacagacaacgugcauacauggacagagcaauacaaguuucaaccugaaucacccaguaagcuagcgucugcaauucaaaaagcucaugaggaagggauaugcgguauacguucaguaacgagacucgaaaauuuaauguggaaacaaauaacaccugaacuaaaccauauauuaagugaaaacgaaguaaaacuaacgauaaugacuggagacauaaaaggaauuaugcaagcuggcaaacguucauugcgaccacaacccacggaauuaaaauauaguuggaaaacuuggggaaaagcaaaaaugcuauccacggagagccauaaucagaccuuuuuaauugacggcccggagaccgccgaauguccuaauacuaaccgagcauggaauagcuuagaaguagaagauuacggcuuuggcguauuuuccacaaauauauggcugaagcuaagagagaaacaggacguauucugcgauucaaaacucaugagugcagcgauaaaagauaauagggcaguucaugcggauaugggguauuggauugaaagcgccuuaaaugauacauggaaaauggaaaaagcgucauuuaucgaagugaaaucaugucacuggccuaagucacauacucuuuggucaaacggaguacucgaaagugaaaugauaaucccuaaaaauuucgcuggcccaguaucacaacauaauuauagaccaggcuaccauacucaaacugcagguccauggcaccugggaaaauuggaaauggauuucgacuuuugugaaggaacuacggugguaguaaccgaagacugugguaacagagggccaagucucagaacgacaacugccagcgguaaguuaauaacggaaugguguugucgaaguuguacgcuaccacccuugcgguacagaggugaggauggaugcugguacgguauggagauacgaccacuuaaagaaaaggaggagaacuuagucaauagucuuguaacugcgggucauggccaaauagacaacuucaguuuaggugugcuaggcauggcgcucuuucuugaagagaugcuaaggacccggguagggacgaaacaugcaaucuuacuuguagcggucaguuucgucaccuuaaucacagggaauaugaguuuucgggaucuaggaagaguuaugguaauggucggcgcuacuaugaccgacgauauuggaaugggaguuacuuacuuagccuugcuagcagccuuuaaaguuaggccuaccuucgcagcgggguuacuuuuaagaaaauuaacaaguaaagaacuuaugauggccacuauuggaauagcauugcuuucacaaagcaccauuccugaaacuauacuugaacuaacagacgcauuagcucuaggaaugaugguucuuaaaauaguacggaaccucgaaaaauaucaacuugcagugacaauuauggccauaucguguguaccaaaugcaguuauacuccaaaaugcauggaaaguaucgugcacuauccucgcagccguaaguguaucgccacuuuuacucacuucuucucaacaaaaagccgauuggauaccguuagcgcucacgauuaaagguuugaacccuacugccauauuccuaacaacacuaagucggacaucgaaaaagagaucuuggcccuugaacgaggcugucauggccguugggaugguuucaaucuuagcuucgucguuacucaaaaaugauauaccaaugacuggcccucuaguugcugguggacuucuaacaguauguuauguauuaaccggacgaagugcggacuuagaacucgaaagggcagcagauguaaagugggaagaccaggcagagauaagcgggaguucacccauccugagcauaacuauaucagaggacggcucgaugucgauuaaaaaugaagaagaagaacagacucuuaccauauuaauaagaaccggacucuuaguaauuucuggcguauuuccagucucgauuccaaucacugcagccgccugguauuuaugggaaguaaagaaacaacgcgcggggguacugugggauguuccaucaccaccaccggucggaaaagcagaauuagaggauggagcauauagaauaaaacaacgaggcaucuuugguuacucacaaaucggagccgguguauacaaagaggguacauuccacacaauguggcacguaacuagaggugcagucuuaaugcacagagguaagcggauagagccuaguugggcugacgugaagaaggaucuaauaagcuaugguggggguuggaaauuagagggagaguggaaagaaggggaagaaguucaaguguuagcauuagagccgggcaagaauccaagagcuguucaaacaaaacccggacuguuuaagacaaauacagguacaauuggggcaguaucacuagacuuuucaccugggacuuccgguagucccauagucgauaggaaaggaaaaguagugggucuauauggaaaugguguugugacucgguccggagcauacguaucugcgauugcccaaacugaaaaaucaaucgaagauaaccccgaaauugaagacgauauauuucguaagaaacgauuaacuauuauggauuuacacccaggggcagguaagacaaagcgauauuuaccugcgauaguacgugaggcuauaaaaagaggacuacggacacuuauacuagcgccaacgaggguaguagcugcagagauggaagaagcucuaagaggacuaccuauaagguaccaaacuccagcaauccgggcggaacauacugggagggagauaguugacuuaaugugucaugccacguuuacuaugagauuauuaagcccagucagggucccaaauuauaaccuuaucauuauggaugaagcucacuucacagauccagcaaguaucgcugcacggggauauauaagcacuaggguggaaaugggcgaagcagccggaauauucaugaccgcgacaccuccaggaagccgugauccauuuccucaaaguaacgcucccaucauggacgaggaacgggaaauccccgagcgaucauggaacucaggucaugaauggguaacagauuuuaagggaaaaacuguaugguuuguaccgucuauuaaagccgguaaugauaucgccgcauguuuaaggaaaaauggcaagaaaguaauccaacucagucggaagacuuuugauuccgaauauguaaagacgcgagcaaaugauugggauuucguaguuacuacugauaucagcgaaaugggugcuaauuuuagagccgaacgaguaauugauccgagaagguguaugaaaccaguuauauuaaccgauggagaggagcgcguuauucuagcaggcccaaugccgguaacacauucaagcgcugcacagaggcgaggacguauaggcagaaaucccaaaaaugaaaacgaucaauacauuuauaugggggaaccucuagaaaaugaugaggauugcgcacauuggaaagaggcuaaaauguuauuggauaauauaaauacaccagaagggauaauuccaaguauguuugaacccgaaagagaaaagguugacgcaauagauggugaauaucgucuacguggcgaagcgcgaaaaacuuuuguugaccuuaugaggcguggggaucuuccaguaugguuagccuaucggguagcagcagaaggcauaaacuacgccgacagacguuggugcuuugacggaauuaagaacaaucagauucuggaagaaaaugucgagguagaaaucuggacaaaggagggggaacguaagaaacuaaaacccagguggcuagaugcccgcauuuacucagauccauuagcuuuaaaggaguucaaagaauuugcugcaggacgaaaaagccuuacuuugaaucucauuacagaaaugggccguuuaccuacuuucaugacucaaaaagcccgcgacgcacuagacaauuuagccguguugcacacggcagagguagguggucgcgcauauaaucacgcucuaucagaguuaccggaaacuuuggagacauuauuauugcuuacuuugcucgcuacaguaacgggaggaaucuuccuauuucugaugaguggaaagggaauugggaaaaugacauuaggcaugugcugcaucaucacggccuccauauuacuaugguaugcacaaauucaaccacauuggauagcggccaguauaauacuagaauuuuucuuaaucguacuacugauaccagaacccgaaaaacaaagaacaccacaggauaaccaguuaaccuauguuguaauagcaauacucacugucguagcagccaccauggcaaacgaaaugggguuuuuggagaaaaccaagaaagaccuuggguuaggaucgauaaccacacaggaaagugaguccaacauacuagauauagaucuaaggccugccagugcuuggacucucuaugcaguggcaacaacuuuugugacaccaauguuaagacauaguaucgagaacaguagcguuaauguuaguuuaacugcuauugcgaaucaggcgacuguccugaugggauuaggcagaggauggccccuauccaaaauggacauaggcguaccacuguuggccauaggaugcuacucucagguaaacccaauaacgcuuacagcagccuuacuguuauuaguagcacauuacgcgauaauaggcccuggacuacaggccaaggcgaccagagaagcacagaaaagagcagcagcggguauaaugaaaaaccccaccguagauggaauaacaguaauugauuuagaaccaauaccauaugaucccaaauuugaaaaacaacuaggacaaguaaugcuauugguuuuauguguuacgcaaguacucaugaugcgcacaacaugggccuugugugaagcucuaacacuagccacugguccaauuucgacacuaugggaagguaauccaggaagguuuuggaauacgacgaucgcaguaucgauggccaacauuuuuaggggaagcuaccuugcaggagcuggacuuuuauuuagcauaaugaaaaacacaaccaacacaaggagagggacaggcaauaucggugaaacucugggagagaaauggaaaaguagauuaaaugcacugggaaagagugaauuucaaauauacaagaaaucagguauucaagaaguagaucgcacucuggcaaaagagggaauuaaaagaggugaaaccgaucaucaugcugucucuagagguucggcgaaacuaaggugguuugucgaacgaaacaugguuacaccggaaggaaagguaguagauuuaggcugcgguagaggaggauggucauacuacugcgggggacucaagaauguacgugaaguuaagggauuaacaaaagggggacccggacaugaagaacccauuccaaugucaacauauggauggaauuuaguacgucuccagucaggcgucgauguauuuuucacaccgccagaaaaaugugauacccuuuuaugcgauauaggugaaaguucaccaaacccuaccauugaagccggcagaaccuuacggguacuuaaucuaguagaaaacugguuaaauaauaacacacaauucugcauaaaaguauuaaaucccuacaugccaagcguaauagagaaaauggaaacccugcagcguaaauacggaggugcguugguaaggaacccucuaucuagaaacucaacgcacgaaauguacuggguuucgaaugcgacagggaauauaguaagcaguguuaauaugauaagcagaauguugaucaacagauucacaaugaagcauaagaaagcaacuuaugagcccgacguagaucugggaucagggacacguaauauaggaauagaaaacgaaauuccuaaucucgacaucauaggaaaaagaaucgagaaaauuaaacaggaacaugaaacgaguuggcauuaugaucaagaccacccauacaaaacuugggcauaccauggcucuuacgaaacaaaacagacaggcucagcgaguucgaugguuaacgggguugugagauuacuuacgaagccuugggacguugugccuaugguaacacaaauggcaaugacagacacaacuccuuuuggccagcaaagggucuuuaaagaaaaaguagauacaagaacgcaagagccaaaagaaggaacuaaaaagcuaaugcgaaucacagccgaaugguuauggaaggaauuaggaaagaagaaaacacccaggauguguacuagggaagaauuuacucgaaaaguaaggucgaaugcagcccuaggggcuauuuucacugaugaaaacaaguggaaaucggcucgagaagcugucgaagacagccgauucugggagcuaguugacagagagcggaauuuacaccucgaagguaaaugcgagaccugcguauacaauaugauggguaagagagagaagaaacuaggggaguucggcaaagcaaaagguagccgagcgaucugguauauguggcuaggagccagauuuuuagaauuugaggcccuaggauuuuuaaaugaagaucacugguuuagucgcggcaauaguuuaucaggaguagaaggcgaaggguuacauaaguuaggcuauaucuuaagggacguuagcaagaaagaaggcggugcaauguaugcugaugauacagcugguugggauacacggauaacuuuagaagaucuuaaaaaugaagaaaugguaacuaaucauaugaagggcgaacauaagaaauuggcugaagcuaucuucaaacuuaccuaucaaaauaagguaguucguguacaaagaccgacaccuagagguacagucauggauauaauaucaagaaaagaccagagaggaucggggcaaguagggacuuaugggcugaauacauuuacaaauauggaggcgcaacuaauacgucaaauggaaggagaagguaucuuuaaaagcauccagcaucuuaccgucacggaagaaaucgcgguucagaacuggcuagcaagaguagguagggagagacuuuccagaauggcaauuaguggagaugauugcguggucaaaccguuggacgaucgcuuugcuucugcauugaccgcccucaacgauauggguaagguacgaaaggauauacaacaaugggaacccaguagaggauggaacgauuggacgcaaguuccauuuuguagucaucauuuucacgaauuaguuaugaaagauggaagaguacugguagucccaugucgaaaccaagacgaacugauaggcagggcgcgcauaucccaaggugccggguggucccuaaaagaaacggcguguuuagguaagaguuaugcucaaauguggacccuaauguauuuccaccgaagagaucuucgacucgcagcgaacgcaauauguagugcuguuccuucucauuggguaccaacaucgcgcacaaccuggucaauacaugcgaaacaugaauggaugacaacugaggacaugcuugcaguauggaaucgaguuuggauacaagaaaauccuuggauggaagauaaaacgccuguagaaagcugggaagagguaccauaccugggcaaacgggaagaccaguggugugguucauuaauaggacuaacgucgagagcuacaugggccaagaacauucaaaccgcgauaaaccaaguuagaaguuugauaggaaaugaggaguauacugacuacaugccaagcaugaaacgauucagaaaagaggaagaagaggccgguguuuuaugguaa

SEQ ID NO: 22542 - RNA, 9876 nt, Artificial Sequence
  derived and/or modified CDS sequence (opt6) from DENV-2__EU529701__SS-prME
acugcaggcguaauuauaauguuaauaccaaccgcaauggcauuccacuuaacaacuaggaacggcgaaccgcauaugauaguaggacgucaggaaaaaggaaagucacuucuguuuaaaacagaagaugguguaaauauguguacauuaauggcuauggaucugggagaacucugugaggacacuauuaccuacaaguguccgcuucuacgucaaaaugaaccugaagacaucgauugcuggugcaauagcacaucuacuugggucacuuacggcacauguacuacgacaggugaacacaggagagaaaaaagaagugucgcuuuagugccucacguagguaugggauuagaaacaagaacagagaccuggaugucaucggaaggggcauggaaacacguucaaaggauugaaacauggauccuaagacacccuggauuuacaauaauggcagcaauacuugcuuauaccauugguacaacccauuuccaacgugcgcuaauuuuuauacuauuaacggcaguagcgccaucaaugacgaugaggugcauaggaauauccaaucgugauuucguggagggaguuaguggagguucuuggguggauaucguacuugaacaugguucuugugucacgacaauggcaaaaaauaagccgacacuagacuucgaguuaaucaaaaccgaagcuaaacaaccagcaacacuacgaaaauacuguauugaagcaaagcucacaaauacaacgacagagagcagauguccaacucagggugaaccaucacuaaaugaagaacaggacaagcgcuuucugugcaaacauuccaugguagaucggggauggggaaacggguguggucuuuucggaaaagguggcaucguuaccugcgccauguuuacuuguaaaaaaaauauggagggaaagguaguccagcccgaaaauuuagaauauacaauagugauaacaccucauaguggagaggaacaugccguaggaaaugauacaggaaaacacgguaaagagauuaaaaucaccccccaaucaucaaucacagaggcugaauuaacaggauacggaacgguuaccauggagugcagcccuaggacuggccuggacuuuaacgagauggucuuacuacagauggaggauaaagcuuggcucguucaucggcagugguucuuagaccuaccacuaccuuggcuuccuggugcagacacccaaggcagcaauuggauccaaaaagaaacuuugguuacuuucaaaaacccgcaugcaaagaaacaagaugucguuguacucgguagucaagaaggagccaugcauacagcccuuacaggggcaacagaaauccaaaugucaaguggaaacuuacuauuuacuggccauuuaaaaugcagauuacgaauggauaaauuacaauuaaaggggaugaguuacagcauguguaccgguaaauucaagauaguuaaggagauugccgaaacacaacacgggacuauagugauaagaguucaauaugaaggagacggaucucccugcaaaaucccuuuugaaauuauggacuuggaaaaacgccauguauuaggcagauuaauaaccguaaacccaauugucacagagaaagacucacccgugaauauagaagcugaaccaccauuuggugacagcuauaucauaaucggagucgaaccuggucagcugaaguuaaauugguucaagaaggggagcaguauuggucaaauguuugaaacaacuaugcggggggcaaaaaggauggcaauauugggugauacggcuugggauuucggaucauuaggcggggucuuuaccagcgucgguaaagcccugcaccaagucuucggugcuauauauggagcugcauuuagcgguguaagcuggacgaugaaaauauuuauaggggucauuauuacauggauagguaugaauuccagaucaacaucauuaucugucucauugguccuaguuggaguaguaacacuuuaccucggagcaaugguacaagcugauucuggaugcguugucucauggaaaaauaaagagcuaaagugugggagcggaauuuuuaucacagacaaugugcacacauggacagaacaauauaaauuucaaccggaaaguccaaguaaauuagcuucagcaauucaaaaggcacaugaagaaggcauuugcggaauaagaucuguaacaaggcuagaaaaccuuauguggaaacaaauuacuccggaauugaaccauauauuaucagaaaacgagguaaaacuaacaaucaugacaggggauauaaaaggcaucaugcaagcugguaaacgaagucucagaccgcaacccacugagcugaaauacucuuggaagaccuggggaaaagcuaaaauguugucuacugaaucucacaaucagaccuuccuaauagauggaccugaaacagcugaaugcccaaauacuaaccgagcauggaacucccuggaaguugaagauuauggguucgggguauucacuacaaauauauggcuaaagcuaagagagaaacaggacgucuucugcgacucaaaacuaaugucugcggcaauuaaggacaauagagcaguacacgcagauaugggguauuggauugaauccgcgcuaaaugacacauggaaaauggaaaaagcgucauucauagagguaaagucgugucauuggccaaaaagucauacguuguggucaaacggugucuuagaaucagagaugaucauacccaaaaauuuugcuggaccaguuucacaacauaacuacagacccggguaucauacucaaacugcuggcccauggcaucugggcaaacuagagauggacuuugauuuuugugaagguacuacgguugugguaacagaagauugcggaaauagaggaccuucccuaagaaccacuacggccucuggaaaacugaucaccgaauggugcuguagaagcuguacauuaccaccucugcgguaccggggugaagauggcuguugguaugggauggaaauaagacccuuaaaagagaaagaagaaaaccucguaaacagcuugguaacagcaggacacggucaaauugauaacuuuucauugggaguccuaggaauggcacuauuuuuagaggagauguuaagaacacgaguagguacuaaacaugcgauccuauugguggccguaucuuucgucacauuaauuaccggaaauaugucguuucgagaccucggaagaguaaugguaauggucggugccacuaugacagaugauauaggaaugggcgugacauaucuugcucuucucgcagcauuuaagguacgaccaacauuugcagcugguuuacuacuaagaaagcugacaaguaaggaacucaugauggcaacuaucggaaucgcgcugcuuagucagaguacaauacccgaaacuauccucgaacuuacagaugcacuagcauugggaaugaugguacuuaagaucgucagaaacauggaaaaauaccagcuagcuguaacgauaauggccauuucuugcguaccgaaugcuguaauacuccaaaaugcauggaagguuaguuguacgauucuggccgcaguuucaguaucaccacucuugcuaacaucaagccaacaaaaagcggauuggauaccucuugcauuaacuauaaaagguuuaaauccgacagcuauauuuuuaaccacucugucacgaacuucaaagaaaaggagcuggccgcuuaaugaagcgaucauggcuguagguaugguuagcauauuggcuucaagccuuuugaagaacgauauaccaaugacuggcccuuuaguugcaggcggacuauuaacugucuguuaugugcuaacagguagaagugcagauuuagaguuagagagagccgcagacgucaaaugggaggaccaagcggaaaucagcggaucuucuccaauuuugucuauuacuauuucugaagauggaaguauguccaucaagaacgaagaggaagagcaaacgcugacaauauuaauacguacaggacuauuggugauaaguggaguguuuccuguaucaauuccuauaaccgccgcagcuugguaucuuugggagguaaaaaagcaacgcgcaggaguauuaugggauguaccuagucccccaccuguaggcaaagcggaauuggaagauggagcauaccgaauaaaacagagggguauacucggauacucccagaucggagcuggcgucuacaaagaagguaccuuucacacaauguggcaugucacccguggagcuguauugaugcacagggguaaaaggauagaaccaucaugggcugacgugaaaaaagaccuaauuucauacgguggcggcuggaaguuggaaggugaauggaaagaaggugaagaaguacagguauuagcgcucgaaccagguaaaaauccuagagcugugcaaacaaaaccuggauuauuuaaaacaaauacagggacaauuggggcuguaagccuggauuuuucaccuggaacaaguggguccccuauuguugauaggaaggguaaagugguaggauuguauggcaaugguguaguaacacgaucuggagcguaugugagugcgauugcucaaacagaaaaaucaauagaagacaacccugaaauagaggacgauaucuuucgaaaaaaacgcuuaaccaucauggauuuacaucccggugcagguaagacuaagagauacuuaccggcuauagugagagaagcaauaaaacggggauugagaacccucaucuuggcaccaacuagaguagucgcggcagagauggaagaagcucuaagaggguuaccaauuagauaucaaacucccgcuauaagggcugagcauacuggcagagagauaguugauuuaaugugccaugcaacauucacaaugcgccuauugucaccuguacgaguaccaaauuauaacuuaauuauuauggacgaagcgcacuucaccgauccggccucaauagcugcgagagguuacauuagcacaagagucgaaaugggugaagcagcagguauuuuuaugacggcgacuccgccuggaucgagggacccauuuccgcaaucaaaugcgccaaucauggaugaggaaagagaaauaccugaacgaaguuggaacucaggacaugaaugggugacugacuuuaaagggaagacugugugguuugugccgaguauaaaggcaggcaaugauauagcagcuuguuugaggaaaaaugggaaaaaaguaauacaauuauccagaaaaacauucgacuccgaauacguuaaaacacgcgcuaacgacugggauuuugucguaaccaccgacaucagcgagaugggcgcuaauuuuaaagcagaaagagucauugauccaagaagaugcaugaaaccggugaucuuaacagacggagaagaaagagugauuuuagccggaccaaugccagugacccacucuagugcugcucaacguagaggacgaaucgguagaaacccgaaaaacgaaaaugaucaauauauuuauaugggugaaccauuggaaaaugaugaagacugugcccauuggaaggaagcaaagauguuacuagacaacauaaauacuccagaaggcauaauaccgaguauguuugaacccgaacgcgaaaaaguugaugccaucgacggagaauaccguuuacggggagaagcucgaaagacuuuuguugauuuaaugagacgaggagauuugccaguauggcuggccuacagaguagcagcagaagggaucaacuacgcugaucgucgauggugcuucgauggaaucaaaaauaaucagauacuagaagaaaauguagaaguagaaauauggacaaaagaaggagaacgaaaaaaacuaaaaccgcgaugguuagacgcccggauauacagugauccguuagcccucaaggaguuuaaggaauucgccgccggacgaaaaagccucacuuuaaaucuuauaacggaaaugggcagauuaccaacauuuaugacccaaaaggcucgugaugcacucgacaaucuagcgguacuacauacggcagaagcuggggguaaagcauauaaucaugcuuugucagaauugccugaaacauuagaaacucuucucuuauuaacuuuacuugcaacuguuaccggaggaauauuuuuguuuuuaaugucaggaaaaggaauagguaaaaugacauuaggcauguguugcauuaucacugcgucuauauuauuaugguaugcucagauacaaccccacuggaucgcggccagcauaauucuugaauuuuuccuaauaguacuacuaauaccagaaccggaaaagcagcgaaccccacaggauaaccaacuaaccuauguuguuauagcaaucuuaacggucguugcggcgacaauggcaaaugagauggguuuccucgaaaaaacaaagaaagaccucggauuagggucaauuacaacacaagaauccgagaguaauauucuagacauagauuuaagaccugcgagcgcauggacguuguaugccguagccacaacauuuguuacuccaaugcuaaggcacucgaucgaaaacuccagcguaaacguaagcuuaacugcgauugccaaucaagcaacaguacuaaugggccuugguaagggguggccacuuaguaagauggacauuggggugccacuucuggcaauuggcuguuacucucaggucaauccgauaacccucacagcagcucuacuacuauuaguagcacauuaugcgauuauugguccugguuugcaagccaaagcaacccgugaagcccagaaacgagccgcugcaggcaucaugaaaaauccuacaguugacgguauaacagucauagaucuagaaccgauaccguacgauccuaaauuugaaaagcaauuaggucagguaaugcuccucauuuugugcguaacccaagugcucaugaugaggacaacgugggcacuuugugaagcguuaacucucgcuacuggaccgauaucaacccuaugggaaggcaauccagggagguucuggaauaccaccaucgccguuagcauggcaaauaucuucagagggucuuauuuagcuggagcuggauuacuuuucucuauaaugaaaaauaccacgaauacgagacgaggaacaggaaauauuggggaaacuuuaggugagaaauggaaaucacggcuuaacgcguuaggaaaaucagaguuccaaauauacaaaaaaucaggaauucaagaagucgauagaacauuagcaaaagaagguauuaaacguggagagacugaccaccaugcuguaaguagagguucggcaaagcugaggugguucguagaacgcaauaugguaacaccagaaggaaaaguuguugaucuugguugcggcagggggggaugguccuacuacugcggaggauuaaaaaacguaagagaaguaaaggguuugacaaaaggaggcccgggccaugaagaaccaauaccaaugagcaccuacggauggaaucucguuagauugcaaaguggggucgacguuuuuuuuacuccgcccgaaaaaugugauacauuacuaugugacauuggggaaucaaguccaaaccccacuauugaagcgggccguacucuucgaguacuuaaccuaguagaaaauugguugaacaauaauacacaauuuuguaucaaaguccuaaauccauauaugcccaguguuauagagaaaauggagacguugcaaagaaaauacggcggcgcucuaguacgcaauccauuaucacgaaauucgacacaugaaauguacugggucucuaaugcuacugguaacauugugaguuccguaaauaugauuucucggauguuaauaaaccguuuuacuaugaaacauaagaaagcuacauaugaaccugauguagaucuaggcagcgggacaagaaauauagguauugaaucugagaucccuaaccucgauauuaucggaaagagaauugaaaaaaucaaacaagaacacgaaacuucuuggcauuacgaucaagaccaucccuacaaaacuugggcauaucauggaucuuaugaaacaaaacaaacugguagugcuaguaguaugguuaaugggguuguacgucuucuaacaaaaccaugggacguagucccaaugguaacacaaauggcaaugaccgauacaacacccuuuggacaacagagaguauuuaaagagaaagucgauacaagaacacaagaaccaaaagaagguacuaagaaauugaugaaaaucacagcagaauggcuauggaaagaauugggaaaaaaaaagacgccuagaauguguacaagagaagaguucacucgaaaggugcgaucuaaugcagcacucggcgcaauauuuacugacgagaacaaauggaaaucagcacgugaggcagucgaagauaguagauuuugggaacuuguagauagagagagaaacuuacacuuagaagggaaaugugagacauguguauauaauaugaugggcaaacgagagaaaaaguuaggagaauucgggaaagcgaaaggaagucgagccauuugguauauguggcuuggggcaagauuccuugaauucgaggcacuuggguuccugaaugaagaccacugguuuucuaggggaaauucucucaguggaguugaaggagaaggucuucaucgauugggauauauacugagggauguuucuaaaaaggaaggcggugccauguaugcugaugacacagcagguugggacacuagaauuacucuugaggacuuaaaaaaugaggagauggucacaaaccacaugaaaggagaacacaaaaaauuagcugaggccauauuuaagcucacauaccaaaacaagguuguccgaguucaacguccgacaccaaggggaacuguaauggacauaaucucaagacgagaucagcguggcucagggcaaguugguacuuauggauuaaacacauucacaaauauggaagcccaguuaauccgacaaauggagggugaagggauuuucaaaaguauccaacaccuuacugugacagaagaaaucgcaguccaaaacuggcuugcuagaguagggcgugagcgauuaucccgaauggccauuuccggugacgacugcgucguuaaaccucuagaugaccgcuucgcuagugcccuuacggcacuaaaugauaugggcaagguuaggaaggacauacaacaaugggagccauccagaggguggaaugacuggacacaaguaccauuuuguagccaucauuuucacgaguugguuaugaaagaugguagaguacuaguaguaccaugccgaaaccaagaugaauuaaucggcagagcgagaauuucacaaggagcuggauggaguuuaaaagaaacagcaugucucgggaaauccuacgcccaaauguggacacuaauguacuuucauagaagggaucugcgauuggccgccaacgcaaucugcuccgcaguucccucacacuggguaccaacgucaagaacgacauggucaauucaugcaaaacacgaauggaugacgaccgaggauaugcucgcagucuggaaucguguauggauccaggaaaauccauggauggaagauaaaaccccaguugaaucaugggaagaaguaccguaccuaggcaaacgugaggaucaaugguguggcucauugauaggauuaacuaguagagcuacaugggccaaaaauauucaaacagcaauaaaucaaguuagaucuuuaauuggaaaugaggaguacacagauuacaugccaucuaugaagcgcuuucgaagagaggaggaggaggcaggaguacucugguag

SEQ ID NO: 22543 - RNA, 9876 nt, Artificial Sequence
  derived and/or modified CDS sequence (opt6) from DENV-2__EU569704__SS-prME
acugcgggagucauaauaauguuaauaccgaccgccauggcauuucacuuaacgacaagaaauggagaaccacacaugauugugggccgucaagaaaaaggaaaaucccuauuauucaaaacggaagacggagugaacaugugcacacucauggcaauagauuuaggagaacucugugaagauaccauaacauauaaauguccguuauuaaggcagaacgaaccagaagacauagauuguugguguaacucaacuucuacuuggguaacauauggcacuugcacuaccacaggagagcauagacgagagaaaagguccguggcauuaguaccacauguaggaaugggacuagaaacacguacagaaacauggaugagcucugaaggagcauggaaacauguucaacguauagaaacauggauucuuaggcaucccggguucacgauuauggccgcuauucuagcauauacaauaggaacaacacauuuucaaagggcguuaauauuuauacuuuuaacggcaguagcuccaaguaugacuaugcguugcauaggcauaaguaacagagauuuuguugaaggaguaagcggaggaucguggguugauauuguauuagaacacggcucaugugucacgacgauggcuaaaaacaaaccaaccuuggauuuugaauugauaaaaacugaagcgaaacaacccgcaaccuuacgaaaauacuguauagaggcaaaacucacuaauaccacgacugagucgaggugcccgacacaaggagaaccaucacuuaaugaagaacaggacaaacgauuccuuuguaagcauuccaugguggauagaggguggggcaaugggugcggguuguucggaaaaggggguauagucacuugcgcaauguuuacauguaagaaaaacauggaaggaaaggucguauuaccagaaaauuuagaauauacaauaguaauuacaccccauucaggugaagaacacgcuguaggaaaugacacaggaaaacacggaaaagaaauaaagaucacuccgcaaucaucuauuacagaagcggaacucacuggauauggaaccguuacgauggaaugcaguccccgaacaggccuggauuucaacgagaugguacuucuucaaauggaggauaaagccuggcugguacauagacaaugguuccucgacuugccuuuacccuggcuuccaggagcugacacacaagguucuaauuggauacagaaagaaacuuuaguuacauuuaaaaauccccacgcaaagaaacaagacguaguuguccugggaucccaagaaggagcaaugcauacagcacuuaccggggcuacagaaauacagaugucuuccggaaaccuacucuucacaggacaccuaaagugccgacuaaggauggacaagcuacaauuaaagggcaugucauauucaauguguaccggcaaauuuaagauaguaaaggaaauagcagaaacgcaacacgguacaauuguaauuaggguacaguaugaaggugaugggucgccuuguaaaaucccauuugaaauuauggauuuggagaaaaggcauguccuuggacggcugauuacaguaaacccaaucgugacagaaaaagauucaccggugaacaucgaagcagaaccuccauucggagacuccuauauaauaauuggaguggaaccaggacaauuaaaacucaacugguucaagaaagggagcuccauaggacaaauguuugagacaacaaugcggggagcaaaaagaauggcgauauugggagacacagcgugggauuuugggucauuaggaggaguauuuacaaguauagggaaggcuuuacaccaaguauucggggcaauauauggcgcggcuuucagugguguauccuggacaaugaaaauucuuauagguguaauuauuacguggauugggaugaauagcagaucuacaucccuaucagucaguuuaguuuugguagguguagugacguuauaccugggagcuaugguccaggcagauagcggcugcguaguaucauggaaaaauaaagaacuaaaaugcggaaguggcauauuuaucacagauaauguucacacuuggaccgaacaauacaaauuccaaccugaaaguccaucuaaauuagcaucugcgauacaaaaagcacacgaggagggaaucugcgguauacgaucuguaacacgcuuggaaaaccuaauguggaaacaaaucaccccugagcuuaaucacauucuaagcgaaaaugaagucaaacuuaccauuaugaccggggauauaaagggaauaaugcaggcuggcaagagaucacuaagaccccaaccuaccgaacuaaaauauaguuggaagacaugggggaaggcaaagauguugaguacugaaagucacaaucaaacauucuuaauagaugguccagaaacagcagaguguccuaacacgaaccgagcauggaacucucucgaaguugaggauuacggcuucgggguguuuacaacaaacauaugguuaaaacugcgcgaaaaacaagauguguuuugcgauaguaaguugaugucugcagcaauuaaagauaaucgugcaguacaugcggacaugggauauuggauagaaagcgcucuaaaugauaccuggaagauggaaaaagcaucauucauugaaguaaaaucaugucauuggccaaaaagccauacucuguggaguaauggaguguuagaaagugaaaugaucauuccuaagaauuucgccggaccagucucucaacacaacuaucggcccggauaucauacccaaacugcaggaccauggcaccuaggaaaacuugaaauggauuucgauuuuugcgaagguacaacgguaguuguaacagaggacuguggaaaucgaggacccucacuucgaacuacuacugcgaguggaaaacuaaucacugagugguguuguagaaguugcacuuuaccaccauugagauauagaggugaagacggguguugguauggaauggagauacggccucuaaaagagaaagaagaaaacuugguaaauucccuaguaacagcgggucauggacaaaucgauaacuuuagcuugggcaucuuaggaauggcguuguucuuggaagagaugcuaaggacaaggguagguacgaaacacgcuaucuuauuggucgcgguuuccuucguaacacucaucacugguaacauguccuuucgagaccuagggcgaguaaugguaaugguaggagcgacaaugacagacgauauuggaaugggcguaacuuauuuagcacuuuuggcugcuuuuaaaguacgucccacauuugccgcuggauuacucuuacgaaagcuaacaaguaaagagcuuaugauggcgacaauagguauagcucuuuuaucacagaguacuauaccagaaacaauacuggaguugacagacgcacuggcauuagguaugaugguucuaaaaauuguuaggaacauggaaaaauaccaauuggccguaacaauaauggcaauaaguuguguuccuaaugcuguaauucuccagaaugccuggaaaguuuccugcacaaucuuagcagcugugucggugagccccuuauuacuuacaucaucgcaacagaaagcagauuggauaccauuagcauuaacaaucaaaggacuaaauccaacagcuauauuuuugaccacccuuucaagaacuagcaagaaacgcucauggccgcuaaaugaagcuauaauggcuguaggcauggugucuauacuagccagcucgcuauugaaaaacgacauuccuaugacaggaccucuuguagcggguggguuauuaacgguauguuauguucucacaggaagaucugcagaucuagaguuggaacgagcugcggauguaaaaugggaagaccaagcggagauaucagguuccaguccgauucuaucuaucacuauuucagaagauggaucaaugucuaucaaaaaugaagaagaggagcaaaccuuaaccauauuaauacguacgggacuuuugguaaucagcggaguauucccagugaguaucccaaucaccgcagcggcuugguaccuaugggaaguuaagaaacaaagagcaggaguuuugugggacgucccaucucccccaccaguugguaaagcugaauuggaagauggugcuuauagaauaaaacaaagagggauucugggcuauagccagauaggcgcaggaguauauaaagaggguacuuuucacacaauguggcauguaacgagaggagcuguccuaaugcacagggggaagcgcaucgagccuagcugggccgacgugaagaaagauuuaauaucauauggaggaggauggaaacuugaaggcgaauggaaagaaggugaagaaguacaagucuuggcuuuagaaccaggcaaaaauccaagagcaguacaaacaaagccggggcuauucaagacaaauacugggaccauuggggcuguuagccuagauuuuuccccagggacgucuggaucaccaauaguugacaggaaggggaaagugguaggguuauaugguaauggcguagugacacgcucgggggcuuacgucucugcuauagcccaaacagaaaaaucaauugaggacaauccugaaauugaggaugauauuuuuagaaagaaacgacuuacaauaauggaucuucacccuggugcuggaaaaacuaaacgguacuugccagccauaguucgggaagcuauaaaaagaggacuacgaacucuaauuuuggcaccgacucguguugucgcagcagagauggaagaggccuuacgagguuuaccgauaagauaucaaacacccgcgauucgugcagaacauacaggaagggagaucguagaucuaaugugucacgcaacuuuuacaaugcguuuauuaaguccgguccgagugccaaauuauaauuuaauuauaauggaugaagcacacuuuacagauccggcaaguauugcagcacggggauauauaucgacgagaguugaaaugggggaagcugcaggaauuuucaugacagcuacaccacccggaucucgcgauccauucccucaaaguaaugccccuauuauggacgaagaacgcgaaauaccagaacggucauggaacucgggucacgagugggucacugauuucaaggggaaaacaguaugguuuguaccaucaauaaaagccggcaaugacaucgccgcaugucuacgcaaaaaugggaaaaagguaauucaacuaucaaggaaaacguuugauagcgaauaugucaaaacgagagcaaaugacugggauuucgucguaacaacugauauuagcgaaaugggagcaaauuuuaaggcugagagagugaucgaccccagaaggugcaugaaaccagugauuuugacagauggagaagaaagggugauauuagcgggccccaugccaguuacacacuccagcgcagcacagagacgaggaaggaucggccguaauccuaaaaaugaaaacgaucaauauauauacaugggagaacccuuagaaaacgacgaagauugugcucacuggaaagaagcgaaaaugcuucuagauaacauuaacacccccgagggaauuauaccgucuauguucgagcccgaaagagaaaaaguggaugccauugacggagaauacaggcuucguggagaagcuagaaaaacauuuguagaucuaaugcgaagaggcgaucuuccaguauggcuugcauauagaguagcugcggaaggaauaaauuaugcugauaggcguuggugcuuugaugggaucaagaauaaccaaauacuagaggaaaacguugaaguagaaauauggacaaaagaaggugagagaaagaaacuuaaaccacguugguuagacgcaagaaucuauagcgauccgcucgcauugaaagaguucaaagaauuugcugccgggcguaaaagucuaaccuuaaaucucaucacugagauggguagacuccccacauuuaugacacaaaaagcaagggaugcuuuagauaauuuagcgguuuugcauacugcagaagccggaggacgcgcauauaaucacgcgcuuagugaacucccugaaacucucgaaacacuguuauuacuaacucugcuugcuacaguaacagguggaauauucuuauuccuaaugagcgggaaaggaauugguaaaaugacuuuagggaugugcuguauaauaacagcaucuauacuauugugguaugcccaaauacaaccacauuggauagcugcuucgauuauuuuagaauuuuuccucauuguguuacuaauaccagaaccagaaaaacagcguacaccccaagacaaucaauuaacauauguaguuauagccauccucacuguuguggcggcgacuauggcgaacgaaaugggauuuuuggagaaaacuaagaaagauuuaggacuagggaguauaacuacacaagaaucugaaagcaacauucuugauauugauuugcggccagcaucugcuuggacguuguaugcaguagcuacaaccuuuguuacaccuaugcugagacauucuauagagaacaguaguguuaauguaucacugacggcuaucgcaaaucaagcuaccguguuaauggguuuaggcaagggcuggccguuaaguaaaauggauauaggugugccauuacuagcaaucgguugcuacucucaaguuaacccaauaacacugacugcggcgcucuugcuauuaguugcacauuaugcgauaaucggcccuggucugcaagccaaggcaacuagagaagcccaaaagagagcagccgcaggcaucaugaagaaucccaccguugauggaauaacgguaauugauuuagaacccauucccuaugacccaaaauucgaaaaacaacuaggacaagugauguuauugauucuuuguguaacucaaguccucaugaugcggacaacaugggcacucugcgaagcucuuacucuagcuacagguccgauuucuacccugugggaaggaaacccuggaagguuuuggaauacuacaaucgcgguaaguauggcaaacaucuuucgggguagcuauuuagcuggcgcaggauuguuauuuagcaucaugaaaaacacaacuaacacaagaagaggaacugggaacaucggagaaacacuaggagagaaauggaaaaguagauuaaacgcacuaggaaagucugaguuccaaauauacaagaagucugguauacaggaaguugaccgaacacuggcgaaggaaggaauuaaacgcggagaaacggaucaccaugcgguuucaagaggaagugcuaaguuacgaugguucguugagagaaauaugguaaccccagaagguaaagugguagaucuaggauguggcagaggggguuggucauauuauuguggcggucucaaaaauguuagggaaguaaaagggcuaacaaaaggaggccccggacacgaagaaccgauaccaaugucaacuuacgguuggaaccuaguacggcuccaaagcgggguggacgucuucuucacucccccugaaaaaugcgauacacucuugugugauaucggagaaaguucgccaaauccuacuauagaagcaggacgaacacuaagaguacuaaacuuaguggagaacuggcuuaauaacaauacucaauucuguauaaaaguucugaauccauacaugcccuccgugauagaaaagauggagacuuuacaaagaaaauacgggggugcgcuaguuaggaauccacugagucgcaacuccacacacgagauguacuggguuuccaacgcaacuggaaacaucguuucaagcguuaacaugauaaguaggauguuaauuaauagguucacuaugaagcauaagaaagcaacuuacgaaccagauguagacuuagguaguggaacaaggaacauaggcauugaaagcgaaauaccaaaucuagauaucauagguaaaagaauugagaaaauaaaacaggagcaugagacuucguggcauuacgaucaagaccacccuuauaaaacaugggcauaccacggcaguuaugaaaccaaacagacgggaucugcgucaucgaugguaaauggaguaguacgguuguuaacaaaaccaugggaugugguaccaaugguaacccaaauggcaaugacagacacgacucccuuuggccaacagagaguguucaaagaaaaaguagacacucgaacacaggaacccaaagaaggaaccaagaaacuuaugaagauaaccgccgagugguuguggaaagaauuaggcaagaagaaaacgccaagaaugugcacucgagaagaauuuacaagaaaaguaagaucgaacgccgcacuuggagcuauauucacagaugaaaacaaauggaaaagugcaagagaagcgguagaagauucaagauucugggaauuaauagaucgugaacggaaucuccauuuagaagggaaaugugagacuugcgucuacaauaugauggguaaacgugagaagaaacucggugaauuuggcaaagcuaaagguucgagagcaauaugguacauguggcucggagcgagauuucuugaguucgaagcauuaggauuuuuaaacgaggaucauugguuuucaagggguaauagucuuagcggaguagagggugaaggucuacaucguuuaggauacauacuuagagauguaagcaagaaagaggguggagcgauguaugcagacgauacagcagggugggacacgcgaauaacucuugaagaucuuaaaaaugaagagauggugacuaaucauaugaaaggugaacauaagaaacuagccgaagcuauauucaaauuaaccuaucaaaacaaagucguaaggguacagagaccgacaccgagaggaacuguaauggacauaauaucacgaagagaucagcgcgguuccggacaaguaggaacuuacggucuuaacacauuuaccaauauggaagcucagcucauaaggcagauggagggagagggaauuuuuaagucaauacaacaccugacaguaacagaagaaauagcgguacaaaacuggcuggcuagaguuggcagagaaagacuuucaaggauggccauaaguggggacgacugcguaguuaaacccuuggacgaucgcuucgcaagcgcacucacugcauuaaacgauaugggaaaagugcguaaggauauucaacaaugggagcccaguagaggguggaacgauuggacacaaguaccauuuuguagucaucauuuucaugagcugguaaugaaggaugguaggguucuaguagucccaugucgaaaucaagaugaauuaauaggucgagcaagaauuagccaaggagcuggcugguccuuaaaggaaacggcaugcuuagggaaaaguuacgcucaaauguggacguugauguauuuucaucgacgugacuuacgguuggcagcaaacgcaauuuguucugcugucccgucucauuggguaccgacaagcagaacgacuuggaguauucaugcaaaacacgaauggaugacaacagaggauaugcuagccguauggaaccgaguauggauucaggagaauccguggauggaagacaaaaccccugucgaaucaugggaagagguacccuaucucggcaagagagaagaccagugguguggcagcuuaaucggacuaacaucucgcgcaaccugggcaaagaauauccaaacagcuauuaaccaagugcgcagccuaauaggaaaugaggaauacacagacuauaugccaagcaugaagcgcuucagaagagaggaagaagaggcaggaguauuaugguaa

SEQ ID NO: 22544 - RNA, 9876 nt, Artificial Sequence
  derived and/or modified CDS sequence (opt6) from DENV-2__EU482568__SS-prME
acagcugguguuauaauaauguugauucccacagcaauggcuuuccaucuuacuacaagaaauggagaaccgcauaugauaguaggacgacaagaaaaagguaaaucacuguuauucaaaacugaagauggcguuaauauguguacauuaauggcgauagaucuuggcgaacuaugcgaagacacgauaacuuacaaauguccguugcugcgucagaaugaaccagaagacauugauugcugguguaacaguacuucaacuuggguuaccuauggcacguguacaacaacaggagaacaccgcagagagaaaagaucuguggcauuaguaccucacguaggaaugggacuagagacaagaacagaaacuuggaugagcucugaaggagcauggaaacauguacaacgaauagaaaccuggauuuuaagacacccugguuucacgauaauggcagcaauacuggcuuauacuauuggaacaacacacuuccaaagagcccuaauuuuuauucuacugacugcggucgccccaaguaugaccaugagguguauaggaauaagcaauagagauuuuguugaaggagucaguggggguucuuggguagauauaguucuugaacacgguaguuguguuacuacgauggcuaaaaacaaacccacacuugauuuugaauuaauaaaaacagaggcaaaacaaccagcaacccuaaggaaauauuguauagaagccaaauuaacuaauaccacuaccgaaagucguuguccaacgcaaggagaaccaucucuaaaugaagaacaggauaaaagauuuuuauguaaacauucuaugguagacagagggugggguaauggcugcggauuauuugggaaagggggaauugugacuugugcaauguucacuuguaagaaaaauauggaggguaaagugguauuaccagaaaacuuagaauauacaauaguuaucacgccgcauucgggagaggaacacgcaguagguaacgacacagggaaacacggcaaagaaauuaaaauuacaccacaaucaagcauuaccgaagcggagcugacuggguauggaacaguuacgauggaauguagcccacgaacgggucuagauuucaaugaaaugguacugcugcaaauggaagacaaagcaugguugguucaccgacaaugguuuuuagaucugccacucccaugguuaccgggagcggauacacaggguucuaauuggauacaaaaagaaacccuaguaacuuucaaaaacccacaugccaagaaacaggacguaguaguucuaggaucacaggagggugcaaugcacacagcgcucacaggagcgacugaaauucaaaugucuucuggaaaccuccuauucacuggccaucugaaauguagacuaaggauggauaaacugcaauugaaaggcaugaguuacucaaugugcacuggcaaauuuaaaauagugaaagaaauagcugaaacgcaacacggaacuauugugauccgaguucaguaugaaggagaugguucacccuguaaaauacccuuugaaauuauggaucuugagaaacgacacguucuaggacgccuaaucaccguuaauccaauuguaacugagaaagacucuccgguaaauaucgaagcugagccgccuuucggggauucauacauuauaauuggcguagaacccggacagcucaaauuaaacugguuuaagaaaggaucuuccaucgggcaaauguucgaaacuacgaugcgcggagccaaacggauggcgauccuuggagauacugcuugggauuuugggucgcuagguggcguauuuacaaguauuggaaaggccuuacaucaaguguucggagcaauuuauggagccgcauucaguggagugucauggacaaugaaaauacuuaucggaguuauaauaaccuggauagguaugaacagccgaucaacgagcuugucagugucacucgucuuaguaggcguaguaacacuauaccuaggagcuaugguucaagcggacuccggcugcgucgugucauggaagaacaaagaguuaaaauguggcucgggaaucuuuauaacagacaacgugcauacguggacugagcaauauaaauuccaaccagaaucaccuaguaagcuagccucggcuauacaaaaagcccaugaagaaggaauuugcggaaucagaucagucacgcgauuagagaaccuuauguggaagcaaauaacacccgaauuaaaucacauacuaagugaaaacgaaguaaaguugacuaucaugacaggggauauucgagguaucaugcaagcagggaaaagaagucucagaccgcaaccaacugaauuaaaguacucauggaaaaccugggggaaggcuaaaauguuaucuacagagucacacaaccaaacuuuucugaucgacgggccagaaacugcagaauguccuaacacaaaucgagcauggaacucauuagaaguggaagacuauggguuuggagucuucacaacgaacauaugguuaaaauuacgugaaaaacaggacguauucugugacaguaaguuaaugucagccgcaauaaaagauaauagagcuguacaugcugacaugggauauuggauugagagcgcucuaaaugauacauggaaaauggagaaagccaguuuuauugaaguuaagucaugucauuggccuaaaucgcacacacuauggucuaacggaguacucgagagugaaaugaucauaccgaaaaacuuugcaggacccguaagccaacauaauuaccgccccggauaucauacacaaaccgcaggaccauggcaucugggaaaauuggaaauggacuucgacuucugcgaaggcacuacggugguagugacugaagauugcgguaaucgugguccgagucugaggacuacaacagcaagugguaaacucauaacggaauggugcugucguucgugcacuuugccuccauugagauauagaggagaagauggauguugguacgguauggaaaucagaccgcucaaagaaaaagaagaaaaccuuguaaauucacucgucacagccggccauggacaaauugacaauuuuagccuggggauauuaggaauggcauuauuccuugaggaaauguuaagaacacgaguuggaacuaagcaugcuauucuccuuguagcaguuucauucgucacuuugauuacaggaaauaugaguuuuagagaucuaggacguguaaugguuaugguaggggcuacgaugacugacgauauugguaugggcguaaccuaucuugcucugcuagccgcauuuaaaguaaggccuaccuucgcugcaggacuguuauuaagaaaacuaacaaguaaggaauugaugauggccacaauuggaauagcucugcuuagccaaucgacaaucccugaaacaauacuugaacugacugaugcacuugcacuaggaaugaugguguuaaaaauagugagaaauauggaaaaauaucaacucgcuguuacaauaauggcaauaaguuguguuccaaacgcagugauacuacaaaacgccuggaaaguuaguuguaccauacuagcggcaguaucggucucccccuugcuccuaacaucaagucaacaaaaagcagauuggauccccuuagcacugacaaucaaggggcuaaacccuaccgccaucuuuuuaacuacccugucccgaaccaguaagaaacgcagcuggccguuaaaugaagcuauaauggcaguuggcaugguaucuauccuagcguccucacuacucaaaaacgauauuccaaugacugguccccuaguagccgguggauugcuuacuguaugcuauguccucaccgguagaucagcagauuuagaacuugagagagcagccgaugugaaaugggaggaucaagcggaaaucucuggauccaguccaauauuaucaauuacuauuagugaagacggaaguaugucaaucaaaaaugaggaagaagaacagacacuuacuauacuaauuagaacgggacuguuagucaucucuggcguauucccaguaaguauuccaauaacggcggccgcuugguacuuaugggaaguuaagaaacagagggcugguguauuaugggacguaccaagcccaccaccaguggaaaaagccgaacuugaagauggugcguacagaauaaaacaaagagggauucuaggauacagucaaauaggagccgguguauauaaagaggguacauuccacacuauguggcacguaacaagaggggcggucuuaaugcaccgaggaaaaagaguagagccaucaugggccgacgucaagaaagauuuaaucaguuacggugguggauggaaacuggaaggugaguggaaggaaggcgaagaaguccaaguauuggcacuggagccaggcaagaauccaagagcaguucaaacaaaaccaggacuguuuaaaacaaauacagggacaauaggggccgucaguuuggauuucuccccagggacaagugggucacccaucgucgauaggaaaggaaaagucguaggacuguacggaaacggaguaguaacgcgcagcggagcuuauguauccgccauugcgcaaacagagaaaucgaucgaagauaauccagaaauagaagaugauaucuucaggaagaaaagguuaacaauuauggacuuacaucccggugcuggaaaaacuaaacgcuaucuuccagcaauugucagagaagcuauuaaaagaggacuaagaacccuaauucuagcccccacaagggucguugcagcugagauggaggaagcgcuacguggauugccuauacgauaccagacucccgcaauaagagcugaacacaccggacgagagaucguugaucugaugugucacgcaacauuuacgaugcggcuuuuaaguccgguacgagucccaaauuauaaccuaauuauaauggacgaagcacauuuuacagacccggcuaguauagccgccagaggauauaucucuacuaggguugagaugggagaagccgcaggaauuuucaugacugcuacucccccaggaucuagagauccguucccgcaaucgaacgcuccuauaauggacgaagaaagggaaauacccgagcgaaguuggaauaguggucaugaaugggugacagacuuuaaaggaaaaacaguuugguucgucccgaguauaaaagccggaaacgauauagcagcaugucugaggaaaaacggcaagaaagugauacaacugucaagaaagacauuugacagcgaauacguaaaaacgagagcgaaugauugggauuucguaguaaccacugauauaucagagaugggagcgaauuucaaagcugaaagaguaauagauccgaggaggugcaugaagccagucauacugacagauggagaggaaagagugauccuugcaggaccuaugccaguaacacacucaagugcagcgcagcggcgaggccgaauuggacggaacccuaagaacgaaaacgaccaguauauauauaugggugaaccucuugaaaaugacgaagauugugcucacuggaaagaagcaaaaaugcuuuuagauaauauuaacacuccagaaggaauaauaccgucaauguuugaaccagagagagaaaaaguagaugccauugauggagaguaucgccuaagaggagaagcacguaagacguuuguugaucuaaugaggcgcggcgauuugccugucuggcuagcuuaucguguugcugcagaaggaauuaauuaugcagacagacguugguguuuugauggaauuaaaaacaaucaaauauuagaagaaaacguggaggucgaaauauggacaaaagagggggaaagaaagaaacuuaaaccccguugguuggaugcgcggauuuacagcgacccguuagccuugaaggaauuuaaggaguuugcggcagggagaaagagcuuaacccuuaauuuaauaaccgagaugggccgauuaccaacguucaugacacaaaaggcgagggaugccuuagauaauuuagcuguguugcacacagcagaagccgguggcagagcauacaaccacgcauugagcgaauuaccggaaacuuuagaaaccuuauuacuucuaacccuccucgcuacuguaaccggaggaauauucuuauucuugaugucaggaaaagguauugguaagaugacauugggaaugugcuguauaauaacugccaguauauuauuaugguacgcucaaauucaaccgcauuggauagccgcaagcauuaucuuggaauuuuuccuuauaguccuuuuaauacccgaaccagagaaacagagaacuccacaagauaaucaacuuacuuacguagucaucgcaauccuuacgguuguagcugcaacaauggcaaaugagaugggauuucuugaaaagacgaaaaaggauuuaggacuggguucuauaacuacucaagaaucagaaucuaauauacuggacauagaccuacgacccgcuucggcuuggacuuuauaugcaguagcaacaacauucguuacuccgaugcugcgccauuccaucgaaaauucgaguguuaauguaucgcuaacugcaauugcgaaccaagcaacaguuuuaaugggucuaggaaaaggcuggcccuuaaguaaaauggauauugggguaccucuacucgccauaggaugcuauagccaaguaaacccuauuacacucacggcagcauuauugcuccuagucgcacacuaugccauaauaggaccgggccuccaagcaaaagcaacucgcgaagcacaaaagagggcagcagcugggauaaugaaaaacccuacuguagauggcauuaccgugauugaucuagagccaaucccauaugacccgaaguuugaaaaacagcuaggucaaguaaugcuucuaauuuugugugucacccaagugcuuaugaugagaaccacaugggcacuuugcgaagcauuaacacuggcaacgggaccaauaucuacucuuugggaggggaauccaggacgauucuggaauacaacgauagcuguaucgauggcaaacauauuuagagguucuuaucuagcaggggccggucuuuuauucucuauaaugaagaauacuacuaauacccgcagagguacuggcaacauaggagaaaccuuaggggagaaauggaaaucccgccuaaacgcacuaggaaaauccgaguuccaaauuuacaagaaaagugguauucaagaagucgaccgaacguuggcaaaagaaggaaucaaacggggugaaacugaucaccacgcaguaucuagagggucagcgaaacuaagaugguuuguagaacggaauaugguaacaccugaaggaaaaguuguugacuuaggaugugggagaggugguuggaguuacuauugugguggacucaaaaauguaagagaagucaaaggucuaacgaaaggcggacccggccacgaagaaccaauuccaaugaguacuuacggauggaaccuugugcgcuuacaauccggaguggacguauucuuuacaccuccagaaaagugugauacacuuuugugcgacaucggggaaucuaguccuaaucccacaauagaagcggggcgaacauugcggguauugaacuuaguagaaaauuggcugaauaacaauacacaguucuguaucaagguucuuaauccauauaugccaaguguaauugaaaagauggagacccuucaacguaaauacggcggagcucuagucaggaauccauuaucgagaaacucaacucaugaaauguacugggucaguaaugcaacagguaauauuguaucuaguguaaauaugauaucccgcaugcuuauaaaccgauuuacgaugaaacacaagaaagcaaccuacgaacccgaugucgaucucgguucaggaacuagaaauauaggaauagaauccgaaaucccuaauuuagauauuaucgguaaaaggauagagaaaauaaagcaggaacacgaaacaaguuggcauuacgaucaggaucauccauauaaaacaugggcauaccaugguaguuacgaaacaaagcaaacagguucugcuucgucaauggugaacggaguagucagacugcugacgaaaccuugggacgucgugccaauggugacucaaauggcaaugacagacacaacaccuuuuggacagcaacgcguauuuaaagaaaagguugauacuagaacgcaggaaccuaaggagggaaccaaaaagcuaaugaaaauuacagcagaauggcuuuggaaagagcugggcaagaagaaaacuccaagaauguguacgcgcgaggaguuuacaagaaaaguccgaaguaaugcagcuuuaggcgcaauauucacugaugaaaauaaauggaaguccgcucgagaagcaguagaggacagccgauucugggaauuaauagaccgagaaagaaaucuccacuuagagggaaagugugaaacauguguuuacaauaugauggguaaaagggaaaagaaauugggcgaguuugguaaggcaaagggaucaagagcuauuugguauaugugguugggagcaagauuuuuagaauuugaagccuuagguuuucuaaacgaggaccauugguuuagcagaggaaauucucuuuccggaguugagggagaagggcuacauaggcuggguuauauccuacgggauguaucuaagaaagagggcggagccauguacgcagaugacacugccggaugggauacgagaauaacacuggaggaucucaaaaacgaagagauggugacuaaccauaugaaaggugaacacaagaaguuagccgaagcaauauucaaacuaacuuaucaaaauaaggucguacguguccaaagaccuacccccagaggcacggugauggauauaauuucaagaagagaucaacguggcucugggcaaguagggacuuauggacuuaacacguucacgaacauggaagcucaacugauaagacaaauggaaggugaaggcauauucaaaaguauccagcauuuaacugugacugaggagauagcuguucaaaauugguuagcaagaguuggaagggagcgcuuaagcaggauggcuaucucaggugacgacuguguaguaaaaccgcuagacgaucgcuuugcaagugccuuaaccgcccugaaugauaugggaaaagugaggaaagacauucaacaaugggaaccaagcaggggguggaaugauuggacucaagucccauucuguucucaucauuuccaugaguugguaaugaaagauggaagggucuuaguuguaccuugcaggaaccaagacgaguugaucgggcgugcacgcauuagucaaggcgcgggcuggucacugaaggagacggccugucuaggaaaauccuaugcucaaaugugggcuuuaauguauuuucaucguagagaccuacgucucgcagcaaacgcaauuuguucggcaguaccaucucacuggguuccuacgagccgaacgacuuggucaauccacgcgaaacacgaguggaugacuacagaagauauguuagcuguauggaacagaguauggauucaagagaauccauggauggaggauaaaacaccggucgaaagcugggaagaaguacccuaccuagggaagcgugaagaucaauggugcggcucacuaaucggacuuacuucuagagcaaccugggccaaaaauauccaaacagcgauuaaccaaguacgaucgcuaauuggaaacgaagaauacacugauuauaugccuagcaugaagcguuuucgaagagaggaagaagaagcaggaguauuaugguga

SEQ ID NO: 22545 - RNA, 9876 nt, Artificial Sequence
  derived and/or modified CDS sequence (opt6) from DENV-2__EU482569__SS-prME
acagcugggguaaucauuaugcuaauuccgaccgcaauggcguuccaccuuaccacacgaaauggggaaccccacaugaucguaggacgucaagaaaaaggaaaaaguuuauuauucaaaacugaagacggagucaauauguguacauuaauggcgauagaccugggagaacugugugaagauaccauaacauauaaaugccccuuacuuaggcagaaugagcccgaagacauugacugcugguguaauaguacaucgacaugggucacauacggaacgugcaccaccacaggagaacaucguagagagaaaaggaguguagcccuaguaccgcacguaggaaugggauuagaaacgcguaccgaaacuuggaugucaucagaaggugcguggaaacauguucagagaauugaaacguggauucuucgccaccccggauuuacgaucauggcagcuaucuuggcauauacaauugguacaacccauuuucaaagggcauuaauuuucauuuuauuaacugcaguagcaccaucaaugacaaugcgcugcauaggaauaucaaacagagauuuuguugaagguguaucuggaggaucuugggucgacauuguguuagagcaugggaguuguguaacaacaauggccaaaaacaaaccaacguuggacuuugaacuaauuaaaacugaagcaaaacagccggcaacgcuucgaaaauauugcauugaagcaaaauugacaaauacuacgacagaaucaagauguccaacacaaggcgagccaucauugaaugaagaacaagauaaacgcuuuguguguaaacauucaaugguugacagggguuggggaaaugggugcggauuauucgggaaaggagguauaguuacuugcgcaauguucacuugcaagaaaaauauggaagguaaaguaguguugccggaaaauuuagaauacacgauuguaauuacgccacauucuggggaagaacaugccgugggaaacgacacuggaaaacacgggaaagaaauaaaaauaacgccacaaucaagcaucacagaggcagaguuaaccggguauggcacggucacuauggaauguuccccacgcacgggguuagauuuuaacgaaaugguucuauuacagauggaagauaaagcauggcuaguucaucgacagugguuuuuggaucuaccuuugccauggcuaccgggugcagacacucaaggaaguaacuggauucagaaagaaacgcuugucacguuuaaaaauccacaugcgaagaaacaggacguaguggugcuaggcucacaagagggagcuaugcauacagcguuaacaggcgcuacagaaauacaaaugucaagugggaaccuuuuauuuaccggacaccucaaauguagauuacgaauggauaaacuacaacuuaaagggaugucauacuccauguguacagguaaauucaaaauaguuaaagaaauagccgaaacucagcaugguacaauugucauaagaguacaauaugaaggggaugggucaccauguaaaauaccauucgaaauuauggaucuagagaaacgacauguguugggccgacuaauuacaguaaauccgaucguuacugagaaagauucacccguuaacauagaagcggaaccaccauuuggggauaguuauauuauuauugguguagaaccaggucaacuaaaauugaacugguuuaagaaagguucaucuauaggucaaauguucgagacgacaaugagaggggcuaaaagaauggccauucugggagacacagcuugggauuuuggaucucugggaggcguauuuacgucaaucgguaaagcgcugcaccagguauucggugcaauauacggcgcagcauucuccgggguaucauggacuaugaaaauuuuaauagggguaauaauaacauggauuggaaugaacucacguucaacuagcuuaucaguuagccuaguuuuaguugguguaguaacuuuauacuuaggggcuaugguucaagcagacucugggugcgugguaucuuggaaaaauaaagaguuaaaaugcggcagcggaauauucauaacagacaauguucacacuuggacggaacaguacaaauuucaaccagagucaccauccaaacuggccucagcaauacaaaaggcccacgaggaggguauuuguggaauacgaucgguaacaaggcuagagaauuugauguggaaacaaauuacaccagagcuaaaccauauauuaucggagaaugaagucaaguugacaauaaugaccggagacauaaaagguauuaugcaggccgguaagcguucgcugagaccacaaccaaccgaacuuaaauacucguggaaaacaugggguaaagccaaaauguuauccacagaaucacacaaucaaacauuuuuaauagauggccccgaaacugcagaauguccuaacaccaaucgcgcauggaacucgcuagaaguggaagauuacggguuuggagucuuuacgacaaauauaugguuaaaauuacgagaaaagcaagauguauuuugcgauaguaaauugaugucagcagcaauuaaggauaauagagcugugcaugcggauaugggauacuggauugaguccgcuuuaaaugacacauggaaaauggaaaaggcgaguuuuauagaaguaaaaucuugucacuggccgaagucacacacucuauggaguaacggaguacuagaaagcgaaaugauaauccccaaaaacuucgcagguccgguaagucagcacaauuauagaccgggguaucacacacagacggcggguccguggcauuuggguaaacuagagauggauuuugacuucugcgaaggaaccacaguugucguaaccgaagauuguggaaauagggguccauccuugcgaacgacuacagcaagugguaaauugaucacagagugguguuguagauccuguacgcuaccgcccuuaagauaucgaggugaagaugguuguugguauggaauggaaauccgaccccuaaaggaaaaagaggagaauuuaguaaauagucuaguaaccgcuggacauggccaaauugauaacuuuaguuuaggaguauuggggauggccuuauuuuuagaggaaauguuaagaacaagagucgggacaaagcaugcaauauuauugguagcuguaaguuucguaacucuaauaacugguaauaugagcuuucgagaucuagguagagugauggucauggucggugccaccaugacagacgauauuggaaugggaguaacauauuuagcacuacucgcggcauucaaaguaagaccgacauucgcagcggggcuacuacuaaggaagcuaacuucaaaagaacucaugauggcgacgauugguauugcacuucuaucgcaaagcacgauaccggaaacaaucuuggagcuaacggacgcgcuagcgcuugguaugauggugcuaaaaauugugagaaauauggaaaaguaccaauuagcgguaacgauuauggcgaucagcuguguaccaaaugccgugauauuacaaaaugcauggaagguuucgugcacuaucuuagccgcaguuucagugagcccucuauuauugacuuccucucaacagaaggcugacuggauaccauuagcacucacgauaaaaggacuaaacccuacggcaaucuuuuuaacuacuuuaaguagaacaaguaagaaacgaagcuggccgcucaaugaagcaauuauggccguggggauggucaguauccuagcaaguucucuucugaaaaacgauauucccaugacuggaccacuggucgcugggggauuacugacaguauguuacgugcuaaccgggagaagugcugaucuggaauuagaaagggcggcagauguuaaaugggaagaccaagcugaaauuuccgguagcaguccgauccuuucuauuacaaucagugaagacggaucuaugucaaucaaaaacgaagaagaagaacaaacauuaacaauucuaauaagaacgggucuguuagucauaucugguguauucccagugucaauaccgauaacugcugcugcuugguaucuuugggaagucaagaaacagagagcaggcguucuuugggacgucccuagucccccuccgguaggaaaggcagaacuagaggauggcgcauacaggaucaaacagcgagguauucucggguacucacaaaucggcgccggaguguacaaagaagggacguuucauacaauguggcauguaacuaggggcgcagugcuaaugcacagaggaaaaagaauagagccauccugggcugacgucaagaaagacuuaauaagcuacgguggcggguggaaacuagaaggugaauggaaggagggugaagagguccaaguacuagccuuggaaccuggcaaaaacccaagagcuguucaaacaaaaccaggacuauuuaaaaccaacacgggaacuauaggugcuguuagcuuagacuuuagccccggcacaagugguuccccaauagucgaccgcaaaggaaaaguagucggacuguacggcaaugguguagucacuaggucgggagccuacguuucagcaaucgcacaaacugaaaagucaaucgaagacaauccagaaauagaagaugauauuuucaggaagaaacgcuuaacaauaauggaucuucauccuggagcaggaaaaacgaaacgauaccuaccagcuauuguacgagaagcuauuaaaagggggcucagaacguugauauuagcaccgacucgaguuguagcggcggaaauggaagaggcgcuacgaggcuugccgauuagguaucaaacuccagcaauuagagcagaacauacaggacgggaaaucguagacuugaugugucaugccaccuuuacgaugcggcuucucucaccaguacgggucccgaauuacaaucuaauuauuauggaugaggcgcauuucacugaccccgcguccauagcagcuagaggauacauuaguacaagaguugagaugggugaagcagcaggaaucuucaugacagcaacgccgccugguaguagagauccauuuccacaaucgaaugcaccuaucauggaugaagaaagagaaauaccagaaagaaguuggaacuccggacaugaaugggugacagacuucaaagguaagacagucugguucgugccaucaaucaaagcugggaaugacauagcagcuugccuuagaaagaauggcaagaaaguaauccaacuuaguaggaagaccuuugacagugaauauguuaaaacacgagcaaaugauugggauuuuguggucacaacagacauuucggaaaugggcgcaaauuuuaaagcggaaagaguaauugaccccagacgguguaugaagccugugauucuaacagacggagaagaaaggguuauuuuagcggggcccaugccaguaacgcauaguagugccgcacaacgaagaggaagaauuggccgcaauccgaaaaaugagaaugaucaauacaucuauaugggcgaaccguuagaaaacgacgaggauugcgcgcacuggaaagaagcaaaaaugcuacucgacaauauuaauaccccagaaggaaucauccccaguauguuugaaccagagagagaaaagguugacgcaauagacggagaguaucggcuaagaggugaagcacgaaaaacauuuguagacuugaugagacguggcgauuuaccagucuggcuagcuuauaggguagcagcagaaggcauuaauuacgcagaucgaagguggugcuucgaugguaucaaaaacaaccaaauacuagaggagaacguagaaguggaaauauggacuaaggaaggagaaagaaagaaacuaaagccaagauggcuagaugccaggauauauucagauccacuggcauuaaaagaauuuaaagaauuugcggcaggaagaaaaucauuaacccucaaccuaauaacugaaaugggcagacugccaacauucaugacucagaaagcuagagaugcucuugauaauuuggcaguuuuacauacggcagaggcgggaggacgagcauauaaccaugcauugucggaauuacccgagacacuagaaacuuugcuauuacuaacacucuuagcgacggucacaggagggaucuuuuuauuccuaaugucagggaaagggauaggaaaaaugacauugggcaugugcugcauuauaacggcaaguauucuacuaugguacgcucagauacaaccacauuggaucgcagcuagcauaauauuggaauuuuucuuaauaguuuuauugauuccagaaccagaaaaacagagaacaccucaagacaaucaacugacauacguagucauugcaauauugaccguuguggcagccacaauggcaaacgaaaugggauuuuuagagaaaacuaagaaagaucugggauuagguucgauaaccacacaagaaagcgaauccaauauuuuagauauagaccuuagaccagcgucagcauggacacuauaugcuguggcaaccacauuuguaacuccaauguuacgucacucaauugaaaacucaucgguuaauguuucauuaacagcuauugcaaaccaagcaacuguuuugaugggccuagguaaagguuggccguugucaaaaauggacauaggcguuccacuucuagcgauaggaugcuacucacaagugaacccgauuacgcuuacggcugcacuacuacucuuaguggcgcacuacgcgauaauugggccaggcuuacaggcaaaagcuacaagagaagcacagaaacgagcggcagcagguauaaugaaaaauccaaccguagaugggauaacuguuauagaccuagaaccaauucccuaugacccuaaguuugaaaagcaguuaggacagguuauguuauugauucuaugcgugacacaaguucuaaugaugagaaccacgugggcgcuaugugaggcucuuaccuuagccaccgggccuauuucaacacuaugggaaggaaauccggguagguucuggaauacaacaaucgcuguuagcauggcuaauauauuucgagguaguuauuuagccggugcgggacuucuguucuccauuaugaagaacacaacuaacacgcgucgaggcaccggaaacauuggcgagacacucggggagaaauggaaaucuagacugaaugcauuagguaaaaaugaguuccaaauauauaagaaauccggaauacaagaaguggauaggacacucgcuaaggaaggaauaaaacgaggagaaacagaccaucaugcaguaaguagaggcucggcaaagcuacgaugguuuguagaacguaauauggugaucccagaagguaaaguuguagaccuagggugcggucgaggugguugguccuacuacuguggggguuugaagaauguacgcgagguaaagggccuuacgaaaggggguccgggucacgaagaacccauaccuaugucuacuuacggauggaacuugguucgauuacaaagcggaguugauguauucuuuacaccacccgaaaaaugcgauacguuacucugcgauauaggagaaagcagcccaaacccuacuauagaagccgggcgaacccuaagggucuuaaauuuaguggaaaacuggcugaauaauaacacgcaguuuuguauuaaaguuuugaacccuuacaugcccuccgugauagaaaagauggaaacauuacaacgcaaauacggaggggcccuaguuaggaauccacuaucgagaaauaguacacacgagauguacuggguaucaaacgcuacgggcaacaucgugaguucggucaacaugauaaguaggaugcuaaucaauagauucacaaugaaacauaagaaagcuacauaugaacccgauguugauuugggcaguggcacucgcaauauugguaucgaaagcgaaauaccaaaucucgacauuauugggaaacgaauagagaaaauaaagcaagaacaugaaacaagcuggcacuaugaccaggaucauccuuacaaaacuugggcuuaucaugggagcuacgaaaccaaacaaacuggaagcgcgucuuccauggucaacggaguuguucgucuauugacgaaaccaugggaugucgucccaauggugacccaaauggcaaugacagacacuaccccauucggccaacaaaggguauuuaaggaaaaaguagauacuagaacacaagaaccuaaagagggcaccaagaaacuaaugaaaauaaccgcggaaugguuguggaaagaacuaggcaagaagaaaacgccccguaugugcacgcgcgaagaguucacuaggaaggugaggagcaaugccgcacugggugcgauauuuacagaugaaaauaaguggaagagugcccgcgaagcugucgaagacaguagauuuugggaauuaauagauagggagcguaaucuucaucuugaaggcaaaugugaaacauguguuuacaacaugauggggaagcgagaaaagaaauuaggagaauuugguaaggccaaaggaagccgagccaucugguacauguggcuaggugcacgauuucucgaguuugaggcuuugggcuuucuaaacgaagaucacugguucaguagaggaaauaguuuaucuggcguagaaggagaaggccuacauagguuaggauauauauugcgugacguaagcaagaaagaaggaggcgcgauguacgcugacgauacagcuggcugggacacucgaauuacccuagaagaucugaaaaaugaagaaaugguaacaaaucauaugaaaggcgagcauaaaaaguuagccgaagcaaucuuuaagcugacauaucaaaauaagguagugcgcguucaacguccaacuccucgagggacagucauggauauaauaucacgaagagaccaacgcgggucaggacaggugggaacguauggacugaauacguuuaccaauauggaagcgcaacucauuagacagauggaaggagaaggaauauuuaaaaguauacaacauuuaaccgugacugaagaaauugccguucaaaauugguuggccaggguaggacgugaaagguuaucuagaauggcaauaucgggagaugauugugugguaaagccuuuagaugauagauuugcuucggcucuaacugcacucaaugauaugggaaaagugagaaaagauauacaacaaugggagcccucucgaggauggaaugacuggacacaaguaccauucuguucacaccacuuucaugaguuagucaugaaagauggaagaguccuaguuguaccgugccgaaaucaagacgaacugauugggagagcaagaauaagccagggggcggguuggucacugaaagagacagcaugccuaggaaagucuuaugcucaaauguggacauuaauguauuuucaccguagagaucuuagguuggcagcuaaugcuauauguucagcaguccccucacacuggguuccaacaagccgaacaacauggaguauacaugcgaaacaugaguggaugacuacggaagauaugcucgcaguauggaaccgcguguggauccaagagaauccauggauggaagacaaaacuccaguagaguccugggaagaggucccuuaucuagguaaacgagaagaucaguggugcgguaguuuaauaggcuuaacuucacgggccacuugggccaaaaacauacaaacagcgauuaaucagguacggucacucauugggaaugaagaauauacggacuauaugccguccaugaaaagguucaggagagaagaggaagaggcgggaguuuuaugguga

SEQ ID NO: 22546 - RNA, 9876 nt, Artificial Sequence
  derived and/or modified CDS sequence (opt6) from DENV-2__EU482570__SS-prME
acagcggguguuauaauaaugcuuauaccaacagcaauggcauuucaccugacgacacgcaauggagaaccucauaugauuguaggccgucaagaaaaaggcaaaagucuacuauucaaaacagaagaugggguaaauauguguacccucauggcuauagacuuaggggaauuaugcgaagacacgaucacauacaaaugcccauuacucaggcaaaacgaaccagaagacauugacuguugguguaauucgacuucaacuuggguuacguauggcacgugcacuacaacaggugaacauaggcgugaaaaacgauccgucgcgcuagugccacacguugguauggggcucgaaacucgaacagaaacuuggaugucaagcgaaggagcauggaaacacguccaacguaucgaaaccuggauucuucgccauccuggauucacgauuauggcagcaauuuuggccuacacaauaggaaccacccacuuccaaagagcucuaaucuucauuuuguugacggcagucgcuccguccaugaccaugaggugcauaggaauaaguaauagggauuuuguugaagguguaagcggaggcaguugggucgauaucgugcuagaacauggaucuugcguuacgacgauggcuaaaaacaaaccgacuuuagauuucgaacuuauuaaaacugaagcuaaacaaccagcaacccuacguaaauauuguauugaagccaaauuaacgaauaccacgacggaaucucgauguccaacgcaaggugaaccaucucuuaaugaagaacaagacaaaagauucuuauguaagcauucaaugguagaccgaggauggggaaaugggugcggauuguuuggaaaagguggaauuguaacuugcgcaauguuuacaugcaagaaaaauauggaggguaaagucguccagccagagaauuuagaauacacgauugucauuacuccgcauucgggugaggaacaugccguaggcaaugauacuggaaaacaugggaaggaaauaaaaauaaccccucagucuucaauaacugaagcagaguuaacaggguaugguacaguuacaauggaaugcucacccaggacggguuuagauuucaaugagauggugcuauuacaaauggaagauaaagcauggcucguucauagacaaugguuccuugaccuaccccuaccaugguuaccuggggcagacacucaaggaucaaauuggauucagaaggagacuuuaguaacauuuaaaaacccucaugccaaaaagcaagauguaguuguguuaggaucacaagaaggggcaaugcacacagcauuaaccggugcaacagaaauucagaugagcaguggaaauuugcuguuuacaggucaccuaaaauguagguuaaggauggacaaauugcaauuaaaaggaaugucuuauaguauguguacugguaaauuuaaaauagucaaagaaaucgcggaaacacagcaugggaccaucguaauaagaguucaguaugaaggugacgguaguccaugcaagauccccuucgaaauaauggaucuggagaaacgacacguacuuggacgucucauaacuguuaauccaauaguaacagaaaaagacucaccagugaauauugaagcugaaccaccguuuggcgauucauacauaauuauaggaguagagccagggcaacucaaauugaauugguuuaagaaaggaaguaguauuggacagauguuugaaacuaccaugagaggcgcgaaacgcauggccauuuuaggagauacagcgugggauuuugguagcuugggaggaguauucaccagcauugguaaagcacuucaucaaguuuucggagcaauuuacggagcagcuuuuuccgguguuucguggacaaugaaaauacucaucggagugauaaucacguggauagguaugaacucacgaagcacaucccugucaguuucauuaguuuuggugggcguugucacucucuauuuaggcgcuauggugcaagcagauucaggcuguguaguaucauggaaaaacaaagaacuaaaaugcggaucagguauuuuuauuacagauaauguacacacauggacggaacaguauaaguuccaaccagaaucuccgaguaaacuagcuucugcuauucaaaaagcgcaugaggaaggaauuugugguauaaggucggugacacgacuugaaaaccucauguggaaacaaguuacaccagagcugaaccauaucuugucagagaacgaagugaaacuuacuauuaugacaggcgauauuaaggguauuaugcaagcaggaaaaagaucuuuacgaccacaaccaacagaacugaaauauaguuggaaaacauggggcaaagcgaaaaugcuuaguacugaaagucacaaucagaccuuccuaauagaugggccagagacagcagaauguccgaauaccaauagagcuuggaacucucuggaaguagaagacuacggcuucggugucuuuacuaccaauauuugguuaaaguuaagggaaaaacaggaugucuuuugcgacucuaaacugaugucagcugcaauaaaggacaacagagcgguacacgccgacauggguuauuggauagaaagugcguugaaugacacguggaagauggaaaaagcaucauucauagaaguaaaaagcugccacuggccuaaaucucauacuuugugguccaacggagucuuagaaucggagaugauaauaccuaaaaacuuugcaggcccuguaucucaacauaacuaucggcccgguuaucacacccaaacugcuggaccuuggcaucuugggaaacuugagauggauuuugauuucugugaggguacgaccgucguaguaacagaagacuguggcaauagagguccuucacuacguacgacgacugcaucugguaaacuuauuacugaaugguguuguagaucauguacccuaccgccacuuagauaucgaggagaagauggcugcugguaugggauggaaauccguccccuuaaagagaaggaggagaacuugguaaauucguugguuacagcuggccauggacagauugauaauuuuucacuaggaguacuuggaauggcccuauucuuagaggaaauguugcgcacacgaguuggaacaaagcaugcgauucucuuaguagcaguaucauuugugacgcuaaucacugguaauaugaguuuccgugaucuaggaagaguaaugguuaugguaggagcuacuaugacagaugauauaggaaugggugugacuuauuuagcgcuucuggcagccuuuaaaguucgaccgacuuucgcagcaggacuucuacugagaaaguugacaucuaaagagcuaaugauggcaacaauuggcauugcucuuuugagucaaucuacgaucccagaaacaauacuagaacuuaccgacgcucucgcccuaggaaugaugguguugaaaauaguccguaacauggaaaaauaucagcuagcggugacgauuauggcaauuagcugugucccuaaugcugucauccuacaaaacgcuuggaaaguuggcuguacaaucuuagcagcuguaucaguaagcccacuucuauuaacaaguucacaacagaaagccgauuggauaccacuugcacuaacuauuaagggacucaauccuacagcgaucuuucugacuacauuaagcagaacauccaaaaagcggaguuggcccuugaaugaggccauaauggccguaggcaugguuucaauacuagcaucaagucuauugaagaacgauauuccgaugaccggaccccuaguggccggaggucuauuaaccguuugcuaugucuugaccggccgaagcgcagaccuagaauuagaaagagccgcagacguuaaaugggaagaucaagccgaaauaagcggcagcagccccauuuuaucaauuacaauaucagaagauggaaguaugucaauuaaaaacgaagaagaagaacaaacccugacaauacuaauaagaacaggguuauugguaauaagcggaguauucccuguaagcauaccgauuacagcggcagcaugguacuuaugggaggugaaaaagcaaagagcgggcguauugugggauguaccaucaccuccgccaguagggaaagccgaguuagaagauggagcuuacagaauuaaacaacgcgguauucuuggauauucacaaauuggcgcugguguuuauaaagaagguaccuuccauacuauguggcacgugaccagaggagcaguacucaugcaucgugggaagaggauagagccuucuugggccgauguaaagaaagaucuuauaucuuacggcggaggcuggaaacuagaaggggaauggaaggaaggggaggagguacaaguauuagcacuagaaccuggaaagaaucccagggcgguacaaacuaaaccagggcucuuuaaaacuaacacaggaacuauaggagcggucucacuagauuucucaccaggaaccucaggcaguccaauugucgacagaaaggggaaggucguaggacuuuauggaaaugggguaguaacacgaaguggagcauauguuucugcuauagcacaaacagaaaaaucgaucgaagauaaucccgaaauagaagacgauauauucagaaagaaacgacucacaauaauggaucuucacccaggugcgggcaaaacaaaaagauaucuaccggcaauagugcgagaagcuauaaaaagaggccuaagaacuuuaauacuagcaccuacaagagugguagcagcggaaauggaagaggcauuaagaggacucccaauaagauaccagacuccggcaauuagagcagaacacacaggaagagagauaguggaccucaugugucaugcuacguuuaccaugcgauugcuauccccaguaagaguuccgaauuauaaccucauaauaauggaugaggcucauuuuacagacccugcaucuauugcugcaaggggauauauuucgacaagggucgaaaugggcgaggcggcagguaucuucaugaccgccacuccuccgggaucgcgagauccauuuccacaauccaaugccccaauaauggaugaagaacgagaaauacccgagcguagcuggaacucuggacacgaauggguuacagauuucaaaggaaaaacgguaugguucgucccuucaauaaaggcugguaaugauauagccgccugucuucguaagaauggcaagaaaguaauucaacucucgcgaaaaacauucgacucggaauacgucaaaacaagagcaaaugauugggacuuuguugucaccacagacauuuccgaaaugggugcgaacuucaaagcagaacgaguaauagauccaaggagaugcaugaaaccaguuauuuugacugacggagaagagagaguuauacuagcgggacccaugccugucacucacucauccgcugcacaaagaagaggacguauaggacgaaaccccaaaaaugaaaaugaucaguauauauauaugggagagccacuggaaaaugaugaggacugugcacacuggaaagaagcaaaaaugcuucuggacaacauaaauacucccgaagguauaauccccucaauguucgaaccugagagagaaaagguugaugcaaucgauggggaauacagauuaagaggugaggcaagaaagacauuuguagaccucaugaggcgcggagauuuaccagucuggcuagcuuauagaguagcagcagaagggauaaauuaugcagacaggagaugguguuuugacgggauuaaaaacaaucaaaucuuagaggaaaacguagaaguugaaauauggaccaaagaaggagaacguaaaaaguugaaaccacgaugguuagacgcacgcauauacucagacccauuggcucuaaaagaguuuaaggaauuugccgccggacgaaagucccugacguuaaauuugaucacagaaauggggcggcucccaacuuuuaugacacaaaaagcucgggaugcccuggacaacuuagcuguauuacauaccgcagaggcuggagggaaagcguacaaucacgcguugucugaauugccagagacccuagaaacguuauuguugcuaaccuuauuggcaacaguaacuggaggcaucuuucuauuuuuaaugucaggaaaaggcaucgguaaaaugacguuaggaauguguuguauuauaacugcaucgaucuuauuaugguaugcacaaauacaaccucauuggaucgcagcaucaauuauauuagaguucuuucuaauagucuuauugauuccugaaccagagaaacaaaggaccccacaagacaaucaauuaacauaugucguaauagcaauacugaccgugguagcagcaacaauggcgaaugagaugggguuccuagagaaaaccaagaaagaccuuggacuuggaucuauaacaacgcaagaguccgaaaguaauauauuagacauagaucuaagaccagcaucagccuggacucuuuaugcaguggcaacuaccuucgugacgccuauguuaagacacuccauugaaaauucaucaguaaauguuucucucacagcuauagccaaccaagcaaccguacuuaugggauuggguaaaggguggccgcuaucaaaaauggauauuggaguaccuuuauuagcgauaggcugcuauagccaagugaacccaaucacacuuacggcagcucuccuauuauugguugcacacuacgcaauaaucggcccaggacuacaggcuaaggccacgcgugaagcucagaaacgggcugccgcggguauaaugaaaaauccaacaguggacgggauuacaguuauagacuuagagccuauuccauaugacccaaaguucgaaaaacagcuaggacaaguaaugcugcuaauauuaugcgucacacaaguacuaaugaugagaaccaccugggcucuuugugaagcauuaacacuagcuacagggccgauuucaacuuuaugggaaggaaauccugggcgguuuuggaauacaacgauagcaguuuccauggcaaacaucuucagagggaguuaccuagcuggggccggacuacucuuuaguaucaugaaaaauacgacuaacacgcgacgaggcacaggcaacauaggugaaacucuuggugaaaaauggaaaagucgacuuaaugcguuaggaaaaagugaguuccaaaucuacaaaaagucuggaauacaagaaguagaccguaccuuagcaaaagaggggauaaagagaggcgagacugaccaucaugcaguuucacgugggucggcuaagcuacggugguuuguagagagaaacaugguaacgccugagggcaaaguggucgauuuagggugcggccgcgguggaugguccuauuauugcgguggccucaaaaauguccgggaaguaaaaggucucacgaaagggggaccaggacaugaagaaccgauaccgauguccacuuaugguuggaacuuaguaagauugcagagugguguggacguauucuuuacgccuccagaaaagugugauacacucuugugugauauaggcgaaucaucacccaacccaacuauagaggcaggacgaacguugcgaguauugaaucuaguagagaauugguuaaauaauaauacucaauucuguauaaaagucuuaaaccccuauaugccgucaguaauagagaagauggaaacauuacaacgaaaauacgguggggcguuagugcggaaccccuuauccagaaauuccacacaugaaauguauugggugagcaaugcaacugguaauauuguaucuucuguaaauaugauaaguagaauguugauaaauagguuuacaaugaagcauaaaaaggcaacuuaugaaccugacguagaccugggaucuggaacccggaacauagggauugaaucggaaauaccuaaucuagacaucauaggcaaaaggauagagaaaaucaaacaagaacacgaaacgaguuggcauuaugaucaagaccauccauauaagacaugggccuaucauggcucauaugagacgaaacaaaccgguucagccucaucaauggucaacgggguuguuagacuauuaaccaaaccgugggaugugguuccgaugguuacccaaauggcgaugacggacacaacacccuuugggcaacaacgcguauucaaagaaaaaguugacacuaggacacaagagccuaaagaagggacuaagaaacuuaugaaaaucacagcugagugguuauggaaagaguugggcaagaagaaaacaccuagaauguguaccagggaagaguucacgcguaaaguucgaaguaacgcggccuuaggagcuaucuucaccgaugaaaauaaauggaaaagcgcuagagaagcuguagaagauucgagauuuugggaauugguggaccgagagcgaaauuugcaccuagaaggaaaaugcgaaacaugcguauauaacaugaugggaaagagagagaaaaaguugggagaauuuggcaaagcgaaaggaucucgagcaauuugguauaugugguuaggcgcucgauuuuuagaguucgaagcauuggguuuccucaacgaagaucacugguuuagucgcggaaauucacucucuggcguugaaggcgagggcuugcaccgauuaggauacauacugaaagacguauccaagaaagagggaggcgcaauguaugcagacgacaccgcggguugggacacgagaauaacgcuggaggaucuuaaaaacgaggagaugguaaccaaccauaugaagggcgaacauaagaaauuagcugaggcaauauuuaaauugaccuaccaaaacaaaguugugaggguccaaagaccaacaccacgcgguacaguaauggauaucauaagucggcgugaucaaagaggaucuggucaaguagggacuuauggucuaaacacuuuuacuaacauggaagcacaguuaauacggcaaauggagggagaaggaauauuuaaauccauucaacaccuuaccguuacggaagaaauagcgguacaaaacugguuagcaagagugggcagagagcggcuaucaagaauggucaucucuggugaugauugugucgugaaaccgcuugaugacagauuugcuucagcucucacggcucuaaaugauaugggaaaaguuagaaaagacauacaacaaugggaaccaagcagaggguggaaugauuggacgcagguuccguucuguucacaucauuuccaugaauuaguuaugaaagacgggcggguguuaguuguaccuugcagaaaucaagacgaguuaauaggucgcgcacgcauaucacaaggagccggauggucguuaaaagagacggcuuguuuagguaagucguaugcucaaauguggacacuaauguacuuucaccgaagagaucuaagguuagcagcaaacgcgaucuguagcgcagucccgucacauuggguaccgacaucgagaacaacuuggucaauacacgccaagcaugaguggaugacuacagaagauauguuagcaguguggaaucgugucuggauucaagaaaaucccuggauggaagacaaaaccccugucgaguccugggaagaaguaccauacuuagguaaaagagaagaucaauggugugguucacuaaucgguuuaacgagucgcgcgacaugggccaaaaauauacaaacagccaucaaccagguccguagcuuaaucggaaaugaagaauauacagauuacaugccuucaaugaaaagauuucggcgagaggaagaagaagcugguguguugugguga

SEQ ID NO: 22547 - RNA, 9876 nt, Artificial Sequence
  derived and/or modified CDS sequence (opt6) from DENV-2__EU482571__SS-prME
acugcugggguuauuauaaugcucauaccaaccgcaauggcauuccaucugacuacuagaaauggugaaccacauaugauaguagggcggcaggaaaaaggaaaaucucuacuauuuaaaacugaagauggaguaaauaugugcacucuuauggcaauugauuugggggaauuaugugaagauacuauuacuuacaaauguccgcuauuaagacaaaacgaacccgaagacauagacuguuggugcaauuccacgucaacuugggugacauacggaacaugcacaacaacaggagaacaucgcagagaaaaacgaaguguagcucuaguaccacacguaggaaugggauuagaaacacgcacugaaacuuggaugucuagugaaggagcauggaaacauguucaaagaauagaaacauggauuuuaaggcacccuggauuuacuauaauggcagcaauucucgcauauacaauaggcaccacacauuuucaaagagcucuaauuuucauauugcugacagcaguagcaccaaguaugacaaugcguuguauaggaauaaguaauagagauuuuguagaaggaguaaguggaggcucauggguagauauaguuuuggaacacgguucgugcguuacuacgauggccaaaaauaaaccaacuuuggacuuugaauuaauaaaaaccgaagcaaaacaaccugcaacauuaaggaaauauugcauugaagccaaacuuacuaauacaacaacugaaucacgaugcccaacacaaggagaaccgucucuaaacgaagaacaagacaaaagauuucuuuguaaacacuccaugguugaccgaggauggggcaauggcuguggucuauuuggaaagggaggcauaguaacuugcgcuauguuuacauguaagaaaaauauggaaggaaaagucguucugccggaaaauuuggaauacaccauugugauuacaccccacaguggugaagaacacgcaguugguaacgauacaggcaagcauggcaaggaaauaaagauaacaccucaaaguucgauaacugaagcagaacugacuggauaugggacaguaaccauggaaugcucuccucguacgggacuagacuuuaaugaaaugguguuauuacaaauggaagacaaagcauggcugguacaucgacagugguucuuagacuugccacuaccguggcuuccaggggcugauacacaaggaucaaauuggauccagaaagaaacguuaguaacuuuuaaaaacccucacgcgaaaaagcaagacguuguagucuuggggucccaagagggugcaaugcacacugcucuuacgggugcaaccgaaauucaaaugagcuccggaaaccuauuguuuacaggccauuuaaaauguagguugagaauggauaaauuacaguuaaaaggcaugagcuacagcaugugcacaggcaaauuuaaaauuguaaaggaaaucgcagaaacgcagcacggcacuauaguuauccgaguacaauaugagggugauggcaguccuugcaaaauaccguucgagaucauggaucuugagaagcgucauguccuaggucgacugauuacugucaauccaauaguuacugaaaaagauucaccuguaaacaucgaagcagagccuccauuuggggauucauauauuauaauaggaguagagccaggucaacuaaaacuaaacugguucaagaaaggauccucgauagggcaaauguuugaaacaacaaugcguggagcuaagaggauggcaauacuuggggauaccgcaugggauuuugguagcuuagguggaguauucacgaguaucgguaaagcacuucaucaagucuuuggagcaauuuauggagcggcauuuucagguguuaguuggacaaugaagaucuuaauugggguaauaauaacuuggauugguaugaauagucgaucaacuucguuaaguguaucguuaguguuagucggaguaguuacacuauaucuaggugccaugguacaggcagauucuggaugugucguuagcuggaaaaacaaggaauuaaaaugcgguucgggaauauuuauuacagauaacguacacaccuggacugaacaauacaaauuucagccggaaucgcccaguaaauuagcaucagcaauacaaaaagcacacgaagaaggaauaugugguauuagaucuguuaccagauuggaaaacuuaauguggaaacagauaacgcccgaguuaaaucacauuuuaucugaaaaugaaguaaaacuaacaauaaugacaggagacaucaagggcauuaugcaagcaggaaaacgaagucucagaccgcaaccuaccgaauugaaauauucauggaaaacuuggggaaaagcuaaaaugcuaaguacugaaagucauaaccaaacuuuccucauagaugggccagaaacagcggaguguccaaauaccaaucgggcauggaauagcuuagaaguugaagacuauggauuuggaguauuuacaacaaacaucuggcucaaguuaagagaaaaacaagacguuuucugcgauagcaagcugaugucagcugcgauuaaagacaacagggccguacacgcugauauggguuauuggauugagucagcucucaaugauacguggaaaauggaaaaggcaucauuuauugaaguaaaaucuugccauuggccaaagagucauacauuauggucaaacggggucuuagaaucagagaugauaauucccaaaaauuuugcagggccgguuucucaacauaauuacagaccaggguaucacacacaaacugcggguccauggcauuuaggaaagcucgaaauggauuucgacuuuugugaaggaacgacaguagugguaacugaagacugugggaaucgagguccgucucuacgaacaacgacagcgucgggcaaacuaauuacagaaugguguugcagaaguugcacucuuccucccuuaagauaucguggugaagauggcuguugguaugguauggaaauccggccauuaaaggaaaaagaggaaaaucuugugaauagucuaguaacugccggacacggacaaauugauaauuuuucacucggugucuugggaauggcuuuauuccuagaagaaaugcuuagaacaagagucgggacuaaacacgcaauacuucuaguagcuguuuccuuuguaacacucauuacggggaacaugaguuuucgugaccuaggacgcguuaugguaaugguaggagcaaccaugacggaugacauugguaugggagugacauauuuggcacucuuagccgcauucaaaguccggccgacauucgcagcagguuuacucuuaagaaaauuaacaaguaaagagcugaugauggccacuauagguauagcacuuuugucacaaucuacaaucccugaaaccauauuagaguuaaccgaugcacucgcccuuggaaugaugguucucaaaauagugcgcaacauggagaaauaucaauuggcagucacaauaauggcaauaaguugugucccgaaugcaguaauacuucaaaacgcguggaaagucucgugcacgauucuagcagcugucucugucucuccauuacuacuaaccucgagucaacagaaagcugauuggauaccacuugcuuugacaauuaagggauugaauccaacugcaauuuucuuaacuacccuauccagaaccaguaagaaaagaagcuggccacuuaaugaagcgauuauggcgguaggaaugguaucaauucuagcaucuagcuuauugaagaacgauauaccaaugacaggccccuuaguagcaggagguuuacucacuguaugcuacguauuaacuggccggagugcagaucuagaacuugaaagagcggcagauguuaaaugggaagaucaagccgaaauaucagguuccagcccaauuuuaucuauaacaauuucugaggauggaaguaugucgaucaaaaaugaagaggaagaacagacgcugacaauucugauaagaacaggucuacuuguuauaucggguguauuccccgugucuauacccauaacggcagcagcuugguaccuaugggaaguaaagaaacaacgugccgguguacugugggauguaccuaguccaccaccaguaggcaaagcagaauuagaagauggggcuuaccguauuaaacaaagagguaucuuaggcuauucccaaauuggugcaggggucuauaaagaagguacuuuucacacaauguggcaugucacgaggggcgcgguauuaaugcauagaggaaaaaggauagaacccuccugggcagaugucaagaaagaucuuaucucguacgggggcggauggaaacuugaaggggaauggaaagaaggagaagaaguacaagugcuggcauuagaacccggcaaaaauccucgcgcaguacaaacaaaaccugguuuguucaaaacaaauacuggaacaauaggggcaguaucauuggacuuuuccccaggaaccaguggaaguccaauuguagaucgcaaagguaaaguaguuggcuuguacggaaacggaguggugacacguagcggugcauaugucagugcgauugcgcagacagagaaaaguauagaagauaauccagagauagaggaugacauauuuaggaagaaaagauugacaauuauggaucugcacccuggcgccggaaaaaccaaaagguaccuuccugccauaguacgugaagcuauuaaaagaggguuaagaacccuaauauuagcaccgacucgugucguggcagcugaaauggaggaagcauugagggguuuaccaaucagguaucaaacgccagcuauccgugcugaacacacagguagagaaauaguagauuuaaugugccacgcaacuuucaccaugcgucuuuuaucaccaguaagaguaccuaacuauaaucuuaucaucauggaugaagcacauuuuacagacccugcgucgauugcagcacggggauacaucucuacccgaguagaaaugggcgaagcugcgggaauauuuaugacggcuacucccccaggaucacgugauccuuuuccgcaaagcaaugcucccaucauggaugaggaaagagagauaccagaaagaaguuggaacucaggacacgaauggguaacggauuucaaagguaagacgguaugguuuguuccaagcauaaaagcggguaaugauauagccgcaugccuacggaaaaacggcaagaaagugauacaauuaucccgaaagacuuuugauagugaauaugucaagacaagagcaaaugauugggauuucguuguuacgaccgacauaagcgagaugggggcgaauuucaaagcggaacguguaaucgauccaaggagauguaugaaacccgucauacucacugauggggaagaacgagugauacuggcagguccuaugccaguaacacauucaucugcugcacagagaagagguagaaucggcaggaauccuaagaaugaaaacgaccaguacauauacaugggagagccguuagaaaaugacgaagacugcgcgcauuggaaagaagcaaagaugcuacuggacaacauaaacacaccugagggcauuauccccaguauguucgaaccagaacgggagaaaguagaugccauagacggcgaauacagguuacguggagaagcaagaaagaccuucguagaccugaugcggcguggggauuugccaguaugguuggcauacagaguagcagcagaggggaucaauuaugcagauagacgcugguguuucgacggaauuaaaaauaaccaaauucuugaggaaaauguagaaguggaaauauggaccaaagaaggugaacgaaagaaacuuaaaccucggugguuagacgcucgaauuuauucagaccccuuagcucuaaaggaguuuaaagaauuugcggcagguaggaagaguuuaacguuaaauuuaauaaccgaaaugggccguuuaccaacguucaugacacaaaaagcgagggaugcauuagacaaucuggcaguacuacauacugcagaggccggugggagagcuuauaaccaugcauugagcgaacuaccugagacccuggaaacgcuacuucuauuaacauuacuggccacgguuacagguggaauauuccucuucuuaauguccgggaaaggaauaggaaaaaugacauuagggaugugcuguaucauaaccgcgucaauauuacugugguaugcgcaaauacaaccucauuggauugccgccagcauaauucuggaguucuucuugauuguacuauugauaccugagccugagaaacaacgaacgccccaagauaaucaguuaacguaugucgugauagcgauuuugaccguuguagcagcuacaauggcgaacgaaaugggauuuuuagaaaagacaaagaaagaccuagguuugggaucuauuacaacccaagaaagcgagucaaacauacuggacauagaucuuagaccagccucagcuuggacauuauacgcgguagcuacaacauucguuacuccaauguuaaggcacuccauagaaaacagcucggucaauguaucauuaacagcaauagcgaaucaagcaacaguucuuaugggauuagguaaagguuggccgcuaaguaagauggauauaggggugccccuuuuggccauaggaugcuauucacaaguaaacccuauaacccuuacagcagcuuuacuucuuuuaguugcccacuaugccauaauaggaccaggguuacaagcaaaggcaacacgggaagcucaaaagcgcgccgcagcagguaucaugaaaaauccuacaguagacgguauaacaguuaucgaccuugaaccuaucccauaugacccuaaauucgaaaaacagcuaggucagguuauguuauuaauucuauguguaacgcaaguauuaaugaugagaacaacaugggcauuaugugaggcguuaaccuuggcuacgggacccauuucaacacuaugggaaggaaacccaggacguuuuuggaacacuaccauagccguaagcauggcaaauauuuucagagguucauaucuagccggagccggacuccuauuuucgaucaugaagaacaccaccaauacgcgaagaggcacggguaacauuggggaaaccuuaggcgagaaauggaaaucaagauugaaugcucuaggcaaaucugaguuccaaaucuacaagaaaagcggaauccaggaaguugaccgaacuuuagcuaaggaagguauaaaacgaggagagacagaccaucacgcuguuucgcgggggagcgcaaaacugagaugguuuguagaaagaaacauggucacuccggaagguaaagugguagauuuggguugcggacgggguggauggucauacuauuguggcgggcuuaagaaugucagagagguaaagggauuaacaaagggagggccuggucacgaggaaccaauacccaugaguacauacggguggaauuuaguacgauuacagucuggaguggauguauucuuuacacccccggaaaaaugcgacacacuccugugugauauaggcgaaaguuccccaaacccgacaaucgaagcagguaggaccuuacguguucucaaucuugucgagaauugguuaaacaacaacacucaauuuuguaucaaaguucuuaaccccuauaugccuaguguuaucgagaaaauggaaaccuuacaaagaaaguaugguggugcguuaguacguaacccguuaagccguaacaguacucacgaaauguauuggguaucuaaugcaaccggcaauauaguaaguucgguaaauaugaucucgcgaaugcuuaucaaccgauuuacgaugaagcauaagaaagcaaccuacgaaccagauguagacuuagguaguggaacucgcaauauugguauugagucagaaaucccaaauuuagacauaaucgggaaaagaauagagaagauaaaacaagagcaugagacuuccuggcauuaugaucaggaucauccuuauaaaacaugggccuaccauggauccuaugagacuaagcaaacagggucagcuaguuccaugguuaacgggguuguccgacuauuaacuaaaccaugggaugugguaccaaugguaacgcaaauggcuaugacugacacuacacccuuugggcaacaacgcguuuuuaaggaaaaaguugacacucgcacgcaggagccaaaagaaggcaccaagaaauuaaugaaaauaacugccgccugguuguggaaagaauuggggaaaaagaaaacaccucggauguguacaagagaagaguucacacgaaagguucggagcaaugcggcgcuaggagcgauauuuacugaugaaaacaaauggaagucagcacgggaagcuguagaagauucgagauuuugggaauuaauagaccgagagagaaauuugcaccuugagggaaaaugugaaacaugcguuuauaauaugaugggaaaaagagaaaagaagcugggagaguuuggaaaagcgaaaggaagcagagcuauuugguauaugugguuaggcgcgcgauuucuggaguucgaagcacuaggcuuccuuaacgaggaccacugguuuaguagaggaaauuccuuaaguggaguugaaggagagggauugcauagauuagguuacauauuaagggauguaucuaagaaagaggguggcgcuauguaugcagaugacacagcggguugggacacaagaauaacauuagaagacuugaaaaaugaagaaaugguuacaaaucauaugaagggcgaacacaaaaaguuggcugaagccaucuuuaaacugacauaucagaauaagguagucagaguucaacgcccuacaccaagagggacagugauggauaucauuucacgucgggaucaacggggauccggucaaguuggaaccuauggguugaauacauuuacaaauauggaagcacaacuuauacggcaaauggaaggugaaggaauuuucaaaucaauacagcaucuaaccguuacagaggaaauagcuguacaaaacugguuagcacggguuggaagagaacgacuuucacgaauggccauuaguggcgacgacuguguagugaaaccccuagacgaccguuuugcgucggcauuaaccgcacuaaaugacauggguaaaguuagaaaggauauucaacaaugggaaccuucaaggggauggaacgacuggacgcaggucccauuuuguucccaucauuuccaugaauuaguaaugaaagauggacgagugcucguuguaccaugucgcaaccaagaugagcuuauaggacgugcgcgaaucagucaaggugccgguuggagccuaaaagaaacagcaugucucggcaagaguuaugcucaaauguggacuuuaauguauuuccauagacgugauuuacgacuagcagcuaaugcaauuuguagugcaguaccaucgcacugggucccaacgucccgaacuacauggaguauacaugccaagcacgaauggaugacaacagaagauauguuggcgguauggaauagaguuuggauucaagaaaaucccuggauggaagacaagaccccuguagaaaguugggaggaagucccguaccuugguaagagggaagaccaguggugcggaucauuaauaggacucacuagccgagcgacuugggcaaagaauauacagacggcaaucaaccagguaagaucauuaauaggaaacgaagaauauacugacuacaugccaucaaugaaaagguucagaagagaggaagaagaggcuggcgugcuaugguga

SEQ ID NO: 22548 - RNA, 9876 nt, Artificial Sequence
  derived and/or modified CDS sequence (opt6) from DENV-2__EU482572__SS-prME
acagcuggugucauaauuauguugaucccaacugcaauggcauuccacuuaacuacuaggaauggagaaccacacaugauaguaggaagacaagaaaaagguaaaaguuuauuguuuaaaacggaagaugguguaaacaugugcacgcuuauggcaauagaucuaggcgaauuaugugaagauaccauaacuuauaaaugcccacuacugcggcaaaaugaaccagaagacauagauugcugguguaacucuacaaguacuuggguaacuuacggaacauguacgaccaccggagaacauagaagagagaaaaggucaguggcauuagugccacacguuggaauggguuuagaaacaagaacugaaacauggaugucaagcgaaggcgccuggaaacauguucagcggauagagacauggauacuucgacauccaggcuuuacaauaauggcggccauauuagcauacacaauuggcacuacacauuuucaacgagcccuuauauuuauacuauuaacagcaguagcaccgucgaugacaaugcgguguauuggaauuucaaacagagauuucguugaagggguaaguggugguaguuggguagauauaguauuagaacaugguagcuguguuacuacuauggcuaaaaauaaaccaacacucgauuuugaacuaaucaaaacugaagcuaaacagccagcaacacuuagaaaauauuguaucgaagcuaaauugacuaauaccacuacggagucacggugcccgacccaaggagaacccaguuugaacgaagaacaagauaaacgcuuucucuguaaacauucaauggucgauagaggcugggggaacggauguggucucuuuggaaaaggaggaaucguaacuugcgcuauguucacgugcaagaaaaacauggaaggaaaagucguucagccagagaacuuagaauauacaauugugauaacuccccauagcggagaggaacaugcaguaggaaacgacacugggaaacacgggaaagagauuaaaauaacaccacaaaguucuauuacugaagcggaauuaacaggcuacggaacaguuacaauggaauguucgccacggaccgggcucgauuucaacgaaaugguacuucuacagauggaagacaaagcauggcuuguucauagacagugguucuuagauuuacccuuaccuuggcugccaggagcggauacacaaggaucaaacuggauacaaaaagagacccucgucacuuuuaaaaacccucacgcuaagaaacaagauguagugguucugggaagccaagaaggcgcuaugcauacagcacucacaggugcaacugaaauucaaaugucuucagggaaucuccuauucacaggacauuugaaaugucgucugagaauggauaaauugcaacuaaaaggcaugucguauagcauguguaccggaaaguuuaagauugugaaagaaaucgcggaaacgcaacauggcacuaucguaaucagaguucaauaugaaggggaugguagucccuguaaaauucccuucgaaauuauggaucuagagaaacgccauguauugggacgauuaauuacaguuaauccaauaguaaccgaaaaagauucuccaguaaauauugaagcggaaccgccuuucggcgacagcuauauaaucauagguguagaaccuggacaacuuaaacuaaacugguucaagaaagggucauccauuggucaaauguuugaaacaacuaugagaggagcuaaacgaauggcuauacuuggcgauacagcaugggacuuuggaucacuuggagggguguuuacaaguaucggaaaagcguuacaucaaguauuuggggcaauauauggugcugcauuuucuggaguuucguggacaaugaaaauuuuaaucggaguaauuauaacauggauagguaugaauagcaggucaacgucuuuaucugucucacuuguucuuguuggggugguaacacuauauuugggugcuaugguccaagcggauagugggugugugguaucauggaaaaauaaagaacuuaaaugugguaguggaaucuuuauaacagacaacguccauacuuggacagaacaguacaaguuucaaccugaaucgcccucuaaacuagcaucugcaauacagaaagcacaugaagaaggaauaugcggaauuagaagcgucacacgacuagaaaauuuaauguggaagcaagucacuccggaacucaaccauauauuaucagaaaacgaaguaaaacucaccauaaugaccggugauauuaagggcauaaugcaagcuggaaaaagaucuuuacguccacagccgacagaacugaaauacucauggaaaacgugggguaaagcaaaaaugcucucaacagagucacauaaccaaacauuuuuaaucgauggcccagaaacagcagagugcccaaauacaaauagggcauggaacagcuuagaaguggaggauuauggguuuggcguauuuacgaccaauauaugguuaaaauuaagagaaaaacaagauguauuuugcgauucuaaacugaugagcgcagcaauuaaagacaaucgcgcuguacacgcagacaugggcuauuggaucgagucggcuuuaaacgacacguggaaaauggaaaaggcgucguuuaucgaaguuaaaucaugucacuggccuaaaucacacaccuuauggucgaacgggguuuuagaaagugagaugauaauccccaaaaauuucgcggguccuguaagucaacacaauuaccgaccugguuaccacacacaaacggcagggccauggcaucucggaaaacuagaaauggauuuugauuuuugugaagggacaaccguaguagucacaggugacugcggaaaucgagguccgucacuacgaacuaccacagccaguggaaaacugauuacagaauggugcugucguuccugcacacuuccaccccucagauauagaggugaagauggaugcugguacgguauggaaauaagaccauuaaaggaaaaagaggagaacuuaguaaauucgcuuguuacugcuggucauggucaaauagauaauuucagcuuaggaguucuaggcauggcgcuguuuuuggaagaaaugcuccguacaaggguuggaacgaagcacgccauuuuauuaguugcagugucguucguaacauugauuacuggcaauaugucguuuagggaccucggucguguaauggugaugguaggggcaaccaugaccgacgacaucgggauggguguaaccuaucuagcguugcuagcagccuucaaaguaagacccaccuucgcagcaggauuguuacuaaggaaguuaacuucaaaagaacucaugauggcgacgaucggcauugcacuuuuaucgcagucaacuauacccgaaacaaucuuagaacugacggaugcauuggcuuuaggaaugaugguauugaaaauagugaggaauauggaaaaguaucaauuagcaguaaccauuauggccauuaguuguguccccaacgcaguuauuuuacaaaaugcauggaaaguaucuugcacaaucuuagccguagugaguguuagcccacuuuuauuaacuucaagccaacaaaaagcagauuggauaccacuugcacuuacaauaaaggguuugaacccaacugccauauucuuaacgacguuaucaagaaccucuaaaaagcgaagcuggccucuaaaugaagcgauuauggcaguaggaauggucagcauacucgcaucgagucuuuugaaaaaugauauuccuaugacuggaccauugguagcuggagggcuucuaacaguaugcuaugucuuaacaggaaggucagcagacuuggaauuagaaagggcugcagaugucaagugggaggaccaggccgaaauauccggaagcuccccaauucuaagcauaacaauuucggaagacggauccaugaguaucaaaaaugaggaagaagaacaaacacuaacaauauugauacgaacaggucuguuggugaucucaggcguauucccggugucaauuccaauaaccgcagcagcaugguaucuaugggaggucaagaaacaaagagcaggaguuuuaugggacgucccaucuccaccuccgguggguaaagcagaguuagaagauggcgcguacaggauuaaacaaagaggaauacuaggauacucccaaauaggagcuggagucuacaaagagggcacauuucauacaauguggcauguuaccagaggggcaguucuuaugcacagagggaagagaauagaaccuagcugggcagauguaaagaaagaucucaucaguuacgggggaggguggaaacuugagggcgaguggaaagaaggagaagaaguacaaguuuuagcauuggaaccuggaaagaauccccgugcugugcagacaaagccgggacucuuuaaaacuaauacaggaacaaucggugcggugaguuuagauuucucuccaggaacgucaggauccccuauuguggauagaaaagggaaaguaguuggacuauacggcaacggugucguaacaagaaguggagcauauguaagcgcgauagcgcagacagaaaaaucgaucgaagacaauccagaaauugaggaugauauuuuucggaagaagcguuugacaauaauggaucuacacccaggagccggcaaaacgaaacgcuaucuaccagcuaucguucgugaagccaucaaaagaggacuccguacucuuauacuggcgccuaccagaguagucgcagcugagauggaagaagcguugagagguuuaccaauaagauaucaaacuccagcuauuagggcagagcacacaggacgugaaauaguugauuuaaugugucaugccacuuuuacgaugagacuccuaaguccaguacgaguaccuaauuauaaccuuauaauaauggaugaagcccacuucacugacccagcaucgaucgccgcaagaggguacauuuccacgagaguggaaaugggagaagccgcugguauauucaugacagcaacaccaccuggaucccgagauccuuuuccacaaaguaacgcgccaaucauggacgaggaaagagagauaccagaacgaucauggaacucaggccacgagugggucacugauuuuaaggguaagaccguaugguucguaccuuccaucaaagccggcaaugauauagcagcgugccuacgaaagaacggcaagaaaguaauacaacucagucgaaaaacguuugacucagaauauguuaagacucgugcgaaugauugggacuuugucguaacuacggauauuucggaaaugggagcaaacuuuaaagcugaaagaguuauagauccucgaagauguaugaaaccuguuauacuaacggauggagaagaaaggguuaucuuagcgggucccaugccagucacacacucuagugcugcccagaggagaggccguaucggacgaaaccccaaaaaugaaaacgaccaguacauauauaugggugagccauuagaaaacgacgaggacugugcacauuggaaagaggcuaaaaugcuuuuagauaacauaaauacaccagagggaauaauaccuaguauguuugaacccgaaagagagaaaguggaugcaauagacggagaguaucgguuacguggagaagcaagaaagacauuuguugacuugaugcgccgaggcgauuuaccuguauggcucgcauacagaguagcagcagaagguaucaacuaugcagacagaagauggugcuucgacgggaucaaaaauaaccaaauacuagaagaaaauguugaaguugaaauuuggacaaaagaaggugaacggaagaaacuuaaaccaagaugguuagaugccaggauauacuccgauccuuuagcauugaaagaguucaaagaguucgccgccggucgcaaaucacugacacugaaucucauaaccgaaaugggcagguuacccacguucaugacccaaaaggcaagagaugcucuugauaacuuagccguacuacauacagccgaagcuggaggaaaagcguauaaccaugcgcuaucugaauuaccagaaacacuggaaacacuguuauuguugacauuacuggcaacagugaccggaggaauauuccuguuuuuaaugucugggaaaggaauaggcaaaaugacauuagguaugugcuguauaauaacggcaucuauacuacuuugguacgcacaaauacaaccacauuggauugcugcgaguauuauacuagaauuuuuccucauaguguuguuaauuccagaaccagaaaaacaacgaacuccucaagauaaucaauuaacguauguuguuauagcuaucuugacuguaguggcagccacuauggcgaacgaaauggguuuucuugagaaaacuaagaaagaccuaggauuagggagcauaacaacacaagaauccgaaaguaauauccuugacauagaucuccggccagcuagugcuuggacacucuacgcaguagcuacaacauuuguaacaccgaugcuaagacacucgauugaaaauucaucgguuaauguuucuuugacggcaauagcuaaccaggcaacuguccugauggguuuaggcaaaggauggccguuguccaaaauggacauaggcgucccucuucuugcgauagguuguuauucccagguuaauccaauaacacuuacugcagcgcucuuauugcucguagcccauuacgcuauaauugggccuggauuacaagcuaaggcaacacgggaagcacagaaaagagcugccgcagggauaaugaaaaacccuacaguugaugguauaacagucauagacuuagaaccuauaccauaugauccgaaguucgaaaaacaauugggacagguaauguuguugauacucugcguuacacagguaaugaugaugcggacaaccugggcauuaugcgaggcacuaacacuggcuaccggacccauuucaacucuaugggaaggaaauccaggacguuucuggaacacgacaauagcggucuccauggccaacauauuuagggggaguuauuuagcaggcgcaggguuacuuuucagcauaaugaaaaacacuaccaauacaagacgagguacaggaaauaucggagaaacacuaggggaaaaauggaagaguagacuuaaugcuuuagggaaauccgaguuccagauauacaagaaaucagguauacaagaaguagauagaacucuugccaaagaagguauuaaaagaggcgaaacugaucaccacgcaguaucgaggggaucagcuaaauuacgcugguucguugaaagaaauaugguaacuccagaaggaaaaguaguugaucucggauguggaaggggugguuggucauauuacugcgguggguugaaaaauguucgugaaguaaagggccugacuaaggguggcccgggacaugaggaacccauaccuaugucuacguacgguuggaacuuaguaagacuccagaguggggucgauguguucuucacgccgcccgaaaaaugcgauacacucuugugcgacaucggagagagcuccccaaacccaacaauagaggccggccgcacucuacgcguauuaaacuugguugagaacuggcucaacaauaacacucaauucuguauaaaaguccugaauccauauaugccuucuguuauugaaaagauggaaacuuuacaaaggaaauaugggggugcccuaguaagaaauccacuaagucguaauucaacgcaugaaauguacuggguuuccaacgcgacagggaauaucguuaguaguguaaacaugauaaguagaaugcuaaucaaccgguucacgaugaaacauaagaaagcuacuuaugaaccagauguugacuuaggaucuggaacaagaaauauaggaauagaaagugagauacccaauuuggacauaauugguaagagaauugagaagaucaaacaggaacacgaaacgucguggcauuaugaucaggaucaucccuacaagacuugggcguaccaugguucauaugaggcuaaacaaacagguucggcaucaucgaugguaaacggugugguaagauugcuuacuaagccaugggauguuguuccaauggugacacaaauggcuaugacggacaccacaccauucggacaacagcgcguauucaaagaaaaaguagauacaagaacgcaagaaccaaaagaaggcacuaagaaacuuaugaaaauuacggcagagugguuauggaaagaguuagguaagaagaaaacuccccggaugugcacgagagaagaauuuacgagaaaaguccggucaaacgcagccuuaggugcuauuuucacugacgagaacaaauggaaaagugccagggaggccguggaagauaguagauucugggaacugguagacagagaaagaaacuuacaccucgaaggcaaaugugaaacaugcguguauaauaugaugggaaaaagagagaagaaacucggagaauuuggaaaagcuaaaggaaguagggccauaugguauauguggcuuggcgccagauuuuuagaauuugaagccuuaggcuuccugaacgaagaucacugguucucaagaggaaacagcuuaaguggaguggaaggagagggucuccaccguuuaggguacauccugagggauguuucaaagaaagaaggcggagcuauguaugccgacgauacagcagguugggacacccgcauaacacucgaagaucucaaaaaugaagaaaugguaacgaaucauaugaaaggagagcacaagaaacuugcagaagccauauuuaaacucacguaucaaaacaaaguaguacggguacaacgacccaccccuagggggacaguuauggauauaauaaguagaagagaucagcggggaucuggacaaguaggaacuuauggacugaacacauuuaccaauauggaagcucaacugauacgacagauggaaggggagggcauuuuuaaaucaauccaacaucuaacaguaacugaggagauagcaguacagaauugguuagcucggguuggucgugaaagauuaagucguauggugauaucuggcgaugauuguguagugaaaccauuagacgauagauuugcgucugcucuaacugcacuuaacgacauggguaaaguacguaaagauauccaacaaugggaaccuagccguggauggaaugacuggacucaaguaccuuuuuguagccaucauuuccaugagcucguaaugaaggaugggaggguacuuguagucccuugccgcaaccaggaugaguugauaggacgagcucgcauuagucaaggggcuggcuggucccucaaagaaacugccugucuuggaaaaaguuacgcucaaauguggacgcuuauguauuuccauagaagggacuuacgccucgcagcuaacgcaauuuguuccgcaguuccaucgcacuggguucccacuucgcgaacuacauggagcauacaugcgaaacaugaauggaugacaacugaggauauguuagcaguuuggaaccgaguauggauacaagaaaauccauggauggaagauaaaaccccaguggagaguugggaagaaguaccauaccucgguaaacgagaagaucaauggugcggaaguuuaauaggccugacaucuagagccaccugggcuaagaacauacaaaccgcaauaaaucaaguacgcagcuuaauuggaaacgaggaauauacugacuacaugccuucaaugaagcgauuccgacgagaagaagaagaagccggaguccucugguga

SEQ ID NO: 22549 - RNA, 9876 nt, Artificial Sequence
  derived and/or modified CDS sequence (opt6) from DENV-2__EU482573__SS-prME
acugcaggagugauaauaauguuaauuccaacagcuauggcauuucaccuaaccacuagaaauggagaaccucacaugauaguaggaagacaagaaaaagguaaauccuuauuauucaaaacggaagacggaguaaauauguguacccuaauggcaauagacuuaggagaauugugcgaagauacaauaacguauaaauguccccuauuacgacaaaaugaacccgaagauauugauuguugguguaacucaacauccacguggguuaccuaugguacaugcacaacaacaggugaacacagacgugagaaaagaaguguagcauuaguaccucacgucgggauggguuuagaaacucgaacagaaacauggaugucaucggaaggagcguggaaacauguacagcguauagaaacauggauacuacgacaucccggguuuacaauaauggcagcaauauuggcauauaccauagggacgacacacuuucaaagggcgcuaauuuucauacuuuuaacggcaguagcaccaagcaugacuaugagauguauagguauuaguaacagagauuucguagaaggaguuaguggaggcucauggguggauaucguucuggaacacgggagcugcguuacgacgauggcuaaaaauaaaccgacuuuagacuucgaacuuauaaaaacggaagcaaaacaaccugcuacccuccguaaauacuguauagaggcaaaauuaacaaacacaacaacugaaucacggugcccuacccaaggagaaccgaguuuaaaugaagaacaagauaaaagguuccuuuguaaacauagcaugguagauagagguugggggaacggcugugguuuauuuggcaaaggagguaucguaaccugcgcuauguucacauguaagaaaaacauggaaggaaaaguaguauuaccggaaaacuuagaauacacuauagucauaaccccacauucgggugaagaacaugcggucgggaaugacaccgggaaacauggaaaagaaauaaaaauuacaccucaaagcucaauaacugaagcagaacuuacaggcuauggaacugucacgauggaguguaguccaagaacuggacuagauuuuaaugagaugguacuacuucaaauggaggauaaagcauggcuaguccaucgucagugguuucuagacuuaccgcucccuuggcugccgggugcagauacucagggcucgaauuggauccaaaaagaaacgcucguaacauuuaaaaauccacaugcaaagaaacaagauguaguaguauuagguagucaggaaggggcuaugcacacagcucugacaggagcuacagaaauacaaaugaguucgggaaaucuacucuuuacuggucaccuaaaaugucgcuuaagaauggacaaacuacagcugaaaggaaugaguuauaguaugugcacugguaaauucaaaauaguuaaagagaucgcagaaacucagcacggcacuauaguuauucgaguacaguacgagggggauggauccccauguaaaauaccauuugaaauuauggacuuagaaaaacggcauguuuuaggacggcuuaucaccguuaaucccauaguaacagagaaagacucccccgugaacauagaagcugaaccgccauuuggggauagcuacauaauuaucggagucgaaccugggcaauuaaaacuaaauugguuuaagaaagggagcuccauagggcaaauguucgaaaccacuaugagaggcgcaaaaagaauggcaauuuuaggagacacugccugggacuuugggaguuuaggaggcguuuucacuucaauaggaaaggcuuugcaccaagucuucggggccauuuacggagcagcuuuuucuggcguaucguggacuaugaaaauuuuaauuggcguaauaauaacuuggauagguaugaacucacguaguacuucacuuagugugucauuaguuuuaguagguguaguuacguuauacuugggagcaaugguucaagcagauucuggaugcguugugagcuggaaaaacaaagaacuaaaaugcggauccgguauauucauaacggauaacguacauacauggacggaacaauacaaauuccaacccgaaagcccaaguaaauuagcuucagccauucaaaaagcacaugaagaaggaauaugugguaucagaaguguaacgcguuuagagaauuuaauguggaaacaaaucacuccagagcuuaaccacauacucucagaaaaugaggucaaauuaacuauaaugacaggugauauaaaaggaauaaugcaagcagguaaaagaucccugagaccucaaccaaccgaacugaaauacaguuggaagacguggggaaaagcaaaaaugcuaucuacggaaagccauaaucaaaccuucuuaauagacggcccugaaaccgcagaaugcccaaauacgaaucgcgcauggaacucguuagaaguggaagacuaugguuuuggaguauucacaacaaauauuuggcugaaauuacgagaaaaacaggaugucuuuugugacucaaaauuaaugagugcggcuaucaaagacaauagagccguucaugcggacaugggauauuggauugaaucagcucuuaaugacacguggaaaauggagaaggcuucauuuauagaaguaaaaagcugucauuggccaaaaucucauacauuauggaguaacggcguccuggaaucggagaugauaauacccaaaaauuucgcagguccuguaucacaacauaauuaucgacccggauaucacacucagacggcaggcccuuggcaucuggguaaauuagagauggauuuugauuucugugaagggacaacuguggucguaacagaagauugcggaaacagaggccccagccuacgcacaacaaccgccucugguaaauugauaacagaauggugcugucguucuugcacucuuccuccguugcgauaucgaggagaagaugguuguugguacgggauggaaauccggccguuaaaagaaaaagaagaaaauuuaguaaauucuuuaguaacggcagggcaugggcaaauugauaacuuuucgcuugguguucuugggauggcccuguuuuuggaagagaugcuuagaacuagaguagggaccaaacacgcaauacuuuugguugcuguguccuucguaacuuuaauuaccggaaacaugucuuuucgagaccuugguagagucaugguuaugguaggagcaaccaugaccgacgauaucggaaugggagucacauaucuggcguuacuagcagcauuuaaaguuagaccuacuuuugcagcagguuugcucuuaagaaaauugacuucaaaagaacugaugauggccacuaucggcauagccuuauugagucaaucaaccauacccgaaacgauauuagaauuaaccgacgcacuggcuuuaggcaugaugguuuuaaaaauugucaggaauauggaaaaauaucaacuagcaguuacuauaauggcuaucucuuguguuccaaaugcuguaauccuacagaaugcguggaaaguuaguuguacuauacuagcugcagucucagucucaccuuuguugcuuacuucgucccagcaaaaagccgacuggauaccucuagcgcuaacgauaaaaggacugaaucccacugcgaucuuucuaacaacgcugaguagaacaaguaaaaagagaagcuggccauuaaacgaagcgauaauggcaguagggaugguaucuauauuagccucaucuuuacuuaaaaaugacauuccaaugacuggaccccucguagcgggaggucuacuaacuguauguuauguuuuaacaggaagaucugcagaucuagaauuagagcgcgcagcugacguaaaaugggaagaccaagcagagauuuccgggaguuccccgauucucuccauaacgauaucugaggaugggucaaugucgaucaaaaaugaagaagaggaacaaacauuaacaauacuuauacgaacgggauuauuggucauaaguggcguauucccagugucuaucccuauaacggcagccgccugguaucucugggaaguuaaaaagcaacgagccgguguucugugggauguuccgaguccacccccaguagguaaggcagaacuagaggauggugcauauagaaucaaacaaaggggaauacuuggauacucacagauaggagcgggaguguacaaagaggggacauuccacacaauguggcacguaacacgaggugcggucuugaugcauagaggaaagaggauugagccauccugggcagacgugaagaaagaccucaucaguuauggaggaggguggaaguuagaaggagaguggaaagaaggagaagaaguacaaguucuagcucuagaaccuggaaagaauccgcgagcugugcagacgaagccaggcuuauuuaagacaaauacgggaaccauaggggcagucucacuugacuuuagcccuggaacgucagguucaccaauuguugauaggaaagguaaaguuguuggguuguaugggaauggcguaguuacacggaguggagcuuauguuagugcgauagcacaaaccgaaaagucgauugaagauaauccugaaaucgaagacgauaucuuuagaaagaaacgauuaacuaucauggacuuacauccaggagcuggaaaaacaaaaagauaucuaccagcaauagugagggaagcuauaaagaggggguugaggacacuaauacuagcccccacaagagucguugcugcagagauggaagaggcuuuaagaggacuuccuaucagauaucaaacaccagccaucagagccgagcacacgggaagagagauugucgauuugaugugccaugcuaccuuuacgaugagacuguugucuccuguuagaguuccgaacuacaaucucauaaucauggacgaggcacauuucacagauccugccucgauagcggcaagaggauauauauccaccagaguagaaaugggggaggcagcagguauauuuaugacugcuacuccuccggggucgcgggauccguuuccgcaguccaaugcgccuaucauggaugaagaacgcgaaauucccgaacgaagcuggaacucuggucaugaaugggucacagacuuuaaagguaaaacuguaugguuugucccuucgauaaaggcaggcaaugauauugccgcuugcuuaaggaaaaacggcaagaaagugauucagcucucaagaaagacauuugauucugaguacguuaagaccagggcuaaugauugggacuucguagucacaaccgauaucucagaaaugggagcuaauuuuaaggcagaacgcguaauagacccgagaagaugcaugaagccaguaauauuaacugauggcgaagaacguguaauuuuggcuggaccuaugccggugacucauaguagugccgcacagagacguggcagaaucggacgaaaucccaaaaaugagaaugaccaauauaucuauaugggagaaccacuagaaaacgaugaagauugcgcucacuggaaagaggcuaaaauguuacuugauaacaucaacacacccgaagguaucauaccaucgauguuugagccggaaagagagaaaguagacgccauagacggggaauauagacuaagaggagaagcacggaaaacauuuguggaccucaugcgccgaggagaccucccagugugguuagcauacagaguagcggcugaaggcauuaauuaugcggauagacgauggugcuuugauggcaucaaaaacaaucaaauacucgaggaaaauguagaaguagaaaucuggacuaaggagggugaaaggaagaaauugaaaccuagaugguuggaugcuaggaucuauagugauccauuagcacucaaagaguucaaagaauuugccgcagguagaaaaucccuaaccuuaaauuuaauaacagaaaugggucgcuuaccaacauucaugacacaaaaagcaagagaugcucuugauaacuuagccguacuacacacagcagaagcuggcgggcgugcguauaaucaugcuuuaucagaacuuccugagacacuagaaacgcuauugcuucuaacacuucuagcuacaguaacagguggcaucuuucuuuuccucaugucagggaaaggaauuggaaagaugacacuugguauguguuguauuauuacugcaucuauucugcucugguaugcacaaauccagccccauuggaucgcagcauccauaauucucgaguucuuuuugauaguacuucucauaccugaaccagaaaagcagagaacaccccaggacaaccaacuaacguacguuguaauagcuauauuaacggucguagcagcaacgauggccaacgaaaugggguuucuugaaaagacuaagaaagaccuaggacucggaagcauaacgacccaagaaucugaauccaauauacuagacauagauuuacgcccagccucugccuggacacuuuacgcuguagcaaccacuuucguaacgccuauguuacgccacucaauagaaaacagcagcguuaaugugucgcucaccgcgauagcuaaccaggcaacuguacucaugggacuagggaagggauggccccuaucaaaaauggauauugguguuccgcuuuuagcaauaggguguuacagccaaguuaacccaauaacacuaacugcagcuuugcuacuccuagucgcgcauuaugcuauuauagggcccggauuacaagcaaaagcuacaagggaagcacaaaagcgcgcggcggcgggaauaaugaagaauccgaccguugauggaauuacuguaauugaccuugagccaaucccguaugauccaaaauuugaaaaacaacuuggacaggucaugcuucuaauucuaugcguaacgcagguacuuaugaugcgaacuaccugggcacuuugcgaagcauugaccuuagcaacagguccaauaucgacacuuugggagggaaauccggguagguucuggaacacaacgauugcggucucuauggcuaauauuuuuagggggaguuacuuagcgggugccgguuuacucuuuaguaucaugaaaaauacaacaaauacacgcagggguacuggaaacauaggagagacguuaggggaaaaguggaaaucaagauugaaugcauuggggaaaucggaguuccaaauauacaagaaaagcggcauacaagaaguugauagaacauuggccaaagaagguauuaaaagaggagagacagaucaucaugcagucaguagaggaucagcuaaauugcguugguucgucgaaaggaacaugguaaccccagaggggaaaguaguagauuuaggaugcgguagaggggguuggucauacuauuguggagggcucaaaaauguucgagaagugaagggacuuacgaaaggcggaccuggccaugaagaacccauacccaugaguacuuacggauggaaucuagucagacuucaaaguggcguggaugucuucuucacaccaccugaaaaaugugauacauuacuaugugauauuggcgaaucguccccuaacccuacgauagaagcugggcgaacucuucgugugcugaacuugguugaaaacuggcugaauaauaauacucaauuuuguaucaaggucuuaaauccguauaugccuucaguaauagagaaaauggaaacccuucaacgaaaauacggaggagcucuaguaaggaacccgcugucacggaacucaacccacgaaauguacugggugucgaacgcgacugguaacauaguaucguccgucaauaugaucucgcggaugcuuaucaauagauuuaccaugaaacacaagaaagcgacauaugaaccagauguugauuuaggaagcgguacaagaaacauagguaucgagagcgaaauaccaaauuuagacauuauugggaaaagaaucgagaaaauaaaacaagagcacgaaacaagcuggcauuaugaccaagaucaucccuauaaaacaugggccuaucaugguaguuaugaaacaaagcaaacagguucugcuucuucaaugguuaaugggguaguccgucuguuaacuaaaccgugggacgugguacccaugguaacgcaaauggccaugaccgauaccacaccguuuggccaacagcguguauuuaaagaaaaggucgauacaagaacacaggagccgaaagagggaaccaagaaauuaaugaaaauaacagcugaaugguuauggaaagagcugggcaagaagaaaacacccagaauguguacacgcgaggaauuuacacgcaaagugcgcucaaacgcugcuuuaggggcaauuuuuaccgaugagaacaaguggaaaucugcaagagaagcaguagaagacaguagauuuugggaauuaauagaucgagaaagaaaucuccauuuagaagguaaaugugaaacauguguauauaauaugaugggaaagcgugaaaagaaguuaggugaguuuggaaaggcuaaagggaguagagcaauaugguacauguggcucggugcacgauucuuagaguucgaagcucuagguuuucucaaugaagaucauugguucucucgaggaaacagcuuaagcgggguggagggggaaggguuacauaggcuaggauauaucuugagagaugugagcaagaaagaaggaggugcuauguacgcagaugacaccgcaggaugggacacacggauuacacuugaagauuugaaaaacgaagaaaugguaacuaaucacaugaaaggcgaacauaagaaacuugccgaagcuauauuuaaauuaacauaccaaaauaagguuguaagagugcaacgacccacuccacgugggacuguaauggauauuauaucucgacgagaucagagaggcagcggucaaguuggcacauacggacuuaauacguuuacuaacauggaggcacagcugauaagacaaauggaaggagaaggaauuuucaagagcauacaacaccucacaguaacagaagaaauugcagugcaaaacuggcuggcgagaguggggagagagaggcucucccgaauggcaauaaguggagaugacuguguaguaaaaccacucgaugaccguuucgcaagugcucuaacagcccuaaaugacaugggaaaaguuaggaaagauauacagcagugggaaccaaguaggggauggaaugacuggacacaagugcccuuuuguagucaucacuuucaugaacuuguuaugaaggacggaagaguauuaguugucccaugccgaaaucaagaugaacuaauagggagagcgagaauuagccaaggcgcuggcuggaguuuaaaggaaacugcgugccuaggaaagaguuacgcucaaauguggacccuuauguacuuccaucguagagacuuaagauuagccgcuaacgcaauauguagcgcaguaccgucacauuggguuccaacaucgagaaccaccuggagcauccaugcaaaacacgaguggaugacaacagaagauaugcucgcaguuuggaacaggguuuggauucaggaaaauccauggauggaagauaaaacgccugucgaaucuugggaggaaguacccuauuuaggcaaaagagaagaucagugguguggaagccuuauaggauugacaagcagagcaacuugggccaaaaacauacaaacagcuauaaaucaaguacguucauugauugguaacgaagaauauacggauuacaugccuagcaugaagagauuucgucgagaagaggaggaagcagggguacucugguaa

SEQ ID NO: 22550 - RNA, 9876 nt, Artificial Sequence
  derived and/or modified CDS sequence (opt6) from DENV-2__EU482574__SS-prME
acagcaggaguuauaauaaugcuaauaccuacagcgauggcguuucauuuaacaacacggaauggagaaccucauaugauaguaggacgccaagaaaaagggaaaagucuacuguucaaaacagaagacgggguuaacauguguacauuaauggcuauagaucuaggagaacuaugugaagauacaauuaccuacaaauguccucuucuaagacaaaacgaaccagaagacauagacugcugguguaauagcacgucaaccuggguaacuuaugguacguguacuacaaccggagaacauagaagggaaaaacguucaguagcucuuguaccgcacguugguaugggauuggaaacacgaacugaaacauggaugucaucagaaggagcuuggaaacauguacaaagaauagagacauggauacuacgucauccuggauucacaauaauggcugcaauacuagcuuacacaauaggcaccacccacuuccaaagggcucuuauuuucauacuauuaaccgcaguagcgccauccaugaccaugagauguauugguauuuccaauagagauuuuguggaaggagucagcggggguucguggguugauauuguacuugaacacggaucuugcguaaccacaauggccaaaaauaaaccaacguuagacuucgaacuaauaaaaaccgaagccaaacaaccagcuacacuacguaaauacuguaucgaagcgaaauugacaaacacuacaacggagucgagguguccuacccaaggcgagccuucccuaaacgaagaacaagauaaaagguuuuuauguaaacacagcauggucgaccguggcuggggaaacggaugcggucuauucggcaaaggaggaauugugacaugcgcaauguucacaugcaagaaaaauauggaagggaaagugguucucccggagaaucuugaguauacaauugucauaaccccacauucaggggaagaacaugcuguuggcaaugauacaggcaaacacggaaaggaaauaaaaauaacgccucagucaucaauuacugaagcagaauugaccggauauggcaccgucacaauggaauguagcccuagaacaggcuuggauuuuaaugaaauggugcuacuucauauggaggauaaggcaugguuaguacaccgacaaugguuucuggacuugccgcuuccuuggcuaccaggagcagauacccaagguaguaacuggauccaaaaagaaacauuaguaacauuuaagaacccucaugccaagaaacaggacgucgugguucuagguucucaagaaggagcgaugcauacagccuuaaccggugcaaccgaaauucaaaugaguucagguaaucuguuguuuacaggccacuuaaagugucgguuaagaauggauaaacuucaauuaaaaggcaugucuuacuccaugugcacaggcaaauucaaaauuguuaaagaaauugccgaaacucagcaugguacaauugucauuagaguacaguaugaaggagaugggaguccuugcaaaaucccauuugaaauaauggaucuugagaaaagacacguacuagguagacucauuacgguaaauccaaucguuacugaaaaagacaguccaguaaauauagaagcggaaccgcccuucggcgauagcuacauuaucauagggguagaaccuggacagcucaaacucaauugguuuaagaaaggaucuucgaucggccaaauguuugaaacuacaaugcgaggagcuaagcguauggcuauuuuaggugauacggcuugggacuuugggaguuugggaggagucuucacuucgauaggaaaagcauuacaccaaguauucggcgcgauauauggagccgcauucagcggugucagcuggacaaugaaaauacucauaggagucauaaucaccuggaucggaaugaacucacguucaacuucauuaaguguuucguugguauuaguaggagugguaacacuauaccucggugcuaugguucaagcggauuccgggugcgucgucagcuggaaaaacaaagagcuaaaaugcgguucggggauuuuuauaacagacaauguucacacuuggacggagcaauacaaguuucaaccggaaucgccuagcaaacuagcaagugccauacaaaaagcccacgaggaaggaauuugcggaauacggaguguaacacgacuagaaaauuuaauguggaaacagauuacaccagaguuaaaucauauacuaucagaaaacgaaguaaaauuaacuauuaugacaggcgauauaaaaggaauaaugcaggcaggaaaacguucucuacgaccgcaaccgaccgaacuuaaauauucguggaagacuugggggaaagccaaaauguuaucaacggaaagucacaaccagacauuuuugauagaugguccugaaacagcugaaugcccaaauaccaauagagcauggaacucacuggaaguagaagacuacggauucggggucuucacaacaaauaucugguuaaaacuuagagaaaagcaagacguauuuugcgauucgaaauuaaugucagcagcgauuaaagauaacagagcaguacaugcugauauggguuacuggauugaaagugcucuuaaugauacauggaaaauggaaaaagcaaguuucauagaaguuaagaguugccauuggccaaaaucacacacauuguggaguaacggcguuuuagaauccgaaaugauuauccccaagaacuucgcgggcccuguaucccaacacaauuaucggccuggauaucacacccaaacagcuggucccuggcaccuaggcaaacucgaaauggauuuugauuucugugaaggaacaaccguagucguuacagaagauugugguaauagagguccaucacuaagaacaaccacagccagugggaaacuuauaacagaaugguguugucgguccuguacccuaccaccccuucguuaccgaggagaagacggauguugguauggaauggagauacgucccuuaaaagaaaaagaagagaauuuagucaacucguuaguaacagccggacacggacagaucgauaacuucucgcucggaguauuagguauggcuuuauuccuggaagagaugcucagaacaagaguaggaacaaaacaugcaauucuccuaguagccguauccuuuguaacccuaaucacaggaaauaugucuuuuagggacuuaggaaggguaaugguaaugguuggggcaacuaugacugaugacauaggaaugggcguuacuuaucuugcacuucuugcggccuuuaaaguuagaccuacguucgcagcaggacuguuacugagaaaauuaaccucuaaggaauuaaugauggcaaccaucggcauugcacucuuaucacagaguacuauuccagaaacaauccuugaacuaacagaugccuuggcuuuaggaaugaugguauugaaaauagucaggaacauggaaaaauaucaacuugcuguuacuauaauggcaaucaguuguguaccgaaugccguaauucuacaaaacgcauggaaaguauccuguacaauauuagcagcaguaucaguaagccccuuauuacuaacuucaagccaacagaaagcagauuggauuccuuuggcacuaacaauaaagggauuaaauccaaccgccauuuucuugaccacuuugucccguacuucuaaaaagaggucguggccucuaaacgaagcgauaauggcaguaggaaugguaucaauccuugcuucaucacuucucaaaaaugacauuccaaugacuggaccguuaguagcgggaggauuacuaacagucuguuacgugcuuaccggacgaucugcagaucuagaguuagagcgcgcggcagaugugaaaugggaagaucaggcugaaauuaguggaucaucuccaaucuuaaguauaacuauaucugaagauggaucaaugaguaucaaaaaugaagaggaagaacagacgcucaccauacuaaucaggaccggauuguuaguuauaaguggggucuucccaguaucgauaccaaucacugccgccgcgugguaccucugggaagucaagaaacaacgagcugguguuuugugggauguaccgaguccgccuccgguuggaaaagccgaauuagaagauggagccuauagaaucaagcaaagagguauacuagguuauagucagauaggagccggugucuauaaggaaggcacuuuucauaccauguggcacguuaccaggggcgccguacuaaugcacaggggaaaaagaaucgagcccucaugggcugacgucaagaaagacuuaauaagcuauggaggaggguggaaauuggagggagaauggaaagaaggagaggaaguucaaguauuagcucuugaaccuggcaaaaauccgcgggccguacagacuaagccgggucuauucaagaccaauacagguacaaucggggcggucucacuggauuuuuccccaggcacaagugguuccccgauuguugauaggaaggggaagguaguuggauuauaugguaacggugugguaacuagaucuggagcauacguuucugcaauagcucaaaccgaaaaguccauagaagauaacccagagauagaagacgauauauuucguaagaaaagauugacgauaauggaucuccaucccggggcagguaaaacaaaaagauaccuaccagcgauagucagagaggcaauaaaaagaggucuuaggacccuuauauuagcaccuacaaggguuguagcugcagagauggaggaagcucuuaggggauugccaauaagauaccaaaccccagcaauacgggcggagcauacuggcagggaaauaguugauuuaaugugucacgcgacguucacgaugagauuacucagucccguacgagugccuaacuacaacuuaauaauaauggacgaagcacacuuuacagaucccgcuagcauagcugcaagaggcuauaucagcacccgcguugaaaugggcgaagcagcuggaaucuuuaugacagcaacaccuccaggaagucgugacccauucccccaaaguaaugccccaaucauggaugaagaaagagagauaccagaaagaucuuggaacucaggacaugaguggguuacggauuuuaagggaaaaacggucugguucguaccaucaauaaaagcagguaaugauaucgcagccuguuuaaggaaaaauggaaagaaagugauacagcuaagucgaaaaacauuugauagugaauaugugaaaacuagagcuaacgacugggacuuuguaguaacaacagauauaucugagaugggugcgaacuuuaaagcggaaagaguaaucgauccuaggcguugcaugaaaccaguuaucuuaacagauggcgaagaaagaguuauuuuagcgggacccaugccaguuacucauucauccgccgcccagcgaaggggcagaauuggaagaaaucccaaaaaugagaacgaccaauauauauacaugggggagccacuagaaaaugacgaagacugugcucacuggaaagaagcgaagauguuauuggacaauauuaauacaccagaagguauaauuccaaguauguuugagcccgaaagagaaaaaguugacgccauagauggagaauaccgacuaagaggagaagcgaggaaaacauucgucgaucuuaugcgaagaggcgaucuaccaguauggcucgcuuauagaguagcugcugaaggaauuaauuaugcggaucguagauggugcuuugacgguaucaaaaauaaucaaaucuuggaagagaacguggagguagaaauuuggacaaaggaaggagaaaggaagaaacuaaaaccgagauggcuugaugcgagaauauacagcgacccauuagcauuaaaagaauuuaaagaguuugcagcuggacguaagucucuaacucuaaaucugauuacagaaauggggagauugccgacuuucaugacacaaaaagcaagagacgcuuuagauaaucuagcaguacuccauacagccgaggccggcgguagagcauauaaucacgcccuauccgagcuaccagaaacacuagagacucuucuccuacugacuuuacuagcuacagugacuggaggaauuuuucuuuuucucaugaguggaaaaggaauagguaaaaugacguuagggaugugcuguauaaucaccgccucuauauuacuaugguacgcacagauucagccccauuggauagcggcauccauaauucuugaguuuuucuuaauaguauuauuaauaccagaacccgagaaacagagaacaccacaagauaaccaauugaccuaugucguuauagcgauacuaaccgucguagcugcaacgauggccaacgagaugggauuucuggagaagaccaagaaagaccuaggacucggguccauaacuacccaagaguccgaaagcaauauauuagauaucgauuuacggcccgcuucugccuggacucuauacgcaguagcaacaacuuuuguuacgccaauguuaagacacucuauagaaaacagcaguguuaauguaucucuaaccgcuauagcgaaccaggcaacgguacuaaugggacugggaaaaggauggccauuaagcaaaauggauaucgguguaccacuucuagcaauaggauguuauucucagguaaauccuauuacccugacugcagcccuauuguuacuuguugcacacuaugcgauaauagggccggguuuacaggcaaaagcaacgagggaagcucaaaagcgagccgccgcgggaaucaugaaaaaccccacaguagaugguauuacaguuaucgauuuagagccaauaccuuacgauccaaaauuugagaaacaauuaggacaggucauguuacuaauauuaugcguaacacaaguucuaaugaugcgaacuaccugggcguuaugugaagcauuaacacuugcuaccgggccaauaaguacguugugggagggcaacccaggucgguucuggaauaccacuauagcaguuaguauggccaauauauuucgggguuccuaccuggccggagcagggcuacuauucaguauaaugaagaauacaacaaauacgaggaggggcacagggaauaucggcgaaaccuuaggagaaaaguggaaaagcaggcuuaaugcgcucggcaaaucugaguuccaaauuuauaagaaaucgggcauucaagagguagaucgaacauuagcgaaagaaggaauaaaacgaggcgaaacugaucaccacgcaguaagucgugguagugcgaaguuaagaugguuuguggaaagaaacaugguuaccccugaagguaaaguagucgauuuaggauguggaaggggcgggugguccuacuacugcgguggauuaaagaacgugcgagagguaaaggguuugacuaaagggggaccaggucacgaagaaccgauuccaaugagcaccuacggcuggaaccuuguucgacugcagagugguguugacguauuuuucacgccaccugaaaaaugcgacacauuauuaugugacauuggugaaaguucaccgaaucccacuauugaggcuggaagaacccuuagggucuuaaaucuaguggaaaauuggcuaaauaauaacacgcaauucuguauaaaaguuuuaaaucccuacaugccaucaguuaucgagaagauggagacgcuacaaagaaaguauggcggcgcccuaguuagaaauccauugagccgaaacaguacacaugaaauguauugggucaguaacgcaacaggaaauauagugaguaguguaaauaugauaucuagaaugcucauuaaucgguuuacuaugaaacacaaaaaggcuacauaugaaccagaugucgaucucggaucagggacuagaaacauagggauagaaucagaaauucccaaccuggauaucauaggaaaacggauagagaaaaucaaacaagaacacgagacgaguuggcauuaugaucaggaucauccauauaaaacaugggcauaccaugggaguuaugagacuaaacaaaccggaagugccagcucaaugguuaaugggguagucagacuacucacaaaaccaugggacgugguaccuaugguaacccagauggcgaugacugauacaacuccauuuggacaacaaagaguuuucaaggagaaagucgauacacgaacccaggagccuaaagagggaacuaagaaacuaaugaaaauaacagccgaguggcuauggaaagaacucgguaagaagaaaacgccaaggauguguacacgugaagaguucaccaggaaagugagaucaaaugccgcacuuggagcgauauucacagacgaaaauaaguggaagagugcaagggaagcgguugaagauucgagauuuugggaacucauugaucgcgaaagaaaccugcaucuugaggggaaaugugaaacuugugucuacaacaugaugggaaaaagagaaaagaaacuaggugaguucgguaaagcuaaaggaucucgagcuauaugguauaugugguuaggagcgcgauuucuugaguucgaagcucucgguuuccucaaugaggaucacugguuuucccgaggcaauagccucaguggagucgaaggagaaggcuuacauagauuagguuacauacucagagacgugaguaagaaagaaggaggcgcaauguaugcggacgauacggcagguugggacacacgaauaacucuugaagauuuaaagaaugaagaaaugguaacgaaccacaugaagggagaacauaagaaguuggcggaagcaauuuuuaaacuaacuuaucaaaauaagguagugcgcguacaaagacccacuccuagaggaacaguaauggauauaauaagcaggcgcgaccaacgagguucugggcaagugggcacuuauggccuuaauacauuuacaaauauggaggcccagcuaauuagacaaauggagggagaggguaucuuuaaaaguauacaacaccucacuguaacggaagaaauagcaguacaaaauuggcucgcaagaguuggcagggaaagauuaucaaggauggcuauaagcggugaugauuguguggugaaaccacuugacgaucguuucgcgucggcucuaacugcauuaaaugauaugggaaagguaagaaaggacauacaacaaugggaaccaagcagagguuggaaugauuggacacaggugcccuucuguucucaccacuuccaugaacucguaaugaaagaugggcgagucuuggucgucccuugccgaaaccaggacgaacuaauagggagagcaagaauuucacaaggugcaggauggucgcuuaaagaaacugcaugcuugggaaaaaguuaugcccaaauguggacucuaauguacuuucaccgaagggaucuuagacuagcagcuaaugcgaucugcagugcaguucccucccacugggucccuaccaguaggacuacuuggaguauacaugccaaacaugaauggaugaccacagaagauaugcuggccgucuggaauagaguauggauacaggaaaaccccuggauggaagauaaaacgccaguugaaagcugggaggaaguaccauaccuugguaaacgagaagaccaaugguguggaucauuaaucggccucaccaguagagcuacaugggcuaaaaauauccaaacugcaauuaaucaaguaagauccuuaauaggcaaugaagaauacacagacuacaugcccagcaugaaacgguucaggcgagaagaagaagaagccgguguucucugguag

SEQ ID NO: 22551 - RNA, 9876 nt, Artificial Sequence
  derived and/or modified CDS sequence (opt6) from DENV-2__EU482575__SS-prME
acugcgggcgugauuauaaugcuaauccccacagcaauggcuuuucauuuaacuacacgaaauggugaaccccauaugauugucggacgacaggaaaaaggaaaaucgcuucuauuuaaaacagaagacggcguuaauauguguacguugauggccauugaucuaggagaauuaugugaagauacuauaacuuacaaaugccccuugcuuaggcaaaacgaaccggaagacauugauugcuggugcaauaguaccaguacuugggugacauaugguacauguacgacuacaggcgaaaggcgaagggagaaaagaaguguugcauuaguuccacauguaggcaugggacuugaaacgaggacagaaacuuggaugucuagugaaggggccuggaaacacguacaaagaauagaaacuuggauucuacggcauccaggauuuacaauuauggcagcgauauuggcuuauaccauuggaacaacgcauuuucaaagagcguuaauauuuauauuauuaacagccguagccccaaguaugacgaugagaugcauaggaauuaguaaucgugacuuuguagaaggaguauccgguggaaguuggguagauauuguuuuagaacauggaucuuguguaacgacuauggcgaaaaacaaaccaacauuagacuucgaacuaauaaaaacugaagcaaaacaacccgcuacauuacguaaauauugcauugaagcuaaacugacuaacacaacaacugaaucuagaugucccacacaaggugaacccucuuuaaacgaagaacaagacaaaagauuucugugcaaacauucuaugguugauagaggcuggggaaaugggugcgggcuuuuuggcaaagguggaaucguaacaugcgcaauguucacguguaagaaaaauauggaaggaaaagugguguuacccgaaaacuuagaguauacuauaguuauaacuccucauucaggggaagaacacgcagucgggaaugauacagggaaacauggcaaagagauaaaaauuacaccacaaaguucuauuacugaggcagaauugacuggcuacggaacgguuacaauggaguguaguccucgaacgggccuagacuucaacgagaugguacugcuucaaauggaagacaaagcguggcuaguacaucgucaaugguuucuugacuugccacuaccauggcuaccaggcgcagacacgcaagguucaaacuggauacaaaaagagaccuuaguaacuuucaaaaacccacaugccaagaaacaagacguaguuguguuaggaagucaggaaggcgcgaugcacacagcucugacuggagcaacugaaauucaaaugucgucagguaauuuacuauuuaccggccaccucaaaugcaggcuucgaauggacaaacuucagcuaaaagguaugucuuacucgaugugcacagggaaauuuaaaauuguaaaagaaauagcugagacacagcauggaacaauuguaauucggguccaauaugaaggugaugguucaccauguaaaauaccauucgaaauaauggaucucgagaaaagacauguacucgggcgacuaauuacaguaaauccuauaguuacugaaaaagacucccccguaaauauugaggcagaaccacccuuuggggauaguuauauaauaauugguguugagccugggcagcuuaaacucaauugguuuaagaaagggaguagcauuggacagauguuugagaccacaaugaggggagcgaaaagaauggcgauauugggggauacugcaugggauuucggaucucuagggggaguuuuuaccucgauuggaaaggcuuuacaccaaguuuucggagcaauauauggugcagcauuuaguggcguaaguuggaccaugaaaauccucaucggagucauaauaacauggauagggaugaacagucgaucaaccagccugucuguaagccugguauuggugggaguuguuacacuauaccuaggugcuaugguacaagcggacagugguuguguugucaguuggaaaaauaaagaauugaaauguggaucuggaauuuucauuacugacaauguucacacuuggacugaacaauauaaauuucagccugaaucgcccucaaaacuagcuagugcaauccaaaaagcacacgaagaaggaauaugcgguauuagaucggugacacgauuagaaaauuugauguggaagcaaauuaccccugaacuuaaucauauauugagcgaaaaugaggucaaacuaacuaucaugaccggagauauuaaaggaauaaugcaggcggggaaaagaucacugagaccacagccaacggagcuaaaauauaguuggaaaacgugggguaaagcuaaaauguugaguacugaaucucauaaucaaacuuuucucauugaugguccagaaacagcggaauguccaaauacgaacagggcauggaacucacuugaaguagaagauuaugguuuugggguauuuucgaccaauaucuggcuuaaauuaagagaaaaacaagauguauuuugugauucgaagcucaugucagcggcaauaaaagauaauagggcaguacaugcugauaugggcuauuggauugaaagcgcgcuaaacgauacuuggaaaauggaaaaggccucauuuauugagguaaagaguugucacuggcccaaaucucauacacucuggucaaauggagucuuagaaucugaaaugauuauaccuaaaaauuucgccggaccagucucgcaacauaauuacagaccuggcuaccauacacaaacggcaggucccuggcauuuaggaaagcuagaaauggauuucgauuucugcgaaggcacaacuguagugguuacugaggacuguggaaaucgaggaccuucuuuaagaacgacgacagcgagcgggaaauugauaacagaaugguguuguagaagcugcacccucccuccacugcgguacaggggagaggacggcugcugguauggaauggaaauaagaccacuuaaggaaaaagaagaaaacuugguaaacagucucgucacagcagggcaugggcagauagauaauuuuucccuaggagucuuaggaauggcccuuuuccuugaggagauguuaaggacaagagucggcacuaagcaugcaauacuguugguugccguuuccuucgucaccuugauuacaggaaacaugagcuuccgggaccucggcaggguuaugguuauggugggagcaacaaugacagaugauauuggaaugggcguuaccuauuuagcauuacuggcugcuuuuaaaguacgcccgacauucgcagcuggacuuuuacuacgaaagcuaacaucaaaggagcuaaugauggcaacaauugguauagcguuacugucgcaaucaacaauuccugagacgauacuagaacucacagacgcucucgcucuagguaugaugguacuuaaaauagucaggaauauggaaaaguaucaacuugcagugacuauaauggcuaucucauguguaccaaaugcgguaauauuacagaaugcauggaaaguuucgugcaccauucuagcugccguaucgguuaguccccuccuauugacaucuucacaacaaaaagcggauuggauacccuuggcacuaaccauuaaaggacuaaacccaacggccauauuccuuaccacuuuaagucggacuucuaagaaaaggucuuggccacuuaaugaagcaauaauggcaguagggaugguaaguauccuagcuuccagucuauugaaaaaugauauuccuaugacugguccccuagucgcuggcggcuuacuuacuguuugcuauguccuaacuggacguagcgcugaccuagaauuggaaagagcugcagauguaaaaugggaagaucaagccgaaauaucaggcuccucaccaauccugagcauuacaaucagugaggacggaaguaugucaauuaaaaacgaagaagaagaacaaacacugacaauauuaauaagaacuggauuauuggugauuucaggaguuuuuccugugucgauacccauuacggcugcagcaugguaucuaugggaaguuaagaaacagcgagcaggaguccuaugggauguuccuucuccgccgccaguuggcaaagccgaacuugaagacggggcguaucgaauaaaacagaggggcaucuuaggcuauagccaaauaggugcgggcgucuauaaggaggggacuuuucacacgauguggcaugugacccgcggcgcaguguuaaugcacagaggaaaaagaauagagccuaguugggcagauguaaagaaagauuuaaucaguuauggggguggguggaaauuagaaggugaauggaaagaaggcgaagaagugcagguucuggcuuuagagccagguaaaaacccuagggcuguucaaacuaagccagguuuguuuaaaacaaauaccggaaccaucggugcaguauccuuggacuucucaccggggacuuccggcucgccuauaguugacagaaaaggaaaaguaguggggcuauauggaaacggaguuguaacgcggucuggagcauauguaucggccaucgcccaaacugaaaagaguauagaagacaauccagaaauagaagaugauauauuuaggaagaaacgacucacgauuauggaucuccauccuggagcuggaaaaacaaaaagguaccucccagcuauagugcgcgaagcaauuaagaggggauuacgcacauuaauccuggcaccgacccguguaguggcugcugaaauggaagaggcacuucgcgggcuacccauccguuaccagacaccagcuauacgcgcagaacauacuggaagggaaaucguagaucucaugugccaugcaacauuuacaaugagacuacuuucaccagugagagucccgaauuacaacuuaauaauaauggacgaagcucauuuuacagacccagcgaguauagcggcacgugguuacauaagcacucgggucgaaaugggugaagcugcaggcauauucaugacggccacacccccugguucuagagaucccuuuccucagaguaaugcuccaauaauggaugaagaacgcgaaauuccagaacguucauggaacucaggacaugaauggguaaccgacuuuaaaggcaagacagugugguuuguaccaucaauuaaagcaggaaaugacauagcugcaugccuccgcaaaaaugguaagaaaguaauacagcugaguagaaaaacuuucgauucugaauacguaaagacgcgugcaaacgauugggacuucguagugaccacagauauuucugagaugggcgcaaacuuuaaagcagaaagagucauagacccuagacgaugcaugaaaccugucauucucacugauggagaggaaagagugauucuagcaggaccgaugccuguuacgcacagcagcgcugcccaacgaagaggaagaauuggacggaaucccaagaacgaaaaugaccaguauauuuauaugggugaaccuuuagaaaaugaugaggauugugcacauuggaaagaggccaaaaugcuauuagacaauauuaauacaccggaagggauaauaccuuccauguuugaaccagaacgugaaaagguagacgcuaucgauggagaguauaggcuucgcggagaagcacgcaaaacguuuguugaucucaugagacguggagauuugccuguuuggcuggcguauagaguugccgcggaagggauaaacuaugcagauagacgaugguguuuugacgguaucaaaaauaaucagauccuugaagaaaacguagagguugaaauuuggacuaaggaaggagagagaaagaaauuaaagccaagauggcuugaugcuagaauuuauagugacccauuagcccuaaaagaguuuaaagaauuugcagcaggucguaagucucuuacccucaaucuuauaacugaaaugggaagacuaccuacuuuuaugacgcagaaagcaagagacgcucucgauaaccuagccgugcuacauacagcggaagcaggcgguagagcauacaaccaugcauuaagcgaacuccccgaaacacuagaaacucuuuuacugcuaacacugcucgcaacuguuacagggggaauuuucuuguuucucaugucgggaaaaggaauuggaaagaugacccuaggcauguguuguauaauaacugcgaguaucuuacuuugguacgcccaaauucaaccgcacuggauagcagcaucuauuauauuagaguucuuucuaauugucuuauuaauuccugaaccugaaaaacaaagaacgccacaagauaaucaauugacuuauguagucaucgcaaucuuaacggucguugcagcuacuauggccaaugaaaugggguuuuuggaaaagaccaagaaagaucuaggacuaggaaguauaacuacgcaagaaagugaaucaaauauuuuagacauagacuuaagaccagccucagcauggacuuuauacgcaguagcaacaacauuuguaacccccauguugagacacuccaucgaaaauagcucuguuaaugucucucuaacagcaauugcgaaccaagcgacuguacuaaugggacuuggaaagggauggccguuaucuaaaauggacauaggugucccacuguuagcaauuggauguuacucucaaguaaauccaauuacauugaccgcagcauuacuauuauugguagcccauuaugcgaucaucggacccggucuucaagcgaaagcuacuagggaagcacagaaacgugcagcagcgggaauaaugaaaaacccuacuguggacgggauaacagucauagacuuagaacccauaccguacgacccgaaguucgaaaagcagcuuggacaagucaugcuucuaauacuaugcguaacccaaguucuaaugaugagaacaacaugggcacuuugugaagcacuaacuuuagcuacagggccgauaucgacacuaugggaagguaacccaggucgauucuggaauacaacaauagcgguaagcauggccaacauauucaggggguccuauuuagcaggcgccgguuugcuauucaguaucaugaaaaacacuacuaauacacguagaggcacugguaauauuggagaaacccuuggagagaaguggaaauccagacucaacgcacuaggaaagucagaguuccaaaucuauaagaaaucgggaauccaagaaguggacagaacauuggcuaaagaggguauaaaaagaggagagacagaccaccaugccguuaguagaggaucagcgaaacuaaggugguucguugaacggaauaugguaacucccgagggaaaagugguugaucuugggugugggagaggcggauggucauacuacugugggggauugaaaaauguuagagaaguuaaaggguuaacaaaaggagguccuggccaugaagaaccuaucccaaugucuacauacggguggaacuuaguacggcugcaaaguggaguggauguauuuuucacgccacccgagaaaugugacacauuauuaugugauauaggagaaucaucaccaaacccuacaauagaagcgggacggacguuaagaguacugaacuuaguggagaacuggcuuaauaauaacacacaguucugcauaaaaguacuaaauccauauaugccauccguaauugaaaagauggagacucuacaacguaaauacggaggugccuuaguacgcaacccucuuucgagaaauucaacccaugagauguauuggguaagcaaugcuacuggaaauauugucucgucaguaaacaugauuucuaggaugcuuauaaaccguuucacuaugaaacacaagaaggcaacauaugaacccgauguagaccuuggaucuggaacuaggaacauaggaauagaaucugaaauucccaauuuggacauaauuggaaaaagaauugagaaaauaaaacaagagcaugaaacauccuggcauuacgaccaagaccauccauacaaaaccugggcguaccacggaaguuaugaaacuaagcaaacagguucagcgaguaguaugguaaaugguguggugcguuuauugaccaaaccaugggaugugguuccaaugguaacucagauggcaaugacggacacaacaccguucgggcagcagcggguguucaaggaaaagguagacacgagaacacaggaacccaaagaagguacgaagaaauuaaugaagauaacugcggaauggcuauggaaagaauuaggcaagaagaaaacgccccggaugugcacgagggaggaguuuacacgaaaaguacgaagcaaugcugcacuuggggcaaucuucacagaugaaaauaaguggaaaagugcgcgcgaagcgguugaggacaguagauucugggagcuaauagauagggaaagaaaucuacacuuagagggcaagugugaaacauguguauauaacaugauggguaaacgagagaagaaacuaggggaauuuggaaaagcaaaaggaagucgggccauaugguacauguggcugggggccagauuucuagaauuugaagcucucggauuccuaaaugaggaucacugguuuucccguggaaauucuuuaucggggguagagggagaaggucugcaccgccugggauacauucugagagauguauccaagaaagaagggggcgcgauguaugcugaugauacagcagguugggacacgagaauuacuuuggaagaucucaaaaaugaagaaauggugacaaaucacaugaaaggggaacacaagaaauuggcugaagcuauauuuaaauuaacauaucaaaacaaggugguaagaguccaaaggccuacaccucgagguacggugauggauauaauaucaaggagagaucagagaggcagcggacaaguuggaaccuacggacuuaauacguuuacgaauauggaggcucaguuaauaagacaaauggaaggugaaggaauauuuaaaaguauacaacauuuaacuguaacagaggaaaucgcuguucaaaauugguuagcgagagugggacgagagaggcuaaguagaauggcuaucucuggggacgauuguguaguuaaaccgcucgacgaucgguuugccuccgcucuaacugcacucaaugauauggguaaaguucgcaaagauauacaacaaugggaaccuaguagaggauggaaugacuggacccaaguuccuuucugcucucaccauuuucaugaacucguuaugaaggacggacgaguuuuagucgugccauguagaaaccaggaugagcuuauaggcagagcgagaauaucacagggggcuggauggucuuuaaaagagacugccugccuggguaaaagcuaugcccaaauguggacacuaauguauuuccauagaagggaucuccgacuagcggcaaacgcaauuuguucugcggucccaucucacuggguaccuacaagucgaacaacuuggagcauacaugcaaagcaugaguggaugacgaccgaagauaugcuugcaguauggaauagaguauggauacaagaaaauccauggauggaagacaagacaccagucgaaucaugggaagaaguaccauaccuagguaaacgagaagaccaguggugugggucccuuaucggacuuacaucaagagcaaccugggcaaagaacauacaaacagccauaaaucaaguaagaucauuaauaggaaaugaagaauauacagacuauaugccgucaaugaaacgauuccgaagggaggaagaagaggcugguguacugugguaa

SEQ ID NO: 22552 - RNA, 9876 nt, Artificial Sequence
  derived and/or modified CDS sequence (opt6) from DENV-2__EU482578__SS-prME
acagcgggcguaauaauuaugcuaauuccuacugcaauggcuuuucaucuaacaacuagaaauggagaaccacacaugauuguuggacgucaagaaaaagguaaaagucuauuauucaaaacagaagaugguguaaauauguguacacuuauggcaauagacuuaggagaacuuugugaagauacaauaacauauaaaugcccauuacugcgacaaaaugaaccggaagauauugacuguugguguaauucaacgaguacgugggucacauaugguacauguacaacaacuggcgaacaccgaagagaaaaacgcucaguggcacuugucccgcacgugggcauggggcuggagacgcguacagaaacauggaugucuucugagggcgcuuggaaacaugugcaaagaauagaaacguggauucugcgucacccugguuucacgauaauggcagcuauacuugcauacacaauuggaacuacacauuuucagagggcuuuaauuuuuauacugcucacugcaguagcaccuaguaugacaaugagauguauaggcauuuccaacagggauuuugucgaagguguuucaggagguucguggguugauauaguucucgaacacgguaguugcgucacaacgauggccaaaaacaaacccacacucgauuucgaauuaaucaaaaccgaagcuaaacaaccugcgacucuuagaaaauauugcauagaggcaaaacuuaccaauacgacuacggaguccaggugcccaacgcaaggggagccgucacucaaugaagaacaagacaaaagauuuguaugcaaacacaguaugguggauagggguugggggaaugguuguggauuguuugggaaaggaggaauaguaacuugugcaauguucacuuguaagaaaaauauggagggaaaagugguguuaccagaaaauuuagaauauacaaucguuauaacaccucacucgggagaagaacaugcaguaggaaacgauacagguaaacacggaaaagaaauaaaaauuacgccucaaucaucaauuacagaagccgaguuaacaggguauggcacaguaacuauggagugcaguccacguacagggcuagacuucaaugaaaugguacuccuccagauggaagauaaggcuuggcuaguacacaggcaaugguuuuuagaucugccucuucccuggcuaccuggagcugacacucaaggcaguaauuggauacagaaagaaacguuaguaaccuucaaaaauccacacgcaaagaaacaagacguagucgucuugggaagucaagaaggagcgaugcauacagcgcugacaggggccacugaaauccaaaugucaucggggaauuuacuuuuuacaggacaucuaaaaugucgguuacgaauggacaaauuacaguuaaaagggauguccuauuccauguguacuggaaaauuuaaaaucguaaaagaaauugcggaaacccagcacgggacgaucgucauuagagugcaguacgaaggcgacggaucaccauguaaaauacccuuugagaucauggauuuagagaaaagacauguacuugggagguugauaacaguuaacccaauuguuacagagaaagauagcccaguaaacauugaagcggaaccaccauuuggcgacuccuacauaauaaucggaguggagcccggucaacugaaauuaaacugguuuaagaaaggaaguaguauaggucaaauguucgaaacaacaaugagaggcgcuaaacgaauggcuauauuaggagauacggcgugggacuuugguaguuuagggggaguauuuacgucaaucggaaaagcacugcaucagguauuuggagcaaucuacggugccgcuuuuucaggaguaucuuggacaaugaaaauccugaucggaguaauaaucacuuggaucgggaugaacaguagaaguacgagcuuaagcguaucacuuguauuaguaggaguaguuacauuguauuugggugcuaugguacaagcagauucaggcuguguugucaguuggaaaucuaaagagcucaaaugcgggaguggcaucuucaucacagacaauguacacacguggaccgaacaauacaaauuccaacccgagucgcccucuaaauuggcaucagcgauacagaaggcacaugaagaggggauaugcgggauucgaucugugacuagacuugagaauuuaauguggaagcagauaacuccagaauuaaaucacauacuaagugaaaaugagguuaagcugaccauuaugaccggugacauaaaggguauaaugcaagcuggcaaaagaucauuaaggccgcaaccuacugaacucaaguauaguuggaaaacauggggcaaagcaaaaaugcuaucaacagaaagccacaaucaaacauuucuuauagaugggccugaaacggcagagugcccgaauacaaaucgcgcauggaacucucuagagguagaagauuacggauuuggaguuuucacaacuaauaucugguugaaacuaagagaaaaacaagacgucuuuugugauucaaaauuaaugagugcagccauaaaggacaacagggccguccacgcugauauggguuauuggauugaaucagcccucaaugauacauggaagauggagaaggccucauucaucgaagugaaaaguugucauuggccaaaaucccacacacuuuggaguaauggaguguuggaauccgaaaugauaauaccuaaaaacuucgccggaccagugucgcaacauaacuacagaccuggcuaccauacacaaacugcggggcccuggcaucugggcaaguuagaaauggacuucgauuucugugaagguacaacaguuguagucaccgaagauugcggcaaucguggaccuucacuaagaacaaccaccgcgagcggaaaacugaucacagaguggugcugccggaguuguacacuaccuccucuucgauauagaggugaagacggaugcugguaugggauggaaauaagaccucugaaggaaaaagaggaaaacuugguuaacagcuuaguuaccgcgggacauggacaaauagauaauuuuucacuagggguucugggaauggcgcuauucuuagaggaaauguuaagaacuaggguaggaacgaaacacgcuauuuuacuggucgcagugaguuuuguuacguugauuacggguaauaugaguuuucgggaccuaggaagaguaaugguuaugguaggugcuacaaugacagaugacaucggcauggguguuacauaucuugcacucuuagcagccuuuaagguuaggcccacauuugcagccgggcuacuauugcggaaacucacaaguaaggaguuaaugauggcaacaauaggaauugcauuauuaagucaaucaacuauuccugaaaccauacuagaguuaaccgaugcauuagcguuagggaugauggugcuaaaaauuguucguaacauggagaaguaccaauuagcuguaacuauaauggcuauaucuugugugcccaacgcugugauucugcaaaaugcauggaaagugucguguacaauucuagcugcagugucaguuucaccucuacuauuaacauccucacaacaaaaagcagacuggauuccccuggcauuaacgaucaaagggcuuaauccaaccgccauauucuuaacgacucuuagucggaccaguaagaaaaggucauggccucugaacgaagcgaucauggcuguugguauggugucaauccucgcuagcucuuugcugaagaacgauauaccaaugaccgguccguuaguagcaggaggguuacugacgguguguuacguauugaccgggagaagcgcagauuuagaauuagaaagagcagcugaugucaaaugggaagaucaggcagagauuucaggaucaucaccuauuuugagcauaacaauaagugaggauggcucaaugucuaucaaaaaugaagaagaggaacagacuuugacaauauuaaucagaacgggcuugcuagugauuagcgggguuuuuccggucucuauaccuauaacagcagcagcaugguacuuaugggaggugaagaaacagcgagcagggguauugugggacguaccaaguccgccgccuguaggaaaagcagaguuagaagacggagccuauagaauaaaacagaggggcauacuaggcuauagucagauuggcgcaggaguguauaaggagggaacauuucacacaauguggcacgugacacgaggagcagucuuaaugcauagaggaaaaagaaucgaacccagcugggccgauguuaagaaagaucuuauaaguuauggaggaggguggaaacucgaaggcgaauggaaagagggcgaggaaguacagguacuagcacuugaaccuggcaaaaauccaagagccguacaaacuaaaccaggauuauucaaaacgaauacuggaacaauaggggccguaucauuagauuuuaguccuggaacaaguggaucaccuauaguugauagaaaggggaaagugguaggacuauacgggaaugguguugugacacgcucaggagccuacguaucugcaauugcucaaacagagaaaucuaucgaagacaacccugagaucgaagaugacaucuuuaggaagaaacgauugacaaucauggaucuucauccaggugcuggaaagaccaaacgguaucugccagcaauugugagggaagcuauuaaacguggccuaaggacuuugauccuagcccccacuagaguuguagcagccgaaauggaagaagcccuuagagguuuaccuauaagauaucaaacccccgcuauuagagcugaacauacuggcagagaaauuguagaccuuaugugucaugcgacuuucaccaugaggcuucuauccccagugagagucccuaacuauaauuugauaauaauggaugaagcgcacuucacagacccugcuagcaucgccgcuagaggauauauaucaacucggguagagaugggugaagcugcaggaauuuuuaugacagcuacacccccggguucgagagauccuuucccccaauccaacgcuccuauuauggaugaggagagagaaauacccgaacgaaguuggaacucgggucaugaauggguuacagacuucaaagguaagacugugugguuuguacccucuauaaaagccgguaaugauauugcagcuuguuuaaggaaaaaugggaagaaagugauacagcugagcagaaaaacuuuugauucagaauacguaaaaacaagagcaaacgacugggauuuugucguaacgacugacauuagcgaaaugggugcaaauuuuaaagcggaaagagugauugacccuagaagauguaugaaacccguuauucucaccgacggugaagaaagggucauauuggcagguccaaugcccguaacacauuccucugcagcacaacgccguggaaggauaggaagaaauccaaagaaugaaaacgaucaauacauauacaugggggaaccauuagaaaacgacgaggauugugcucacuggaaagaagcuaagauguuauuagacaacauaaauacaccagaagguauuauaccaucaauguucgaaccagaacgagaaaaaguugaugccauagacggagaauaccgauugagaggggaagcgcggaaaacguuugucgaucucaugcgccguggugaucugcccguaugguuagcguauagaguagcugcggaaggaaucaauuacgcggauaggcguugguguuuugauggaauuaaaaauaaucaaauuuuagaagaaaacguggaaguagagauauggaccaaagaaggcgaacguaaaaagcuaaagccacggugguuggacgcccggauauacuccgauccgcuagcucucaaggaguuuaaagaguuugcugcaggaaggaaaucacuaaccuuaaaucucaucacagaaaugggacguuuaccgacuuucaugacacaaaaggcacgagacgcucuugacaaccuagcuguacuucauacugcggaagcuggcggucgagcauacaaucaugcccuauccgagcuaccggaaacauuagagacuuuauugcugcuaacauuauuggcgaccguaacagguggaauauuuuuguuucucaugucuggaaaagguauugggaaaaugacauuagggauguguugcauuauuacagcgucaauacuucuuugguacgcucaaauucaaccacauuggauugcugcgucgauuaucuuagaauuuuucuugauaguauugcuaauuccugaacccgagaaacagaggacaccucaggacaaccaacuaacauauguugucauagcaauauuaaccguaguugcggccacaauggcaaaugaaaugggauuuuuagagaaaacaaagaaagaucucggccuuggaucaauaacaacccaagagucagaaagcaacauacuagauauagacuuaagaccggcaagugcguggacguuauacgcuguugcuacaacguuugugacgccuaugcuaagacauucgauagaaaacucaagugucaauguauccuuaacagcuaucgcuaaucaagcaacuguucuaaugggccucggaaaaggcuggccacuaucgaaaauggauaucggaguaccacuacucgcuaucggauguuauagucaaguuaacccaauuacucuaacugcggcguuauuacuccuaguagcccauuaugcuauaauuggaccgggccuccaggcaaaagcuacccgggaagcacaaaaacgagcagcugcagguauaaugaaaaacccaacugucgacggcauaacgguaauagaucuagagccgaucccguaugacccuaaauuugaaaaacaguuaggucaaguaaugcuacuaauauugugugugacgcaaguacugaugaugcgcacuacaugggcauuaugugaggcacuaacacucgccacugggccuauuagcacauugugggaaggaaauccggguagauucuggaauacgacaauugcgguuaguauggcuaacauauuccgaggcucuuauuuagcaggcgccggauuauuguuuagcauuaugaagaauacuacaaacacucgucgagguacagggaauauaggggaaacuuugggggaaaaguggaaaucaagauuaaaugcgcugggaaaaucugaauuucaaaucuacaagaaaucagggauucaggaaguagauagaacguuggccaaagaggggauaaagagaggggaaaccgaucaccacgccgucucacggggauccgcuaaacuuagaugguucgucgaaagaaacaugguaacaccugaaggaaaaguaguugauuuagguuguggaagagguggauggucauauuacugcggaggauugaaaaauguacgugaaguaaaagggcuaacaaaaggagguccugggcaugaggaaccaauaccuaugucgacuuauggauggaauuuaguucgguuacaaagcggugucgacgucuucuuuacgcccccagaaaaaugugauacucuccuaugugacauaggugaaagcaguccuaaucccacaauagaggcgggaagaacgcuaagaguauuaaauuuaguagagaauuggcuaaauaauaauacgcaauuuuguauaaagguauugaauccuuauaugccgucaguaaucgagaaaauggaaacgcuacagcgaaaauacgguggcgcucuuguccggaauccgcucagucgaaauagcacccacgaaauguauuggguguccaacgcuaccgggaauauaguaucuucugucaauaugauaucacgaaugcucauaaauagauucaccaugaagcacaagaaagcgacguaugaaccagauguggaucuuggaucuggaacaagaaauauagguauugaaucggaaauaccgaaccuagacauuauuggaaagagaaucgagaaaauaaagcaagaacaugaaacguccuggcauuaugaccaggaccacccauauaagacgugggcauaucacggaucuuaugaaacaaagcaaacaggcucagcaucuuccauggucaacggcguaguuagacuuuuaaccaaaccaugggaugucgugccaauggucacgcaaauggcaaugacggauacgacaccguuugggcaacaaaggguuuuuaaggaaaagguugauacgcgcacucaggaaccuaaagaaggaaccaagaaacuuaugaaaauaacugcugaaugguuauggaaagagcuggguaagaagaaaacaccuagaaugugcacgagagaagaguucacaagaaaagugaggucaaacgcagcuuuaggugcuauauuuacugaugagaacaaauggaaaucugcucgagaggcaguagaagauaguagguucugggaacuaauagaccgcgaacgcaaucuucacuuagagggaaaaugugaaaccuguguguauaauaugaugggaaaaagagaaaagaaacugggagaauuuggaaaagcaaaagguucaagagcaauuugguauaugugguugggugcaagauuccuggaauuugaagcauuaggauucuuaaaugaggaccauugguucagucgagggaacaguuuaucuggaguagagggugaaggauuacaucgccuuggauauauacuucgagacgugagcaagaaagaaggcggagcgauguaugcugaugauacugcugguugggauacaaggauaaccuuagaagaucucaaaaaugaggaaaugguaacuaaucauaugaaaggagaacauaagaaauuagcagaagcaauauuuaaguuaaccuaccaaaauaaaguggucagaguucaaagaccaacuccacgcggaacaguaauggacauaauaucaagaagggaucaacgagggaguggacaagugggaacguacggucugaacacguuuacuaacauggaagcgcaguuaauaagacaaauggagggagaaggaauauuuaaaagcauucaacaucugacaguuacagaggaaauugcagugcaaaacugguuagcacgugucggacgagagcggcucagucguauggcuauuaguggggaugauuguguuguaaaaccacuagacgauagauuugcuagugcacugacagcauuaaaugauaugggaaaagucagaaaagacauccaacaaugggagccaucuaggggauggaaugacuggacacaaguaccauuuuguagucaucauuuccaugaauuaguuaugaaggacggaagaguauugguaguuccguguagaaaccaagacgaauugauaggcagagcgcguauuucacaaggcgcaggauggucguugaaagaaacagccugccucgguaaaagcuacgcucaaauguggacacuaauguauuuucauagaagagacuuaagacuagccgcuaaugcaauuuguucagcuguaccuagucacuggguaccgacgucuaggacaacuuggaguauacaugccaaacaugaguggaugacaacugaagauaugcuugcaguauggaacagagucuggauccaagagaauccguggauggaagacaagacgccaguugaaagcugggaggagguuccauauuugggcaaacgugaagaucaauggugugggucacugauaggauuaacuuccagggcaacgugggccaaaaauauacaaacagccauuaaccaagucagaucgcuaauuggaaaugaagaauauacggauuacaugccaucaaugaaaagguuuagaagggaagaggaagaggcagggguccugugguga

SEQ ID NO: 22553 - RNA, 9876 nt, Artificial Sequence
  derived and/or modified CDS sequence (opt6) from DENV-2__EU482580__SS-prME
acagcagggguuauuauaaugcuaauucccacggcgauggcauuccaucuaacuacacgcaauggagaaccucauaugauagucggacgucaagaaaaagggaaaaguuuacuuuucaaaacugaagauggaguuaacauguguacguuaauggcgauggaccuuggagaacucugcgaagauacaauaaccuauaaauguccgcucuugcgacaaaacgaaccggaagacauugauugcugguguaacucaacgagcacaugggugacuuaugggacauguacuacaacaggggaacaccgcagagaaaaacgaucaguugccuuaguuccccacgugggaaugggauuggaaacgcgaacagaaacauggaugucuucugaaggggcauggaaacaugugcaacguauagaaacuuggaucuuaaggcaucccggauucacgauaauggcagcgauauuagcuuacacuaucggaacaacacauuuucaacgugcuuuaauauuuauacuccugacggcaguugcaccaucuaugacaaugcguuguauaggaauaucuaauagagauuucguugaaggugucucaggcggaucguggguggacaucguguuggaacaugguucuuguguuacuacaauggcgaaaaauaaaccaacauuagauuuugaguugaucaaaacggaagcaaaacaaccggcuaccuugaggaaauacuguauagaagcuaaacuaacuaacaccacuacagagagucgauguccaacucaaggagaaccuagcuugaacgaggaacaagauaaaagauuuuugugcaaacacucaaugguagaccgagggugggggaacggauguggacuauucggcaaaggagggauaguaacaugugcaauguuuacuuguaagaaaaacauggaaggaaaaguaguucaaccggaaaaccucgaguauacaaucgucauuacuccacacaguggagaggaacaugcuguagggaaugacacaggaaaacaugggaaagaaauaaaaauaacgccacagucuucaaucacagaagcagaauuaacaggcuacggcaccguaaccauggaauguucuccgcguacuggccuugauuuuaacgagaugguacuuuuacaaauggaagacaaagccuggcugguccaucgucaaugguuuuuagaucuuccacucccaugguuacccggugcggacacacaagguuccaacuggauccaaaaagaaacccuaguaacguuuaaaaauccacaugcgaagaaacaggacguagucguacugggaucacaagaaggugcaaugcauaccgcacuaacgggcgcuacagaaauacagaugaguagcgguaaccugcuauuuacaggucaccugaaauguagacucaggauggauaaauugcaacugaaagggaugaguuacagcauguguacaggaaaauucaaaauaguaaaagaaauagcggaaacccaacacggaacgaucguaauuagagugcaguaugaaggugauggcucgcccugcaaaauaccguuugaaauaauggaccuagagaaaagacauguucuagggcgcuuaaucacaguuaauccuauaguaacagagaaagauucccccguaaacauugaagcagaaccacccuucggagacucauauauaaucauaggcguugaaccugggcaauuaaaacugaacugguucaagaaagguaguagcauugggcagauguuugagacaacuaugcggggagcuaaacgaauggcuauauugggcgauacugcaugggauuuuggaagucugggaggcguauucaccucaauugguaaagcacuucaccagguguuuggagcgauauauggcgcagcauuuucgggagugaguuggaccaugaaaaucuuuaucggcgugauaauaaccuggauagguaugaauagcaggucaacaucauugucagucagucuaguacuugucggaguuguaacucuauaccuuggcgccaugguacaggccgauucaggaugcguuguaucuuggaaaaauaaagaacuuaaauguggaucuggaauauucaucaccgacaacguacacacuuggacugaacaauauaaauuucaaccggagucuccaucaaaauuagcgagugcuauacaaaaagcacacgaagaaggaauaugcggcauaagaaguguuacuagacuugagaaccuaauguggaaacaaauuacgcccgaauuaaaccauauuuuaagugaaaaugaaguaaaguugacuauaaugaccggagacauuaaggggauaaugcaggcagggaaaaggucauugcgaccacagccaaccgaacuuaaauacagcuggaagacguggggcaaagcaaaaaugcuaaguaccgaaucucacaaucagacguuucuaauagacggcccagaaacagcugaauguccaaacacgaauagggcuuggaacagucuugaggucgaggacuauggauuuggaguauucacuacuaacauaugguuaaaauuaagagagaaacaagauguauuuugcgacaguaaacuuauguccgccgccaucaaagacaauagagcaguacacgcagacaugggauauuggauugaauccgcucuaaacgauacauggaaaauggagaaagcuaguuuuaucgaaguaaaaucaugccauuggccuaagucccacacacuuuggucaaauggggucuuagaaucagaaaugauaaucccuaagaacuucgccggucccguuagucagcauaauuaccgaccagguuaccacacgcaaacggccgggccauggcaccuaggcaaauuggaaauggauuuugauuuuugugaagguacaacgguagucguaacugaggauugcgggaacagaggaccaucacuuaggaccaccacagcauccggaaaauuaauaacagaaugguguugcagaucuuguacacuaccaccccuacgcuauagaggcgaagauggaugcugguaugggauggaaauaaggccgcugaaagagaaagaggaaaaccucguaaacagccuugugacugcaggacaugggcaaauagauaauuucagccuaggcgucuuagguauggcguuauucuuggaagaaaugcuuagaacuagaguuggaacaaagcaugcaauauuauuaguagcaguuucauuuguaacacuuauuaccggaaauaugagcuucagagauuuggggagaguaaugguuaugguaggugccacuaugacagaugacauagguaugggagucacauauuuagcauuauuagcagcauucaagguaaggccaacauuugcagcggggcuccuguuacggaagcuaacgucaaaagaguuaaugauggcaacgauaggcauagccuuauuaucacaaucaacaaucccagaaacaauuuuagaacuuaccgacgcccuugcauuagggaugaugguguuaaaaauagugcggaauauggagaaauaccaacuugcuguuacaauaauggccauaucauguguacccaacgcaguuauacuacaaaacgcuuggaaggucucaugcaccauacuugcagcugucagugugaguccucuauugcuaacgucaucgcaacagaaagcggauuggauacccuuagcguuaacaauuaaggguuugaauccaacggcuaucuuuuuaacuacguuaucccgcaccagcaagaaaagaucguggccacugaacgaagcuauaauggcaguggguaugguaucaauuuuagcaucuaguuugcucaaaaaugauauuccaaugacaggucccuugguugcuggcgguuuacugacagucuguuauguuuuaacuggccgcucugcagauuuagaauuagaaagagcggcugauguaaaaugggaggaccaggcagaaauaaguggaucaagcccuauucuuagcauuacuauuucagaagacggaucgaugagcaucaaaaaugaagaggaggagcaaacauugacaauacugaucagaacggggcugcucgucauaagcggaguauuccccguuaguauaccaauaacagccgccgcuugguaccuaugggaagugaagaaacagcgggcugguguacuaugggacguacccagucccccacccgucggaaaagcagaacuggaagauggugcauauagaauaaaacaacgcggaauauuaggguacagccaaauaggugcgggagucuauaaagaaggaaccuuccacacuauguggcacgucacuagaggagcuguucuaaugcauagggggaaaaggauugaaccguccugggcugaugucaagaaagacuugauaaguuauggcggaggcuggaaauuggaaggcgaauggaaagaaggagaagaaguacaaguauuggcguuagaaccagggaaaaacccaagagcgguacaaaccaaaccgggucuauucaagaccaauaccgggacgauuggagcaguuaguuuagacuuuucgccgggaaccagugguucaccaaucguggaccgaaaagggaaaguagucggucuauaugguaauggaguugucacgagauccggggcauauguaagcgcaauugcucagacagagaaauccauagaggauaacccggagauugaagaugauauuuucaggaagaaacgucugacaauuauggaucuacacccaggugcaggaaaaacaaaaagauaucuaccugcuaucguacgggaagcgaucaaacggggacuacguacccuaauauuagcacccacaagaguaguugcagccgagauggaagaggcuuugcguggucuaccuauaagauaccagacgccugcuauaagagcagaacacacgggccgagaaauuguagauuugaugugccacgcuaccuucaccaugaggcuccuaagcccuguacggguuccaaauuauaaucuaaucauaauggaugaggcacauuucacagauccugcaaguaucgcugccaggggguauauuucuacacgaguugaaaugggcgaggcggcgggaauuuucaugacagcgacuccacccgguagcagagacccguucccgcagucgaaugccccgauuauggacgaagaaagagaaauaccggaaagauccuggaacagcggucaugaguggguuaccgauuucaaaggcaaaacuguuugguuuguuccuucgauuaaagcagguaacgauauugcagcuugccuuaggaaaaacgggaagaaaguaauacaauugucaagaaaaacguuugauagugaauacguuaaaacaagagcgaaugacugggauuuugucguaaccaccgauauuagugaaaugggugcaaacuucaaagcagaacgugucauugauccgagacguuguaugaagccaguaauacuuaccgauggcgaagaaagaguaauuuuagcggguccuaugcccgucacacauucauccgcugcgcaacgaagagguagaauuggacguaauccuaaaaaugagaacgaucaauauauauauaugggugagccacucgaaaacgaugaagauugugcucauuggaaagaagcuaaaauguuauuagacaacauaaauacacccgaaggaaucauucccucaauguuugagccagagagggaaaagguggacgcuauagacggggaauaccgauuaagaggcgaggcgagaaaaacguucgucgacuuaaugcgaagaggagaucucccagucuggcuagcauauaggguagcagcagagggaauaaacuacgccgaccgaaggugguguuuugauggcaucaaaaauaaucaaaucuuagaggaaaauguagagguugagauauggacaaaagaaggugaaaggaagaaacuaaaaccaagauggcuagaugccagaauauauuccgauccacucgccuuaaaggaguuuaaagaguucgccgccggaaggaaaucauugacacuaaacuuaauuacugaaaugggacggcuaccuacuuucaugacccagaaagcucgagaugcucuagauaauuuagccguauuacauacggcagaagccggugguaaggccuauaaccaugcccucucugaauuaccagaaacacuggaaacacuauuacuauuaacacucuuagcaaccgugaccggagguauuuucuuauuuuuaaugagcgguaaaggaauugggaaaaugacucuaggaauguguuguaucauaaccgcgagcauauuauugugguaugcacaaauucaaccacauuggauugccgcaucaauaauauuagaguucuuccucauaguauugcuuaucccagaacccgaaaaacaaagaaccccacaagacaaccaauuaacauacgucgucaucgcuauacuaacgguggucgcagcuaccauggcaaacgagaugggguuuuuagagaaaaccaagaaagaccuaggauugggguccauaacuacucaagagucagagucuaauauucuagacauagauuugagacccgcauccgccuggacgcucuaugccguugcaacgacguuugucacaccaauguuacgccacucaaucgaaaacaguucaguaaacgugagucuuacggcuauugcaaaccaagcuacaguauuaaugggucuaggaaagggcuggccacuaucaaaaauggauauuggaguaccauuauuggcgauaggcuguuauucacaggucaauccgaucaccuugaccgcggcauuguuauuguuaguugcgcauuaugccauaaucggcccaggauuacaggccaaagcgacgcgugaagcccagaaaagagcagcggcugggauaaugaaaaacccgaccgucgauggcauaaccguaauagaucucgaaccuauaccguaugacccaaaguucgaaaaacaguugggucaaguaauguuacuaauucuaugcguuacacaaguacugaugaugaggacaacuugggcccuaugugaagcacugacauuagcgacaggacccauaucgacguuaugggaaggaaacccaggaagguuuuggaauaccacaauugcugucaguauggcaaauauuuuucgagguucguaucuagcaggcgcaggauuacuuuuuaguauaaugaaaaauaccacaaacacacgaagagguacagggaacauaggagaaaccuuaggugaaaaauggaaguccagacuaaacgcacuuggaaaaagugaauuucaaauauacaagaaaucggguauucaagaaguagaucguacucuugcaaaagaaggaauaaagcguggggagacagaucaucacgcaguaucaagagguucugcaaaauugaggugguuugucgaacgaaauaugguaacucccgaaggaaaaguagucgaccuaggcugugguaggggaggguggagcuauuauugcgguggacuaaagaaugugagggaagugaaaggauuaacaaaaggagggcccgggcaugaagaacccauaccgaugucaacauacggcuggaaucuaguccggcuacaaucugguguagauguauucuuuacgccaccagaaaaaugugacacccucuuaugugauauuggagaaagcaguccuaacccuaccauagaagcaggaagaacauuacgcguccucaauuuaguagaaaauugguuaaacaauaacacacaauuuugcauaaaaguacuuaaccccuauaugccgucugucauugagaaaauggaaacucuacagaggaaauaugguggugcucucgugcguaauccgcuuuccagaaauuccacucaugaaauguacuggguaucaaaugcgacgggcaauauuguaaguucuguaaacaugaucagcaggaugcuuauaaauagguucacuaugaaacacaagaaagcaacauaugaaccagacguggaccuuggcucuggcacacgaaauaucggaauagaaucagaaauaccgaaccucgauauaauaggaaaaagaauagagaaaauuaaacaagagcaugagacaaguuggcauuacgaccaggaucauccauauaaaacuugggccuaccacggaucauacgagacgaaacagacugguucggccucuucaaugguaaauggaguaguaaggcuucuuacuaaacccugggauguuguacccaugguaacccaaauggcaaugacugauacaacgccuuucggacaacagcgaguuuucaaagagaaagucgauacaagaacucaagaaccaaaagaaggaaccaagaaauugaugaaaauaacggcagaauggcucuggaaagaacucgguaagaagaaaacaccaagaauguguacacgugaagaauuuacgaggaaagucagaaguaaugccgcacuaggugcaauuuuuacggaugaaaauaaguggaaaagcgcgagagaagcaguugaggacagucgcuuuugggaauuagucgaccgcgaaagaaacuugcaccucgaaggaaaaugugagacaugcguuuauaauaugaugggcaaaagagaaaagaaauuaggggaguucggcaaggcgaaaggaucaagagcgauaugguacauguggcugggagcacgauuccuagaauuugaagcccuuggcuucuuaaacgaagaccacugguuuaguagagggaauagucuuuccggaguagagggagaagguuuacaccgauugggguauauacuaagagauguuaguaagaaggaaggaggggcaauguacgcagaugacacugcuggaugggacaccagaauaacauuagaagaccugaaaaacgaagaaauggucacaaaccacaugaagggagaacacaagaaacuugcagaagcaaucuucaaacuuaccuaucaaaacaagguaguacguguucaaagacccacuccuagggguacgguaauggauauaaucucucggagggaucagcgggguaguggacaaguagguacguauggacuuaacaccuuuacaaauauggaagcacaacuuauaagacaaauggaaggagaaggcauauuuaaaucaauccaacaccuaacugucacugaagaaauagcuguacagaauugguuagcgagaguuggucgggaaaggcuguccagaauggccauaucuggcgaugacugugucguaaaaccucuagacgaucgauuugcuucugccuuaacugcauuaaaugauaugggcaagguaaggaaagauauucagcagugggagccuucacggggauggaacgauuggacacagguuccuuuuuguucccaucacuuucacgagcuagucaugaaagacggaagagugcucgucguaccaugcagaaaucaggacgaacuuauaggcagagcaagaauaucgcaaggagcaggauggucuuuaaaggaaacagcgugccuagguaaaagcuaugcgcaaauguggacacugauguauuuucaucgccgugaccucagauuagcugcuaaugcuauuuguucugcuguuccaagccauuggguaccaacuucacguacaacuuggagcauucacgcaaaacaugaguggaugacaacagaagauaugcuagcaguuuggaaccgaguguggauacaggaaaauccauggauggaagacaagacccccguggagucaugggaagaagugccguauuuaggaaaacgugaagaucaaugguguggcagcuugauaggacuuacgagccgcgccacaugggcgaaaaauauucaaacagcaauuaaccaaguucgaucucuuauagguaaugaagaauauacagacuacaugccuaguaugaaaagauuuaggagagaagaggaagaagcaggcguauuaugguga

SEQ ID NO: 22554 - RNA, 9876 nt, Artificial Sequence
  derived and/or modified CDS sequence (opt6) from DENV-2__EU482581__SS-prME
acagcuggagugauaaucaugcucauaccaacagcuauggcuuuucacuuaacuacacggaauggcgaaccacauaugauaguaggaaggcaagagaaaggaaaauccuugcuauuuaaaacagaagauggaguaaacauguguacuuuaauggcaauagaccucggagaacuaugugaagauacuaucaccuacaaaugcccgcuuuuaaggcaaaacgaaccagaagacauagauuguuggugcaauagcacaucaacuuggguaacauauggaacuugcacaacuacuggcgaacacagacgagagaaacgaucgguggcuuuaguaccacauguuggcaugggauuagaaacacgaacagaaacauggaugucaucagaaggggcuuggaaacauguacagcgaauugaaacauggauuuuaagacacccaggguuuacuaucauggcagccauuuuagcuuauacgauugguacuacacacuuucagcgagcauugauauuuauucuguuaacagccguugccccaaguaugacaaugcgaugcauagggauaaguaaccgagacuucguagaaggaguuuccggaggaaguuggguagacauaguauuggaacacggauccugugucacuacgauggcgaaaaauaaaccgacccucgauuuugaacuaaucaaaacagaagcaaagcaaccagcaacacuaagaaaauauugcauugaagcuaagcucacuaacacuacgacagaaucacgcugcccuacucaaggugaacccagcuuaaaugaggagcaagauaagagauucgucugcaaacauucuaugguagaucgagguuggggaaacggcugugguuuauucgggaaaggagguaucguaacaugugcaauguuuacuuguaaaaaaaacauggaaggaaaaguaguacuuccagaaaauuuagaauacacaauuguaauaacaccacauucaggggaagaacacgcaguagguaacgauacagggaaacaugguaaagagaucaaaauuacgccacaaaguaguauaacagaagcagaacucacaggguacgguacaguaacgauggaauguucaccgcggacaggacuagauuuuaacgagaugguuuuacuucaaauggaagacaaagcguggcuuguacaucgacaaugguucuuggacuuacccuuaccauggcuaccaggugcugacacacaaggaucaaauuggauacaaaaagaaacacuggucaccuucaaaaauccgcacgcaaagaaacaagaugugguuguauuaggaagccaagagggagcgaugcauacagcacugacaggugcaaccgaaauucagaugucaagcggaaaccuuuuauuuacugggcaccugaaaugccgccuacguauggauaagcugcaauugaaagguaugucauauucuaugugcacagguaaauuuaagaucgucaaggagaucgcagaaacacaacacgguacaauaguuauaagggugcaauaugagggagauggaaguccauguaagauucccuuugaaauuauggaucuggaaaaaaggcauguucuaggaagacuaaucacaguuaauccaauaguuacagguaaggauaguccaguaaauauagaagcagagccucccuucggcgacucauacauuauaauugguguagaaccaggucagcugaaacucaauugguuuaaaaaaggaagcagcauaggucaaauguuugaaacgacgaugagaggcgcaaaaaggauggcuauauugggggauaccgcuugggacuuuggaucgcuggggggaguguuuacaucuauaggaaaagcuuuacaccaaguuuuuggugcaaucuacggcgcugcuuucucgggcguaucauggacaaugaaaauauugauuggaguuauaauaacguggauagggaugaauucgagaucuacuagccucaguguaucucuugugcuugucggcguagucacacucuauuuaggugcaaugguacaggcagauuccggguguguuguaucauggaaaucgaaagagcuaaaauguggaaguggcauuuuuauaacagacaauguucacacuuggacugaacaguauaaauuccagccagagucuccuaguaaacuugcgucagcuauacaaaaagcgcaugaagagggaauuuguggaauacgcagcgucacacggcuggaaaaccucauguggaagcaaaucacaccugaguuaaaccacaucuugucagagaaugaagugaaacuaacaaucaugacuggugacauaaaaggaauaaugcaggcuggcaaacggucacuaagaccucaacccacugaacucaaguacucuuggaaaacauggggcaaagcgaaaaugcucucaacggaaucccauaaccagaccuuucuuauagaugguccagaaacagcagaauguccaaauacaaauagagcauggaauucacuugaagucgaggacuacgguuucggaguguucaccacuaauauuugguugaaacugcgcgagaaacaggacguauuuugugacucgaaacuaaugucagcugcgauuaaggacaaucgagccguacaugcagauaugggcuauuggaucgaaagcgcccucaacgacacuuggaaaauggagaaggcgucauuuauagaaguuaagucuugccauuggccaaaaagccauacauuguggucuaauggaguccuagagagcgaaaugauuaucccaaaaaauuucgcaggccccguaagucaacauaauuaucgucccggcuaucacacacaaacagccggaccguggcaucuuggaaagcuggaaauggauuuugacuuuugcgaaggaacaacaguuguaguuacagaagacugcgguaauagaggaccaucguuaagaacaacuaccgcaucaggaaaacuuauuacugaauggugcugccguucaugcacguugccgccauuaagauauagaggagaggaugggugcugguauggaauggaaauacggccauuaaaagaaaaagaagaaaacuuagucaauagcuuaguaacugcaggucauggccagauugauaauuucagucuaggcguucuagguauggcacuuuuccuugaggaaauguuacgaacaaggguagggacaaaacacgcaauuuuguuaguugcaguaucauuugucacucucaucacaggaaacaugucauucagggaucuggggagaguaaugguaauggugggugcuaccaugacggaugauauaggaaugggaguaacauauuuagcuuuacuagcggcauucaaaguaagacccacauucgcagccggauuacuauuacguaaguuaacaucaaaagaguuaaugauggccacuauugguauagcucuauugucacagucaacuauaccagaaacaauauuagaacuuacagacgccuuagcauuagggaugaugguguuaaaaaucguaagaaauauggaaaaauaucaguuggcgguuacaauuauggcaauuucaugugucccaaaugcaguuauauugcaaaaugcguggaaagucucaugcacaauauuagccgcugucagcguuaguccucugcuucucacuaguucccagcaaaaagcagacuggauaccacuagcgcuuacgaucaaagguuuaaauccuacggcuaucuuucuaacgacccuauccaggacaucaaaaaagcgaagcuggccacucaacgaagcgauuauggcaguagguaugguaucgauacuugcgucaagucuuuuaaagaaugacaucccuaugacaggucccuuagucgcaggaggacuacucaccguauguuauguacuuacagggcgaucagcugaucuagaacucgaacgcgccgcagacguaaaaugggaagaccaggcugaaaucuccggcucgucuccuauccuaucgauaacgauaucugaggauggaaguaugucaauaaaaaaugaagaagaagaacagacuuuaaccauccuaauaaggacuggauugcuagucauaagcgggguuuuccccgugucgauuccaauaacggccgcugcuugguaccuuugggaaguuaaaaagcaaagagcgggaguauuaugggauguaccgucaccaccuccugucggaaaagcagagcuggaagacggggcguaucgaauaaaacagcgaggaauucuugguuauucgcaaaucggagcgggaguauauaaggagggaacauuccauacgauguggcacguaacgcggggggcaguuuuaaugcauaggggaaaacggauagaacccucuugggcagacguuaagaaagaccugauauccuacggaggcggauggaaacuugaaggagaauggaaagagggagaagagguccaaguauuggcuuuagagcccggaaaaaauccacgugcaguacagacgaaaccaggccuuuuuaaaacaaacacagguacgauuggggcgguauccuuagacuuuucuccagguacgaguggcucuccaauaguagaucguaaagguaagguggucggacuauauggaaacggggucguaacccgaaguggggcauauguauccgccauagcucagacagagaaaucaauugaagacaacccagaaauugaggaugacauauuccguaaaaaaagguuaaccauuauggaccuccauccuggggcugguaagaccaaaagauaccucccugcaauaguacgagaagcaauaaaaagaggacuuagaacauuaauacuagcacccacuagagugguggccgcugagauggaggaggcuuuaagagguuuacccauacgcuaucaaacaccggcaauuagggcugaacacacaggcagagaaauuguugaccuaaugugucacgcaacauuuacuaugaggcuacugucaccuguaagagucccaaauuacaaucuuaucauuauggacgaagcucauuucacugauccugcauccauugcugcacgagguuacauuucaacacgcguggagaugggagaagcggcgggcauauuuaugacugcgacuccaccuggaaguagggauccuuuuccacaaagcaaugcaccgaucauggacgaagaaagagagauaccagaaagaaguuggaauagcggacacgaaugggugacagauuuuaaaggaaaaaccguaugguucgucccaucgaucaaagcagguaacgauauagcugcgugucuccguaaaaaugguaagaaaguaauucaauugaguagaaaaacauuugauagugaguaugugaaaacuagagcaaaugacugggauuucguagugacaacugauauuucagagaugggggccaauuucaaagcagaacguguuauagacccuaggcgaugcaugaaaccgguuauuuugacagauggcgaagagagagugauucuggcuggaccuaugccggugacacauucaagugcagcucagagaagagggagaauagggcgaaauccuaagaaugaaaaugaccaauacaucuauaugggagaaccuuuggaaaaugaugaagacugugcucauuggaaagaagcuaaaauguugcucgacaauauaaauacuccggaaggcauuaucccuagcauguucgaacccgagcgagagaagguagaugcuaucgauggugaauacaggcuaagaggagaagcucguaagacauuuguagaucuuaugagaaggggagauuuacccguauggcuugcuuaucgcguggcagcagagggaauaaacuaugcugaccgccggugguguuuugauggaauaaaaaacaaccagauuuuagaagaaaauguggaaguagaaauauggaccaaagaaggugagagaaaaaaauuaaaaccgagaugguuggaugcucgcauauacucagauccccuggcguugaaagaauucaaagaauuugccgcaggcagaaaaucauuaacauuaaaucuaaucacagaaaugggccguuuaccaaccuuuaugacacagaaggcaagagaugcgcuugacaaccucgcuguauugcacacagccgaagcaggggggagggcauauaaucacgcacuaucagaacuaccugaaacgcuagaaacacugcuacuacugacacuauuagccacaguaacgggaggaaucuuucuauuucucaugucugggaaaggcauugguaaaaugacauuagguauguguugcauaauaacggcuucgauacucuuaugguacgcucaaauccaaccucacuggaucgcagccucaaucauccuagaauuuuuucuaauugugcucuuaauuccagaacccgagaaacaaaggacaccucaagauaaccaacuaacauaugugguuauagcuauucuuacagugguagcugcaacuauggcaaaugaaaugggauuuuuagagaagacgaaaaaggacuuaggauuagguaguaucacaacccaagaaucugaaagcaauauacuugacauagauuuacgaccagcuagcgcauggacacucuaugccguagccacgacauucgugacaccuauguuacggcacagcauagaaaacaguucagucaauguaaguuugacagccauagcaaaccaagcaacuguacuaaugggauuaggaaagggauggccauuauccaaaauggauaucggaguucccuuguuagcaauuggaugcuacucgcaaguaaauccaaucacuuugacagcagcucuauuacuguuagucgcucacuacgcuauuaucgguccggguuuacaagcuaaagcuacccgugaagcgcaaaaacgcgcagcugcagguauaaugaaaaauccaacaguagacggaaucaccguaaucgacuuagaaccuauaccuuaugacccuaaauucgaaaagcaacuaggccaagucauguuacugauccuguguguaacccaaguguuaaugaugaggacuacaugggcucuaugugaagcacuuacucuagccacaggaccuauaucuacacuuugggaggggaacccuggacguuucuggaauacaaccauagcaguauccauggcaaauauuuuccgagguucauaccuggcgggagcuggucuccucuuuucaauaaugaaaaacaccaccaauacaaggagaggaacuggaaacaucggagagacuuuaggugaaaaguggaaaagcaggcuaaaugcacuagggaagagugaauuucaaauuuauaaaaaaucagggauucaggagguagauaggacacuagcaaaagagggcauaaagagaggugagacagaucaucaugcgguuucuaggggcucugcgaaacuaagaugguucguggagagaaauaugguaacaccagaaggaaaaguuguagauuuggguugugggagggggggcuggagcuacuauugcgguggacucaaaaauguuagggaggugaaaggcuuaacgaagggcggaccgggacaugaggagccuauacccaugucgaccuauggauggaaucuaguccgcuuacaaagcggcguugaugucuuuuucacaccaccagagaagugugacaccuuacucugugacaucggagagucaucaccaaaucccacuauagaagcaggucgcacuuugcgagugcucaauuuggucgagaacuggcugaauaauaauacacaauuuuguauaaagguacucaauccauauaugccauccguaauugaaaaaauggaaacauuacagcgaaaauacggaggagccuuaguacguaacccccuuucacgaaauucgacucacgaaauguacugggucucaaaugcuacagguaauauagugucuucaguuaacaugauaaguagaaugcuaauuaacagauuuacaaugaaacauaaaaaagcaaccuaugaaccggaugucgaucuugguucggggacaagaaauauuggaaucgaaucagaaauaccgaaccuugauaucauuggaaaaagaauagagaaaaucaagcaagagcaugaaacuucguggcacuacgaucaagaucauccguauaaaacuugggccuaccacgguaguuacgaaacuaagcaaacaggcagugccucuucuauggugaauggagugguaagacucuugacgaaaccaugggacguggugccgaugguaacacaaauggccaugacugacacuacuccguucggacagcaacgggucuucaaagaaaaaguggacacuagaacccaagagccuaaagaaggaacaaagaaauuaaugaaaauuacugcugaauggcuauggaaagaacugggcaagaagaagacuccgagaaugugcacaagagaagaauucacccgaaaagugagaaguaaugcagcucucggugcuauauuuacggaugaaaauaaauggaagucagcucgugaagcgguugaagacaguagauuuugggaacuaauagaucgagagagaaaccugcaucuagaaggaaaaugcgaaacauguguauacaacaugauggguaaacgugaaaaaaaauuaggagaauuugggaaagcaaaagggucucgagcuaucugguauauguggcuuggagcaagauuuuuagaauucgaagcacuugguuuucuaaacgaggaucauugguucucaagggggaauagccuaagugguguagaaggugagggauugcaucgacuaggguacauacugagggauguaucgaaaaaagaaggcggagcaauguaugcagaugauacugcuggcugggauacuagaauaacacuggaagaucuaaaaaacgaagaaaugguaaccaaccacaugaaaggcgagcauaaaaagcuggcugaggcaauauucaaacucacauaccaaaacaaagucgugcggguacaaagaccuaccccacguggcacaguaauggauaucauuaguaggagggaccaacggggcuccggucaagugggaacuuacggauugaauacauucacuaacauggaagcacaacuuauuagacaaauggaaggagaaggaaucuuuaaaucaauacagcaccucaccgucacagaggagauugcgguacagaacugguuagcaagggucgguagggaacgucuaucgaggauggcgauuaguggggaugauugugugguaaaaccacuagacgaccgauuugccagcgcguugacggcccuaaaugauaugggcaaagucagaaaagauauacaacaaugggaaccgucacgcggauggaaugacuggacacaggugcccuuuugcucacaucauuuucacgaacugguaaugaaagacgggagaguauuaguuguuccgugcaggaaucaagaugaauugauuggcagggcgagaaucucacagggagcaggauggagucucaaggaaacggccugccuagggaaaaguuaugcucaaauguggacgcugauguauuuucauagaagagaccuaagacuugcugcaaaugcuauauguucagcaguaccaucacauuggguaccuacaagucggacaaccuggucaauacacgcaaaacacgaauggaugacaacagaggacaugcuugcaguguggaaucgaguauggauccaagaaaacccauggauggaagauaaaacgccuguugaaucaugggaagaaguuccauauuuagggaagcgugaagaccaaugguguggaagccuaaucgguuuaacaagcagagcaaccugggcaaagaacauucagacagcgauaaaccaaguacgaagucuaauaggcaacgaagaauacacagauuacaugcccaguaugaaacgguucagaagagaagaagaagaagccgguguauuaugguaa

SEQ ID NO: 22555 - RNA, 9876 nt, Artificial Sequence
  derived and/or modified CDS sequence (opt6) from DENV-2__EU482582__SS-prME
acugcagggguaauaauuauguuaauaccaacggcaauggcauuccaccuaacuacgaggaauggcgaaccacauaugauuguuggcaggcaggaaaaaggaaaaagucuccuauucaaaacggaagacggcgugaauauguguacucuuauggcuauagaccuaggcgaacuuugcgaagauaccauaaccuacaaauguccucuacugcgacagaacgaaccugaagauauugauuguuggugcaauucaaccaguacuugggugacauacggaacguguaccacaacaggagaacaucgaagagagaaaaggaguguggcacugguuccacacguuggaaugggauuggaaacucgaacagaaacauggauguccucugaaggcgcguggaaacauguacaaagaauagaaaccuggauauuacgacaucccggcuucacgauuauggcagcuauacuagcauacaccauagguacaaaucauuuccagagagcacuaauauuuauauuacuaacugcgguugcuccuaguaugacuaugagauguauagggauaagcaauagagauuucguggaaggcguuucagggggaaguuggguagacauaguauuagaacauggaucaugcguuaccacaauggccaaaaauaaacccacguuggauuucgagcucaucaaaacugaggcgaaacaaccggcgacccucagaaaauacuguauagaggcuaaacucaccaacacaacgacugagagcagaugcccuacacaaggagaaccaucucuaaacgaagaacaagauaaacgguuuguaugcaaacauaguaugguagauagagguugggguaacgguuguggacuauucgguaaaggggguauaguaacaugcgcaauguuuacgugcaagaaaaauauggagggaaaagucguacuaccagaaaaucuagaauacaccauagugauaaccccucacucgggagaagaacaugcaguagggaacgacacggggaaacacgggaaagaaauaaaaauaacaccacagagcagcauaacggaagcugaauugacuggauacggcacugucacaauggaauguaguccgcgaacuggacuugacuucaaugagaugguacuccugcaaauggaagacaaagcauggcuaguucaccgucaaugguuuuuagacuuaccuuuaccuuggcuacccggugcggauacucaagguagcaauuggauucaaaaggagacgcuaguaacuuucaaaaauccucaugccaagaaacaggauguaguaguauugggaagccaagaaggagcgaugcauacagcucuaacaggggcuacagaaauacagaugucuucgggaaauuugcuguucacgggucaucuuaaaugccgacucaggauggacaaacuacaguuaaaagguauguccuauucuauguguacagguaaguucaaaauaguaaaagaaauagcagagacacagcacggaacaauuguaauaagaguucaauaugaaggagaugggucgccaugcaaaaucccuuuugagauaauggacuuagaaaagagacacguucuaggucgucuaaucacugucaaccccauagugacagaaaaagauucaccgguaaauauagaagcagaaccuccuuucggagauucauauauaauaauuggagucgaaccggggcaauuaaagcuaaacugguuuaaaaaggggucgucaauaggacaaauguucgaaacgaccaugcgaggcgccaaaagaauggcuauccugggcgauaccgcaugggacuuuggaucauuaggaggugucuuuacaaguauagguaaggcauuacaucaaguauuuggagcaaucuacggagcgguauuuucagguguaucauggacuaugaaaauacucauaggcguaauaauuacuuggauaggaaugaacaguagaucuacaucguugaguguuucauuagucuuaguuggcguuguaacccuauaccuuggugcaaugguacaggcagacagcgguugugucguauccuggaagucaaaagaacuaaagugugguuccggaauauucaucacugauaauguacauacauggacggagcaauacaaguuccagccugaaagcccgucgaaacuugcaagcgcaauacaaaaagcacaugaagagggaaucugcgguauuaggagugucacgagauuggaaaacuuaauguggaaacaaauaacaccugagcuaaaccauauacuuagcgaaaaugaagugaaauugacuaucaugacaggggauauaaaagggauaaugcaagcagguaaaaggucucuaaggccccaaccaacggaauuaaaauacaguuggaaaacauggggaaaagcgaaaaugcuaucuacugagucccauaaucaaacauuuuugaucgauggaccagaaacagcagaaugcccaaacacuaauagagcuuggaacagcuuagaagucgaagacuacggcuucgggguauuuacgacgaauauauggcuaaaacugagagagaaacaagauguauuuugugauaguaaacuuaugagugcggcaauaaaggauaaucgagcugugcacgcugauauggguuauuggauugaaucggcacugaacgauacauggaaaauggagaaggcgaguuucauugaagugaagucaugucacuggccuaaaucacacacccuaugguccaacggaguuuuagaguccgagaugauaauuccuaagaauuuugcaggacccguuagccaacauaacuaucgcccugguuaccauacacaaacugcugguccauggcacuuaggcaaacuggaaauggacuuugauuucugcgaaggaacaaccguuguuguaacagaggacuguggaaauagggguccaagucuaaggacaacuacggccucaggaaaauuaauuacagaauggugcuguagauccuguacauugccaccguuacgguauaggggagaagauggaugcugguacggaauggaaauucgacccuuaaaagagaaggaagagaaccuaguuaacaguuuagugaccgcaggacauggacagauugauaacuuuucauuggguguucucgguauggcgcuuuuucuagaagaaauguugagaacaaggguugggacgaaacaugcuaucuugcuagucgcugucucauuuguuacacuaaucaccggcaacaugucuuuucgagaccuagggagaguaaugguuaugguuggcgcuacaaugacagacgacauaggaaugggaguuacguaccuagcucuacuagcagcauucaaggugcgacccaccuuugcggccggccuauuguuaagaaaacuaaccucaaaggaacugaugauggcuaccaucggaauagcccuauuaagucaaucaacgauaccggagacaauauuagaacucaccgaugcucuagcguuagguaugaugguguuaaagauagugagaaacauggaaaaauaucaacuagcugucacaaucauggcgauaucaugcgucccaaacgcuguaauauuacaaaaugcauggaaaguaucuuguaccauacuagcggcaguguccguaucaccuuuacuucuuaccucaucacaacaaaaagcagauuggaucccuuuagcuuugacaauuaaaggacuuaacccaacugcgauauuucuaacaaccuugaguagaacaaguaagaaaagaaguuggccauugaacgaagccauaauggcuguagggaugguuagcaucuuagcaaguucacuccuuaagaaugauauaccaaugacuggaccucucgucgcugggggacuccuaacgguaugcuacguguuaacaggacgaagugcagauuuagaauuagaaagagcugcugacgucaaaugggaagaccaagcugagauauccggaaguaguccaaucuuaucuauuacgaucucugaggacgguucgaugucaaucaaaaacgaagaggaagaacaaacgcucacaaucuuaauacggacaggauuauuggugauaucaggcgucuuuccggucaguauacccauuacagcggccgcaugguauuuaugggaggucaagaaacaaagagcagggguacuaugggauguaccauccccacccccaguagguaaagcagaacuagaagacggagcuuauagaauaaaacaaagaggcauauuaggauauucccaaauuggugcgggaguauacaaagaaggaacauuccauaccauguggcauguaacacgaggcgccgucuuaaugcauaggggcaaaaggauugaaccaagcugggcagauguuaaaaaggacuugauuaguuacggcggugguuggaaacuugaaggcgaauggaaagaaggugaagaaguacaaguacuagcucuagaaccugguaagaauccucgugcaguucaaacuaaaccagguuuauucaaaacaaauacggguacaauuggcgccguuucacuagacuuuuccccagggacgucuggaaguccaaucgucgacagaaaagggaagguagucggacuauacggcaauggagugguaacuaggaguggagccuauguuuccgcuauagcacagacugagaaaagcauagaggauaacccugaaauagaagacgacaucuuucgaaagaaaagacucacuauuauggaucuacacccaggugccgguaaaacuaaacguuauuugccagcgaucguaagggaggccauaaaaagaggauuaagaacucuuauacuugcacccacgagaguaguggccgccgaaauggaagaagcauugaggggacuaccaauuagguaucaaaccccugcaauacgcgccgagcacacaggucgugagaucguggaucuuaugugccaugcaacguuuacaaugagauuacugucgccaguccgcgugccaaauuauaaccuaauaaucauggacgaagcgcacuuuacugacccugcaaguaucgcugcgagagguuacauaucuacacggguggaaaugggagaggcggcugguaucuuuaugacggcgaccccuccgggaucgagagauccauuuccucagaguaacgcgccgauaauggacgaggaaagagagauucccgaacgaaguuggaauaguggucaugaauggguaacggacuucaaaggaaagacuguaugguucguuccgaguaucaaggcagguaacgauauugccgccuguuuaaggaaaaaugguaagaaagugauucaacugagccgaaaaacguucgauucggaguauguaaaaacucgcgcuaacgauugggacuuuguagucacgacugacauuagcgaaaugggcgcaaauuuuaaggcagaaagagugaucgauccccgcagauguaugaaaccagugauccuaacugauggugaagaaagaguuauacuagccggacccaugccgguaacucacucaagugcagcacaacgucguggcagaauugguagaaauccuaaaaaugagaacgaucaguacauauauaugggagaaccccuagagaacgacgaagauugugcccacuggaaagaggcuaaaaugcugcuagauaauauaaacacuccugaaggaauuauaccaaguauguuugagccagaaagagaaaaaguagaugcuauagacggagaauacagacuaaggggagaagcuagaaaaacuuuuguggaucucaugcgcagaggagaucucccaguaugguuagccuaccggguagcagcagaagggauaaauuacgcagauagaagaugguguuucgauggaauuaaaaauaaucaaauucuagaggaaaaugucgagguagaaauauggacaaaggaaggugaacggaagaaauuaaagccaagauggcucgacgcgagaauauauagcgacccacuggccuuaaaagaguucaaagaauuugcugcaggaagaaaaucucuaacguuaaauuuaauuacggagauggguagacugcccacauuuaugacacaaaaagcaagggaugcacuugacaauuuggcuguccuacauacagcagaagccgguggacgagccuacaaucaugcuuugagugaacuccccgaaacauuggaaaccuuacuguuauuaacauuacuagcuaccguaacaggagggauuuucuuauuucucaugagugguaaagguaucggaaaaaugacucucggaauguguugcauaauaacagcuaguauccugcuaugguaugcacaaauucaaccacacuggauagcagcaucaauuauucuagaguuuuuccuaauaguuuuauuaaucccagaaccagagaaacaacgcacaccacaagacaaccaacuaacuuauguuguuauugccauacuaacaguaguagcagcaacaauggcaaaugaaauggguuuccuagaaaagaccaagaaagaucugggacuaggcucaaccaccacucaagaguccgagucaaacauauuggauaucgauuugcggcccgcaagugcguggacuuuauacgcuguagcgacuacauuuguaacuccaaugcucaggcauuccaucgaaaauucaucuguuaacguaucgcugacagcaauagcaaaccaagcuacugugcuaauggggcuuggaaaaggauggccacuaagcaaaauggauauuggaguuccuuuacuagcaauaggauguuacagucaaguuaauccgauaacucuuaccgcggcccuacuauuguuaguugcucacuaugcaaucauaggcccaggacuucaggcgaaagcuacacgggaagcacagaaaagagcugcagcggggauaaugaaaaauccaacaguagauggaaucacagugauugaccuggaaccuaucccuuacgacccaaaauucgaaaaacaguuagggcagguaaugcuucuaauuuuguguguuacacaaguucugaugaugagaacaacaugggcucuuugcgaagcccuuacacuugcgacuggacccauaaguacccuuugggaggguaacccuggccgguuuuggaauaccacgauagcugucucuauggcaaacauauuucgugggaguuacuuagcuggugccggcuuacuauucucaaucaugaaaaauacaaccaauacgcgaagaggaacugggaauauaggagagacuuugggugaaaaauggaagaguagacuaaaugcacugggaaaaucagaguuucaaauauauaaaaagucagggauucaggaaguugacaggacucuggcgaaagaaggaauaaaacgcggggagacagaucaucacgccguuagucguggaucggcuaaauuacguugguucguggagagaaacaugguuacucccgaaggaaaaguaguggaucuggguuguggaagaggugguugguccuauuauugcgguggcuuaaagaacgugagagaggugaaagguuuaacuaaaggagguccuggacacgaagaaccaauaccaaugucuacauacggcuggaaucuggugaggcuacagucuggagucgauguuuucuucacuccaccugaaaaaugugauaccuuauuaugcgauauaggggaaagcagcccgaauccaaccauugaagcugggcgcacacuaaggguauugaauuuagucgagaauuggcuaaauaauaacacccaauucuguauaaagguucuuaauccauauaugccauccguaaucgagaaaauggaaacacuccaacgaaaauauggaggugcucuuguucgaaauccucucucccgaaauucaacucacgaaauguauuggguuagcaaugcuacuggaaacauuguaucaacuguaaauaugauaucaagaaugcucaucaauagauuuaccaugaaacauaagaaagcuacauacgaaccagauguagaccuagguagcggaacaagaaacaucggcauagaaagcgaaauaccaaaucuagacaucauagguaaaagaauagagaaaauaaagcaggaacaugaaacaagcuggcacuacgaccaagaccauccauacaagacaugggcguaccauggcaguuaugaaacaaaacaaacaggcagcgcaucgucaaugguaaaugguguaguacgucucuuaacuaaaccuugggacguaguucccauggucacccaaauggcaaugacagauacaacaccauucggacaacaacgaguuuuuaaagaaaaaguagacaccagaacacaagagccuaaggagggaacuaagaaacuuaugaaaauaacugcagagugguuauggaaggaauuggguaagaagaaaacucccaggauguguacgagagaggaguucacacgaaaggucagaaguaaugcugccuuaggggcuauauuuacggaugaaaauaaauggaaaucggcacgcgaggcagucgaagauucaagauuuugggaguuaauagaucgggagcgaaauuuacaucucgaaggaaaaugugaaaccugugucuauaacaugauggguaaacgugaaaagaaacuaggagaguuuggaaaagcaaaaggauccagagcgaucugguauauguggcuuggagcuagauuccucgaauuugaagcacugggauuccuaaacgaggaucauugguuuucgagagguaacagcuuaagugggguagaaggugaaggccuccaucgccuuggauacauacuacgagauguaaguaagaaagaaggaggggccauguacgcagacgauaccgcaggaugggauaccagaauaacguuggaagauuuaaagaaugaagagauggucaccaaccauaugaagggagaacauaagaaacuagcagaagcgauauucaaacuaacuuaucaaaauaaagucguuaggguacaacgaccaaccccaagggggaccguaauggauauaauuagccgacgagaucaaaggggauccggacaaguaggcacguauggacuaaauacuuuuaccaauauggaggcucaauuaauaaggcaaauggaaggcgagggaauuuucaaaucuauacaacaccugacaguaacugaggaaauagcaguacagaacuggcuugcccguguaggccgagaacgucuuagccgaauggcaauuagcggagaugacuguguaguaaaaccacuagaugaucgauucgcuucagcacuuaccgcacuaaaugauauggguaaaguucgcaaagacauccaacaaugggaaccgaguagagguuggaaugauuggacucaaguuccauucugcucacaucauuuucaugaguuggucaugaaagacggacguguccuagucguaccgugccgaaaucaggaugagcuuauaggaagggcgagaaucucucagggcgcaggauggucccuaaaagaaacagcuugucuagggaaaucguaugcacaaauguggacauuaauguacuuccauagacgggacuugcggcuagcagcgaacgcaauuuguucagcaguaccaucgcauuggguaccgacauccagaacgacauggagcauacacgcaaaacaugaauggaugacgacugaagauauguuagcaguauggaaucgaguuuggauucaagagaaccccuggauggaagauaaaacaccaguagaaagcugggaagaagucccauaucuagguaagcgagaagaucaauggugcggaaguuuaaucgggcuuacgucgcgugcgacaugggccaaaaauauccaaaccgcuauaaaucaaguuagaucccucauaggaaacgaagaguacacagacuauaugccgucaaugaaacgauuuaggcgcgaagaagaggaagcaggaguauuaugguaa

SEQ ID NO: 22556 - RNA, 9876 nt, Artificial Sequence
  derived and/or modified CDS sequence (opt6) from DENV-2__EU482583__SS-prME
acagcuggcguaauaauuaugcuaaucccgacagcaauggcuuuccauuuaaccacucgaaacggugaaccgcauaugauaguuggucgccaagaaaaaggaaaaucgcuauuauucaaaaccgaagauggaguaaauauguguacgcuaauggcaauagaucuaggagaauuaugcgaagauacuauuacauacaaauguccacuacuucgacaaaacgaaccagaagacauugauuguugguguaauaguaccucaacauggguaacauacggaacaugcaccacaacaggugaacaccgcagagaaaaacguagcgucgcauuaguaccacacguggggaugggucuggaaacucgcacggaaacuuggaugucaagugaaggagcauggaaacauguacaacgaauugaaacauggauacuaagacauccgggcuucacaauaauggcagcgauucuagcauacacuauagguaccacccauuuccaaagagcuuuaauauucauacuucucacugcaguugcacccagcaugacaaugcgauguauaggcauauccaacagagauuucguggaaggaguuucuggaggaucuuggguugauauaguauuagaacacggauccugcguaacuacuauggcgaaaaauaaaccaacgcuagauuuugaacuuauuaaaaccgaagcaaaacaaccagcaacucuaagaaaauauuguauugaagcgaaacuaacaaauacgacaacggagucgagaugcccaacacagggcgaaccgagucuaaaugaagaacaagacaaaagguucguuuguaaacauucaaugguagaccgaggauggggaaauggcuguggauuguuuggaaaagguggaaucguaacaugcgcuauguucacuugcaagaaaaauauggaaggaaaaguugugcuuccagaaaauuuggaauauacaauagucauaacgccacacucuggugaggagcaugcggucgguaacgacacuggaaaacaugggaaagaaauuaaaaucacaccccaaucaaguauaacugaagcggaguuaacugguuacggaacgguaacgauggaaugcucgccaagaacaggauuagacuucaacgaaaugguucuacuacaaauggaagacaaagcguggcuaguacaucgacagugguuucuugacuuaccguugccaugguuaccaggagcggauacucaggguucaaauuggauccagaaagagaccuugguaacauucaaaaauccacaugccaagaaacaagauguugucgucuuaggaagucaagaaggugcuaugcacaccgcgcuaacaggcgcuacagaaauucaaaugucuucgggaaaccuguuauucaccggacaucugaaaugucgauuaagaauggauaaauuacaacuuaaaggcaugucuuauucgauguguacaggcaaauuuaaaaucguaaaagagauagcggaaacucagcacggcacaauaguaaucaggguacaauacgaaggagacgguucucccugcaaaauuccauucgaaaucauggauuuagagaaaagacauguuuugggacgauuaaucacagugaauccgaucguaacugagaaagauuccccugucaacauugaagcagaaccgcccuuuggcgacucuuauauaauaauaggaguagaaccgggacaauuaaaacuaaacugguucaagaaaggcagcaguaucggccaaauguucgaaacgacaaugcgcggagcuaaacgaauggcaauuuuaggagauacugccugggauuucggauccuuaggaggcguauucacuucaauuggaaaggcccuccaccaggucuuuggugcaauauacggcgcugccuucucgggugucucguggacaaugaaaaucuuaauaggugugauaauaaccuggauaggcaugaacaguaggaguacaagucuuagugugaguuuaguccuaguagggguaguaacgcuuuacuugggagcaaugguucaagcggauuccggcugugucgucagcuggaaaaauaaggaauugaaauguggaucagguaucuuuauaacagacaaugugcacacauggacagaacaguauaaguuucaaccugagaguccuaguaaacuagcaucggcaauucagaaagcacaugaggaggguauuugcggcauucgaucaguaacaagauuggaaaauuuaauguggaagcaaauuaccccugaacuaaaccacauuuugucggagaacgaaguaaaacuuacaaucaugacaggugacauaaaaggaauaaugcaagcaggcaaaagaaguuugcguccacaacccacagagcuaaaauauucuuggaagaccuggggaaaagccaagauguuaucgacugaaucacacaaccaaacauuuuuaauugauggaccagaaacagcagaaugcccaaauacaaacagagcuuggaacucacuggaaguugaagauuauggcuuuggagucuuuacaacaaauauuuggcucaaauuaagggaaaagcaggauguguuuugugauucuaaacuaaugucagcagcaauaaaagacaacagagcgguacaugccgauaugggcuauuggauagaauccgcuuuaaacgauaccuggaaaauggaaaaagcaucauuuaucgaaguuaaaucgugccauuggccuaaaucacacacccuuugguccaauggagugcuugaaagugaaaugauaauccccaaaaacuucgcuggacccguaagccaacauaacuauagaccaggauaucauacgcaaacagcagggccuuggcauuugggaaaacuagaaauggauuuugauuuuugugaaggcaccaccguuguggugaccgaggauugcggaaauagagggccaaguuuaagaacgacaacugcgucagguaaacucauaacugaauggugcugucgaaguuguacucucccacccuugcgauaucggggagaagauggcuguugguauggcauggagauaagaccucucaaggaaaaagaggagaacuuaguuaacucccuaguaacugcggggcacggucaaauugauaauuuuucucuaggugucuugggaauggcucuauuucuugaagaaaugcuacgaacgcgugucggaaccaaacacgcuaucuugcuaguugcaguaaguuuuguuacauugauaacugguaacauguccuuucgugauuuaggaaggguaaugguuaugguaggggcuacaaugacagacgacauaggaaugggaguuacuuacuuggcucuacuugcggcauuuaaagugaggccuacauuugcugcagggcuucuuuuacgcaaauuaacaucaaaagaacuaaugauggcuacgaucggcauagcuuuacuaucacaaucuaccauaccggaaaccauacuagaacuuacagacgcccuagcuuugggcaugaugguucuuaaaauagugagaaauauggaaaaauaccaacuagcuguuacgauaauggcgauaucuuguguaccuaaugcagucauucuacaaaacgcuuggaaagugucaugcacgauucuugccgcuguaagcguaaguccacuauuacuaacaucaagucaacaaaaggcagauuggauuccgcuagcacucaccauaaaaggucuaaauccaacggcaauauucuuaaccacauuaucccguacaaguaagaagagaagcuggccauuaaaugaagccauuauggcaguugguauggucaguauucuugcauccucauugcugaaaaaugacaucccaaugacagguccgcugguugcgggaggauuacuaacaguguguuacguuuugaccggaagaagugcggaccuagaguuagaaagagcugcugaugugaaaugggaagaccaagccgaaauaucuggaucaagucccauacuaaguauaaccauuucggaggacgggaguaugucgaucaaaaacgaagaagaggagcaaacacuuacuauauugauacgcacugggcuauuggugauuagugggguuuuuccaguuucaauaccaauaacagccgcagcuugguaucucugggagguuaagaaacagcgggcuggaguuuuaugggacguuccaucaccaccucccguugggaaagcagaacuggaagauggggcguaccggaucaaacagcguggaauauuggguuacucgcaaaucggggccggagucuauaaggaaggcacuuuucacacgauguggcauguaacaagaggugcaguccuaaugcacagaggaaaacgaaucgaaccaaguugggcugacgucaagaaagacuugauaagcuacgggggaggauggaaacuugaaggugaguggaaggaaggggaggaggugcaggucuuagcccuagaaccagguaaaaaccccagagcaguucaaaccaagccuggacuuuucaaaacgaauacggguacaaucggugcuguuucccuagacuuuagcccaggaacuucagguaguccaauuguagauagaaagggaaagguuguaggucuauaugguaauggcgugguuacgaggucuggggcuuacgugucagcuauagcucaaaccgaaaagucaaucgaagauaacccggagauagaagaugacauauuucgaaagaagagauugacaauuauggaucugcacccaggggcugguaaaacaaaacgcuaccuuccagccauaguucgagaagcaauaaagagaggauuacgaaccuugauacuagccccuacccgcgugguagcugcugaaauggaagaggcauugcgugggcuaccuauaagauaccaaacaccggcuauccgcgccgagcauacaggacgagaaauuguggauuuaaugugccacgcuacauuuaccaugagauuguuaaguccgguaagagugccuaacuacaacuugauaauuauggacgaagcacauuucaccgacccugcguccauugcggcuagaggauauauaaguacccguguugaaaugggagaagcugccggaauauucaugacagcaacacccccggguucuagagacccauucccccaauccaaugcaccaauaauggaugaagaacgagaaaucccggaaagaaguuggaacucgggacaugaaugggucacggauuuuaaaggaaaaacugucugguucguuccauccauaaaagcugguaaugauauagcagcguguuuaaggaaaaaugggaagaaagucauccaacuaucaagaaaaacguucgaugccgaauauguuaagacaagagcgaaugauugggauuuuguuguaacaacagacauuucagagaugggugcaaauuucaaagcagaacgaguaauagauccucguagguguaugaagccgguaauucuaaccgauggggaagaacgcguaauuuuagcagguccgaugccaguuacucauucaucagcagcacaacggcgaggcagaauaggacguaauccaaagaaugaaaaugaccaauacauuuacaugggggaaccccuagagaacgaugaggacugugcucauuggaaagaggcgaaaaugcuucuagauaauaucaacaccccugaagggauaauaccauccauguuugaaccugaacgagagaaaguggaugcaauugacggcgaauauagacugcgaggggaagcgcggaaaacauucguagaucuaaugagaaggggagacuuaccuguuugguuagcauauagaguggcugcugaaggaaucaauuaugcagacaggcgguggugcuucgauggcaucaaaaacaaucaaauucuugaggagaauguagagguggaaauauggacuaaggaaggugagaggaagaaacucaaaccuagguggcucgacgcucgaauuuacuccgauccuuuggcuuugaaagaguucaaagaauuugcagcaggacggaaaagccugacauuaaaucuaauaacggaaauggggagauuaccaacauuuaugacacaaaaagcucgagaugcauuagacaaucuggccguacuacacacagcggaggcgggcggacgcgcuuauaaccacgccuuauccgaauuaccagagacauuagaaacacugcuauuacuuacauuacuggcuacaguuacgggcggaauuuuucucuuccuaaugucaggaaaagguauagguaaaaugacucuggguaugugcuguauuauaacagccuccauucuucuuugguaugcucaaauucaaccucacuggauagccgcaaguauaauauuagaguucuuccuaaucguauuacucauaccagaacccgaaaagcaacgaacuccacaagauaaccaacucacauauguagugauagccauauuaacuguaguugcugcaacuauggcaaaugaaauggguuuccuagagaagacuaagaaagaucuuggguugggaagcauuacuacgcaagaaucagaaucgaacauauuagauauagacuuaagaccagcaucugcuuggacauuauacgcaguagccacuacauuuguaacaccuauguuaaggcauucaauagaaaauucaagcguuaauguaucuuuaacugcaauagcaaaucaagcgacgguauuaaugggccuggguaaaggguggccuuuaucaaaaauggauaucggcguuccacucuuagcaaucggauguuauucgcaaguaaauccaaucacccuuaccgcagcguuauuauuauuaguagcacacuaugcgauuauaggaccgggacuacaagccaaagcaacacgugaagcccaaaagcgugcggccgcggggaucaugaaaaauccaaccguugauggaauaaccgugauagaucuggaaccaauuccauacgacccaaaauuugaaaaacaauuaggucagguuaugcuuuuaauauuauguguaacucaaguucuuaugaugagaacgaccugggcgcuaugugaggcgcuuacauuagcaaccggacccauaagcacacuaugggaaggaaacccgggccgauucuggaauacaacuauugcuguaaguauggcaaacauuuuuagaggaaguuauuuagccggagccggccuauuauuuaguauaaugaaaaacaccacuaauacgagaagagggacaggaaauaucggagaaacuuuaggagagaaauggaaaucacgccugaaugcacuggguaagagcgaauuucagauauauaagaaaagcgggauacaagaaguagaucgaacccuggccaaggaggguaucaaacguggggagacggaucaccacgcuguuaguagaggaagugcaaaauuaagaugguuuguagaacgcaacaugguaaccccggaggguaaggucguagaccucgguugcgggaggggagguuggagcuauuauuguggaggcuuaaagaaugugagagaggucaaagggcugacuaaaggaggaccagggcacgaggaaccaaucccuaugaguacauacgguuggaauuuaguuaggcuucagagugguguggacguauuuuucacaccaccagaaaaaugugauacacuuuuaugugacauaggcgaaagcaguccaaacccuacaauagaggcagguagaacccuaagaguacugaacuuaguagagaauuggcuaaauaauaacacgcaauucugcauaaaaguacucaacccauauaugccgucagugauagagaagauggagacgcuacaaagaaaauauggaggugcauuaguacguaauccguugagccgcaauucuacgcacgaaauguauuggguauccaacgccacaggaaauauuguuucaagcguaaacaugauaucuagaauguugauuaaucguuucacaaugaaacacaaaaaggcaacuuaugaacccgauguagaucuaggcucagggacucgaaacaucggaaucgagucugagauuccgaaucuagacauaauaggaaaaagaaucgagaaaauaaaacaagaacaugaaacaaguuggcauuaugaucaagaucauccuuacaagacgugggcauaccaugguucuuaugaaacaaagcaaacuggaagugcaagcucaaugguuaacgggguaguucgauuguuaaccaagccgugggacgugguacccaugguaacacagauggcuaugacagauaccacccccuucgggcaacagcguguauuuaaagaaaaaguagacacgcgcacacaagaaccgaaagaagguacuaagaaauuaaugaaaauaacugcggaaugguuguggaaagaauuagggaaaaagaaaacaccaagaauguguacgagagaagaguucacucgaaaaguucguuccaacgcagcucuaggagcgaucuucacagaugaaaauaaauggaaaucggcaagagaagccgucgaagauucaagauucugggaauuaauagauagagaaagaaacuuacauuuggaagguaaaugugaaacaugcguuuauaauaugaugggaaaacgcgagaagaaacuuggcgaauuugguaaagcgaaagguucaagagcaauaugguauauguggcugggggcuagguucuuggaguucgaagcccuaggguuucuuaacgaagaucacugguucaguagaggcaacucgcuuucagguguggaaggugagggguuacauagacuaggauacauauuaagggauguaucgaaaaaggaaggcggugcuauguaugcggaugauacugcgggaugggauacacguauaacacuagaggaucucaaaaaugaagaaauggugacuaaccacaugaagggagagcacaagaaauuagccgaggcuauuuucaaacuuaccuaccaaaauaaaguuguacguguacaacgaccaacaccgagggggacaguuauggacauaauaucuagaagggaccaacgagggucgggacaaguggguacuuauggauuaaauacauucaccaacauggaagcacaacuuauaagacaaauggaaggcgaaggaauauucaagucgauacaacaccuaacaguuacugaagaaaucgcgguucaaaauuggcuagcuagagucggacgcgaaaggcuguccaggauggcaauuucuggagacgacuguguagucaagccauuggaugaucgauuugcgagugcgcuuacagcacuaaaugauauggggaaaguccggaaagauauucaacaaugggagcccaguagaggauggaacgauuggacacaaguaccuuuuuguagucaccauuuucaugaacugguaaugaaagaugguaggguauugguugugccauguagaaaucaagaugaauuaauuggccgagcucggaucagccaaggagcugguuggucuuugaaagagacagccuguuuaggcaaaaguuaugcacaaauguggacgcuaauguauuuucacagaagagauuuaagacuagcggcuaaugcuaucuguagugcgguuccuagucacuggguaccaaccagccggacaaccuggucgauucacgcaaaacaugaguggaugaccacugaagauauguuagccgucuggaaccgcguauggauucaagaaaacccguggauggaagauaaaacaccugucgaaucuugggaggagguaccauauuuagguaaacgagaagaccaauggugcgguaguuuaauugguuuaacuagcagagcaacaugggccaaaaauauacaaacugccauaaaccaaguacggagucucaucgguaaugaagaauauacagacuauaugccaucgaugaaacgcuuccgacgugaagaagaggaagccgguguauuaugguaa

SEQ ID NO: 22557 - RNA, 9876 nt, Artificial Sequence
  derived and/or modified CDS sequence (opt6) from DENV-2__EU482585__SS-prME
accgcugggguaauaauaaugcuaauuccuaccgcuauagcguuucaucuaacuacaagaaauggagaaccucacaugauugucggaaggcaagaaaaagguaagucauuauuauucaaaacggaagauggagugaacauguguacgcucauggcaaucgacuuaggagaauugugcgaagauacaauaacauacaagugcccucuacuaagacaaaacgaaccugaggauauagauuguuggugcaauucaacaaguacauggguaacauacggaacauguacgacaacaggagaacacaggcgggaaaagcgcucuguagcauuagugccgcauguggggauggggcuagaaacaagaacugaaacuuggauguccucugagggggcuuggaaacacguacagcgaauugaaacguggauuuugagacauccuggguuuacuauuauggcugcgauccuagcuuauacuauaggaacuacacacuuccagcgagcacuaaucuucauucuauuaacagcuguugcucccagcaugacgaugcgauguauuggaauuucuaaccgugacuuugucgaaggcguaucaggaggguccuggguagauaucguauuggaacaugguucgugcguuacaacuauggcaaaaaauaaaccuacacuugauuuugaauuaauaaaaacggaagcaaagcaaccagcuacauuaagaaaauacuguauagaggcaaaauuaacgaauacgacuacggaaucucgcugcccaacgcagggugaacccaguuuaaaugaagaacaggauaaacgauucguuuguaaacacucaaugguugaccgagguuggggcaacgguugcggacuauucggaaaaggaggaauuguuaccugcgcaauguucacuuguaagaaaaacauggaaggaaaaguaguucuuccggaaaacuuggaauauacaauaguaauuacaccacauucaggcgaagaacacgcgguaggaaacgacaccggcaagcacgggaaggaaauaaaaaucaccccccaauccaguauuacagaagcggaguugacuggcuacgggacaguuacgauggaauguagcccaagaacuggacuagacuuuaacgaaaugguauuguuacaaauggaagauaaagcauggcuuguucacagacaaugguucuuagaccuaccacucccaugguuacccggcgcagauacccaaggcucaaauuggauacaaaaggagacguuaguaacuuuuaagaacccgcaugccaaaaaacaggaugugguaguucugggaagccaagaaggugcuaugcacacugccuugaccggcgcaaccgaaauacagaugucuucaggaaaccuacuguucaccggucaccugaaaugcagacuacgaauggauaaacuucagcugaaaggaaugucauacaguaugugcacaggcaaguucaagauaguuaaagagauugcagaaacccaacauggcacaauaguaaucagaguucaguaugagggcgacgguagcccuugcaaaauucccuuugaaauuauggauuuggaaaagcgacacguauuaggaaggcuaauaacagugaauccuauagugacggaaaaagacaguccgguaaauauagaagcagaaccgcccuuuggagacucuuauauuauuauaggggucgaaccaggucaacuuaaacucaauugguuuaaaaaggguagcucaaucggacaaauguucgaaacuaccaugagaggagcaaaacgaauggcgauucucggugacacugccugggauuuuggaucauuagguggaguuuuuaccaguauaggaaaagcguugcaucaaguauucggagcaauauauggcgcugccuucucuggaguaaguuggacuaugaaaauuuuaauugggguaauuauaacauggauuggcaugaacuccaggagcacuucccuaucgguaagccuaguucuaguaggaguaguaacccuauaucuaggagcaaugguacaagcugauuccggcugcguaguaucguggaagaguaaagaacuaaaaugugguuccggaauauucauaacugauaacguacauaccuggacagagcaauauaaauuucaaccagaauccccgucaaaacucgcaucugcuauucaaaaagcacaugaagaaggaauaugcggaauuaggucagugacaagacuugaaaaccuuauguggaaacaaauaacucccgaacucaaccauauauuaucagaaaaugaagugaaacuuaccauuaugacaggcggaauuaaaggaauuaugcaagccgguaagcgaagucuacgcccucagccgacagaacuuaaguauucguggaagacuugggguaaggcaaaaauguuaucgacugagagccacaaucagacuuuucuuauagacgguccagaaacagccgaauguccuaauacuaauagggcuuggaauucucuagaggucgaagacuauggauuuggaguguucacaacaaauauauggcuaaaauuacgugaaaaacaagauguuuucugugauucuaaacuaaugagugcagcaauaaaagacaacagagcgguccaugcggauauggguuauuggauagagagcgcccugaacgacaccuggaagauggagaaagcauccuuuauugagguuaagaguugucauuggccgaagagucacacguuauggucaaaugguguauuggaaucggagauggucauaccuaaaaauuuugcaggaccggugagucagcauaacuaccggccuggguaucauacucaaaccgcuggcccauggcaccucggaaagcucgaaauggauuuugauuuuugugaagggaccaccgugguaguuacagaagauuguggcaauagggggccaucacugagaacaaccaccgcuaguggaaaauuaauaacagaaugguguuguaggaguuguacacucccaccauugcguuacagaggcgaagauggaugcugguauggcauggaaauucguccguuaaaggaaaaggaagaaaacuuaguuaacagucucgugacagcuggacauggucaaauagauaauuuuucuuuaggaguuuuaggaauggcacuguuucuggaggagaugcuacgaacacgaguuggaacaaaacacgcgauauuauuaguugcuguaagcuuuguaacguugauaacgggcaacaugaguuucagagaucuugguagaguaaugguuaugguuggagccaccaugacugaugacauagggauggggguaacauaccuugcucugcuagcagcuuuuaaaguaagaccaacauucgccgccggacuauuauuaaggaaauugacaagcaaagagcuaaugauggcaacuauagggauagcguuauuaagucaaucaacgauuccugaaacaauuuuggaacuuacagaugcacuagcacucgggaugaugguacucaaaauaguaagaaacauggaaaaauaucaauuggcagugacuauaauggccauuagcugugucccuaaugcuguaauucuacagaaugcuuggaaagugucuugcacaaucuuggcagcgguaucaguuaguccucuacuacucaccucaucacaacaaaaggcggauuggauaccguuggcacucaccauuaagggacuuaauccuacagccauauuucuaacaacccuaagcaggacuagcaaaaaaaggaguuggccacuuaacgaagcgauaauggcggugggaaugguaaguauacuugcaaguagcuuacuuaaaaaugauauuccuaugacugguccuuuagucgcaggugggcuucuuacaguuuguuauguacuaacgggucguucagcagacuuagagcuagagcgugcggccgacguuaaaugggaagaucaagcggaaauaaguggaucuaguccaauacugaguauaacaauuucagaggacgguucaaugucaaucaaaaaugaagaggaggaacaaacacucacuauacuuauaaggaccggacuauuaguuaucucaggcguauuuccugucucaauaccaauaacugccgccgcgugguaccuaugggaagugaagaaacaacgagccggaguauugugggaugucccaucuccucccccagucggaaaggcagagcuugaagacggugccuauagaauaaaacaaagaggaauuuugggauacagucagauaggugcagggguuuacaaagaagggacauuccacacgauguggcacgucacaagaggagcaguuuugaugcauagaggaaagcgcauagaaccaucuugggcagacgucaaaaaggaccuaaucucuuauggaggugguuggaaguuggagggagaguggaaggagggugaggaaguacaagucuuagcucucgaacccgguaaaaauccaagggccguacaaacaaaaccuggucuauuuaaaaccaacacaggcacgaucggagcaguaucacucgacuucagcccggguacgagcggaagcccuauaguagaucgcaaagguaaaguaguaggucuuuauggaaauggaguugucacaagaucaggagccuauguuagugcaaucgcccaaaccgaaaagaguauugaagauaacccggagauagaagaugacauauuuagaaaaaaaaggcugacuauaauggacuugcacccaggcgcugguaaaacuaaaagauaccuaccugccauaguucgagaggcaauuaagcgaggcuuaagaacacuaauauuagcaccaacaagaguuguggccgcagaaauggaggaagcucucaggggccuaccaauacguuaucaaacaccagccauacgugcagagcauacuggaagagaaauaguugaucuaaugugccaugcaacuuuuacaaugagauuacuuucaccagucagaguaccaaacuauaaucucauaaucauggacgaagcacacuuuacagauccggcuaguauagccgcaagaggauauauaaguacaaggguugaaaugggcgaagccgcaggaauauucaugacggcuacgccuccuggaucgcgcgauccuuuuccacaaucuaaugcaccaauaauggaugaagaaagagaaauaccagagagaucguggaacagcggucaugaauggguaacugacuuuaaggguaaaacaguaugguucguaccaucaaucaaagcugguaaugauauugcugcgugcuugcguaaaaaugguaagaaaguaauacaacuuaguagaaaaacguuugauagcgaauacguaaaaacgagagcuaaugauugggacuuuguaguaaccaccgauaucuccgaaaugggggcaaauuucaaggcagagcgaguaauagacccaagaagaugcaugaaaccaguuauacuaaccgacggcgaagagagggugauucucgcggguccaaugccuguuacacacucaagcgcugcacaacgucgaggucggaucggucgaaacccuaagaacgagaaugaucaguauauuuacaugggugaaccauuagaaaaugacgaggauugugcccauuggaaggaagcuaaaauguuguuagacaauauuaauacucccgaagguauaauuccuaguauguuugagccggaaagagaaaaaguagacgcuauugauggggaguaccgccuucggggugaggcaagaaagacuuuuguagaucuaaugcgaaggggggaucuaccuguuugguuagccuauagaguagcggcugaaggcaucaacuaugcugauaggcgaugguguuuugauggaauaaaaaacaaucaaauuuuagaagaaaacguagagguggaaauauggacaaaagagggggaaagaaagaaauuaaaaccuagaugguuggacgcacgaaucuauucagacccacuugcguugaaagaauuuaaagaauucgcugcaggacggaaaagcuuaacucuaaaccucauaacugaaauggggagauuacccacauuuaugacacaaaaggcucgagacgcuuuagacaaucucgccguuuugcacacugcagaagcuggaggaagagccuauaaccacgcccuaucugagcuaccagaaacauuagaaacauuauuacuauuaacuuuauuagcuacugucacggggggaaucuuuuuguuuuugaugagcgguaaagggauagguaaaaugacuuuaggcauguguuguauaaucacggcuaguauuuugcuaugguaugcgcaaauacaaccacauuggauagcggcaucaaucauauuagaauuuuuucuaaucguacuucuaauaccggaaccagagaaacaacgaacgccgcaagauaaucaauuaacauauguaguaauugcaauacucaccguagucgccgccacuauggcaaaugaaaugggauuucuugagaaaacuaaaaaagaccucggacuggguaguauuacaacucaggagucagaaucgaacauuuuagauauagaucuucgcccagcaucggcauggacguuauaugccguagcaacaacguucguaacaccaauguuaaggcauagcauugaaaauucgaguguaaauguaucacuaacggccaucgcgaaucaagcaacuguauuaaugggccuugguaaagguuggccucuuucaaagauggacauaggugugccccuucuagccaucgguuguuacucucaaguaaacccaauuaccuuaacagcugccuuacuauuacuaguagcgcauuaugccaucauaggacccggcuuacaggcaaaagcaacacgugaagcucagaagcgggccgccgccggcauaaugaaaaauccaacuguagaugguauaacuguaauagauuuagaaccaauuccauaugauccgaaauucgagaaacaacuaggacaagucaugcuauuaauauugugcguuacccaagucuugaugaugcgaaccaccugggcguuaugugaagcauuaacuuuagccaccgggcccauaucuacccucugggaagggaacccggguagauuuuggaacaccacaauagcagucaguauggccaauauuuuucguggcaguuacuuagccggugcgggauuauuauuuucaaucaugaaaaacacuaccaacacucgccgcggaacuggaaacauuggcgaaacauuaggugaaaaauggaaaagccgucuaaaugcauuaggaaagagugaguuccaaauuuauaaaaaaucaggaauucaagagguggacagaaccuuagcaaaagaagggaucaagcggggagagacagaccaucacgcaguuagcaggggcucugcuaaauuacguugguucguugaacguaacauggucacaccggagggaaagguugucgaucucgggugcggacgaggcggcuggaguuauuauugugggggacuaaagaauguaagggaagugaagggacuaacuaaaggcggaccgggacacgaagagccaauaccuaugucuaccuauggauggaaccuaguaagguuacaaucugggguugacguauuuuuuacaccgccggaaaagugcgauacuuuacuaugcgacauuggagaauccucuccuaauccaacuauagaggccgguagaacacuaagaguccuaaaucuugucgaaaacugguuaaacaguaauacucaguucuguauaaaaguacuuaaucccuauaugccuucaguaauugaaaagauggaaacgcuacaaagaaaauacggaggggccuuagugagaaauccuuugagcagaaauucaacucacgaaauguacugggucagcaacgcgacagguaauauaguuucaaguguuaacaugauaagcagaaugcuaauaaaccgauucacgaugaaacacaaaaaagcaacauaugaaccagacguggaucucgguagugggacucguaacauaggaauagaaagugagauuccuaaucuggauauaauaggaaaaagaauugaaaaaauaaaacaagaacacgagacaucauggcauuaugaucaagaccacccguauaaaacaugggcuuaucacggaucauacgaaacuaaacaaaccggaagcgcgucaaguaugguuaacggaguaguuaggcuuuuaacaaaaccaugggacguaguucccaugguuacucaaauggccaugacagacacaacaccuuucggucaacagcgaguguuuaaagaaaagguagacaccagaacucaggaaccuaaggaaggcacgaagaaauuaaugaaaauaacagcagaaugguuguggaaagagcuagggaagaaaaagacaccacguaugugcacuagagaagaguucacaagaaagguaagaucaaacgccgcacuaggugccauauucacugaugagaauaaguggaaaagugcacgcgaagcuguagaagacaguagauuuugggagcucauagaccgugagagaaaucugcauuuagaagguaaaugugaaacgugcguguauaauaugaugggaaagcgggagaaaaaacuuggagaauucgggaaggccaaaggguccagggcaaucugguauauguggcuaggggcaagguuuuuagaauucgaggcgcucggguuccuuaacgaagaccauugguucagccggggcaacucguuauccggaguggaaggggaaggauuacacaggcuuggcuacauuuugagagaugucucuaagaaagaaggcggggcuauguaugcggacgacacagcaggcugggacacacgcauaacacucgaggacuuaaaaaacgaagaaaugguuacuaaccacaugaaaggcgaacacaaaaaauuagcugaagcuaucuucaaauuaacguaucagaauaaaguugugcgaguccagcgcccuacaccccgcgguacuguuauggacauaauuaguaggcgagaccaacgagguaguggccaaguggguacauauggacuuaacacauucacaaacauggaagcacaacuaauccgccagauggaaggugagggaauauuuaaaaguauacaacacuugacaguaacagaagaaaucgcuguucaaaauuggcuugcacggguggguagggaacgucuuucucgaauggcaaucucuggcgaugauugugucguuaaacccuuagaugacagguuugcgucggcucugacggccuuaaaugacauggguaaaguccgaaaggauauacaacaaugggagccuagucgaggcuggaaugauuggacacaagucccauuuuguucgcaccacuuucacgaacuaguuaugaaagauggccgaguccugguagugccuugccgaaaucaagaugaauuaauaggucgagcaagaauaucacagggagcaggauggucauuaaaagagaccgcuuguuuaggcaaaucuuacgcacaaauguggaccuugauguauuuccacaggcgugacuuacgguuagcagcaaacgcaauuuguagugcggugccuucucauuggguuccaacauccagaaccacauggucaauucaugcaaaacaugaguggaugaccacugaagacaugcucgccguauggaaucguguauggauccaagagaaucccuggauggaggauaagacgccaguggagaguugggaagagauaccuuaucugggaaaaagagaggaccaauggugugguucguuaauagguuugacaagucgagcaaccugggcaaagaauauacagacagcaaucaaccaaguuagaagucuuauuggaaaugaggaauauaccgauuauaugccuucaaugaaaagauuucgcagggaggaagaagaagcgggaguuuuaugguga

SEQ ID NO: 22558 - RNA, 9876 nt, Artificial Sequence
  derived and/or modified CDS sequence (opt6) from DENV-2__EU482587__SS-prME
acggcgggaguaauaaucaugcuuauucccacugcaauggcauuucacuuaacuaccaggaacggagaaccacacaugauagugggaagacaagaaaaagguaaaucauuguuauuuaaaaccgaagauggugugaacauguguacccuaauggcuauagacuuaggugaauuaugugaggacaccauuacguauaaaugcccauuacuuagacaaaaugaaccugaagacauagacuguugguguaacucaacaaguaccugggugacauacggcaccuguacaaccacuggagaacaccggcgagagaaacgaucuguggcuuuagucccacaugucggcaugggacuagaaaccagaacugaaacauggauguccucagagggcgcauggaagcauguccaaagaauagaaacguggauauuacgucauccgggauuuacaaucauggccgcaauacuagcuuacacaauuggcacuacacauuuucaacgcgcguugauuuuuauauuacuuacggcuguugcaccgucgaugacuaugagaugcauaggcauaucaaaucgggauuucguggaagguguuucuggagguagcuggguagacauuguuuuagaacauggaaguuguguuacaaccauggcgaaaaauaaaccgacauuggauuuugaguugauaaaaaccgaggcuaaacaaccugcaacacuacguaaguauuguauagaagcaaaacuaacaaacacaacaaccgaaaguagaugcccaacccaaggagaaccaaguuuaaaugaggagcaggacaaaagauucguauguaaacauucuaugguugauaggggauggggcaacggaugcggucuauucgguaagggcggcauaguaaccugugcgauguuuacauguaagaaaaauauggaaggaaaagugguacucccagagaacuuagaauacaccauugugauuacaccacauucgggagaagaacacgcgguaggaaacgauaccgggaaacauggaaaagaaaucaagauaacaccgcaguccucgauaacggaaguggaauuaacaggguaugggacaguaaccauggaauguagcccaaggacuggacuggacuuuaacgaaaugguguuauuacaaauggaagauaaagcaugguuaguacauagacaaugguuucuugauuugccauugccaugguuacccggugcagacacucaagggagcaauuggauucagaaagaaacuuuggucacauucaaaaacccucaugcuaagaagcaggacguaguagugcuaggaagccaagagggggccaugcauaccgcgcuaacaggcgcaaccgagauacagaugucuucagguaacuuacuuuuuacuggucaccuuaaauguagacuacgcauggauaaacuucaauugaaggguaugucuuauagcauguguacaggcaaauucaaaauaguaaaagagauugcggaaacgcaacauggaacgauugucauaagaguacaguaugagggagauggguccccauguaaaauaccauucgagauaauggaccucgaaaaacgacaugugcuaggucgacugauuacgguaaacccuaucguuaccgagaaagacucgccagugaauauagaggcagaaccaccguuuggagauaguuauauaauuauugggguagaaccaggacaauugaaauugaacugguuuaaaaagggaucuucaauuggucaaauguuugaaacgacuaugcgaggagcaaaacguauggcaauacuaggcgacacagcaugggauuucgguucacuuggagggguauuuacaucaauagggaaagcccuucaucaaguauucggugccauuuauggagcggcauucagcggcgugucuuggacuaugaaaauacugauaggggugauaauaacguggauaggcaugaacucaaggucaacaagccuaagcgucagucuaguguuagucggugugguuacucuuuauuugggagcgaugguacaggcagacaguggcugugugguuucguggaagucaagagaguuaaaauguggaucaggcaucuucauuacagauaauguacauacuuggacagagcaauauaaauuccaaccugaaagucccagcaaauuggcaagugcaauccaaaaagcacacgaggaagguauaugcgguauacggucggucaccaggcuggagaaccuaauguggaaacagauaacaccggaacuaaaucacauauuaagcgaaaacgagguaaaguugacuauaaugacuggggauauuaaaggaauuaugcaagcuggcaaacguaguuuaagaccucagccuacagaauuaaaauauucuuggaaaaccuggggaaaagcaaagaugcugaguacugaaagucacaaucgaacauuucuaauagacgguccagagacagcagaauguccuaauacuaacagggcguggaauagcuuagaaguugaggacuacggauuuggaguguuuacuaccaauauaugguugaaacuacgagaaaaacaagauguauucugcgacucaaaguugaugagugcagccauaaaagauaauagggcuguccacgccgacaugggauauuggauagaaagugcacuaaacgauacauggaaaauggaaaaggccucguuuauagaggucaaaucuugucacuggcccaaaucacauacacuauggucaaacggcguucuagaaucggaaaugauaaucccaaagaauuuugcggggccuguaucgcaacauaauuaucgcccgggauaccauacccaaaccgccgguccauggcaucuaggcaaacuugaaauggauuuugacuucugcgaaggaacaacgguaguuguaacugaagacuguggcaacaggggaccgagccucagaaccacaacagcgucggguaaguuaaucacagaaugguguugccggaguugcacuuuacccccauuacguuacagaggugaggauggcuguugguauggaauggagauacggccauuaaaagaaaaggaagaaaaucuaguuaauucauuaguaacugcagggcauggucaaauagacaacuucucauuagguguguugggcauggcacuguuuuuagaagagaugcuaaggacccgggugggcacuaaacaugcaauucucuuaguugcaguaucuuuuguaacccuuauaacaggaaacaugagcuucagagacuuaggucgcgugaugguuauggugggcgcgacgaugaccgacgacauagggaugggcgugacauaucuugcguuacuagcugcguuuaagguucguccaacauuugccgcaggacuccucuuaagaaaauuaacuucgaaagaacuuaugauggcuacaauaggaaucgcccuauuaucccaaaguacaauaccugaaacuauccuagaacuuacagaugcucuggccuugggaaugauggugcuuaaaauagucagaaauauggaaaaauaucaacucgcuguaacuauuauggcuauuucaugcguuccaaaugccguuauuuuacaaaaugccuggaagguauccugcaccauauuagcagcaguaucuguaucaccuuuacugcuaacaaguucucagcaaaaagcagacuggauuccccuugcucugacuauaaaaggucuaaauccuacggcaauuuuccuaacaacacuauccagaaccucuaaaaagcgauccuggccauugaacgaggccauaauggcaguaggcaugguuaguaucuuagcaagcaguuuacuuaaaaaugauauaccuaugacaggaccccuaguugcagggggccuauuaaccguaugcuauguacucacugguagaagugcagaccuugaauuggaaagagcugcagauguuaaaugggaagaucaagccgaaauuucggguucaucgccaauauuaucaauaacgauuagugaagaugguucgaugaguauuaaaaaugaagaagaagaacaaacauuaacaauauuaauucgaacaggucuuuuagucauuucagguguuuucccagucucuaucccaaucacagcugcggcgugguauuuaugggaggucaagaaacaaagggccgguguucugugggaugucccuucgccuccgcccgucgggaaagcggaauuggaagauggagcguauagaauuaaacaaagaggaauauuaggauacucgcagauuggugcgggaguauauaaagaagggacauuucauacaauguggcacguaacgagaggggcuguccuaaugcauaggggaaaacgaauugaaccgucaugggcagaugugaagaaagauuugaucucauacgggggcggcuggaaauuagagggagaauggaaggaaggcgaagaggugcaagugcuagcucuggagccagguaagaacccacgagcaguacaaacaaaaccagggcuauucaaaacuaacacugguacuaucggagcaguaucgcuggacuucaguccugggaccucaggcuccccgauaguugauagaaaaggcaaggugguagguuuauaugguaaugguguuguuacacgcucgggugcauacgucucagcuauagcacaaacugagaaaagcauugaagauaacccagaaauagaagaugacaucuuuaggaagaaacgcuugacuauuauggauuugcacccaggugcaggcaagacaaaacguuacuuaccggcaauuguucgggaagcaaucaaacgagguuuacgcacgcugauauuagcaccuacgagagucguugcggcagagauggaggaagcauuacgaggguuaccuauaagauaucaaacucccgccauucgugcagaacauaccggccgagaaauaguggauuugaugugccacgccacauucaccaugcggcuccucuccccagugagaguaccaaauuacaaccuaauuauuauggaugaagcucacuucacagauccagcaucgaucgcugcaagaggguauauuucgacaaggguagaaaugggugaggcugcaggcauuuuuaugacagcuacaccaccugguucucgagacccuuucccucaaucaaaugcaccaauaauggacgaagaacgugaaauacccgagaggagcuggaacucuggucaugaaugggugaccgacuuuaaagguaaaaccguaugguuuguaccuaguauaaaggcaggcaaugauauagcggcgugccugaggaaaaauggaaagaaaguuauacaauuaaguagaaagaccuucgauucagaguacguaaaaacccgagcuaacgacugggacuucguaguuaccacugauauauccgaaaugggggcuaacuuuaaagcugaacgggugauagauccaagacgauguaugaaaccugugauucucacagauggggaggaaaggguuauccuugcaggaccaaugccaguaacacacagcucggcagcccagagaagaggacgcauagguagaaaccccaaaaacgaaaacgaucaauauauauauaugggagaaccguuggaaaacgacgaggauugcgcucauuggaaagaagcaaagaugcuacuagacaacauaaauaccccagagggcauaaucccaaguauguuugaacccgaacgugaaaaggucgacgccauagacggagaauaccgacuacgaggggaggccagaaagacauuuguagacuuaaugcgacgaggcgacuuaccuguaugguuagcuuauaggguagcagcagaaggaauuaacuacgccgaucgucgauggugcuuugauggcauuaaaaacaaccaaauacuagaagaaaacguggaaguagaaauuuggacuaaggaaggcgaacgaaagaaacucaaaccuagauggcuagacgcuaggauuuacagugacccucuagcacuaaaagaauuuaaagaguucgcagcaggcaggaaaucucuaacauugaaucuaauaacagaaauggggagacuaccaaccuuuaugacccaaaaagcucgagaugcauuggauaauuuagcagucuuacauaccgcagaagcgggagguagagccuauaaccacgcacuaucggaauuaccggaaacacuugaaacauuacuacuucuuacguuacuagcgacaguaacaggggguauauuuuuauuucugaugagcggaaaaggaauaggaaaaaugacacuagguauguguuguauaauuacagcaucuauacuacuaugguaugcacaaauacaaccacauuggaucgcagcgucaauaauacuugaauuuuuccugauaguacuacucauaccugagcccgaaaagcaaagaacgccccaagauaaucaacuuacuuauguuguaauagccauuuuaacaguaguggcugcaacuauggcgaaugaaaugggcuuccuagaaaagacaaagaaagauuuaggauugggaagcauaaccacccaggaauccgaaucaaauauauuggacauagaucuaaggccagccucagccuggacacucuaugccguagccaccacguucguuacccccaugcuaagacauaguaucgaaaauaguucagugaacgucagccugacagcuaucgcaaaucaggcaacuguauuaaugggauugggaaagggauggccacucuccaagauggacauaggcgucccacuacuugccauaggcuguuauagucaagucaaucccauaacacuaacagccgcuuuacucuuguuagucgcccauuacgccauuauaggcccggggcugcaagcuaaagcuacacgcgaagcucagaaaagggcggcugccgguauaaugaagaauccaaccguugauggaauaacaguuauugacuuagaaccaauuccguacgacccaaaauuugagaaacaauugggacaaguuaugcuucugaucuugugcguaacccaagugcucaugaugcgcacaacgugggcacuuugugaagccuugacacuagccacaggacccauaaguacacuaugggaaggaaauccaggaagauuuuggaacacaacaauugcggugucaauggcuaacauauuucgcgguucauaucuugcgggcgccgguuuauuauucucaaucaugaaaaauacuacuaauacaagaaggggcacaggcaauauuggagagacauuaggugaaaaauggaaauccagauuaaaugcauuagguaagucugaguuccaaauauacaagaaaagugggauucaagaagucgauagaaccuuagcgaaggaaggaauaaagcguggcgaaacugaucaucacgcuguaagucguggaucugcaaaauuacguugguuuguggaacguaauaugguuacaccagaagguaaggugguagaucuugguuguggucgagguggcuggucauauuacuguggcggacugaaaaauguucgagaagucaaaggucuaacgaaaggagguccuggucaugaagaaccuauccccaugucaacuuauggauggaaucuagugcguuuacaaucuggcguggacguauucuuuacuccuccagagaaaugcgauacucuucuaugcgacaucggagaaaguucaccaaauccaaccauagaggcaggcagaacacugagagugcucaacuuggucgagaauugguuaaauaauaacacacaauucuguauaaaagugcuaaacccauauaugcccaguguuauugagaaaauggagacucuccaacgaaaauauggaggcgcauuagucagaaacccauugucuagaaauucgacacaugagauguauuggguuucaaaugcgacugggaauauuguaucaaguguaaacaugauaaguagaauguugaucaaucgguuuacuaugaaacauaagaaagcaacuuacgaaccugaugucgaccuaggguccggaacucgcaauauaggaaucgaaucggaaauuccaaaucuugacauaauuggaaaacgaauagagaaaauaaagcaggaacacgaaacaaguuggcacuaugaccaagaccaccccuacaaaacgugggcuuaccacgggaguuacgaaacgaaacaaacugggucagcaaguuccauggucaauggaguaguuaggcuucucacuaagccuugggauguuguaccuauggugacccaaauggccaugacagacacuaccccauuugggcagcagaggguuuuuaaagaaaaagucgauacaagaacacaagaaccgaaggagggaaccaagaaauuaaugaagauaacggcagaaugguuauggaaagaacuugggaaaaagaaaacaccccgaaugugcacgagggaagaguucaccaggaagguucgcuccaaugcugcacugggagcaaucuucacagacgagaacaaauggaagagugcaagggaagcugucgaagauaguagguuuugggaauuaauagaccgggagaggaacuuacaccuugaggguaaaugugaaacauguguauacaacaugaugggcaaacgagagaagaaacuaggagaguuugggaaagccaaagggucacgagcuauaugguacauguggcugggggcccgauuuuuagaguuugaagcacuaggauucuugaaugaagaucauugguucucgcgcgggaauagucuauccggggucgagggcgaaggauuacacagauugggauauauauuaagggacguaucaaagaaagaagguggagcaauguaugcagaugauacagcuggaugggacacacguauaacauuagaagaucuuaaaaaugaagaaaugguaacuaaucauaugaaaggcgagcacaagaaacuugcugaggcuauauuuaaacugacguaucagaacaaaguuguucgaguccaaagacccacgccacgggguaccguaauggauauuauaucucgcagggaucagcgagguuccggucaaguggggaccuauggacuaaauacauuuacaaacauggaagcacaauuaauacgucaaauggagggagaagggauauuuaaaucgauucaacaucuaacgguaacagaggagauagccguacaaaacuggcuagccagagucggacgugaaagacucucucggauggcuauuaguggagaugauugcgugguaaaaccauuagacgauagauucgcuagugcguuaacugcauuaaaugauauggggaaagucaggaaagauauucagcaaugggaaccgaguagagguuggaaugauuggacgcaggucccauuuuguucacaucacuuucacgaaauaguaaugaaagaugggagaguauuaguaguucccuguagaaaccaagacgagcuuauuggaagggcaagaauaucccaaggagcuggauggucacuaaaagaaaccgccugccuuggaaaaucguaugcccagauguggacuuuaauguauuuccauaggagagacuuaaggcuggcagcuaaugcuauuuguucagcugucccgagucacuggguaccaacuuccagaacaacauggaguauacaugcgaaacaugaauggaugacaaccgaagacauguuggcgguuuggaauagaguuuggauucaggagaauccuuggauggaagacaagacaccaguggagucgugggaagaagucccuuaucuaggaaagagagaagaccaauggugcgguagucuaauaggacuaacaagccgagcaacuugggcuaaaaacauacaaacugccauuaaccaagugcguucucugauaggcaaugaagaguacacagacuauaugccaaguaugaagcgauuucguagagaagaagaagaggcggggguucucugguaa

SEQ ID NO: 22559 - RNA, 9876 nt, Artificial Sequence
  derived and/or modified CDS sequence (opt6) from DENV-2__EU482588__SS-prME
acugcaggcgucauaaucaugcuuauaccaaccgccauggccuuccauuuaacuacacguaacggugaaccucauaugaucguuggaagacaagaaaaaggaaaauccuuauuauuuaaaaccgaagaugggguuaacauguguacguugauggcaauagaucucggagagcuaugcgaagauacaauaacauauaaaugcccacuacuccgucaaaaugaaccggaagauauagauugcugguguaauaguacuucuaccuggguuacauacgguaccuguaccacaacaggagaacauagaagagaaaaacguucggucgcccucguaccucaugucggcaugggauuagaaacgaggacagaaacguggaugaguagugagggagcauggaagcacguacagaggaucgagacuuggauacuaagacauccaggauucacaauuauggcggcaauccuagcauauacaaucggaacgacccacuuucaaagagcacucauuuucauuuuguuaacggcaguugccccuaguaugacgaugcgcuguauugggauuucuaauagagacuuuguagaaggcguuucaggaggaucuuggguggacaucguauuagagcauggaagcugcgucacuacgauggcgaaaaauaagccgacacuagauuuugaacuaaucaagaccgaagcgaaacaaccugcuacucuaagaaaguacuguauugaagcuaagcuaacuaacacaacuacggaauccagaugucccacgcaaggcgagccaucauuaaaugaagaacaggauaaacguuuuguauguaaacacucaaugguagacagagguuggggaaaugggugcggauuguuuggaaagggcggaaucguuaccugcgcuauguucacauguaaaaagaauauggaaggaaaggugguguuacccgaaaacuuagaguauacaaucgugauuacaccucacaguggugaagaacaugccguaggaaacgauacuggcaagcauggaaaggagauaaaaauaacuccgcaaagcucaauuaccgaagcagaauuaaccggcuacgguacuguuacaauggaguguucaccuagaacuggauuagauuuuaacgaaaugguauugcuacaaauggaagauaaggccugguuaguacaucggcaaugguuccucgaucuuccucuucccuggcuuccaggugccgauacucaagggucgaacuggauccagaaagagacuuuaguaacuuuuaaaaauccucaugcgaaaaagcaagauguaguaguguuagguagucaagaaggcgcaaugcauacggcuuuaaccggagcuacagaaauccagaugucaucggggaauuuguuauucacaggucacuuaaagugucgccugcggauggauaaauuacagcugaaagguaugucauauaguauguguacaggaaaauuuaaaauaguaaaagaaauugcagagacgcaacacgggacuauuguuauaaggguacaguacgagggagacggaucuccaugcaaaguaccauucgaaauaauggaucuggaaaaacgacauguauugggacgacucaucacgguaaauccaauuguaacagagaaggacagucccgugaacauagaagcagagccuccuuuuggcgauucauauauaauaauaggaguggaaccaggacagcugaaacuuaauugguucaaaaaagguucuucgauaggacaaauguucgaaacaacaaugagaggcgcuaaacguauggcuauacuaggcgacacagcuugggauuuugguagucuaggugggguauuuaccagcauagggaaggcuuuacaccaaguguuuggagcaauauauggagcugccuucuccggagucucguggacuaugaagauauuaaucggagucauuaucacauggauuggcaugaacucgagaucgacuagucucucuguaagucuagugcuaguagggguaguuacauuauaccuuggagcuaugguccaagcugacucugggugcguaguaucauggaagucgaaggaguuaaaaugugguaguggaauauuuguaacugauaauguccacacauggacugaacaguauaaauuccaaccagaauccccaucaaaacuagccuccgcgauacaaaaagcacacgaagaagggauuuguggaaucagaagugugaccagacuagaaaaucuaauguggaagcaaauaacucccgaauuaaaccauauucuaucagaaaacgagguaaaacucacaauaaugacuggagauaucaaaggaauaaugcaagcaggaaagagaucgcugcgaccacagccuacggaacucaaauacucuuggaaaacuugggguaaggcuaaaaugcuauccacugaaagucacaaucagacauucuugauagacgguccagaaacugcagaauguccaaacacuaaccgugcuuggaauucgcuagaaguugaggacuaugguuuuggaguauucaccacuaauauauggcucaagcuacgagaaaaacaagacguuuuuugugauucaaagcuaauguccgccgccauaaaagauaauagagcuguccacgccgauaugggcuauuggauagaaucagcacuaaaugauacauggaagauggaaaaagcgagcuucauagaaguaaaaaguugccacuggccaaaaucgcacacauuaugguccaaugguguguuggaaagcgagaugauuauuccuaaaaauuucgcaggcccaguuucacagcacaacuauagaccaggcuaccauacgcaaacggcaggaccauggcaccuaggaaaguuagaaauggauuuugauuucugugaagguacuacgguggucguaacagaagauugcggaaaucgaggaccaucauuaagaacgaccacugcuagugguaaguuaauaaccgaauggugcugcaggaguuguacucugcccccacuccgauacagaggagaggacggcugcugguauggaauggaaauucgaccccuaaaagagaaagaggaaaaucuuguuaacaguuuagucacggcuggucauggacagaucgacaauuucagucuaggcguacucgguauggcgcuuuucuuagaagaaauguuacgcacccguguaggcacaaaacacgcaauauuacuuguagcuguuagcuucgucacacucauaaccggaaacauguccuuccgugaucuuggaaggguuaugguaaugguuggagcuacuaugacagaugauauuggaauggggguaaccuacuuagcgcugcuggccgcuuucaagguacgaccuacauuugcugcugggcuauuauuacgaaaacuaacuucaaaagaguuaaugauggcaacaaucgguauagcucugcuaagccaaucgacuaucccagagacaauacuugaacucacagaugcgcuugcuuuaggaaugaugguauuaaagaucguuaggaauauggaaaaauaucaguuagcagucacuauuauggcuauuuccugugugccaaaugccguaaucuuacaaaaugcauggaagguaucauguacuauuuuggcggcaguaucgguaucaccuuugcuauugaccucaagccaacaaaaagcagauuggauaccauuagcuuuaacaauuaaggguuugaauccaacugcaauauuccuuacaacguugucacguacaagcaaaaagcguagcuggccauugaaugaagcaauuauggcuguuggaaugguaucgauacuugcgaguucguuauuaaaaaacgacauaccaaugaccggaccucucgucgcgggugguuuauuaacuguguguuacguucuaacaggcagaucggcugaccuagaauuagaacgggcagcggacgucaaaugggaagaccaggcggagauuuccggaaguucaccuauucuaucaaucacaauaagugaagacggauccauguccauaaaaaaugaggaggaagagcaaacucuaacaauacuaauuagaacuggcuuguugguuauuagugguguauuuccaguaaguauuccaauuacagcagcggcuugguacuugugggaaguaaaaaagcaaagagcugguguauuaugggauguuccaucgccgccuccagucggaaaggcagaguuagaggacggugcguauaggauuaaacagcgcggaauucuaggcuauucacaaauuggagcugggguauauaaagaggguacauuucacaccauguggcauguaaccagaggugccgucuuaaugcauagagggaaaagaaucgaaccaaguugggcagauguuaaaaaagaccucaucucguaugguggcggguggaaacuagaaggugaauggaaagaaggggaggagguacaaguccuagcacucgaaccuggaaaaaauccuagagcaguacaaaccaaaccggguuuguuuaagaccaacacaggaacaauuggagcugucuccuuggauuuuucaccaggaacaagcgggagcccuaucgucgaccguaaggguaaagucguuggucuauacgggaauggaguaguuaccagaagcggagcauaugucuccgcaaucgcacagaccgaaaaaucgauugaagacaauccggagauugaggaugauauauuucggaaaaaacgacuaaccauaauggaccuccacccuggagcaggaaaaacaaaaagauauuuaccagcaauagugcgagaagcuauaaagagaggacuacggacccugauccuagcaccaacuagagucgucgcggcggaaauggaggaggcacuaagaggauuacccauaagguaucaaaccccugcaauuagggcagaacauacuggaagagaaauuguagaucuaaugugucacgcuacguucacaaugagguugcuaucuccaguaaggguacccaauuauaauuugauaauuauggaugaggcucauuucacggacccugcaucgauagcagccaggggcuacaucucgaccagagucgaaaugggggaagcugcgggaauauuuaugaccgcaacccccccagguucucgggauccauucccucaaucaaaugcacccauuauggacgaggaacgcgaaauaccugagagguccuggaauucgggacaugaauggguaacagacuuuaaagguaagacaguaugguuuguaccaucgauaaaagcuggaaaugacauugcagcaugucuuagaaaaaacgggaaaaaaguuauccaguuaagccguaaaaccuuugauagcgaauauguaaaaacaagggccaaugauugggauuucguaguaacuacagacauuagcgagaugggugcaaacuuuaaggcugaacgcgugaucgacccgcgacgaugcaugaaacccguuaucuuaacggauggcgaggaaaggguaauuuuagcuggccccaugcccgugacgcacuccagcgcagcgcaacgaagaggaagaauugguaggaauccaaaaaaugaaaaugaccaauauauuuacaugggcgagcccuuagagaaugaugaagauugugcacauuggaaagaggcgaaaaugcuguuagauaauaucaacacaccggaaggaauaauaccuucaauguucgagcccgaaagagaaaaaguggacgcaauagacggagaauaucgucuacgaggagaagcccgcaaaaccuucguugacuuaaugagaagaggggacuuaccaguuugguuagcuuaccgaguugcagcggaagggauaaauuaugcagaucggagguggugcuucgacgguauaaaaaauaaccaaauacuggaggaaaacguagaaguugagaucuggacuaaagaaggcgaacguaaaaaacuaaaaccacgaugguuggaugcacgaauuuauagcgauccucuagcacucaaagaauuuaaggaauucgcggcaggcaggaaaucucucacauuaaaccucauaaccgaaaugggcagauuaccaaccuuuaugacccagaaagcaagagaugcccuagauaaucuugcuguacuucacacggcggaagcaggcgggagggcuuauaaccacgcuuuaucagagcugcccgagacucucgagacacuauuacuucuaacacuacucgcuacaguuaccggaggcauuuuuuuguuucuaaugagugguaaaggaauugguaaaaugacgcuuggaauguguugcauaaucacugcaucaauccuucuuugguaugcgcagauacaaccccauuggauugccgcgagcauaauccuugaauuuuucuuaauaguccuauuaauuccagaacccgaaaaacagcguacuccucaagacaaucaauuaacuuaugucguuauagcaauccucacugugguugcugcaacaauggccaaugaaaugggauucuuggaaaagaccaagaaagacuugggauuagggucaauaacaacacaagagucagaaagcaacauucuugacauagaucuccguccggcauccgcuuggacccuauacgcuguagcuacgacauucguaacaccuaugcugcgucauaguaucgaaaacucgagcgugaacguaaguuugacagcgauagcuaaucaggcaacgguacuaauggguuuggggaaaggcuggccacucagcaagauggauauuggggugccuuuacucgccauaggauguuacagucaagugaaucccauaacacuaacugcagcccuccuauuauuagucgcgcauuaugcgauaauagggccgggauugcaagcuaaagccacaagagaagcacaaaaacgugcugcagcuggcauaaugaaaaauccuacaguagauggaauuacaguaauagaccuagaaccaaucccauaugauccgaaguucgagaagcaacuaggccaagucauguuacuaauacuuuguguuacucaggucuugaugaugagaacaacuugggcauuaugcgaagcauuaacuuuggcgacgggaccaaucucgacucuuugggaggggaacccugguagauucuggaauacaacuauugcagugucuauggccaauauauucaggggcuccuaccuagcaggugcaggucugcuuuuuaguaucaugaaaaauacuaccaauacaagacgagguacgggaaauauaggagaaacauuaggagaaaaauggaaaucuagacugaacgcucuaggcaaaucagaauuccagauauacaaaaaaagcggaauacaagagguagacaggaccuuagcgaaggaagggauuaaaaggggagaaacugaucaccaugccguuucaaggggaucagcaaaacuucgcugguuuguugaaagaaacaugguuaccccagaggguaaaguuguagaucuagguugugggcgaggagguuggucguauuauugcggaggauuaaagaaugucagagaaguaaaaggacucacuaaaggcggcccaggacacgaagagccaauacccaugucgacguauggauggaauuuagugcgauuacaaucaggcguagauguguuuuuuaccccgccggaaaaaugcgauacccuauuaugcgauauuggggaauccucaccaaauccuacaauagaagcgggaagaacauuaagaguucucaacuugguggagaacugguuaaacaacaacacccaauuuuguauaaaaguauuaaacccauacaugccaagcguuauugaaaagauggaaacgcugcagaggaaauaugggggggcccuaguuagaaauccuuuaagccgaaauucgacacaugaaauguacugggugaguaacgcuacaggaaauauaguaaguucaguuaauaugaucucuagaauguuaauaaauagauucacaaugaaacacaagaaagcgacguaugaaccggacguugaucuuggaucuggaacgagaaauaucgguauugagucagagauuccuaacuuggauauuauaggcaaacguauugaaaaaaucaagcaagaacaugaaacaagcuggcacuacgaucaagaccacccauauaagacaugggcauaucauggaagcuaugaaacaaagcaaaccggcagugccucguccaugguaaacggaguuguaagauugcuuacaaaaccaugggaugugguuccuaugguaacacagauggcuaugacagacacuacuccguucggucaacagcgaguguuuaaggaaaaaguagauacgagaacccaagaaccuaaggaagguacuaaaaaacuaaugaaaauuaccgcggaauggcuuuggaaagaacuugggaaaaaaaagacgccuagaaugugcacaagagaggaauucacaaggaagguacgcagcaacgcugcucuuggagcaauauuuacagaugagaauaaguggaagucagcgagagaagcgguagaagauuccagauuuugggagcuaauagaccgugagagaaaucuucauuuagaaggaaaaugcgaaaccugcguauacaauaugaugggaaaaagagaaaaaaaauugggcgaauuuggaaaagcaaagggaucaagagcaauuugguauaugugguuaggugccagguuucuagaauuugaagcacuagguuuuuuaaacgaagaccauugguuuucaagaggaaacucauuaaguggaguagagggggagggccuccacagacucggauacauauuaagggaugucagcaaaaaggaggguggcgccauguacgcugacgauaccgcaggaugggauacaagaauaaccuuagaagacuuaaaaaacgaggagaugguaacgaaucacaugaaaggagaacauaaaaaacuagccgaagcaauauuuaaauuaacuuaucaaaauaaaguuguaagaguacaacgcccgacuccucgagggacggucauggauauaauaagccgccgagaucaaagagguagcggacaaguaggaaccuacggucucaauacguucaccaauauggaagcccaacucauucgccaaauggaaggcgaagguauauuuaaaucgauacaacaucugacuguaacagaagaaaucgcuguccaaaauuggcuggcacggguaggucgagagagauuaucaaggauggcgauauccggugaugauugcguugugaaacccuuagacgauagauucgcuagcgcgcuuacugcccuuaaugacauggguaaagucagaaaggacauacaacaaugggagccuagccgaggcuggaaugauuggacccagguaccauuuugcucucaccauuuucaugaacuaguuaugaaggauggcagaguccuugucguaccauguagaaaccaagacgaacuuauaggacgugcuagaauaagccaaggugcaggauggucacuaaaagagacggcauguuugggaaaaaguuacgcacaaauguggacuuuaauguacuuucaccguagggaccuaagguuagcugcuaaugcuauuugcuccgcuguaccaagccacuggguccccacuucaagaaccacauggaguauacaugcaaaacacgaguggaugaccacagaagauaugcucgccguauggaaucgagucuggauacaagaaaauccguggauggaagauaagacuccaguagaaaguugggaagagguacccuauuugggaaaacgggaagaucaauggugcgguagcuuaauaggauuaacuagcagagcaacgugggcuaaaaauauucaaacagcuaucaaccagguucgaucguuaauagguaacgaagaauauaccgauuauaugcccucuaugaagagguuucgaagagaagaagaagaagcggguguuuugugguaa

SEQ ID NO: 22560 - RNA, 9876 nt, Artificial Sequence
  derived and/or modified CDS sequence (opt6) from DENV-2__EU569705__SS-prME
acugcuggagucauuauaaugcuaauuccaacugcuauggcauuccaucucacgacgcguaauggagaaccacauaugaucguaggaagacaggaaaaaggaaaaucucuuuuauuuaaaacugaagauggggugaauaugugcacacuuauggcuauagacuugggagaacucugugaagauacuauuacguauaaauguccacuccuaaggcagaaugaaccagaagauauagauuguuggugcaauuccacauccacauggguuacuuauggaacauguaccacaacaggagaacacaggagagagaaaagauccguagcucuaguaccacacgugggaaugggacuagaaaccagaaccgaaacuuggaugucuagugagggagcuuggaaacauguucaaaggauugaaacuuggauacuaaggcauccaggcuuuacaauuauggcagcaauccucgcauacacaauaggcacgacacacuuccagcgugcguuaaucuuuauacuauugaccgcagucgcuccaucgaugacgaugcgcuguauagggauaucaaaucgugauuuuguagagggcguaagugguggaucauggguagauauaguacuugaacacggaucauguguaacaacuauggcgaaaaauaaaccgacucucgauuuugaacuaauaaaaaccgaggccaaacagccggcaacucuacgaaaauauugcauagaagccaaauuaacaaauacuacuacugaaucaagaugcccuacucaaggagaaccuucauugaaugaagaacaagauaaaagauuuguuugcaaacauagcaugguugauaggggauggggaaauggauguggacuuuuugggaagggcggcauaguaacaugcgcuauguucacguguaagaaaaacauggaaggaaaaguaguuuuacccgaaaaucuggaguauacgauagucaucacaccacauucaggggaagaacaugcugucgguaaugacaccgguaaacauggaaaagaaauaaaaauuacaccucaaucauccauuacggaggcugaacucacaggauacgggaccgucacuauggaguguucgccacggacuggacuagacuuuaacgaaaugguauuauuacagauggaagacaaagcgugguuaguacauagacagugguucuuagauuugccucuuccuuggcuuccuggagcggacacacaaggauccaacuggauucagaaagaaacccuggugacauuuaaaaauccacacgcuaagaaacaagacguugucguauuggggagucaagaaggugccaugcacacagcauuaacuggagcuacagaaauacaaaugucgaguggcaaccuguuauuuaccggucaccucaaaugucgguuaagaauggauaaauuacaauuaaaagguaugucuuauaguauguguacugguaaauucaaaaucguaaaagaaauugcagaaacacaacauggaaccaucgugauaaggguucaauaugaaggagauggcucuccuuguaaaauuccuuuugagauuauggauuuagagaaaagacaugugcugggaagacuaauaacaguuaauccgauagucgcagaaaaagacucaccaguaaauauagaagcggaaccaccauuuggcgacuccuauauuauuaucggaguggaacccggucaauuaaaauuaaauugguucaagaaagguucaucaauaggucagauguucgaaaccacuaugcguggggcgaaacgaauggcgauucuaggagacacagcgugggauuucggcagcuuggguggaguauuuaccucaaucggaaaagcgcuacaccagguguuuggagccaucuauggugcugcauucucuggaguaagcuggacaaugaagaucuuaauagggguaaucauuacguggauuggaaugaacuccagaagcacuucuuuaucggugucccuagugcucgucggagucguaacuuuauauuuaggagcaauggugcaggcagauagugggugcguaguaaguuggaaaucaaaggaacuuaaauguggcucuggaaucuuuauaacagauaaugugcauacauggaccgagcaguauaaauuccagccagaaucacccagcaaacuagcauccgcgauacagaaagcgcacgaagaggguauaugcgguauacguaguguuaccaggcucgaaaauuuaauguggaaacagauaacaccggaauugaaccauauuuugucggaaaacgagguaaaguuaacaauaaugacgggggacauuaaagguaucaugcaagcaggaaaaagaucucuaaggccccaaccaaccgaacuaaaauauaguuggaagaccugggggaaggcuaaaauguuaucgacagaaucacauaaccaaacauuucugaucgaugguccggagacagccgagugccccaacacaaacagagcauggaacucuuuagaaguugaggacuacggauucgguguauucacuacgaauauauggcuaaaguuaagagagaaacaggauguguuuugugacaguaaacuuaugucagccgccauaaaagauaaccgagcugugcaugccgauauggguuauuggauugagagcgcguuaaaugacaccuggaagauggaaaaggcuucauuuauagaaguaaagagcugucauuggccgaagagucauacgcucuggagcaauggaguauuagaaagugagaugaucauaccuaaaaauuucgcuggaccaguaagucaacauaacuaccggccaggguaucauacucaaacagcaggaccguggcauuugggcaaacuagaaauggacuucgauuuuugugaagguacuacagucguaguuacugaggacugugguaauagggguccuaguuuacgaaccacuacugcuucggggaaacuaauaacagaaugguguugucgaaguugcaccuuaccuccucuaagauaccggggcgaagauggauguugguaugguauggaaauuagaccucuuaaagagaaggaagaaaauuugguuaacucauuagugacggccggucacggccaaauugauaacuucucucuggguguauuaggaauggcguuauuuuuggaagaaaugcuucguacacgaguuggcaccaaacacgcaaugcuauuaguugcagugucuuuugugacucuuaucaccggaaauaugucguucagagaucugggacgcguaauggucaugguuggagcuacaaugacagaugacauaggaauggguauaacuuacuuggcccuacuagccgcuuuuaaaguucguccgacuuuugcggcgggcuuauuguuacggaaauugacauccaaggaguuaaugauggcgacgaucggcauagcccuacuaagucagucaacaauuccagagacgauucuagaauuaaccgaugccuuagcauuaggaaugaugguucuaaaaaucguaagaaauauggaaaaauaucagcuugcaguuacgauaauggcgaucagcugcgugcccaaugcuguuauuuuacaaaaugcguggaaaguaucgugcacaauacuugccgccguaucaguaaguccucucuuauugacgaguagccaacagaaagcagauuggauuccauuggcguuaacgauaaaagguuugaaucccacagcuauauuccuaacaacguugagccgaaccaguaaaaagcgaucauggccuuuaaaugaggccauaauggcgguaggcaugguuucgauccuagcaagcucauuacuuaaaaaugauauaccaaugacagggccccuagucgcuggaggguuauugacgguguguuacgucuuaacagggcgauccgcggacuuagaauuagaaagagcggcugauguuaaaugggaagaccaagcggaaaucucagguaguucaccgauacucaguauaacaauaucagaagaugguucgaugagcauuaaaaaugaagaagaagaacaaacccuuacaauacucauacgcacaggauuauuaguaauuucagggguguucccuguaucaauucccauaacugcggcagccugguaucuuugggagguuaagaaacaaagggcagggguuuuaugggaugugccuuccccucccccaguaggaaaggcagaauuagaggacggggcauaccguauaaagcaaaggggaauccugggcuauucucaaauaggagcuggaguauauaaagaagguacuuuucacacaauguggcaugucacgcgaggggcuguguuaaugcauagaggaaagagaauugaaccaagcugggccgaugucaaaaaggaccucaucucauacggaggagguuggaaauuagaaggggaauggaaagaaggagaagaaguccagguauuggcauuagaacccgggaaaaauccccgagcaguacaaacaaaaccaggguuguuuaagacuaacacggggacaauaggagcugucagccucgauuuuaguccaggaaccucaggaucgcccaucguggauagaaaaggcaaaguugucgguuuauacggaaacgguguuguaacuagaucaggagcguauguuucagcuauugcgcaaaccgagaagaguauugaggauaauccugaaauagaggaugauauauuucggaagaaaaggcuaacaauuauggaccuucacccuggagcggggaaaacaaaacgguaccuacccgcaauaguaagagaggcaauuaaacgaggucuaagaacauugauacuagcaccgacucgcgugguagcggcugagauggaggaagcacuaagaggucuacccauaagauaccagacgccagcaauuagagcagaacauacgggaagagaaauuguagaucugaugugccacgcaacauucacgaugagguugcuaagccccguuagaguucccaauuauaauuuaaucauaauggaugaagcccacuuuacagacccggcauccauagcugcuagaggauauauaucgaccaggguugagaugggugaagccgcagggauuuucaugacagcuaccccuccaggcagccgagacccauucccgcaaucgaacgcccccauaauggacgaggagcgugagauacccgaacgauccuggaacucuggacaugaauggguuacggauuuuaaaggcaaaacagugugguucguuccaucgauuaaagcaggcaaugacaucgcggcuugccuacguaaaaauggaaagaaagucauucaacuuagcaggaaaacauucgauagcgaauauguuaagacccgagcuaaugauugggauuuuguaguuacaacugacauaagugaaaugggugccaacuuuaaggcggaaaggguaauagauccuaggcgauguaugaaacccgugauccucacugauggcgaggaacgugugauauuggcuggaccaaugccuguaacccacucgagugcugcucaaaggagaggaagaauuggacgaaauccuaaaaacgaaaaugaucaguacauauauaugggggaacccuuagagaaugaugaggauugcgcucauuggaaagaggccaaaaugcuucuggacaauauuaacacaccugaaggaaucauucccucaauguuugaaccagaacgagaaaaaguagaugcuauagacggagaguauagacuucgaggugaagcacgaaaaacuuuuguagaucuaaugaggagaggcgauuuaccagucuggcucgcauacagaguugcggccgaagguauaaauuaugcagacagacguuggugcuuugacgguauuaaaaauaaucaaauacuagaggaaaauguugaaguggagauauggacaaaagaaggagaaaggaagaaauuaaaaccgcgcuggcuugacgcgcgaaucuauagugauccguuagcccuaaaagaguucaaagaauuugcugccggaagaaaaaguuuaacgcuaaaucuaauaaccgagaugggaagacuuccuacuuucaugacucagaaagcuagagaugcccuagauaauuuggcugugcuucauacugcagaagcuggugggcgcgcauauaaccaugcauuaucagaacugccagagacacuggaaacguuguuauuacuuacucuacuagcaacugucacagguggcauauucuuauuuuuaaugagcggaaaaggcaucggaaaaaugacuuugggaauguguuguaucauaaccgcaucaauucuccuaugguaugcucagauucaaccacauuggauagcagcaagcauuauacuagaauuuuucuuaauaguacuucuaauaccagaaccagaaaaacaaagaaccccacaagauaaucaauuaacauauguaguaaucgcuauuuuaacaguaguagcagccacuauggcaaacgaaaugggguuccuggagaaaaccaagaaagacuuaggauuaggcaguauugcgacacaagagucagagucuaacauucuagauaucgauuuaagaccagcaucugcauggacguuauaugccguagcuacaacguucgucacgccuauguugaggcacaguauagaaaauucaucaguuaaugucuccuugacggccaucgcgaaucaagcgacaguuuuaaugggucuaggaaaagguuggccacucucaaaaauggauauaggcgucccauuauuagcgaucggauguuacucacaaguuaauccaauaacacucacagcagcacuuuuauuguugguggcccacuacgcuauuaucggccccggucuacaagccaaagcaacccgugaagcgcaaaaacgugcggcagccggaaucaugaaaaauccaacuguagacggcauaacggugauagauuuggagccuaucccguaugauccaaaauuugaaaaacaacuuggucaaguuaugcuuuuaauauuaugugugacucaaguguuaaugaugagaacaacaugggcccucugugaagcgcugacacuagcaacagguccuauuucaacauuaugggaagggaauccagggcguuucuggaauacgaccauagcaguaucuauggcaaauauauucagaggaucuuaucuugcuggugccggcuuauuauucucuauaaugaaaaauacaacaaauacgcguagaggaacaggcaacauaggagaaacuuugggggaaaaguggaaaucuagacucaaugcauuaggaaaaagcgaguuccaaaucuauaaaaagaguggcauccaagaaguagauagaacgcuugcgaaagaagggauaaaaaggggagaaaccgaccaucaugcaguuaguagaggcagcgcgaaacuuagaugguucguugagaggaauauggugacccccgaagguaaaguaguggacuuaggcuguggacguggagguuggucauauuacuguggcggauugaaaaacguacgcgaaguaaaagguuugacuaaaggggguccuggacaugaagaaccgauaccaaugucaacauauggcuggaacuuaguuagacuucaaagugggguagacguauuuuucaccccuccagaaaaaugcgacacccuauuaugugacaucggcgaaaguaguccgaacccaaccauugaagcugguaggacuuugagagugcuuaaccuaguagagaauuggcugaauaauaauacucaauucugcauaaaaguauuaaaccccuacaugccuucugucaucgaaaagauggagacacuccagcgaaaguacgguggugcucuaguaaggaauccuuugagcaggaauaguacgcaugagauguauuggguaagcaaugcgacaggaaauauaguaagcaguguaaauaugauaucccguauguuaauuaauagauucacaaugaagcacaaaaaggcaacguacgaacccgauguugaucuaggaucagguacaaggaacauuguaaucgagucagaaauuccaaauuuagauaucauaggaaaacgaauagagaaaauaaaacaagaacaugagaccucauggcacuacgaccaagaucacccauacaaaacuugggcauaccacggaagcuaugaaacaaaacaaacagguagugcuagcucaaugguuaaugggguaguuagacuguugacaaaacccugggacgucguuccaaugguuacccagauggcuaugacugacaccacaccuuucggacagcagcggguuuuuaaagaaaaaguugacacgagaacccaggaacccaaggaaggaaccaagaaauugaugaaaauaacugcagagugguuguggaaggaauuagguaagaagaaaacaccgagaaugugcacgcgcgaagaauuuaccagaaagguucggucuaaugcugccuuaggagcaauuuucacggaugaaaauaaauggaaaucagcucgagaggccguagaggacucaagauuuugggaacuaauugauagagaacggaauuuacauuuagaaggaaaaugugagacauguguauauaacaugaugggaaaacgugaaaagaaauuaggcgaauuuggaaaagccaaaggcagcagggccauaugguacauguggcuuggggcgcgauuucuggaguucgaagcucuugguuuucucaaugaagaccauugguuuaguaggggaaacucacucucuggaguggaaggugaaggacuccacagacugggguauauucuucgcgaugucagcaaaaaggaagggggagcaauguacgccgaugacacugccggaugggacacuaggaucacucuugaggaccuuaaaaaugaagagaugguaacuaaucauaugaaaggcgagcauaagaaacuagccgaggcaauauucaaacuuacguaucaaaauaaagugguaagaguacaaagaccaaccccucgcggcaccguuauggauauaauaucucgaagagaucagagagggucaggccaaguaggcacauauggccucaauacauucacaaacauggaggcucaauuaauacgacagauggaaggagaaggaauuuuuaagagcauucagcacuuaacagucaccgaagaaauagcaguccaaaacuggcuagcaagagucggacgugaacgacuaucucgaauggcaauuucaggugaugauuguguuguaaaaccccuugacgaccgauucgcaucggcguuaacggcuuuaaaugacaugggcaaagugcguaaagauauucaacaaugggaaccgucgcguggcuggaacgauuggacucaaguccccuuuuguagccaccacuuccaugaauuaguaaugaaagacgguagaguuuuaguuguuccaugucgaaaucaagaugaauuaauagguagggcaagaauuucacaaggcgcgggcuggaguuuaaaagaaacugcaugcuugggcaaaaguuaugcucagauguggacacuuauguauuuucaccguagggaucugagacucgcugccaaugcgaucugcucagcuguaccaucccauuggguaccuaccagcagaaccacuuggucuauacacgcaaagcaugaauggaugacaacggaagauauguuagcaguauggaaccggguauggauacaagaaaaucccuggauggaggauaagacuccaguugaaagcugggaagaaguccccuaucucggcaaaagagaagaucaguggugcggcagcuuaaucggauuaacaaguagagcaacaugggccaaaaacauacagacggcgaucaaucagguucgaagccuuauugguaacgaggaauauacugauuauaugccgucgaugaaaagguuucgaagagaagaggaggaagcgggaguuuuaugguaa

SEQ ID NO: 22561 - RNA, 9876 nt, Artificial Sequence
  derived and/or modified CDS sequence (opt6) from DENV-2__EU482589__SS-prME
acggcaggaguaauaauaaugcuaauaccaacagcuauggcauuucacuuaacaacucggaacggagaaccacacaugauaguugggcgacaagaaaaagguaaaucacuccuguuuaaaacagaagaugggguuaacauguguacuuuaauggcgauugaccuaggggaacucugugaagauacaauuaccuauaaaugcccacuacuacgucaaaaugaaccagaagauauugauuguugguguaauucaacaaguacguggguuacuuaugguacauguacaacgacgggggaacaccguagagaaaaacgaucgguagcacuugucccucaugucgguaugggauuagaaaccagaaccgaaacguggauguccucagagggugcauggaaacacgugcaacgaauagaaaccuggauauuacgacacccagguuuuacgauaauggcugcuauccucgcguauacuauuggaacaacccacuuccaacgagcuuuaauauuuauacuauuaacagcuguugcaccaaguaugacuaugcggugcaucgguaucucaaacagagacuucguggaaggggugagcggaggaucguggguugacauaguucuagaacacggcaguuguguaacaacuauggcuaaaaacaaacccacguuagauuuugaacucaucaaaacagaagcgaaacaaccagcgacguuacguaaauauuguauugaagcaaaacugacaaacaccacgacugaaucgagguguccaacacaaggagaaccaaguuuaaaugaagaacaagauaaacgauucguuuguaaacauaguauggucgaucggggguggggaaauggauguggacuuuucgggaaaggcgggauaguaacaugugcaauguuuaccugcaagaaaaauauggaaggaaaaguuguacuaccagaaaaucucgaauauacaauaguaauuacaccacauagcggugaggaacaugccguugguaaugauacaggaaaacaugguaaagaaauaaaaauaacgccucaauccucuauuaccgaagcagaguugacgggcuacggaacugucacuauggaauguucuccacguaugggacuagacuuuaacgaaauggucuuauuacaaauggaagauaaagcauggcuggugcauaggcaaugguuuuuagaucuaccuuuaccauggcucccgggggcagauacgcaggguucaaacuggauucaaaaggagacucuaguaacauucaaaaacccucacgccaagaaacaggacguuguaguucuugguagucaggagggcgcaaugcauaccgcauuaaccggugcaacggaaauccagauguccucagggaaucuauuauucacaggucauuuaaaaugucgucuccguauggauaaacuacagcuaaaaggaaugucauacucaauguguacgggaaaauuuaagauuguaaaggaaauagcagaaacccaacauggaacuauuguaauacgaguccaauaugagggagaugguagcccuuguaaaauacccuucgaaaucauggaccuugagaaacgacauguauuaggacgacugauaacaguaaacccgaucgucacagaaaaagacaguccuguaaacauugaggcagagccuccguuuggggacucuuauauaauaauuggagucgagccgggacaguugaaacucaauugguucaagaaggguagcucuauuggccagauguuugagacuacuaugagaggggccaaaagaauggcaauacuaggcgauacugccugggacuuuggcaguuugggcggcguuuucacaaguaucgguaaagcacuacaucagguauucggagccaucuauggggcagccuuuucaggaguuagcuggacuaugaaaauucuaauuggagucauaauuaccuggaucggaaugaacagccgaaguacuagcuuaucuguuucguuaguacuuguggguguaguuacuuuauaccugggugcaaugguccaggcugacagcggcuguguaguuagcuggaaaucaaaagaauuaaaauguggcagcggaauauucauuacugauaauguacauacguggaccgaacaauacaaguuucagccggaaagcccaucaaagcuagcuucggccauccaaaaagcgcaugaggaaggcauuuguggaauacguucaguaacaagauuggaaaaccuaauguggaagcaaauuacacccgaauuaaaucacauacucuccgaaaacgaaguaaaauugacgauuaugaccggagauaucaaagggaucaugcaagcagggaagcgcagcuuaagaccucagccgaccgaauuaaaauacagcuggaagaccugggguaaagcaaaaauguuaucaacagagucccauaaucagacuuucuuaauugacgggccugaaacugccgaguguccaaauacaaacagggcauggaacagucuggaaguggaagacuacggauuuggaguauuuacaacuaacauuugguugaaauuaagagaaaaacaggauguauuuugcgauucaaagcugaugucugcggcaauuaaggauaaucgggcuguacacgcggauauggguuacuggauugaaucugcacuuaaugacacuuggaaaauggaaaaagccagcuuuauagaggucaaaaguugccauuggccaaaaucucauacucuauggucuaauggaguacuggagucggaaaugauaauuccuaaaaauuuggcaggaccugugagccaacacaacuauaggccaggauaucacacacaaacagcaggccccuggcaucuggguaaacuugaaauggauuucgacuuuugugagggaacuacgguuguaguaacagaagauugugggaaucgagguccgaguuuaagaacuacaacagcuaguggcaaauuaguaacugaauggugcuguagaagcuguacacuaccaccguuaagauaucguggugaagacgguugcugguacggcauggagauaagaccuuuaaaagaaaaggaagaaaaucuaguaaauagucuugugaccgcuggucaugggcaaauugauaacuucucucuagguguauuagguauggcgcuguuuuuagaagagauguugaggacacguguugggacuaaacaugcuauucuauugguagcuguaucuuuuguuacacuuaucacugguaacauguccuucagggauuuaggacgcguaauggugaugguuggagcgacaaugacagaugauauagguaugggagugacuuacuuagcacuauuggcugcguuuaaaguaagacccacauuugcagcaggccuacuauuaaggaagcucacaucgaaagaguuaaugauggcaacaauuggaauugcucuacucucucagagcacaauaccugagaccauacuagaauuaacugaugcacuagcauuggguaugaugguucuaaagauagugagaaacauggaaaaguaccagcuagcaguuaccaucauggccaucucauguguucccaaugcugugauauuacaaaacgcuuggaagguaagcuguacaauacuugcagcaguuucaguaucucccuugcuacuaacaucaucacaacaaaaagccgacuggauaccacuugcgcuuacaauaaaaggauuaaacccgacagcaauauucuuaacaaccuuaucaaggacuagcaagaaacgauccuggccguuaaaugaggcaauaauggcaguagguauggucucuauccuagcaaguucacuacuaaagaaugauauacccaugacgggcccccugguugcaggaggauugcugacggucugcuacgugcuaacuggaagaagcgcagaucucgaacuggaaagggcugcugauguaaagugggaggaccaggcugaaauaucagggucaucuccaauauuaucaauaacaaucagugaagacgguagcaugucaauuaaaaaugaggaagaggagcaaaccuuaacuauauuaauaaggacaggauuacuggugauauccggugucuuuccagucucgauucccauuacagcggcggcgugguaucugugggaaguaaagaaacaacgugcaggcguguuaugggauguuccaagcccaccaccggucgguaaggccgaguuggaggauggagcauacaggauuaaacaaagggggauccuggguuauagucagauaggagcugguguguacaaagagggcacuuuucauacuauguggcauguaacuagaggagccguuuuaaugcauagaggaaaacgcauugaaccaucuugggcagacguaaagaaagacuuaauaucuuauggagguggcuggaagcucgaaggugaauggaaagagggagaagagguucaaguucuugcucucgagccaggaaagaacccaagagcuguacaaacuaaaccaggacucuucaagacaaacacugggacuauuggcgccgucagucuggacuuuuccccaggaacuagcggauccccuauuguagacagaaaggggaagguugugggauuauacgguaaugguguaguaaccagaagcggagcauacguaucagcaauagcucaaacagagaaaagcauugaagauaacccagaaaucgaagaugauauauucaggaagaaacgacuaacgaucauggaccugcacccgggcgcuggaaaaacuaaaagguauuuaccugcuauuguaagggaagcaauaaaacgcggcuugcgaacauuaauucuggcaccaacaagaguuguugcagcagaaauggaagaagcucuacgaggauuaccaauucguuaucaaaccccugcuaucagggcagagcauaccggaagagaaauugucgaccuuaugugucaugccaccuucacaaugagauuauuaagcccuguucguguaccuaacuacaacuuaauaauaauggacgaagcacacuuuaccgauccagccuccaucgcggcccgcggauauaucaguacucgaguagaaaugggugaagcggcagguauauucaugacagcaacuccaccagguucaagagauccuuuuccucaauccaacgcaccaauuauggacgaagagagagaaauacccgaacgcaguuggaacagcggacacgaaugggucacagacuucaagggaaaaacuguaugguuugugccaucaauuaaggcagguaacgauauagcugccugucugcggaaaaacggaaagaagguaauacaguuaucaagaaaaacguuugauagugaguauguaaaaacgcgagcuaaugauugggacuuuguagucacaacggauauuucugaaaugggugcgaauuuuaaagcagaacgaguaaucgauccacgucgaugcaugaagccugugauucuaacagauggagaagaaaggguaauuuuagcaggaccgaugcccguaacccacucaucagcggcacaaaggagaggaaggaucggacgaaaccccaaaaacgaaaaugaucaauauauuuauaugggagagccucuggagaaugacgaggauugugcacacuggaaggaagcaaagaugcuauuagacaacauaaauacgccugagggaauaauaccuucaauguucgaaccugaaagagaaaaaguugaugcaauagauggagaauauagacuacgaggagaggcuaggaaaacuuucguugacuuaaugaggagaggggacuuaccaguauggcucgcauaccgaguggcugcagaggguauuaacuaugcugauaggcggugguguuuugacggcaucaaaaauaaucaaauauuagaagagaauguggaaguugagauauggacaaaagaaggagaacggaagaaauuaaaaccaagaugguuagacgcgcgaauauacucagauccuuuagcauuaaaagaauuuaaagaguuugcagcaggccggaaaagucuaacauuaaaucuaauaacagagaugggacgauuaccaacuuuuaugacacaaaaggcaagaaacgcguuagacaauuuggccguucuacacacggcugaggcuggaggcagggcguacaaucacgcuuuaucggaacuuccugaaacauuagaaacacuucugcuauuaacccuucucgcaacagucacaggagggauauuucuauucuuaaugucgggaaaagguaucgggaagaugaccuugggaaugugcugcaucaucacugcgagcauauuguuaugguacgcacaaauccaaccacauuggauagcggcaucuauaauauuggaguuuuuccucauuguucuauuaauaccagaaccagaaaagcaacgaacgccacaagauaaccaacugaccuauguuguaauagccauauugacuguaguugccgcaacgauggcaaaugaaaugggauuucuggagaaaacaaagaaagaucuaggcuuggggucaaucacuacacaggaaagugaguccaauauucuugauauagaccugcggccggccucugcuuggacauuauaugccgucgcgacuaccuuuguuacaccaaugcuuaggcauucaauugaaaauucgucuguuaauguaagucucaccgcgauagcgaaccaagcaacagugcuuaugggcuuaggaaaaggauggccauugaguaaaauggacauagggguaccacuucuugcaauaggauguuauucucaaguuaauccaauuacucuaacagcugcacucuuacugcuaguugcucauuaugcuauaauuggaccgggguuacaggcgaaagcuacacgagaggcucagaaaagagcugcggccggcaucaugaaaaacccaacagucgauggcauaacagugauugaccuagagccaauaccauaugauccuaaauuugaaaaacaacuaggacagguuauguuguuaauucuuuguguaacgcaaguucuuaugaugcgaacaacaugggcauugugugaagcccuaacuuuagcaacagggccaauaucuacccucugggaaggaaauccggguagauuuuggaauaccacaauugccguuagcauggccaauaucuuccgugggucauaccuagccggggcaggccucuuauuuagcauaaugaaaaauacaacuaacacucgaagagggacuggaaauauaggagaaacauuaggagaaaaauggaagucacgucuuaacgcucuagguaaaucagaauuucaaaucuacaaaaagaguggcauacaagaaguagaucgcacccuagcuaaggaaggaaucaagagaggcgaaacugaucaccaugcagucucgcguggauccgccaaauuaaggugguucguggaaaggaacaugguuaccccggaggguaaaguaguagaucuaggauguggacgagguggauggaguuauuauugcggcggucuaaagaacguacgagaaguaaaaggacuaacaaaaggagguccaggucaugaagaaccaauucccaugagcaccuacggauggaauuuaguaagguuacaaagcggaguugauguauucuuuacacccccugagaaaugcgauacgcuacuuugugacauaggugagucuuccccgaauccaaccaucgaagccggaagaacuuugcggguacucaaucuaguagaaaauuggcuaaacaauaauacacaguucuguaucaaaguucuaaacccauauaugccaaguguuauugagaaaauggaaacauugcagagaaaauauggaggggcauuaguuagaaacccgcucucgagaaauucgacccaugaaauguauuggguuaguaaugcuacugguaacaucgucucguccguaaauaugauaagcagaauguuaauuaauagguuuacaaugaaacacaagaaagcuacauaugaaccagauguugacuuagguagcggaacgaggaauauaggaauagaauccgagauaccgaauuuagacaucauuggcaaaagaauagaaaagauaaaacaggaacaugaaacgagcuggcauuaugaccaagaucauccauacaaaacuugggcuuaccacggcuccuaugaaaccaaacaaacugguucggccuccaguauggucaacggggucguuagacuauuaacgaaacccugggacguaguaccgaugguuacacagauggcgaugacugauacaaccccguuuggucaacaaagggucuucaaagaaaaaguugauacacgaacacaagaaccuaaggaagguaccaagaaacuaaugaagauaacugccgaaugguuguggaaggaauugggaaaggagaaaacaccucgaaugugcacaagagaagaauuuacgagaaaagugcgcucaaaugcagcucuaggagccauauuuaccgaugaaaacaaauggaaaucugcuagagaagccguagaagauaguagauuuugggaacuaaucgaucgcgaaagaaauuuacacuuagaaggaaaaugugaaacuugcguauauaauaugauggggaaaagagagaagaaacuaggugaauuugggaaagcgaagggaagucgggccauaugguauauguggcuaggagcacgauuuuuagaguucgaagcucuuggcuuuuuaaaugaagaccacugguuuaguagggaaaauagucuauccgguguagaaggugaaggauuacauagauuaggcuacaucuuaagagaugugucuaagaaagaaggaggagccauguaugcggaugauacugcagggugggacacuaggauaacauuagaagaccugaaaaacgaagaaaugguuacaaaccauaugaaaggugaacauaaaaagcuagcugaagcuauauuuaaauuaacguaccagaauaaagucguacggguccaaaggcccaccccuagagggacagucauggauauaauaucucgaagagaucaaagaggcaguggacaaguuggaacuuauggacugaauacguuuacuaacauggaggcacaauugaucagacaaauggaaggcgagggaauauucaagucuauacagcaccucaccgcaacagaagaaauagcaguacaaaauugguuggcaagagugggcagagaacgccucagcagaauggcaauaucgggagaugacuguguaguaaagccucuagaugauagauuugcaucagcucuaacggccuuaaacgauaugggaaaaguuagaaaagauauacaacagugggagccuuccagggguuggaacgauuggacccaaguaccauuuuguucccaucacuuucacgaguuaguuaugaaagacggccggguauuaguagucccuugccgaaaucaagaugaacuaauuggaagggcgcgaaucucucaaggggcggguuggucucugaaagagacagcuuguuuagggaaaagcuacgcgcaaauguggaccuuaauguauuuccaccggcgcgaccucagguuagcagccaaugcaauaugcucagcgguaccuagccacuggguaccgacuucccggaccacauggucaauacaugcgaaacaugaauggaugacaacagaggauaugcuagcaguauggaauaggguuuggauucaagaaaauccauggauggaggauaaaacaccggucgaaaguugggaagaaguaccauacuugggcaaacgagaagaucaaugguguggcucucuaauaggauuaaccagcagggcaacuugggccaaaaacauccaaacagcgauaaaccagguacgcucucuuauagggaacgaagaguauacagacuacaugccgagcaugaaacgauuuagacgcgaagaagaagaagcaggaguccuaugguga

SEQ ID NO: 22562 - RNA, 9876 nt, Artificial Sequence
  derived and/or modified CDS sequence (opt6) from DENV-2__EU569706__SS-prME
acagcaggaguaauaauuauguugauuccaaccgcaauggcguuucacuuaacgacaaggaauggagaaccucauaugauaguuggucggcaagaaaaaggaaaaucacugcuauuuaaaacggaagaugguguaaauauguguacccuaauggcaauugaucuuggagaacuaugugaagauacaauaaccuacaaaugcccauuguuacgacaaaaugaaccugaagauauugauugcuggugcaacucuacaagcacaugggucacauauggaacuuguaccacaacuggggaacacagacgagagaaaagaagcguagcgcuaguaccucacguggguaugggucuagaaacgcggaccgaaacauggaugucuagcgaaggagcauggaaacauguucagagaauagaaacauggauccuucgacacccaggauuuaccaucauggcugcaauucuggcauacaccauagggacuacccacuuccaaagagcgcuuauauuuauauuguugacggcuguggcuccaagcaugacgaugagguguauaggaauaucaaauagagacuucguggaaggaguaucaggaggaucauggguugacauaguacuugaacacggaaguugcgugacgaccauggcuaaaaauaaacccacucuagauuucgaacugauaaaaacugaagcaaaacaacccgcaacguuaagaaaauauugcauagaagcaaaacuaacuaacacgacgaccgaaucaaggugucccacgcagggcgaaccuucauugaaugaagaacaggacaaaagguucauuuguaaacauaguaugguugaccgaggcuggggaaacggguguggacuuuucgguaaaggcgggauaguuacuugcgcaauguuuacauguaaaaagaacauggaaggaaaaguaguucuaccagaaaaccuugaauauacaauaguaaucacaccgcauuccggggaagaacaugccguagggaacgacacugggaaacaugggaaagaaauaaaaauaacaccacagagcaguauaacagaagcugaacugacuggauauggaacaguuacaauggaauguagcccaagaacaggccuagauuuuaaugaaaugguucuauuacaaauggaagacaaagcauggcuuguucauagacaaugguucuuagaucuucccuuaccuugguugcccggagcugacacucaaggauccaacuggauucaaaaagagacacuugucacauuuaaaaauccacaugccaagaaacaggauguuguaguuuuaggaucgcaagagggugcaaugcacaccgcucuaacaggagcgacggaaauccaaaugaguucggguaaucuauuauuuacgggacauuuaaaaugucguuuaagaauggauaaauuacaauuaaagggcaugaguuauucaauguguacaggaaaauucaaaaucgugaaagaaauugcagaaacacaacacgguacuauagucauccgaguccaauaugagggugauggaagcccgugcaaaauaccuuuugaaaucauggauuuagaaaaacggcacgugcuagguagauuaauaacggucaacccuaucguggcagaaaaagauaguccgguuaacauagaagcagaaccaccguucggagacaguuacauuauaauaggggucgaaccaggacagcuuaaacuaaacugguucaaaaaggggucaagcaucggacaaauguucgaaacgacuaugcgaggagcaaagcgcauggccauauuaggugauacugcgugggacuucgguucgcuaggcggaguuuuuacaaguaucgggaaggcgcuacaucaaguguuuggcgccauuuauggggcagcauuuagcggagucagcuggaccaugaaaaucuugaucggagucauuaucacguggauaggaaugaacucuaggagcaccagccuaucaguuucuuuaguccuaguuggagucguaacacuuuaucuaggugugaugguacaagcagacuccggcuguguaguaucauggaaaaacaaagaacugaagugcgggucaggaauauuuauaacagacaauguacauacuuggacagaacaauacaaguuucagccagagucaccgucgaagcuggcgagcgcuauccagaaagcgcacgaggaaggaauaugcgguauaagaagcguaacuagauuggagaauuuaauguggaagcaaauuacaccagaguugaaucauauauuaucagaaaacgaggugaaacuuacgauaaugacuggcgauaucaaaggcauaaugcaggcagggaaaaggagucuuagaccacaaccuacagaauuaaaguauucauggaagacaugggguaaagcuaagaugcuaucgaccgaaagccauaaccaaacuuuucuaauugacgggccagagacugccgaauguccuaacacaaauagagccuggaacagccuugaaguugaggacuacggauucggaguuuucucuacaaacauauggcucaaauuaagagaaaaacaagacguauuuugugauucuaaacugaugucagcugcaaucaaggauaaccgugcaguacaugcugauaugggguauuggauagaaagcgcuuuaaaugauacauggaaaauggaaaaagcaucuuuuauugagguaaaauccugucauuggccuaaaucacauacacuuuggagcaacggaguacuagagagugaaaugauaauacccaagaauuuugcugggccuguaucacaacauaauuaucgaccaggauaccauacgcagacagcaggacccuggcauuuagguaaguuagagauggauuucgacuucugcgaagggacuaccguaguagucacagaagauuguggcaauagggggccaucauugagaacuaccacugcgucuggaaaguugauaacagaauggugcugcagaucguguacccugccgccauuacgcuaucguggggaggauggauguugguacgguauggaaauccgcccguuaaaagaaaaagaagagaaucuggugaacagcuuaguuacagcaggucaugggcaaauagauaauuuuagucucggaguacuaggcauggcgcuuuucuuggaagagaugcucagaacgcgugucggaacaaaacaugcaaucuuauuaguagcagugaguuuuguuacgcuaauaaccggaaauauguccuuccgggauuuaggaaggguaauggucaugguaggugcaacaaugaccgacgacauagguauggguguuaccuacuuagcuuuacuugcagcuuuuaagguacggccuaccuuugcagcaggccuucuccuacgcaaauuaacaucaaaagaacuaaugauggcuacuauuggaauugcauuauuaagucaaaguacuaucccagagacaauacuagaacucacagacgcgcuggcccuagguaugaugguacuaaagauaguaaggaaucuugaaaaauaccaacuggcggucacaauaauggcuauaucaugcgucccaaaugcaguaauacuucaaaacgcuuggaaagugaguugcacgaucuuggcagcaguuaguguaucgccacuguuguuaacaagcucacaacaaaaagcagauuggauuccacuagccuugaccauaaagggucucaaccccacagcaauauuucugacgacuuugucccgaacuucgaagaagagaagcuggccauuaaaugaagccguuauggccgucggcaugguaucuauacuggcuaguagccuauuaaagaacgauauuccuaugacuggaccucugguagcuggugggcuacuuacagugugcuacguacucacaggacgaagcgccgaucuagaacucgaaagagcagcagacgugaagugggaagaucaggcugaaaucucaggaucaagcccaauuuuaagcauaaccauaagugaggaugguucgauguccauuaagaaugaggaagaagaacaaacguugacgauauugauacggacaggucuauuagugauuucugguguauuccccguaucuauaccaaucacugcagcagccugguaucugugggagguaaagaaacaaagagcaggcgucuuaugggauguuccaucaccaccucccgucggcaaagcggaguuagaggacggagcuuacaggauuaaacaacgcggcauuuucggauauagccagaucggugcagggguuuacaaagagggaacauuccauacaauguggcaugucacaagaggcgcgguuuuaaugcauagggguaagcguauagaaccaucuugggcagacguuaaaaaggaucugauaaguuacggagggggauggaaguuagaaggagaauggaaggagggcgaagaaguucaaguuuuggcauuggaacccggcaaaaaccccagagcaguacaaacaaaaccuggucuguucaaaacaaacacggguacaauaggggcagucagccuugauuucucaccagggacuucugggaguccaauaguugaucgcaaagggaaaguuguggguuuauacggaaacggaguagucacgcguucaggcgcauaugugucagcuauagcacaaaccgaaaaaucuauagaagauaauccggaaauugaagaugacauauucaggaagaaaaggcuuacgaucauggauuuacacccgggcgcuggaaagacuaagcgauaucuaccagcgauagucagagaagcaaucaagagaggacuuagaacauuaauauuagccccaacacgaguagucgcagcagaaauggaagaggcauuacggggacuaccaauaagguaccagacgccggccauacgagcagaacauacuggaagagagauaguagaucuaaugugucaugcgacauuuacaaugagacuuuugucgccaguaagagugccaaauuacaaccugauaauaauggaugaagcccacuucacagauccggccaguauagcagcgcguggauauauauccaccagagucgaaaugggagaagcggcaggaaucuuuaugaccgcaacuccaccaggaagucgcgacccuuuuccucaaagcaacgcgccaauuauggaugaagaaagggaaauaccggaacgaagcuggaacuccggacacgaguggguaacagacuucaaggggaaaacggucugguuuguuccaucuauaaaagcgggaaaugacauugcugcuugcuugaggaagaacgguaagaaaguaauccagcuaucaagaaaaacuuuugauucggaauaugucaaaaccagggcgaaugauugggacuucgucguuacaacagauauaagugaaaugggggcgaacuuuagggcggaacgcguaauagacccgcgucguugcaugaaaccgguuauacuuacggacggagaagaacgaguaauacuugcaggucccaugccagugacacacaguucugcagcccaacgaagaggcaggauugggcgcaaccccaaaaaugaaaaugaccaauacauauauaugggagaaccuuuagaaaaugaugaagauugcgcucacuggaaggaggccaaaauguuauuagacaacaucaacacaccggaaggaauaauaccauccauguuugaaccggagcgagagaagguugaugcgaucgauggagaguaccgacuccgcggggaagcuagaaaaacauuuguagauuuaaugcggcguggcgacuuaccgguauggcucgcauaccgaguagcagccgagggaauuaauuacgcggaucguagguggugcuuugacggaaucaaaaacaaucaaauacuagaagaaaauguugaagucgagauauggacaaaagaaggugaaagaaagaaauuaaagccccgauggcuugaugcacgaauauacagugacccucuagcacuuaaggaguucaaagaauuugcagcaggaaggaaaaguuugacguuaaaucucauaacugaaaugggacgacuuccuacauucaugacccaaaaggccagggaugcacuugauaaccuggcuguucuacauacagcagaaguaggcggaagggcuuacaaccaugcacucucagagcugccagaaacgcuugaaacuuuguuacuacucacucucuuagccacuguuacuggaggaauauuccucuuucucaugagugguaaagguauagguaaaaugacuuuagguaugugcugcauaaucacagcaucaauacuuuugugguaugcucagauacaaccccauuggauagcagcuucaaucauauuagaguucuuucuaaucguccuucuuauaccugaaccagagaagcaacguacuccgcaggauaaucaacuaacauauguagucaucgccauccucacaguuguagcggcuacuauggcuaaugagaugggcuuccuagagaaaaccaagaaagaucucggauugggcucuauaacuacucaagaaucagaaucaaauauuuuagacauugauuuaagaccggcuucagcuuggacccuauaugcaguagccacgaccuucguaacaccgaugcuuagacauaguauagaaaauucuagcgugaacguaucacucacagcuauugcaaaucaagcuacgguucucaugggacugggaaggggguggccgcucaguaaaauggauauuggcguaccacuauuagcuauagguugcuauagucaaguaaauccaauaacauuaacagccgcacucuugcuucuuguggcgcauuacgcaauuauaggaccaggacugcaggcgaaagcaacaagagaggcucagaagagagccgcagcaggaauuaugaaaaacccgacaguugaugggauaacaguaauugaucuugaaccaauaccauacgacccgaaauuugaaaaacaacuaggacagguaauguuauuaguguuauguguaacacagguguuaaugaugcguacgacaugggcauuaugugaagccuuaacuuuagcaaccggcccuaucagcacuuuaugggaaggaaaucccggacgcuucuggaacacaacgauagcgguuucaauggcaaauaucuuccguggaucguauuuagcaggagcuggccuucuauuuuccauaaugaaaaauacaacaaauacacgucgaggcacagguaacauaggggaaacuuuaggcgaaaaauggaaaucuagacuaaacgcuuuggguaaaagcgaguuccagauauacaaaaagaguggcauucaagaagucgaccggacguuagccaaagaagguauaaaacgaggugaaaccgaucaucaugcagugagucggggaagugcgaaacuaagaugguuuguggaacguaauaugguaacucccgaaggaaagguaguugacuuagguugugguagagggggauggucauauuacuguggaggacucaaaaaugugagagaagugaagggguugacaaagggagggcccggacacgaagaaccuauaccuauguccacuuauggauggaauuugguccgauuacaaucaggaguggauguauucuuuacaccgccagagaaaugugacacauugcuaugugacauuggcgaaagcaguccaaacccuacaauagaagcuggcagaacccucagaguucuaaacuugguggaaaacuggcuuaacaacaauacccaguuuuguauuaaggucuuaaauccauacaugccaagcguaauagaaaagauggagacucugcagcguaaauauggaggggcccuaguccgaaauccauugucuagaaauucaacgcacgagauguauuggguuucaaaugcaacuggcaauauaguguccucgguaaacaugauuucaagaauguuaauaaaucgguuuaccaugaagcauaagaaagcgacuuacgagccagauguagaccucgguucggggacaagaaacauagguaucgaaaaugaaauaccuaacuuagacauaauaggcaaacgcauugagaaaauaaaacaagaacacgaaacaucuuggcauuaugaccaagaccauccguauaaaacaugggcguaucauggaagcuacgaaacuaaacaaacuggcucggcaucaucgauggucaauggagucgugagauuacuaacuaaaccaugggacguuguuccuaugguaacgcagauggcaaugacugacaccacucccuuugggcaacaacggguauuuaaggaaaaaguagauacgagaacucaagaacccaaagaaggaacaaagaaacucaugaggauaacagcagaauggcuauggaaagaauugggcaaaaagaaaacuccacguaugugcacacgagaggaauuuacacguaaaguaaggucuaacgcagcacuaggagcuauauuuacagaugaaaauaaauggaagucggcacgcgaggcugucgaagauuccagauuuugggagcuaguagacagggaaaggaacuugcaucuagaggggaaaugugaaacauguguuuacaauaugaugggaaagagagagaagaaauugggugaguucgguaaagcaaaagggaguagggcaauaugguauauguggcuaggagcacgauuccuggaguucgaggcguuaggauuucuaaacgaagaucauugguuuucucgaggcaacaguuugucuggaguagaaggugaagggcugcacaaacuaggcuauaucuugagagaugucagcaagaaagaaggaggugcaauguaugcagacgacacagcgggaugggauacaagaauuacacuagaagaccucaaaaaugaagaaauggugacuaaucauaugaaaggugaacacaagaaacuggccgaagcgauauuuaaacuuacauaucaaaacaagguugugaggguucaacgaccaaccccaagaggaacuguaauggacauaauuagcagaaaagaccaaagagguaguggacaagugggaacauaugguuuaaacacauuuacaaacauggaggcacaacucauucgacagauggaaggugaagguauauucaaaucuauccaacaccugacaguaaccgaagagauugcuguccaaaauuggcuggcacgaguaggccgugaaagguugagccguauggcgauaucaggcgaugacugcguuguaaaaccauuggaugacagauucgccucugcucuaacagcauuaaacgauaugggcaaagucagaaaagauauacagcaaugggaacccuccaggggcuggaacgauuggacacaaguaccuuuuugcagucaucauuuucacgaacuugucaugaaggacgguagaguauuagugguaccaugucguaaccaggacgaacuuauaggccgagcgaggaucucucaaggugccggauggucgcugaaagaaacagccugucuagguaaaagcuaugcgcaaauguggacucugauguauuuccacagaagagaucuuagguuagcagcuaaugcaauauguucagcaguaccaagucauugggucccgacgucgcggaccacauggaguauacaugcuaaacaugaauggaugacaacagaagauauguuagccguuuggaacagaguauggauacaagaaaauccguggauggaagacaaaacaccaguagaaagcugggaagaaguaccuuaucuuggcaagcgagaagaucaaugguguggaucacuuauagggcugacaucaagggcgacaugggcuaaaaauauucaaacggcaauuaaucaaguacgcucgcugauuggaaaugaagaauauacugacuacaugccuaguaugaagagauuucggaaagaagaggaggaagccgguguacugugguaa

SEQ ID NO: 22563 - RNA, 9876 nt, Artificial Sequence
  derived and/or modified CDS sequence (opt6) from DENV-2__EU569707__SS-prME
acugcaggaguaauaaucaugcuaaucccuacugcgauggcauuccaccucacaaccagaaauggugaaccucacaugauaguaggaagacaagaaaaaggaaaaucauuacuuuuuaaaacugaagauggagugaauauguguacucugauggcaaucgacuuaggggaacuuugcgaagauacgauaacguauaaauguccucuuuugcgccagaaugaacccgaagacaucgauuguugguguaacucuaccucuacauggguaaccuacgguacuuguacaaccacgggggaacaccgacgcgagaaaagaucuguugcgcugguuccccauguaggcaugggcuuggaaacaagaacggaaaccuggaugucuagcgaaggagcauggaaacauguacagcgcauugaaacauggauccuaagacauccaggguuuacgauaauggcagcaauacucgcuuauacaauaggaacaacacauuuucagagggcgcuuaucuuuaucuuacuaacggcugucgcucccagcaugacaaugcgaugcauugggauaucuaauagagauuucguugaaggaguuucuggaggaucauggguagacauagucuuggaacaugguaguugugugacaaccauggccaaaaauaaacccaccuuggacuucgaguugaucaaaaccgaggcuaaacagccagccacccuuaggaaauauuguguagaggcaaaacugaccaacacaacaaccgaaagucguugcccuacgcaaggugagccgucguugaacgaagaacaagacaaaagauuuguguguaaacauucuaugguggaccgaggauggggcaacgguugcggccuuuucggaaaagguggaauuguuacaugugcaauguuuacuuguaagaaaaauauggaggguaaagucgugcuuccagagaaucuagaauauacuauaguaaucacuccacacucaggagaagaacaugcuguuggcaaugauacagggaaacacggaaaagaaauuaaaaucacaccacaaaguucuauaaccgaggcagaguuaacagguuacggaacugucacuauggaauguucaccacguacgggacuugacuuuaacgaaaugguguuguuaagaauggaagauaaagcaugguuaguucacagacagugguuccuugauuugcccuuaccaugguugcccggcgcagacacucaagguagcaauuggauucagaaagaaacauuaguaacuuuuaaaaauccacaugcuaagaaacaagacguuguaguacuagguagucaggaaggagcaaugcacacagcacuuaccggagcuacugagauccaaaugagcucgggaaaucugcuauucacuggacauuugaaauguagauuaagaauggauaaacuccaacucaaaggaauguccuauucgaugugcacuggaaaauuuaagaucguaaaggaaauugccgagacucagcacgguacaauuguuauacgugugcaauaugaaggggacgguagcccuugcaagauacccuucgagauaauggaucuagaaaaacgucacguguugggacgccuuauuacaguaaacccuauaguugcagaaaaagauucaccuguaaauauagaagcggagccacccuucggugauucauauauaauuauaggagucgagccugggcaauugaaauugaacugguucaagaagggauccuccaucggacaaauguuugaaacuacaaugagaggagcaaaaagaauggccauacuaggugauacagcgugggauuuuggcagucuaggaggaguguuuacuagcauugguaaggcucugcaucaaguauuuggcgcaauuuauggugcagcauuuucagggguaaguuggacuaugaaaauucuaaucggggucauuauuaccuggaucggcaugaacagcagaaguacgucacuaagcgucagucucgucuuaguaggaguuguuacacuauaccuuggagcaaugguacaggccgauucggggugcgucguauccuggaaaagcaaagagcuuaaaugcgguucuggaauuuuuauuacagauaauguucacacguggaccgaacaauauaaguuucaaccugaaaguccaaguaaacuggcaagugcgauacaaaaagcacacgaggaaggaauuugugggauaagauccguaacacgauuagaaaauuuaauguggaaacaaauuacuccagaauuaaaccauauacuuagcgaaaaugaaguuaaauugaccauuaugacgggggacauaaaaggcauaaugcaagcgggaaaaagaucauuaaggccacaaccaaccgaacucaaauauucauggaaaacguggggaaaagcaaaaaugcugucuacggaaucacacaaucagacauuccuuauagacggaccggagacugcagaaugucccaacacaaaucgggcguggaacucucucgagguagaagauuauggguucggaguuuuuaccacgaauauauggcuuaaacucagagaaaaacaagauguauucugugauagcaaacugaugagugcugcuauaaaagauaacagagcgguacaugccgacaugggauacuggauagaaagcgcucugaaugauacuuggaaaauggaaaaggcuucguucauagaaguaaaaucgugccacuggccuaagagucauacacuuuggaguaaugggguacucgaguccgaaaugaucauaccuaaaaacuuugcagggccaguuagucagcauaacuauagaccaggauaucauacgcaaacugcaggaccauggcauuuaggaaaauuagaaauggacuucgacuucugcgaagggacuacaguuguagucacggaagauugugggaaccguggcccuagucuaagaacuacaaccgcaucaggaaaauuaauaacggaaugguguuguagaagcuguacacugccaccacuacgguaucgaggagaagauggauguugguaugggauggaaauaagacccuugaaagagaaggaagaaaauuuaguaaacucucuaguaacagcuggucauggucagauugauaacuucucauuggggguacuaggaauggcucuuuuccuagaagaaaugcuaagaacaaggguagguacuaaacaugcaauguugcuuguggccgucucuuucguuacauuaauuaccgguaacaugucauuuagggaccuagggagaguaaugguaaugguaggugccacaaugacagacgauauaggaaugggaauaacauaccuagcacuacuagcagcauuuaaaguaagaccaacauucgcagccgggcuacuguuacgaaaauuaacaagcaaagaauugaugauggcuacgauaggaauagcacuauuaagccagucaacaauuccggaaacgauucuugaacucacagaugcauuagcgcugggaaugaugguauuaaaaaucgugagaaauauggagaaauaucaauuggccguuacaaucauggcgauauccuguguaccuaaugccguaauauuacagaaugcguggaaaguuucuuguaccauauuagcagcagucagcguaagcccuuuacuacugacgucaucucaacagaaggcagauuggaucccccuagcauuaacuauaaaaggauugaauccgacggcgauauuuuugaccacuuuaucuagaacaaguaagaaaaggucguggcccuuaaaugaagcaauaauggcaguagggaugguuagcauacuagcuagcucgcucuuaaagaaugauauuccuaugacaggaccacuuguagcuggaggucuucugaccgugugcuacguacuuacugggcgaagcgcagaccuagaauuagaaagggcagccgacguaaaaugggaagaccaagcagagauuuccggaaguucaccaauucuauccauaacgaucucggaagacgggaguaugucaaucaaaaacgaggaagaagaacagacacuaacuauucuaauaagaacaggacuacuugucauaucugguguauuuccagucucaauaccaauaacggcagcagccugguaccugugggaagucaagaaacaacgagcgggcguucuuugggacguuccuucaccaccuccaguaggcaaggcugaacuugaagauggagcauaucgcaucaagcaaagaggaauacuagguuauagccagauuggagcgggaguuuacaaagaaggcacguuucauaccauguggcacguaacaagaggagcuguacucaugcaucgaggaaaaagaauugagccaaguugggcugaugucaagaaagaucucauauccuacggaggaggguggaaacucgaaggugaauggaaagaaggggaagaaguacaagugcuagcuuuggagcccggcaagaacccacgagcgguacagacgaaacccggucuauuuaaaacuaauacaggaacgaucggagcaguaucauuagauuucagccccggcaccucagggucuccaauaguggauaggaaagggaaagugguagggcuuuacggaaacggagucguaacuagaaguggagcauacgugagcgcuauugcacaaacggaaaagucuauagaggacaauccagaaauugaggacgacauauuccgaaagaaaagauugacaauaauggaucuccauccaggugcugguaaaacaaaaagauaucuuccagcaaucgugcgggaggcaaucaagcgaggacugagaacacuaauacuugcaccaacuagagugguagcugcagaaauggaagaggcguuaagagggcuaccaauacgguaucaaacgcccgcaauacgagcugaacauaccggucgggaaauagucgauuuaaugugucaugcgacauucacaaugagacuacuaucaccaguaagagugccaaauuacaacuugauaauaauggaugaagcucacuucacagacccugcguccaucgcggcgcguggcuauaucagcacuagaguugaaaugggcgaagccgcaggcauauuuaugacagccacaccacccggaucuagagauccauucccacagaguaacgcgccaauaauggaugaagaacgagaaauuccugagaggagcuggaacucgggacacgaauggguaacagacuuuaaaggaaagacaguaugguucgucccuucaaucaaagccgguaacgacaucgcagccugccucaggaaaaauggcaagaaaguaauacaacugucgcgaaaaacauuugauucagaauacguaaaaacuagagccaaugauugggacuuuguaguuaccacugacauaagcgagaugggagcuaauuucaaagcugaacgugucaucgauccuagacgaugcaugaaacccguaauccuaacagacggcgaggaaagaguuauacuagccggacccaugccagucacucauagcagugcugcccagagaagaggacgaauaggacguaacccuaagaaugaaaaugaucaguacaucuacaugggugagccucuagaaaacgacgaagauugugcucacuggaaagaagccaaaauguugcuugauaauauuaauacuccugaagggauuauaccaaguauguuugagccugaacgagagaaaguagacgcaauugacggagaauaucgacuucguggagaagcacgaaagacauuuguagaucucaugaggcgaggugaccuucccguaugguuagcguacagaguugcagcagaagggaucaacuacgccgauagaagaugguguuuugauggaauuaaaaauaaccaaauauuagaagaaaacguugaaguugagaucuggacuaaagaaggugagcggaagaaacucaaaccacgauggcuugaugcacgaaucuacagcgauccuuuagcacuaaaagaauuuaaagaauuugcggccgguagaaaaucccuuacacucaauuugaucacggaaaugggaagacucccuacauuuaugacgcagaaggcgagagaugcacuugacaaucuagcuguccuacauacagcagaagccggagguagagcguauaaccaugcauugucagaguuaccggaaacauuggagacacucuugcuacuaacccuuuuggcaacuguaacuggaggaauuuuucucuuucucaugucagguaaaggcauaggaaaaaugacauuagguauguguuguauaaucacagcaagcauacuuuugugguacgcucagauacaaccacauuggaucgcggcuucuauaauuuuagaguucuuuuuaauuguacuuuugauacccgaaccugaaaagcaacgcacuccgcaagacaaucaauuaaccuacguaguaauugcuauacuaacagucguugcggccaccauggcaaacgaaauggguuuucuugagaaaacgaagaaagauuugggguuggguucaauagcgacucaagaaucggaaagcaauaucuuggacauugacuuaagacccgcaucggcauggacucucuacgcaguagcuacgacauuuguaacaccuauguuaagacauucaauagaaaacucaagcguuaaugugucauugacggcuaucgcgaaucaagcuacuguucuuauggggcuuggaaaaggguggccucuuucaaaaauggauauuggagugccccuccuagcaaucggcuguuacagucagguaaaucccauaacgcuaacagccgcauuacuccucuuaguagcacacuacgccauaauaggaccugguuuacaagcuaaggcgacuagagaagcucagaaacgggcagcagcuggcaucaugaaaaauccaaccgucgacggaauuacagugaucgaucuagaaccuaucccguaugaucccaaauucgagaaacaauuaggacaaguaauguuguuaauacuaugcguuacccaagucuuaaugaugcgaacgaccugggcgcugugugaagcauuaacacuggcaacgggaccaauaucgacucuuugggaagguaauccggguagauucuggaacacuacaauugcggucucaauggcaaauauuuuucgagguucauacuuagcuggagcaggacugcuauuuagcaucaugaaaaacacaacaaauacccgacgaggaaccgggaauauaggcgaaacauuaggggaaaaguggaagagucgguuaaacgcauuaggaaaaucagaguuucagauuuacaagaaaaguggaauacaagaaguagaccgcacguuagcaaaagaggguauaaaaagaggagaaacagaccaucacgcgguaucacguggcucugcaaaauugcgaugguuuguggaacgcaacaugguaacuccagaaggcaaaguaguggaccuugguuguggaaggggaggauggaguuauuauugcggugggcucaagaacguacgcgaaguaaaagguuuaacaaagggaggacccggccacgaggaaccuauuccaaugucaacauauggauggaaccugguacgucuucaaagcggcguagauguauucuuuaccccaccagaaaaaugcgauacauuacuaugcgauauaggagaaaguagccccaacccgacgaucgaagcuggcagaacucuucguguuuugaaccugguagagaacuggcucaacaacaauacccaauuuuguaucaaggucuuaaacccuuacaugcccaguguaauagagaaaauggaaacacugcagcggaaauauggcggugcccuaguacgcaauccccugucaagaaauucuacacaugaaauguauuggguuucaaaugcaacaggaaacaucgucagcucggucaauaugauuucaagaauguuaaucaaucgcuucacaaugaagcauaagaaagcgaccuacgaaccagaugucgacuuaggaagcgggacaagaaauauugggauagaaagcgaaauaccaaaucuagacaucauaggaaaaagaauagagaaaauaaaacaagaacaugaaacaagcuggcauuaugaccaggaucauccguacaaaacgugggcguaccaugguuccuaugaaaccaaacagacaggaucagcgaguucgaugguuaauggcguaguucgacuucugacgaaaccaugggacgucguaccaaugguaacacaaauggcaaugacagauacaacuccuuucggacagcaaagaguauuuaaagaaaaaguagauacgcgaacacaagaaccuaaagaggguacuaagaaauuaaugaagauuacugcggaauggcuauggaaagaguuagggaaaaagaaaacgccucguaugugcacaagagaagaauuuacaagaaaaguacgaaguaacgcagcacuaggugcuauuuucaccgaugagaacaaauggaaaucugcuagagaagcuguugaggauucgcguuuuugggaacucauugacagagaaagaaauuuacauuuagaaggaaaaugugaaacaugcguauauaauaugaugggaaagagggaaaagaagcugggagaauuuggaaaagcaaaagggagucgcgcgauaugguauaugugguuaggagccagguuuuuagaguuugaagcauuaggcuuccucaaugaggaucacugguuuucgcgcgguaauagcuuaucuggugucgaaggugaaggguuacaccgccuagguuauauauuaagagacguaagcaaaaaggaaggcggagcuauguaugcugaugauacugcuggaugggacaccagaauaacacuugaagauuuaaagaaugaagaaaugguaacuaaucacaugaagggagagcacaagaaauuagcagaagcgauuuuuaagcuaacguaccaaaacaagguuguucgagugcaacgaccaacgccgagaggcacuguaauggauaucauaucgagaagggaccaaagaggaaguggccaaguuggaacauacggccuaaauacuuuuacuaauauggaagcccaauuaaucaggcagauggagggagaagggauuuucaaaucgauucaacauuuaaccgucacagaagagauagcagugcaaaauugguuagcacgcgucgggcgagaaaggcuuuccaggauggcaauaucuggggacgauugcguaguuaaaccacuagaugauagauucgcaagugcacuaaccgcccucaacgacaugggaaaagugaggaaggauauacaacagugggaacccucacgaggauggaacgauuggacacaaguuccauucugcucucaucauuuucaugaacucguuaugaaagacggacgaguauuaguuguuccguguagaaaucaagacgagcuuauaggccgugcaagaauuucccaaggagcaggauggucgcuuaaagaaacagccugccuaggaaaaaguuaugcacagauguggacacucauguauuuccaucguagagaucuucgacuagccgcuaaugcaaucuguucugcuguuccuucucacuggguaccuacaagccguaccacauggaguauucaugcgaagcacgaauggaugaccacagaggauauguuagcaguuuggaauaggguauggauacaggaaaauccauggauggaagauaaaacgccaguugagaguugggaggagguaccguaucuaggaaaacgcgaagaccaaugguguggaucacuuauaggcuugacaagucgcgcgacgugggcuaagaauauacaaacugcaauaaaccaaguuaggucgcucaucgggaacgaggaauauacagauuacaugccaucuaugaagagauucagaagggaagaagaagaagcaggcgugcuuugguaa

SEQ ID NO: 22564 - RNA, 9876 nt, Artificial Sequence
  derived and/or modified CDS sequence (opt6) from DENV-2__EU660399__SS-prME
acagcuggaguaauaauaauguuaauaccaacagcaauggcuuuucauuuaacaacaaggaauggagaaccacauaugaucguaggaagacaagaaaaaggaaaaagucuacuauuuaaaacggaagaugguguuaauauguguacuuugauggcaauagauuuaggagaauuaugcgaagauacaauaacauauaaaugcccucuacuacggcagaaugaaccagaagacaucgauuguuggugcaacuccacgucaacauggguaacauacgguacauguacaaccacuggagaacacagaagagagaaaagaucuguagcucuaguaccacacguaggaaugggauuagaaacacgaacagaaacauggaugucgucugaaggggccuggaaacacguucaacgaauugaaacauggauacugagacauccuggauucacuauuauggcagcgaucuuagcauacacaauuggaacaacccauuuucaaagagcauugaucuucaucuuauuaaccgcuguggcuccaucgaugacuaugagauguauugggauaucuaaucgcgacuucguugaggguguaaguggaggguccuggguggauauaguucuagaacacggguccuguguaacaacaauggcgaaaaacaaaccaacacuggauuucgaguuaauuaaaacugaagcaaaacaaccugcaacguugagaaaauauugcauagaggccaaacuaacgaacacaacaacagaaagucgauguccaacacaaggagagccaagucugaacgaggaacaagauaaaagauucguauguaaacacaguaugguagauaggggaugggguaauggauguggauuauuuggaaaagguggaauaguaacgugcgcaauguuuacaugcaaaaagaauauggaggggaaaguuguauuaccagaaaauuuagaguacacaaucguuauaacaccucauucaggagaagaacaugcuguuggaaacgacacagggaaacacgguaaagaaauaaaaauaacgccgcaaagcaguaucacugaggcagagcucacuggguacgggacagucacuauggaauguucuccaaggacgggguuggauuuuaacgagaugguauuauuacaaauggaagacaaggcuugguuaguucauagacagugguuccuagaucuuccccuaccauggcuuccgggugcagauacgcaaggguccaauuggauucaaaaagaaaccuuggucacauuuaaaaacccacacgccaaaaagcaagauguaguuguacuaggaucccaagaaggagcaaugcacacagcguuaaccggcgccacagaaauucaaaugaguuccggaaaucuauuauucaccgggcauuugaaauguagacuacgcauggauaaacuucagcuaaagggaaugaguuacucaauguguaccgguaaauucaaaaucguaaaagagaucgcagaaacgcaacaugguacgauuguuauaaggguccaauacgaaggagacggauccccguguaagaucccuuucgagaucauggaucucgaaaagagacacguucucggacgucuuauaacuguuaaccccauuguagcggaaaaggacucgccaguuaauauagaggcggaaccaccguucggggacucauacauaauuaucggcgucgagcccggccaauuaaaguugaauugguuuaagaaggguaguucuauagggcaaauguuugagacgacaaugaggggcgcgaaacgaauggcaauccuaggugacacagcaugggacuuugguagcuuaggcggaguuuucacgucuauaggcaaagcauugcaucaaguauuuggagccauauauggagcagccuuuucgggcgucaguuggaccaugaaaauauuaauagguguaauaauaacauggauagguaugaauagcaggucaacgucccucagcguaucucuagugcuuguaggcguaguaacauuguaucuaggagcaaugguacaagcggauucaggaugcguagucucuuggaaaucuaaggaacuaaagugcgguucuggaauauuuauaacagacaacguccacacguggacagaacaauacaaauuucaacccgaaucgccaucgaaauuggcuagcgcaauccaaaaagcucacgaagaaggaauuugugguauucggucugucacaagacuagagaaccuaauguggaaacaaauaacuccugaguuaaaucacauccuuagcgaaaaugaaguaaagcuaaccauaaugacuggggacauaaaagggauaaugcaagcaggaaagaggucucuucggccacaacccacugaacucaaauauucguggaaaacuuggggaaaagcuaaaaugcuauccaccgaaucccauaaucaaacguuucuuauugauggaccagaaacugcagaaugucccaacacuaauagagcguggaacucucuggaaguggaagauuacggguuuggaguuuucacgaccaacauaugguuaaaacuccgcgagaaacaggauguuuucugcgauucgaaacuaauguccgcagcaauaaaagauaauagagcugugcacgcugauauggguuacuggauugaguccgcguuaaaugauacguggaagauggaaaaagcaaguuuuauagagguaaagaguugucauuggcccaagagccacacacucuggucgaauggagugcuagaaagugagaugauuauuccaaagaauuuugcgggcccagugagucagcauaacuacagaccgggcuaucauacacaaacugcagguccguggcaucuagggaaacuagaaauggauuucgauuucugugaagggacaacgguaguaguuacagaagauugcgguaaucgggggccgucucuucgcacgaccacugcauccggcaaauuaauaacagagugguguuguagaucuugcacuuuaccaccacugcgcuacagaggugaggacgguugcugguaugguauggaaauccgcccgcuuaaagaaaaggaggaaaaucuagugaauagucucgugacagcagggcauggacaaauagauaauuucucguuaggaguccuaggaauggcauuguucuuggaggaaaugcuaagaacaagaguugguacuaaacacgcgauguugcuuguagcugucuccuucgugacccucauaacagguaauaugaguuuuagagaccucggccguguuauggugaugguuggugcaaccaugacggaugacaucgggauggggauaacauacuuagcacuccuagcagcuuuuaagguaagacccacuuuugcugcgggguuacugcuucgaaaauuaacuucgaaagagcuaaugauggcaacgauuggaauagcacuccuaagucaaucgacaauaccagaaacaauucucgaacucacagacgcucucgcauuaggcaugaugguucuaaaaauaguacgaaauauggaaaaauaucaacucgcaguuaccauaauggcuauaucauguguuccaaacgcgguaauacuucaaaacgccuggaaaguuaguugcacaauacuugcagcagugucgguaucuccucuguuacugacuagcucacagcaaaaagcggacuggauaccucuagcucucaccauaaaagguuuaaacccgacagcaauauuucuaacaacauuaucacguacauccaagaaacgaucuuggccauuaaaugaagccgucauggcaguugguaugguaaguauccuagcaucuagucuccucaaaaaugauauaccuaugacggggccacuugucgcggguggguuauuaacaguuuguuauguccugacagggagaagugccgacuuagaauuggagcgcgcugccgauguaaaaugggaagaucaggcagaaauaucaggguccucuccuauauugucuauaacgauauccgaggacgggucaaugagcaucaaaaaugaagaagaagaacaaacucuuacaauauugauuagaacuggucuuuuggucaucuccggcguauuuccggucucuauacccauuacugcggcagccugguaccuaugggagguuaaaaagcaacgggcuggugucuuaugggaugugcccuccccuccaccgguaggaaaggcagaacuagaagacggagcauacagaauaaaacaaaggggcauuuugggauauagccaaauuggugccggcguauacaaagaaggaacguuccacacgauguggcacguaacucgaggugcuguauuaaugcaccgugguaaaaggaucgaaccaaguugggcugacguuaagaaggaucuaauuucauacgguggagguuggaagcuagaaggggaauggaaagagggugaggaaguacagguguuggcucuagaaccgggcaaaaauccacgugcgguacagacaaaaccaggguuguuuaaaacaaauacugguacaaucggugcuguaaguuuagauuuuucacccggcacaaguggcucaccaaucguagaucgacaaggaaaagucguuggacuguacggcaauggcguagugacacgaagcggcgcauauguaagcgcaauagcucaaacagagaaaaguaucgaggauaaucccgaaauagaagacgacauauucaggaagaaaagguuaacuauaauggaccuacacccuggagcaggaaagacuaaaaaguauuuacccgcuauagucagagaagcuauuaaaagaggacuuagaacacugauauuagcuccuacacgggugguggccgcggaaauggaagaagcucugagaggacuaccuauaagguaucaaacaccagccauaagagcugagcacacugggagagaaauaguagacuugaugugccaugcuacauucacaaugcguuuacuuucuccuguccguguuccaaauuauaaucugauaaucauggacgaagcucauuuuacagauccugcgaguaucgcagcaagaggauacauuucuacucgaguagaaaugggggaggcagcggguauauuuaugacagcuacuccuccagggagcagggaucccuuuccccaaucuaacgcgcccaucauggaugaggagagggagauaccggaaagaucauggaacucaggucacgaguggguuacggauuucaaagggaaaaccgugugguuugucccgaguauuaaagcaggaaaugacauagcagcaugcuuacggaaaaacggcaagaaaguuauacaacuaucaagaaagacuuuugauagugaguacgucaagacaagagcaaaugauugggauuucguggucacaacagauauauccgaaaugggcgccaauuucaaagcggagagagugauagauccccggaggugcaugaaaccuguaauauuaacagacggcgaagaacgagucauacucgcaggcccaaugccuguuacucacaguucagcagcgcaacgaagggggcguauaggaaggaaccccaaaaaugaaaaugaucaauacauauauaugggugaaccuuuggaaaacgaugaagauugcgcgcauuggaaagaagcuaaaauguuacuugacaacauaaauacacccgaaggaauuauuccuucaauguucgaaccggagcgugagaagguggacgccauugauggugaauacagauuacguggagaagcgcgcaaaacauucgucgacuuaaugcguagaggugacuuacccguuugguuagccuacaggguugcagccgagggaaucaauuaugcagaucgaagguggugcuuugauggaauuaaaaauaaucaaauccuugaggaaaacguugaagucgagaucuggacgaaggaaggcgaacggaagaaacuuaagcccagaugguuggaugccagaauauauagugauccgcucgcucuaaaagaguuuaaggaauuugcagcaggucgaaagagccuaaccuuaaauuuaaucacagaaaugggaagacuaccuacauuuaugacccaaaaagcacgagaugcgcuagauaauuuagcaguguugcacacugcagaagcagggggaagggcguauaaucaugccuugucggaauuaccagaaacuuuagaaacuuuauuacuauuaacguugcucgcuacaguaacagguggaaucuuccuauucuugaugaguggaaaagguauaggaaaaaugacacuagguauguguuguaucauaaccgcuagcauucuucuuugguacgcacaaauacaaccucacuggaucgcagccucuauaauacuagaguucuuucucauuguuuuguugauaccggaaccagaaaagcagaggacaccacaggauaaucaauugacuuacgugguuauagcgauucuuacuguaguagcagcgacgauggcaaaugaaaugggauuucuagagaaaaccaagaaagaccuugguuuaggaucaauagcuacacaagaaagugaaucuaacauacuagauaucgauuugcguccagcaucggcauggaccuuguacgcagucgcaacuacauuugucacaccuauguuaagacacagcauagaaaauagcucuguaaauguuagucuaacugccauagcaaaccaagcaaccguuuuaaugggguuaggaaaaggauggccacuaaguaagauggacauugguguuccacuuuuggcgauaggauguuauucacaagucaauccaaucacacuuaccgcagcacuauuguuguuaguugcccacuacgcaauaauaggacccggccuacaggccaaagcaacucgagaagcucaaaagagagcugcagcugguauuaugaaaaacccuacaguugacggaaucaccguaauagaucucgagccgauaccguacgauccgaaauucgaaaaacaacuggggcagguaaugcuucugauauugugcguaacacaaguacuuaugaugagaacaaccugggcccugugugaggcacugacucucgcuacaggaccgauaaguaccuuaugggaagggaauccuggaagauucuggaacacuacaauugcggugaguauggcgaacauauuucgaggauccuaccuagcuggagcuggauuacuauucucuauuaugaaaaacacgacaaacacuagacgagguacgggcaauauaggagagacacugggugaaaaauggaaaagccgauugaacgcgcuaggcaagagcgaguuucaaauauauaagaaaucagggauacaagaaguugacaggacucuagcuaaagaaggaauuaaacguggcgagacugaucaccaugcgguuucaagagggucagcaaaguuaaggugguucguagagagaaacaugguaacgccggagggaaaaguaguggacuuagguugcggaagaggggguuggucauacuauugcgggggucucaaaaauguaagggaagugaaaggacugaccaaaggaggaccuggucacgaagaaccgauaccuaugagcacuuauggcuggaauuuaguaagacuacagucaggaguugacguguucuuuacaccaccugaaaagugcgauacacuccuaugcgauauuggugagaguaguccgaauccaacaauugaagcuggaaggacgcucagaguuuuaaaucuaguagaaaacuggcuuaauaacaacacccaauuuugcauuaaaguauuaaaccccuacaugccaagcguaauagagaaaauggagacauuacaaagaaaauacggaggggcauuaguacgcaauccguuaucaagaaacucgacucaugaaauguacuggguaaguaaugcaacuggaaauaucguaagcucaguuaacaugauaucacguauguuaauaaacagauuuaccaugaaacacaaaaaggcaacuuacgaaccagacguggaucucgggaguggaacuagaaauauagguauagaaucagaaauuccaaauuuagauauaauugguaaacguauagaaaagaucaagcaagaacacgaaacgucuuggcauuaugaccaagaccauccauauaaaaccugggcauaccauggaaguuacgaaacgaagcaaacgggaucagccucaucuauggugaauggagucguccgauuauuaacaaagccuugggacguugucccaauggugacccaaauggcgaugacagauaccacuccuuuugggcaacaaaggguuuucaaggaaaaaguagacaccaggacacaagaaccgaaagaagguaccaagaaacuaaugaaaauuacagcugaaugguuauggaaagaauugggcaagaagaaaacaccaaggauguguacccgagaggaauuuaccagaaaaguaagaucaaaugcugcccuaggcgccaucuucacagaugaaaauaaauggaaaucagcaagggaagcaguugaagacucaagauucugggaauuaauagacagggagaggaaucuccacuuggaaggaaaaugugagacaugcgucuacaacaugauggguaagcgugagaagaaauuaggugaguucggaaaagcgaaaggaaguagggcuauuugguauauguggcuaggcgccagauuucuagaauuugaagccuuaggauuucuaaaugaagaccauugguuuuccagaggaaauucacucucaggcguagaaggugaagggcugcaccguuuaggcuauauuuugcgugauguuaguaagaaagagggaggagcaauguacgcagaugauaccgcaggcugggauacuagaauuacgcuggaagaccuuaaaaaugaagaaaugguuacuaaucauaugaaaggagaacacaaaaaguuagccgaagcaauauuuaaauuaaccuaccaaaauaaaguaguacgaguacaacggccaacaccaagagggacaguaauggauauaauuaguagacgggaccaaaggggaaguggacaaguugguacguacggucuaaacacauucacaaauauggaagcccaacuuauaagacaaauggaaggugaaggaauauucaagucuauucaacauuuaacugugacagaggaaaucgcggugcaaaauuggcuagcacgcguagggcgagaaagauugucacggauggcaauaucuggugaugauuguguagucaaacccuuagaugaucguuuugcguccgcccugacugccuugaaugauaugggaaaaguuaggaaagauauccaacaaugggagccgucgaggggcuggaacgauuggacacagguuccauucuguagucaucauuuccacgagcugguuaugaaagaugguagaguucucguugucccuuguaggaaccaagacgaacugauuggacgagcgcgaauaucucaaggagcuggauggucauuaaaagaaacagcgugucugggaaaaagcuaugcgcaaauguggacuuugauguacuuucaucggcgugauuuaagauuagcugcaaacgcuauaugcucugcuguccccucucacuggguaccaacaucaaggacaacguggucaauucacgcuaaacacgaauggaugaccacagaagauauguuagcaguguggaaccgagucuggauacaagaaaacccauggauggaagacaagacaccaguugaaucaugggaggagguaccauaccugggaaaacgggaggaucaaugguguggaaguuuaauaggcuuaacgucccgugcaacaugggccaaaaauauccagacagcaauaaaucaaguacguucuuuaauaggaaacgaagaauacacugacuauaugcccucuaugaaacgauuuagacgggaggaggaggaagccgguguuuugugguga

SEQ ID NO: 22565 - RNA, 9876 nt, Artificial Sequence
  derived and/or modified CDS sequence (opt6) from DENV-2__EU569708__SS-prME
acugcaggaguaauaaucauguuaauuccaacugcuauggcguuucaucuaacuacccguaauggagaaccgcacaugaucguuggaagacaagaaaaagggaaaagucuacucuuuaaaacagaagauggggugaauauguguacacuuauggcaauugacuuaggagaacuaugugaagauacaauaacuuauaaauguccauuguugcgacaaaaugaacccgaggauaucgacugcugguguaauaguacuucgacauggguaacuuacggaacauguacuacaaccggugaacaucgacgugagaaaagaagcguagcauuagugccacauguugguaugggucuagaaacaagaaccgaaacauggaugucaagugaaggugccuggaaacauguacaacguauagagacauggauucucaggcacccgggauuugcaauaauggcugcuauucuagcuuauaccauaggaaccacucauuuucagagggcacuaauauucauacuucuuacggcuguagcacccucuaugacuaugagauguauuggaauauccaaucgggauuuuguugaaggaguaagcggcggaaguuggguugauaucguucuagaacacggcaguugcguaacuaccauggcuaaaaacaaaccaacacuggacuuugaauuaauuaaaaccgaagccaaacaaccugcuacgcugagaaaauauuguauugaggccaaacuuacgaauacaacaaccgagucuagaugcccgacgcaaggugaaccgucacugaaugaagaacaggauaaaagguucauauguaaacacucaaugguugauaggggaugggguaacggauguggucucuucggaaaaggugguauuguaacaugcgcgauguuuaccugcaagaaaaauauggaaggaaaaguuguacuuccagagaaucuggaguauacaauuguuauuaccccacauucuggagaagaacaugcaguaggaaacgauacgggaaaacauggcaaagagauaaaaauaaccccacaauccucgauuacagaagcugagcucacaggauacgguaccguaacuauggaauguucccccagaacuggacuagacuuuaacgaaaugguguuacuucagauggaggaaaaagcauggcugguucaccggcaaugguuccuugaucuuccucuuccauggcuaccaggagcagauacgcaagguagcaacuggauacagaaagaaaccuugguaacuuucaaaaauccccaugcgaagaaacaagaugugguuguacugggaucucaagaaggcgccaugcauacagcucuaacaggagcaacugaaauacaaaugaguucaggaaaucuccucuuuacaggccaucugaaaugcaggcuuaggauggauaagcugcaacuaaaagguauguccuauucaauguguacaggcaaauuuaaaauaguuaaagaaauagcagaaacacaacauggaacaaucguuauuagaguacaauacgaaggugacgggaguccuugcaagauuccuuucgagauaauggauuuagagaaacgccacguacugggacgauuaauaacagugaaucccauaguaacugagaaagacaguccagugaacauagaagcagaaccuccauuuggcgauaguuacauuauaauaggcguagagccgggacaauuaaaauuaaauugguucaagaaagguucuagcauuggucaaauguucgagacgacaaugaggggagccaagagaauggcaauacugggcgauacagcaugggacuucggaagccucggugggguauucacaucaauuggcaaagcacuccaccaaguauucggugcaauauauggagcagcuuucaguggagucaguuggacuaugaaaauacuuauaggggugauaaucacuuggauuggaaugaacagucguucaacaagucucagcgucagcuuaguucuggugggugugguuacauuguaucucggugcaaugguacaagcagacucaggguguguaguguccuggaagaacaaggaacugaaauguggaaguggaauauuuauaacagauaauguacacacuuggacugaacaguacaaguuccaacccgagucaccauccaaacuagcuucugcaauccaaaaagcacacgaagagggaauaugcggaauaagaucuguaacucgucuagaaaacuuaauguggaagcagauaacacccgaauugaaccacauucucucugaaaaugaggugaaauuaacaauaauaacaggagacauaaaaggcauuaugcaagcaggaaagcgauccuuaagaccucaaccaacagaacucaaguauucauggaaaaccugggggaaagccaaaauguuaaguaccgaaucacacaaucaaacauuucuaauugacggcccugagacagcugaguguccgaauacaaauagggcauggaacucacuggagguagaagacuacggauucgguguuuuuacaacgaauauuugguuaaagcugcgcgagaaacaggauguuuucugugacucaaaguugaugucugcagcaaucaaagacaaccgagcaguucacgcugacaugggcuauuggaucgagucggcacuuaaugauacauggaaaauggagaaagccucauucaucgaaguaaaaagcugucauuggcccaaaagucacacuuuauggucuaacggcguucuugagucagaaaugaucauucccaaaaauuuugcaggaccaguuagccaacacaauuacagaccgggguaccacacccagacugccgggccauggcaccuuggcaaacuagaaauggauuuugauuucugcgaagggacuacaguuguaguuacggaagacugugguaaucgaggaccgucacuaagaaccaccacggcguccgggaaacuuaucacugaaugguguugccguaguuguacguuaccgccuuugagauaccguggagaagacggcugcugguacggaauggaaauuaggccacuuaaagaaaaagaagaaaaccuaguuaacagucuggucacugcgggacacggacagauugauaauuucucauuggggguacuaggcauggcauuauuucuugaagaaauguuacguacuagaguuggaacuaaacaugcuauuuuauugguugccguuucuuuugucacgcuaauaacgggaaacaugaguuucagagaucuaggcagggugauggucauggugggcgccacaaugacggaugacauugggaugggcguuacguaucuagcccuacucgcugcauuuaaagugcggcccacauucgcggcuggccuacuauuaaggaaacugacgaguaaggaacuaaugauggcaacaauaggaauugcacuguuaucgcaguccaccauacccgaaacgauauuagaauuaacagaugcauuagcacucggcaugaugguacuuaaaaucgucagaaauauggaaaaguaucaacuagccgugacaaucauggcuauaucaugugucccaaacgccguuauucuauuaaaugcauggaaaguaaguugcacuauacuugcagccgugucgguuucuccuuuauuauuaacaaguucucagcagaaaacugauuggauaccucuagcauugacaaucaaagguuuaaacccaaccgcgaucuuucuaaccacguuaucuagaacaucaaagaagagaucauggccacuaaacgaggcggugauggcaguuggcaugguaagcauucuggcauccagcuuacuaaagaacgacaucccaaugacagguccccuaguggcugggggccuacugacaguauguuauguccugacaggacguagugcugaccuugaguuagaaagagcagcagauguaaaaugggaagaucaggcugaaauaagugguucaaguccaauacuaagugucacuauuucagaggaugguucuaugucuaucaaaaaugaagaagaagaacaaacauuaacaauacucaucagaacaggacucuuaguaauuaguggaguuuucccaguaagcauccccauaacagcagcagcaugguaucuaugggaaguaaagaaacagagagccggaguuuuaugggauguaccuaguccaccgccaguaggcaaagccgaacuagaggauggcgcguaccgaauaaaacaaagaggaauauuaggguauucacaaaucggugccggaguauauaaagagggcacuuuucauaccauguggcacgugacgcggggcgcugugcuaaugcauagagggaagagaauagaacccaguugggcugaugucaaaaaggauuuaauaucuuacggcgguggauggaaacuugagggugaauggaaagaaggcgaggagguacaaguucuagcgcucgaaccaggcaaaaauccgagggcgguacaaacgaaaccaggauuauuuaaaacaaauacaggcacgauaggcgcaguuagcuuagacuuuucuccuggaacaagugguaguccaauuguagaucguaaagguaaaguggucggauuauaugguaauggaguugucacaagaucaggugcauauguuucagcaauagcccaaacugagaaaucaauugaggacaaucccgaaauugaagacgacauauuuaggaagaaaagauuaacuauaauggauuuacauccgggugcuggaaaaacaaaacguuaucucccugcuauagugcgcgaggcaauaaaaagaggacuaagaacauuaauucuugcuccaaccaggguugucgcugcggagauggaggaggcauuaaggggauuaccaauuagauaucaaacaccagccauaagagcugaacauacugguagagagauuguugaccuuaugugccaugcuacauuuacgaugcggcuccuuucaccaguuaggguccccaacuauaacuuaauuauaauggacgaagcccacuuuacagacccugcaaguauagcagcacgcggauacauaucuacucgggucgaaaugggagaggcagcaggcauauuuaugaccgcaacaccacccggcagccgagaucccuucccucaguccaaugcaccuauaauggacgaagagagagaaauuccugaacguaguuggaacaguggacacgaaugggugacagauuucaaagggaaaacaguuugguucguuccaaguauaaaagcagggaacgauaucgcugcauguuuacgcaaaaacggcaagaaaguuauccaauuaucgcgaaagaccuucgauucagaauauguaaaaacccgagcaaacgacugggauuuuguaguuacaaccgauauauccgagaugggugcuaauuuuagagcggagcguguaauagaccccaggcgcugcaugaagccagucauuuuaaccgauggcgaagaaagaguaauucuagcugggccuaugccaguuacucauucuagugcagcucaacgaagaggccggaucggucguaauccgaaaaaugagaaugaucaguauauuuacaugggugagccuuuagaaaacgaugaagacugcgcgcauuggaaagaagcuaaaauguugcuggauaacaucaauacuccagaaggcauaauaccuucaauguuugaaccggaaagggaaaagguggacgcuauagacggcgaauaucgucuacgaggagaggcacgaaaaacauuuguugaucuuaugagacgaggagaccuaccaguuuggcuugcauauaggguagcagccgaagguauuaauuaugcagauagacgaugguguuuugauggaauuaaaaauaaccaaauauuagaggagaacguagaaguagagauauggacgaaagagggcgagcggaagaaacuaaaaccaagaugguuagaugcgagaauauauucggauccucucgcuuuaaaggaguucaaagaauuugcugcuggaagaaagagucuaacacuuaauuuaaucacugaaaugggacgacucccaacuuucaugacccagaaagcgcgcgaugcuuuagacaacuuagcuguauuacauaccgcggaagccgguggcagagcuuacaaccacgcauuaagcgaacugcccgaaacacuagaaacacuacucuuacuuacacuacuugcaaccgugacagggggcauauuucucuuccuaaugagugguaaagguauagguaaaaugacgcucggaauguguugcaucauuacagcgucgaucuuauuaugguacgcucaaauacaaccccauuggauagcugcuucgaucauucuagaguucuucuuaaucguacuauuaauccccgaaccugaaaagcaacggacaccacaagacaaccaauugaccuauguagucauagcuauauuaacgguagucgcagcgacuauggcgaacgaaaugggguuucuugagaagacgaagaaggaucucggauugggaaguauaaccacgcaagaaucagaaagcaauauacuagacaucgacuuaaggccagcuucagcauggacucuuuacgcuguagcuacaacauucguaacucccauguuaagacauagcauugaaaacaguucggucaaugugagccugacagccaucgcuaaucaggcuacuguuuuaaugggccuugguaaggguuggccauuaagcaagauggauauuggaguaccccugcuggcaauuggauguuauagucagguaaacccaauuacauugaccgcagcucuacuguuauuaguugcucauuaugccaucaucggaccuggauuacaggcgaaggccacaagagaagcacaaaaacgagcagccgcagguaucaugaaaaacccaacagucgacggaauuacaguuauagaccucgaaccaauccccuaugaccccaaauucgaaaaacaacuaggacagguuaugcuacuaauacuuuguguaacgcaaguuuugaugaugagaacgacaugggcacuaugugaagcacuaacccucgcgacagggccgaucagcacauuaugggaagggaacccuggucgauucuggaauacuacuaucgcaguaaguauggcuaauauuuuccggggaucuuaucuagccggugcuggauuauuauuuucaauuaugaaaaacacaacuaauacgagaagagggacgggcaacaucggagagacgcuaggugagaaguggaagucacgccuuaacgcccuuggaaaauccgaguuccagauuuauaaaaagagcggcauucaagaaguagauagaacguuagcaaaagaaggaauuaaacgaggggaaaccgaccaccaugcgguaucuagagguucugcaaaacuccguugguuuguggaacggaauaugguuacuccugaggguaaaguaguugaccuuggcugcggacgagguggauggucauacuauugugguggccuuaaaaauguucgcgaaguaaagggauuaacgaaaggaggcccaggacaugaagaaccuaucccaaugagcacauauggauggaauuuaguucgacugcaauccggagucgauguauucuuuacaccuccggaaaaaugugacacuuuacugugcgacaucggcgaaagcucgccaaaccccacaauagaggcggguagaacguuaaggguauuaaaucuaguagaaaacugguuaaacaauaauacacaguucugcauuaaaguccugaauccauacaugccaucaguaaucgagaaaauggaaacuuuacaacgcaaauacggaggagcucuaguaagaaacccuuugagcagaaauuccacucacgagauguauuggguuucuaaugcgacugguaacauaguaagcucagugaauaugaucucgagaaugcugauuaauagauucacuaugaagcauaaaaaggcaacauacgaaccagacguugaccuagggaguggcacacguaacaucgggauugaaagcgaaauuccaaaccuugacaucauaggaaaaaggauugaacgaauuaaacaagagcaugagaccagcuggcauuacgaccaagaucacccuuacaagacaugggcauaccacgguaguuaugaaacuaaacagacagggucugcaagcagcaugguuaacggaguaguaagauuacuaacaaaaccuugggaugucguaccaaugguuacccagauggcuaugaccgacacaacuccauucgggcaacaacguguauucaaagagaaaguugauacgcgaacgcaggaaccaaaagaaggcacaaagaaacuaaugaggauaaccgcugagugguuauggaaagaauuaggcaaaaagaaaacuccacgaaugugcacucgugaagaguucacuagaaaaguaagaagcaacgccgcacuuggagcaguguucaccgaugaaaacaaguggaaaagcgcucgugaggcugucgaagacucucgauucugggagcuagucgauagagaaaggaaccugcauuuagaggguaaaugugaaacaugcguuuacaacaugaugggaaaaagggagaagaaacuaggagaauuuggaaaagccaaaggaucacgugccauaugguauaugugguugggagcuagguucuuagaguucgaagcacuuggauuucuaaaugaagaucacugguucucgagacggaauaguuugucuggaguugagggggaagguuuacauagauugggauacauucuuagagaugucagcaagaaagagggaggggcgauguacgcggaugacaccgcgggaugggacacucgaauaacccucgaggaucucaagaaugaagaaaugguuacaaaccauaugaagggcgaacauaaaaagcucgcagaggccauauucaaacucaccuaccagaacaaaguaguaaggguccaacguccuacaccaagggggacuguuauggauauuaucucuaggcgggaccaacgugguagcggucaaguggguacuuauggacuuaauacauucacaaauauggaagcucaauuaauacgccaaauggaaggugaagguauauuuaaaagcauacaacaccuaacggucacugaagaaaucgccguacagaacuggcuggccagaguuggaagagaacgauugucgaggauggcuaucucuggggaugacuguguagucaagccacuugaugacagguuugcaagcgcacuaacggcucuuaacgacaugggcaaagugagaaaagacauucaacaaugggaaccaaguagagguuggaaugacuggacacaagugccguuuugcucacaccacuuccacgaacucguuaugaaagacgguagaguuuuaguuguucccugccguaaccaagaugaauuaauuggccgugccagaauaucccaaggagcaggguggucacuaaaagaaaccgcuugccucgggaaaucuuaugcacaaauguggaccuugauguauuuucaucguagagauuuacgguuagcggcgaaugccauauguucugccguacccucccacuggguaccaacaagcaggaccacauggaguauacaugccaagcaugaguggaugacuacggaggauaugcuagcgguuuggaauagggucuggauacaagaaaauccauggauggaagacaaaacacccguagaaucuugggaggaggucccauaucuuggaaaacgagaggaucaauggugugguagcuugauaggauuaacguccagagcuacaugggcgaagaauauacaaaccgcgauaaaccaaguaagaucauugauuggaaaugaagaauauacugauuauaugcccucaaugaaaagauucagacgagaggaagaagaagcggguguacucugguag

SEQ ID NO: 22566 - RNA, 9876 nt, Artificial Sequence
  derived and/or modified CDS sequence (opt6) from DENV-2__EU569709__SS-prME
acggcagggguuauuauuauguugauuccaacagcuauggcuuuucaccuaacuacgagaaacggagaaccucauaugauuguaggaagacaagaaaaagggaaaucacuauuauuuaaaaccgaagacgguguaaauaugugcacauugauggcgauagaccuaggagaauuaugcgaagauacaauuacauauaaguguccguuguugagacagaaugaaccugaagacauugacuguuggugcaauucgacaucaaccuggguuacuuacggaacuuguacaacaaccggagaacauagaagagagaaaaggucaguagcguuaguuccucacgucggaaugggauuagaaacaaggacggaaacauggauguccucagaaggggcauggaagcauguacagcgaauagaaaccuggauccuucgacauccaggauuuacaauaauggcugcaauauuagcguauacaauuggaaccacgcacuuccaaagggcuuuaauauucauccuacuuacagcuguggcaccuucaaugacgaugagauguauaggaaucucuaaucgugacuucguugaaggaguuucuggcgguucguggguagauauaguacuggaacauggaucgugcguaacaacgauggccaaaaauaaaccaacacuggauuucgaauugauaaaaacagaagcuaaacaaccagcuacccuacgaaaauauuguauagaagcaaaacuuacgaacacaacgacagaaucaagaugcccuacacaaggcgaaccguccuuaaacgaagaacaggacaaacgauuuauauguaaacauucaaugguagaucgggguugggguaacggaugugguuuauuugguaaagggggaauaguaacaugugcaauguuuacuuguaagaaaaacauggaaggaaaaguaguccucccagaaaacuuagaauacacaauuguaauaaccccacacucaggagaagaacaugccgucgguaaugacacaggaaaacaugguaaagaaauuaagauaacuccucagucaucuauuacagaggcggagcuaaccgguuauggaacaguaacuauggaaugcucaccuagaacaggcuuggauuucaaugaaaugguauuauuacaaauggaggauaaagcauggcuaguucaucgccagugguuuuuagaucuuccauuaccauggcuuccuggugcagauacucaagguucaaacuggauacagaaagaaacauuaguaacauuuaaaaacccccacgccaaaaagcaagauguugucguccuuggaucacaagaaggugcaaugcauacagcuuuaaccggcgcaacggaaauccaaaugucgucgggcaaucuucuauuuacaggacacuuaaaguguagacuacggauggacaaguuacaauugaaaggaaugagcuauucaaugugcacagguaaguuuaaaauaguuaaagaaauagcagaaacccaacauggaacuauaguaauaaggguacaauaugaaggagacggaaguccaugcaagaucccauucgaaauaauggauuuggagaaacgguacguuuuagggcgauuaauuacaguaaacccuauugucaccgaaaaagauucuccuguuaauauagaggccgaacccccuuuuggagauucauauauuauuauuggugucgaaccaggucaacugaaacuuaacugguucaaaaagggaagcucaaucggucagauguucgagacaacgaugagaggagcaaaaagaauggcaauuuuaggggauacugcaugggauuuuggaaguuuaggagguguauucacgucaauagguaaagcauugcaucaaguuuucggugcaauuuauggugcagcuuucucagguguuaguuggacgaugaagauauuaauaggcguaaucaucaccuggauagguaugaauagucgaaguacgucauugucuguaucguuaguucuugucggcguaguaacucuauaucuagggguaaugguacaagcagauagcggauguguaguaaguuggaaaaacaaagagcugaagugcgggucugguaucuuuauuacggacaauguacauacauggacagaacaauacaaguuucaaccagaaucucccaguaaauuagccucagcaauacagaaagcacacgaagaagguauauguggcaucagaagcguaacacggcuugaaaaccuaauguggaagcaaauaacucccgagcuuaaucauauuuuauccgaaaacgaaguaaaauuaaccaucaugacuggcgacaucaagggaauaaugcaagcaggaaaaagaucacuucgaccgcaacccacagaauuaaaauacucauggaagacauggggaaaagcaaagauguuauccacagaaagucacaaucaaacguuucugauagauggaccagaaacugcugaaugcccaaacacaaacagggcuuggaacucucuagaagucgaggacuacggcuuuggagucuuuucuacaaauauauggcuaaaauuaagagaaaagcaagacguauucugcgacucaaaacuuaugagugccgcaauuaaggacaauagagcaguacaugcggauaugggguauuggauugagucugcuuuaaacgauacauggaaaauggaaaaagccagcuuuaucgagguuaaaucaugccacuggccaaagagucacacccuuuggaguaacgguguucucgagucggaaaugauaauacccaaaaacuuugcagguccaguaucccaacacaacuacaggccagguuaccacacccaaacagcuggucccuggcauuuggggaaauuagaaauggacuuugacuuuugcgaggguacaaccguagucguaacugaagacuguggaaaccgugguccgagcuuaagaacaacuacagcuuccgguaaacucauaacagagugguguugucguaguuguacucuuccgccucuacgcuacagaggagaggauggcuguugguacggaauggaaauuagaccguuaaaagaaaaagaagaaaauuuaguaaauuccuugguaacagcuggccauggucaaauagacaauuucucauugggcguacuagggauggcacuguuuuuagaagaaauguuaagaacaagagugggaacuaaacacgcuauacuacucguagcaguuucguucgucacccuuauuacaggcaacaugucguuuagggaccucggacgcgucauggugauggugggugcuacaaugaccgacgauaucggcaugggcgucacguaccucgcacugcuugcagcuuucaaaguccgacccacuuuugcagcuggucucuugcuccgcaaauuaacuucaaaagaacucaugauggccacgaucggaauagcacuacuaucucagucgaccauaccugagacaauucuagaauuaacugaugcacuagcauuggggaugaugguccugaaaauaguucgaaacauggaaaaauaucaguuggccgugacgauaauggcaauacucuguguuccaaacgcaguuauccugcaaaaugcauggaagguaaguuguaccaucuuagcugcgguaucuguaaguccacugcugcucacuucaucgcagcaaaaggcagauuggauaccccuagcgcuuacaaucaaaggccucaacccaacugccauauuuuuaacaacauuaucucgaacauccaaaaagcggagcuggccauugaaugaagcaguuauggcagucgguaugguuucuaucuuggcgaguucauugcucaaaaaugacauuccaaugacaggaccauugguggcugguggauuauuaacaguauguuacguauuaacaggaagaucagcggauuuggaacucgagcgagcggcugauguaaagugggaggaucaagcugaaauuucgggaaguucuccgauucuuaguauaacaauaucugaggacggaucuaugaguauaaagaacgaagaagaggaacaaaccuuaacaauacuaauucgaacaggucucuuggugauaucagguguauucccagugucgauucccauuaccgccgcugccugguacuugugggaaguuaagaaacaaagagccgguguacuaugggacguccccucaccgccaccuguaggaaaggcugaauuagaagacggggccuauaggauuaaacaaagagggauuuuuggguacucccaaauuggugcuggcguguauaaagaggggacguuucauaccauguggcauguuacucggggugcgguacugaugcacaggggaaaacguauugagccaucaugggcugaugucaagaaagauuugauuucauacgggggagguuggaaacuugaaggugaguggaaagaaggggaagagguucaaguacuagcacuagaacccggcaaaaaucccagagcgguccaaacaaaaccgggacuguucaaaaccaacacaggaacaauaggagcaguaucuuuggacuuuucaccaggaacaaguggcaguccgauaguugaucgaaaggguaaaguagucggauuauauggaaauggggucgucacaagaaguggagccuacguuucagcaauugcccaaacagagaaaagcauagaagauaacccagaaaucgaagaugauauuuucaggaaaaagcggcuaaccauaauggaucugcaccccggggcagggaagacaaaacguuaccuuccggcuauaguacgggaagcuaucaaaagagggcuccgaacacuaauuuuagccccgacuaggguagucgcugccgaaauggaagaagcucuaagaggacuaccgauucgauaccaaacaccagcuauacgagcugaacacacuggcagggaaauaguugacuugaugugucacgcuacauuuacuaugagauuacucucacccguaagaguaccuaacuauaaucuuaucauaauggacgaagcucacuuuacagauccagcgucaaucgccgcuaggggauauauaaguacaaggguagaaaugggagaagccgcuggaauuuuuaugacugcuacacccccaggcaguagagaccccuucccacaaucgaaugccccaauaauggaugaggaaagagagauaccggagagaucguggaacaguggccacgaauggguuaccgauuuuaaaggaaaaacgguaugguucguuccuuccauaaaggccggcaacgauaucgcugcuugcuugcgcaaaaauggcaagaaaguaauacaacuaucacgaaaaaccuuugauagcgaguauguaaaaacgagagcaaacgacugggauuucgucgugaccacggauauauccgaaaugggagcuaacuucagagcggaacgaguuaucgacccaagacgcuguaugaaaccaguaauauuaacugauggagaggagcgaguaaucuuagcaggcccuaugccaguuacucauucaucagcagcacaacggcgagguagaauuggacgcaaucccaaaaacgaaaaugaccaauauaucuacaugggggaaccucuagaaaaugacgaggauugcgcgcauuggaaagaagcuaaaauguuacuagauaacauaaauacuccagaaggaauaauuccaaguauguuugaaccagaaagagaaaaaguggaugcaaucgacggagaauauagauuacgaggugaagcaagaaagaccuuuguggauuuaaugaggagaggggaccuccccguuuggcuagccuaucgagucgccgccgaaggcauuaauuaugcagaccgacgauggugcuucgacggaauaaagaacaaucaaauacuagaggagaacguagagguagaaauuuggacuaaagagggugaaagaaagaaauuaaagccaagauggcucgaugcucgcauauauucugauccgcuagcucugaaagaguucaaagaauuugcagccggaaggaaaucccuaacacuaaacuuaauaacagaaaugggaagacuaccaacuuuuaugacacaaaaggcucgggaugcccucgauaaccuagcaguauuacacacagcggaggucgggggacgggcauauaaucaugcgcugucagaauuacccgaaaccuuagagacccuauuauuguugacccuacuagcaacuguuacaggaggaaucuucuuauuucuuaugucggggaaaggaauaggcaaaaugacucucgguaugugcugcauuauuacagcgucaauucuuuuaugguaugcacagauucagccgcauuggauugcagcaucaauaauccuagaguucuuccucauaguguugcuaauaccagaaccggagaaacagaggacaccgcaagauaaccaacuaacguaugucgugauagcuauccuaacggucguugccgcuacuauggcaaaugaaaugggcuuccuggagaaaacuaagaaggaccuuggguuaggaagcauaauuacacaagagagugaauccaauauauuggauauagauuugagaccagcaucggcauggacuuuauacgcugucgcaacgacauucguaaccccaauguuaagacauaguauagaaaauucaaguguaaacguaaguuuaacugcaauugccaaccaggcaacuguacuaaugggucucggaagagguuggccguuaaguaaaauggacauaggagucccucugcuugcaauaggcugcuauucacaaguaaauccaauaacguuaacugcagcauuacuacuacugguagcacauuacgcaauaauagguccaggacugcaggcgaaagccacucgcgaagcgcagaaaagggccgccgcgggaauuaugaaaaacccuacuguagaugguauaaccgugaucgaccuagaaccuauacccuacgauccaaaguucgaaaaacaacuaggccaggucaugcuauuagucuuauguguaacgcaaguacugaugaugagaaccacaugggcguuaugugaagcguuaacacuagcgaccgguccgauuaguacccuuugggaggguaacccuggcagauucuggaacacuacaauagcuguaucgauggcaaauauauuuagagggagcuauuuagccggugcuggucuccuguucucgauaaugaaaaauacuacuaauacacgaagggggacagguaacauaggagaaacguuaggggaaaaauggaaaaguagauuaaaugcauuaggaaaaucggaauuucagauauacaagaaaagugggauacaggaagucgauagaacccuagcuaaagaggguauaaaacgcggugaaaccgaucaccaugcgguaucaaggggaagugcaaaauuaaggugguucguugaaaggaauauggucacacccgaagggaaaguuguagauuuaggcugugguagaggcggauggagcuacuauuguggaggccucaaaaauguaagggagguuaaaggguuaaccaaaggaggcccuggccaugaagaaccuauaccgaugucaacauauggauggaauuuagugcguuuacaaucgggaguagacguguucuucacuccgccagaaaaaugcgauacauuauuaugcgauaucggggaaagcaguccuaauccgacgauugaagcagggagaacauuaagaguccuaaaccuuguggaaaacugguuaaacaacaauacccaauuuuguauuaaaguauuaaauccuuauaugccuuccguuauugagaaaauggaaacuuuacaaagaaaauaugggggagccuuagugcgaaauccacuuuccaggaacucaacacaugagauguauuggguaucgaaugcaacugguaauauuguauccucaguaaacaugauuucgagaaugcuaauaaacagauuuaccaugaaacauaagaaagcaacuuaugaacccgacguagaucuagguucggguacaagaaacauaggaaucgaaaacgaaauuccaaaucuugacauaauagguaaaagaauagagaaaauuaagcaagaacacgaaacaaguuggcauuacgaucaagaccauccuuacaaaacaugggcauaucauggcucauacgaaacgaaacaaacuggcucugcaucaaguaugguuaacgggguaguccgccugcuaacaaaaccaugggauguaguaccaauggucacccaaauggcaaugacugauacaaccccuuuuggacaacagcgcguguuuaaggaaaaaguagauacuaggacacaagaacccaaggaaggaacaaagaaacuaaugagaauuacagccgaaugguuauggaaagaacuuggcaagaagaaaacuccgcgcauguguacgagagaagaguucacuaggaaaguaagguccaaugcggcgcuuggagccauauuuacagaugagaacaaauggaaaagcgcacgugaagccguagaagauagucgauuuugggagcuaguagaucgagaacgcaacuuacauuuagaaggaaaaugcgaaacaugcguauauaacaugauggguaaacgggagaagaaauuaggagaauuugguaaggcaaagggaagucgagcaaucugguauauguggcuaggagcaagauuuuuagaauuugaagcucucggguuuuuaaaugaggaucauugguuuucuagggggaacagucuaucaggaguugaaggagaaggauuacacaaauuaggauauauucuccgagauguaagcaagaaagaagggggagcgauguacgcagaugacacugcuggaugggauacaagaaucacccuagaagaucucaaaaaugaggaaauggugacgaaucauaugaagggcgaacacaaaaaguuagcggaggcaauauuuaaacuuacguaccagaauaaaguugucaggguucagagaccaacaccgcgagguaccguuauggauauaauaucacgcaaggaccaaagaggguccggccaaguugguacguacggacuaaauacuuucacaaauauggaagcucaguugauacgucagauggaaggugaagggauuuucaagucaauucaacaucucacuguuacagaagaaauagcaguccaaaauuggcuugcacgaguuggucgagaaaggcucucucgcauggccauaaguggagaugacuguguagugaaaccucucgaugauagauuugcuagcgcacuaacagcacuuaaugacaugggaaagguacgaaaagauauacaacaaugggaaccuagucgagguuggaaugauuggacacaggucccuuuuuguucgcaucauuuucaugaauuagugaugaaagaugguagaguauugguagucccuugcagaaaccaagaugagcucauugguagggcacgaauuucucaaggggcgggauggaguuuaaaagaaacugcuuguuuagggaaaucauacgcacaaauguggacccucauguacuuucauaggagggaucuacgauuagccgcuaacgcaauuuguuccgccguacccagccauuggguuccgacaagccguacaaccuggaguauacaugcuaaacaugaauggaugacuacagaagauaugcuagcaguauggaauagggucuggauccaagagaaucccuggauggaagauaaaacaccuguagaaucgugggaggagguuccuuacuuagguaaaagagaagaucaauggugcgggucccuaauuggccuuaccucgcgcgcaaccugggcgaaaaacauucaaacggccaucaaccaaguaaggagcuugauaggaaaugaagaauauacugauuacaugccauccaugaaacgauuucguaaagaggaagaggaagcuggagucuugugguaa

SEQ ID NO: 22567 - RNA, 9876 nt, Artificial Sequence
  derived and/or modified CDS sequence (opt6) from DENV-2__EU596485__SS-prME
acagcagggguuauaauuaugcuuaucccaaccgcaauggcauuccaccuaacaacaaggaauggugaaccucacaugaucguagggcgacaagaaaaaggaaaaucacuuuuauuuaaaacugaagauggagucaauaugugcacgcuuauggcaauugaucuaggagaacuaugcgaagauacgaucacuuauaaaugccccuugcuaagacaaaaugaaccagaagauauagauugcugguguaauucgaccucgaccugggucacuuacgguaccugcacaacaacaggagaacaucgaagagagaaaagaagcgucgcccuaguuccucauguugggaugggucuugaaaccagaacagaaacguggaugucaagcgaaggggcuuggaaacacguccaacgcauagaaacauggauauuaaggcacccaggauucacuauuauggcggcaauacuggcauauacaauaggcacgacucacuuucaaagagcuuuaauuuucauacuuuuaacagcaguugcacccucgaugaccaugagauguauagguauuucaaaucgcgauuuuguugaaggaguaagcggagggagcuggguugauauaguucuagaacaugguucaugcguaacaacuauggcgaaaaauaaaccgacccuagacuucgaauuaauaaaaacugaggcaaaacaaccugcaacccuaaggaaauacuguauagaggcaaaacuaacuaacacaacuacggaaucuagguguccaacucaaggggaaccaaguuuaaacgaagaacaagauaaacgauuuauaugcaaacauucaaugguggauaggggaugggggaauggauguggauuguuugguaaaggcggcauagugacuugugcaauguuuacauguaagaaaaauauggaaggaaaagugguucucccagaaaauuuagaauauacuauaguuauuacaccacacucgggagaagaacacgcggugggcaaugauacaggaaaacauggaaaagaaauuaaaauaacgccacaaucgucuauaacugaagcugaacuaacuggauauggaacuguaacgauggaauguucaccaaggaccggacuugacuuuaacgaaaugguuuuauugcaaauggaagauaaagcaugguuagugcauaggcaaugguuccuagacuuaccacuuccauggcuccccggagcugauacacaggguucgaacuggauacaaaaagaaacauuaguaacuuuuaaaaacccacacgcuaagaaacaagaugugguaguacuugggucgcaggaaggugccaugcauacagcccucacuggggccaccgagauccaaauguccagugguaaucuauuguucacaggucaccucaaguguagguuaagaauggauaaguugcaacugaaagguaugagcuauucuaugugcacggguaaauuuaaaaucguaaaggagauugcugaaacucaacaugguacuauuguaauucgcguucaauaugagggagauggaucaccaugcaaaaucccauuugaaauuauggaccucgagaaaaggcauguguugggaagacuuauaacgguuaauccgauaguuacugaaaaagauaguccuguaaacauagaagcagagccuccauuuggagacaguuacauaauaauaggaguagaacccgggcaauuaaaacucaauugguuuaagaaagguucuaguaucggucaaauguucgaaaccacuaugagaggggcaaaacggauggcuaucuuaggcgauacggccugggacuucggaucacuagggggaguauucacgagcaucgguaaagccuuacaccaaguuuuuggugcuauauacggggcugcuuucucaggagucaguuggacuaugaaaauuuuaauuggugugaucauaaccuggaucgggaugaacucacgaucaacgucacucucuguaagccucguauuaguaggagugguaacccuguauuuggggguaaugguucaggcggacucuggcuguguaguauccuggaaaaauaaggagcuuaaaugcggcuccggcaucuucaucacagacaacgugcacacuuggacggaacaauauaaauuccagccagaaucacccucaaaauuagcgagcgcaauccaaaaggcgcaugaagaagggauuuguggaauaaggucuguuacgagacuagaaaaucuaauguggaaacaaauuacuccugaauuaaaucauaucuuaagugaaaacgaagucaaauugacuauaaugacaggagacaucaaggguauaaugcaggccggcaaaagaagccuacgcccacagccaacugaauugaaauauagcuggaaaacuuggggaaaggcaaagaugcuuucgacugauucucauaaccaaacauucuuaauagauggaccagaaaccgcagaaugcccuaauaccaacagggccuggaacucuuuagaaguagaggacuacggguuugguguauucucaacgaauauuugguuaaaacuacgagaaaagcaagauguauuuugcgauucaaaacuuaugagcgccgcgauaaaagauaaucgcgcuguacacgcugauaugggauauuggauugaaagugcccucaacgauacuuggaaaauggaaaaagcaucauucauugaagugaagucuugccauuggccuaaaagucauacgcuauggaguaauggaguacuagagucagagaugauaauucccaaaaauuuugcuggucccguaagccaacauaauuauagaccaggauaucacacacaaacagccgguccuuggcauuuagguaaacuagaaauggauuuugauuucugcgagggcaccaccguaguaguaacagaggacugcgggaauagaggcccgagccuacgaacaacaacggcuaguggaaaguuaauuacagaguggugcugcagauccuguacguuacccccauuacguuauagaggagaagauggauguugguacggaauggaaauaagaccuuuaaaggagaaagaagaaaauuugguuaacagucuagugacugcuggacacggacaaauugauaacuucuccuuaggaguauuaggcauggcuuuauuucuagaggagaugcuacgaacaagaguuggcacaaaacacgcuaucuugcucguugcgguaucauuuguuacccuaauuacaggaaauaugaguuuccgugaccuaggccgagugaugguuauggugggggcgaccaugacagaugauauuggaaugggugugacguaucucgcccuuuuagcagcauuuaagguuagaccgacuuucgcagcaggacuguugcuacgaaaguuaacaaguaaggagcuaaugauggccaccauugguauagcccuauuaucccaaaguacaauaccugaaaccauauuagaacuuacggaugcacuagcacucgggaugauggucuuaaagauuguucgaaauauggaaaaauaccaauuggcaguuacgauaauggcaaucucaugcguaccaaaugccgugauccuacaaaacgcauggaaaguaucauguacaauucuagccgcugucucuguauccccguuacuccuuaccucaucacaacagaaagcugauuggauaccucuugcacuaacuauuaagggucuaaaucccacagcgauuuucuuaacaacuuuaagcagaaccagcaagaaacggucuuggccguuaaaugaggcaguaauggcaguugggaugguaagcauccuugcaucaucacuucucaaaaaugacauuccaaugacaggcccucucguagcaggagguuugcucacaguguguuaugucuugacuggcagaagcgccgacuuagaauuggaaagagcagcggacguaaaaugggaagaccaagcagagauaucaggcaguucaccuauauuguccauuacaauaagcgaagaugguuccaugaguaucaagaaugaagaagaagaacaaacauuaacgauacuaauacggacgggacuacucgugauuuccggcguguuucccgugucaauaccaauuacggcugcagcuugguaccugugggagguuaagaaacaacgagcugggguauugugggauguuccgucacccccuccaguggggaaagccgaauuagaagauggagcauaucgcauaaaacagagaggcaucuuugguuacagucaaauuggcgccgguguuuauaaagaggguacuuuucauacuauguggcauguuacaagaggugccgucuuaaugcauagaggaaagaggaucgaaccauccugggcagaugucaagaaggacuuaauuucauacgggggaggauggaaacuugaaggagaauggaaagaaggcgaggaaguacaaguccuagcccuugagccagggaagaauccgagagcgguucaaacgaagcccgguuuauuuaagacaaauacaggaacaauuggagcaguuagucucgauuuuagcccagguacuucagguucaccaaucguagacagaaaaggcaaaguugucggucuauaugggaaugguguugugacgaggucgggugcguacguaucggcuauagcacaaacagaaaaguccauagaagacaauccagaaauagaggaugacauuuuccggaagaaacgacuuacgauaauggauuugcacccaggagcaggaaaaacaaaacgauacuuaccagcuauaguccgugaggccaucaaaagaggacugagaacucuaauauuagcaccaacacgcguaguagcggccgaaauggaagaagccuuaagagguuugccgauaagauaucaaacgccagcuauaagggcggagcacacggggagggaaauuguagacuugaugugccacgcuacuuuuacgaugcgauuacuuucuccaguuagaguaccaaacuauaaccuuauuauaauggacgaggcccauuucacugaccccgcaucaauugccgcgaggggauauaucucuacaagaguagaaaugggugaagccgccggaauuuucaugacagcgacaccaccugguucacgagacccauuuccgcaaucaaacgcccccauaauggacgaagagagagaaauaccugagcggaguuggaacucaggccaugaauggguaaccgacuucaaaggaaaaacuguaugguuuguaccaagcaucaaagcagggaaugacauugcagcuugcuuaagaaagaacgguaaaaagguaauccaauuaucacgaaaaaccuucgacucggaguauguaaaaacacgagcaaaugauugggacuuuguaguaacaacugacauuagugagaugggagcuaacuuccgagccgaacgaguuaucgacccacggcgcugcaugaagccaguuauauuaacugauggagaagaaagaguuauucuagcggguccaaugccgguaacacauucgucggcagcacaacgccgaggccguauaggacgaaauccuaaaaaugaaaaugaccaauacauauauaugggcgaaccacuagaaaaugaugaagauugcgcacauuggaaggaagccaaaauguuacuugauaauauaaauacaccggaagggauuauaccgaguauguuugaaccagagagggaaaaaguggaugcaauagacggggaauauagauuaagaggggaagcaagaaaaacuuuuguagacuuaaugcggcgaggugaucucccagucuggcuagcauacagaguagcugcagaagggauuaacuacgcagauagaagaugguguuuugaugggaucaaaaauaaucaaauucucgaagaaaauguggaaguagaaauauggacaaaagaaggggagcgcaagaaauuaaagccccguuggcuagaugcgagaaucuauucugacccacuugcgcuaaaagaauuuaaggaauuugcugcaggcagaaaaucacucacuuuaaauuugauaacggagaugggaaggcucccaaccuuuaugacucaaaaagcacgcgaugcccuagacaacuuagcgguacuucauaccgccgaaguaggaggaagggccuauaaccaugcacucucagaacucccagagacauuagaaacacucuuacuacuaacuuugcuagccgcugucacuggaggcauauuucuuuuucuaaugucaggcaaagggauuggaaaaaugacacuaggcaugugcugcaucauuacagccuccauauuacuaugguaugcucagauacaaccgcacuggauugcugcgagcauaauuuuggaauuuuucuuaauaguucuguuaauuccugaaccugaaaaacaaagaacuccacaggauaaccaacugacuuaugugguaauagccauacuaacgguagucgcggccacuauggcuaaugagaugggauuccuagagaaaacaaagaaagacuuagguuuaggaaguauaauaacccaggagagcgaaucaaauauuuuagacauagauuuaagaccugcauccgccuggacuuuauacgcugucgcaacgacuuucguaacccccaugcuucgccauucuauagaaaauagcaguguaaacguuucauuaacugcaauagccaaucaagccaccguacuuaugggccuaggccgagguuggccccuaucaaaaauggauauagggguacccuuguuggcuauaggauguuacagccagguuaauccuauuacuuuaaccgcggcucuauuguuauuaguugcacauuaugcaauaauaggacccggauugcaggccaaagcaacucgcgaagcucagaaaagggcggcggcgggaauuaugaaaaacccuacaguugacgggauaacaguaauagaucucgagccgauaccauacgacccuaaauucgagaagcaacuaggacaaguuaugcuccuaguguuguguguaacccaaguacuuaugaugcguaccacaugggcacucugugaagcacuuacauuggcuacaggucccauaucuacacuuugggaagggaacccuggacguuuuuggaauaccacaauagcagucaguauggcgaauauauuucggggaagcuaucucgcgggagccggauuauuauuuucaauuaugaagaacacuacaaacacaagaagaggcacugguaacauuggagaaacuuugggagaaaaauggaaaucuagacugaacgcgcugggcaaaagugaguuucaaaucuacaagaaaucugguauucaagagguggauagaacauuggcaaaagaaggcauuaagagaggggagacugaucaccaugcagucucgagagguagugcaaaacugagaugguuuguggaaagaaauaugguuacuccggaagggaagguuguagaucuugguuguggccgagggggauggagcuacuacugugggggccuuaagaauguaagagagguaaaaggucuaacaaaaggugggccggggcaugaagaaccuauaccuaugucgaccuaugguuggaaccuuguucgucuacaaagcggcguagacguauucuuuacuccucccgaaaagugcgacacacuacuaugugauauaggagaaaguucgccuaauccgacgauugaagcaggacguacauuaagggugcuaaaucuagucgaaaauugguuaaacaacaauacucaguuuuguauaaaaguauuaaacccguauaugccuagugucauagagaaaauggagacucugcaaagaaaauacgguggggcccuuguuaggaacccucuaucccgaaauucaacucaugaaauguauuggguuagcaacgccacaggaaauaucguuaguaguguaaauaugauuucacgaauguugaucaauagguucacuaugaaacauaagaaagcaacuuaugaacccgauguggauuuagguuccggaacucggaauauugguauugagaacgaaaucccaaaucuugauauaauaggcaaacguauagaaaagauaaaacaggaacacgagacaagcuggcauuacgaucaagaccacccauauaagacaugggcguaucaugggucuuaugaaacaaaacaaaccggcucagcgaguuccaugguuaaugguguagugcguuuacuaacaaagccaugggauguuguacccaugguaacacaaauggcuaugacugauaccacaccauuuggacaacaacggguguucaaagagaagguugacacuagaacccaggagccaaaggaagguaccaagaaacuuaugcguaucaccgccgaauggcuauggaaagaacuaggcaagaagaaaacccccagaauguguacucgggaggaauuugcgcguaaagugaggucuaaugcagcacuaggggccaucuuuacggacgaaaauaaauggaaaucagcuagagaagcaguugaagacaguagguucugggaauuaguagauagagaaaggaaucuucaccuagagggaaagugcgaaacauguguuuauaauaugauggguaaaagagagaagaaacucggggaauuugggaaagcaaaagggucacgugcaauaugguauaugugguuaggugcaagguuuuuagaguucgaagcacuuggguuccuaaacgaggaccacugguucucaagaggaaacucacuaaguggaguugaaggugagggcuuacauaaacuagguuacauacuacgugacguaaguaagaaagaaggaggggccauguaugccgacgauacggcgggcugggacacacgaauaacccuagaagaccugaagaacgaagaaaugguaacaaaucacaugaaaggagaacauaagaaacuagccgaagcaauauuuaaacuaacauaccagaacaaaguaguacgcgugcaaagacccacaccaagggggacaguuauggacaucauuagucguaaagaccaacgaggaucuggccaggucgguacguacggguugaauacauuuaccaacauggaagcccaguuaauaagacagauggaaggggaagggauuuuuaagucuauccaacaucugacaguuacagaagagaucgcaguacaaaauugguuagcaagagucgggcgcgaaagacuaagcagaauggcaauuucaggcgaugacuguguggucaaaccauuagaugaccguuuugcauccgcacuuacagccuuaaacgauaugggcaaagugagaaaagacauacaacaaugggaaccuucuagaggguggaacgauuggacacagguccccuuuuguagccaucauuuccacgaauuaguuaugaaggauggacggguucucguuguuccgugccgaaaucaggaugaguuaauagguagagcacgaauaucgcaaggugcuggcuggucacuaaaagaaacagcguguuuaggaaaaaguuaugcucaaauguggacgcuuauguauuuccauagaagagaccuaaggcuagcggcuaaugcuauuugcagcgcagugccaucgcacuggguacccacgaguaggacuacuugguccauacaugcaaaacacgaauggaugaccaccgaagacauguuggccguuuggaaccgaguauggauccaagagaacccauggauggaggauaaaacaccaguagaaagcugggaggagguaccauauuuggggaaacgugaagaucaauggugcgguagccuaauaggcuuaacaagucgagcaaccugggcgaaaaacauccaaacagcaauaaaccaaguucgauccuuaauugggaaugaagaauacaccgacuauaugcccaguaugaagcgcuuucgaaaagaagaagaggaggccggcguacuaugguag

SEQ ID NO: 22568 - RNA, 9876 nt, Artificial Sequence
  derived and/or modified CDS sequence (opt6) from DENV-2__EU569710__SS-prME
accgcaggaguaauuauuaugcugaucccuacugcaauggcguuucaccuuacaacgcguaauggagaaccccauaugauuguaggaagacaagaaaaaggaaaaucuuuauuauuuaaaacugaagacggaguaaauaugugcacgcuuauggcaaucgauuuaggggaauuaugcgaagauacaauuacuuacaaaugcccauuauuaagacaaaaugaaccugaagauaucgacuguuggugcaacagcacuucaacuuggguaaccuauggaacaugcacuacuaccggagaacaucggagagagaaaagaucgguugcacugguuccccauguaggcaugggauuagaaacucgaacagaaacauggaugucuuccgagggagcuuggaaacauguacaaagaauagaaacuuggauacuacgccauccgggcuuuacaauuauggcagcuauacuagcuuauaccaucggcacaacgcauuuccagcgagcuuugacuuuuauacuuuuaaccgcuguggcaccaaguaugacaaugcgaugcauaggcauuuccaaucgggacuuugucgaaggcguuaguggcggcucauggguggacauaguucuagaacauggaucaugugugaccacaauggcuaaaaauaaaccaacucucgacuucgaauuaauuaaaacagaagcaaaacaaccagcgauucucagaaaauauugcauagaagcaaaauuaaccaauaccacaacggaaucgagguguccaacacaaggcgaacccaguuuaaaugaagaacaagauaaaagauuuauauguaaacauucgauggucgaucgaggauggggcaauggguguggacuuuuugguaaaggagggaucguaacgugugcuauguuuacauguaagaaaaauauggaaggcaaaguuguguuaccugaaaaucuggaauauacaauugugauaacuccccauaguggugaggaacaugcuguaggaaaugacacuggaaaacaugguaaagagaucaaaauaacgccucagucaaguauaacagaagcugaguuaaccgguuacggaacagugacuauggaguguucgccucguacaggcuuagacuuuaaugagauggucuuacuacaaauggaagacaaagcaugguuaguucacagacagugguucuuggaccuuccguuaccauggcuucccggagcugauacacaaggcagcaauuggauacaaaaagaaacauuaguaacuuucaaaaacccccaugccaagaaacaagacguuguaguucuaggcucccaggaaggagcgaugcacaccgcccuuacaggggcaacggagauacagaugagcuccggaaaucuucuguucacuggacaucuuaaaugucgcuugaggauggauaaauuacaacuuaaagguaugaguuauucaauguguacaggaaaauuuaaaauuguaaaagagauagccgaaacacaacacgguaccaucguaauaagggugcaauaugaaggugacgguaguccauguaaaauaccuuucgagauuauggaucuagagaaaagauacguucuuggaagacuaauuacagucaaccccauaguuacugaaaaagacaguccagugaauauagaagccgaaccacccuuuggcgauagcuauauaauaauaggcguagagccaggccaauuaaaauuaaauugguuuaagaaagguaguaguauuggacaaauguuugaaacgacuaugcggggcgcaaagcgcauggcuauccuuggagacacggcuugggacuuuggcucauugggugguguauuuacuucuauagggaaggccuuacaccaaguauuuggugcuauuuauggagcugccuucagugggguaucguggacuaugaaaauucugauagggguaauaauaacguggauuggcaugaacucucgaagcacaucccucaguguaagccucgucuuagugggaguaguaacccuauaucuugggguuaugguucaagcugauuccgguugcgucguguccuggaaaaauaaagaauuaaaaugcggcaguggaauuuuuauaaccgauaauguacacaccuggacugaacaauauaaguuccagccugaaucaccaucaaaacuagcaucagcaauacaaaaggcccacgaagaagguauaugcggcauucgaucaguaacaagacuagaaaaucuaauguggaagcagaucacuccggaauugaaccacauacucagcgaaaaugagguaaaauuaacgauuaugacgggcgauauaaagggcaucaugcaagccgguaagagaagucuacguccacaaccuaccgagcucaaguauucguggaaaaccuggggaaaagcgaagaugcuuucaacagaaucucauaaucaaacauuuuuaauagauggaccggaaacagccgaauguccaaauacaaacagagcuuggaacucucuagaaguagaagauuacgguuucggcguauuuagcacaaacauauggcuaaaacucagagagaaacaagauguguuuugugauucuaaacuaaugucugcggcaauaaaagauaauagagcgguacaugcagacaugggauacuggauagagagugcacuuaaugauacguggaagauggaaaaggcuaguuuuauagagguuaaauccugccacuggccaaaaucacauacgcuauggaguaacggcgugcuggagagugagaugauaauaccaaagaauuucgccggaccugugucucagcauaacuacagaccaggguaucauacucaaacagcaggucccuggcaucuggguaaacuagaaauggacuuugacuuuugcgaggguacuacugucguggugacugaggacuguggcaauagaggacccucuuugcgcacuacuacugcaaguggaaaacugauaaccgaaugguguugccguucuugcacuuuacccccucugcgauauaggggagaagacgguugcugguaugguauggaaauacgcccacuuaaagagaaagaggaaaacuuaguaaacagcuuaguaaccgcaggacauggacagauagauaacuuuagucuuggaguuuuaggcauggcuuuauuuuuggaggaaaugcuccgaaccagagucggaacgaagcaugcgauccuucugguugcugucagcuuugugacauuaauuacaggaaauauguccuuucgggauuuagguaggguaaugguaaugguaggagccacuaugacggaugauauuggcauggggguuacuuaucuggcacuacucgcggcguuuaaaguaagaccaaccuuugccgcaggucuauuacugaggaaguuaaccagcaaagaauuaaugauggcgacgauagggaucgcgcuacuaucacaaagcacaauccccgagacaauauuagaauuaacugacgcacuagccuugggaaugaugguucuaaaaauuguacgaaauauggagaaguaccagcucgcuguuacuaucauggcgauucuuugugugccuaacgcuguaauucuucaaaacgcguggaaagucaguuguacgauauuagcggcugugaguguuagcccccuacucuugacaucuucacaacaaaaggcagauuggauaccgcuagcccuaacgauaaaaggucuuaauccaacagcaaucuuuuuaaccaccuuaagcagaaccaguaagaaaagauccuggccacuaaaugaagcuguaauggcuguaggcauggugucaauacuagcaucaagucuccuaaagaaugacauuccaaugacaggaccauugguagcaggaggacucuuaacuguauguuaugugcucacuggccgcucggcagauuuggaauuagaaagagcagcagacguuaaaugggaagaucaggcagaaauuagcgggagcagcccuaucuuaucaauaaccauaagcgaagacggaaguaugagcauuaagaacgaagaggaagaacaaacauuaacuauuuuaauacguacugggcuguuaguaauaucaggcguuuuuccuguuuccaucccgauuacugcugcagccugguacuugugggagguaaagaaacaaagagcagggguguuaugggauguuccgaguccgccaccagucggaaaagcagaacuugaggauggggccuaucgaaucaaacaacgagggauuuucggauacucacaaauaggagccggaguauacaaagaagguacauuccacacaauguggcacguuacgcguggcgccgugcuuaugcacagaggaaaaagaaucgagccuagcugggcagaugugaagaaagacuuaauaucauauggaggagguuggaaacuagagggagaauggaaagaaggugaagaaguacaaguuuuagcguuggaaccaggaaagaauccacgggcuguucaaacaaaaccaggcuuauucaaaacaaacacggggacuauaggugcgguuucgcuugacuuuagcccugguacaucuggaucaccaauaguggacagaaaaggcaaagugguaggacuuuaugguaaugguguaguuacgagaucgggagccuaugucucugccauugcacaaacagagaagucaauagaggacaauccagaaauugaagaugauauuuucaggaaaaagcgucugacaauaauggauuugcaucccggugcaggaaaaacaaaacgguaccuaccugcaaucguaagagaggcaaucaagcgaggauuacggacucuaauacuugcaccgacacgggucgucgccgcugaaauggaagaagcauuaagaggacuacccauaagauaucagacaccagccauacgagcugaacacacugguagagaaauaguagaccucaugugucacgcaacauuuacgaugagacuacuuucgccaguccguguuccuaauuauaacuugauaaucauggaugaagcccacuucacugaccccgcaucuauagcagcucgaggguauauauccacucguguagagaugggcgaagcagcagguauuuuuaugacugcaacgccaccugggagcagagacccuuucccacagucaaacgcacccauaauggaugaagaaagagaaauaccggaaagaucuuggaacaguggccaugaauggguaacugacuucaaaggaaaaacuguaugguucguaccaaguaucaaagccggcaaugacaucgcugccugccuuaggaaaaauggcaagaaagugauucaguugucaaggaaaacguucgacucagaauaugugaaaacccgggcuaacgacugggauuuugucgucacaacugauauaucagagaugggugcuaacuucagagcggaaagagugauagacccccgacgguguaugaagccugucauucuuacagauggggaggagcgggucauuuuagcaggcccuaugccugugacacauuccucagcggcucagaggagaggaagaauuggacguaacccgaaaaaugaaaacgaccaauacauauauaugggggaaccccucgagaacgaugaagacugcgcucauuggaaggaagcaaaaauguugcuugacaacauuaacacaccagaaggcauuauacccucaauguuugaaccugagcgagaaaaaguagacgcgauagauggugaauauagacuaaggggugaagcaagaaaaacauuuguagacuuaaugcgucgcggugaccugccagugugguuggcuuauagaguagcagcugaggguauaaacuaugccgaccguagaugguguuuugaugggaucaaaaacaaucaaaucuuggaggaaaauguagaaguugaaauauggacaaaagaaggggaaaggaagaaauuaaaaccucgcuggcucgacgcgaggaucuauuccgauccccucgcuuuaaaagaauuuaaagaauuugcugcggggcgaaaaaguuuaacucuaaauuuaauaacagaaaugggaaggcugcccaccuuuaugacucagaaagcucgagaugcauuggauaaccucgccguauuacacacggcagaaguagggggacgagccuauaaucaugcccuuagcgagcucccagaaacacuugaaacuuuauuauuacugacucuuuuagcgacuguaacugggggaauauuccuauuucuaauguccggaaaaggaauaggaaaaaugacacuaggcauguguuguauuauaaccgcgagcauauugcuaugguacgcacaaauccagccacacuggauugcagcuaguauaauauuagaguuuuucuuaauaguuuuauuaauaccagagccagagaaacagcguaccccgcaagacaaucaauugacauauguuguuauugcgauauugacuguuguagcagcuacuauggcgaacgaaaugggguuuuuagagaaaacuaagaaagauuuaggacucgguagcaucauaacucaagaaagugagucaaacauauuggacauugaccuucgaccugccucugcguggacauuguaugcgguagcuaccaccuuuguaacaccaaugcuacgacacucuauagaaaacagcuccgucaacguaaguuuaacugcuauagccaaucaagcaacgguacucauggguuuagguaggggguggccucucaguaaaauggacauuggaguaccucuuuuagcgauugguugcuauucacaagugaacccgauuacacuaacagcugcccuuuuacuacucgucgcccacuacgccauaauaggaccaggcuuacaagcaaaggcaacgcgagaggcacagaaaagagcagccgcggguauuaugaagaauccaacgguagacgggauaacugugauagacuuggagccgauuccuuacgacccaaaauuugaaaaacaauuaggacaagucauguuauugguacuuugcguaacacaaguguuaaugaugaggacgacgugggcccuuugugaagcauuaacauuagcgacaggccccauaaguacgcuaugggaaggaaacccuggcagauucuggaauacaacaaucgcuguaucuauggcaaauauauuucgaggaucauacuuagcaggagcgggucuuuuauucuccauuaugaaaaauacuacgaauacuaggcgcggaaccgggaacauuggggaaaccuuaggagagaaguggaaguccagauuaaacgcgcuggguaagucagaauuucaaauuuacaagaaaaguggaauacaagagguagauaggacucuagcuaaagaagguaucaaacgaggcgaaacagaccaucacgcuguuagucgaggcucagcaaaauugaggugguuuguagaaaggaauauggucacuccagaaggaaaaguagucgacuuaggcugcgguagaggaggguggucguauuauugugguggucuaaagaauguuagagaaguaaaaggauuaacaaaaggcggaccaggacacgaggaaccaauuccuaugagcacuuauggauggaaccucguucgauugcaaucuggcguugaugucuucuuuacaccacccgagaaaugugauacuuugcugugcgauauaggagaaagcagccccaacccaacaauagaagcaggacggacauuacgcguucuaaauuugguagaaaauuggcuaaauaauaacacacaguucuguauaaaagugcuaaauccauauaugccauccguaauugagaaaauggagacacuacaaagaaaauauggaggugcuuuaguccgaaacccauuaagucguaauaguacucaugagauguacuggguaaguaacgcuacaggcaacauaguaucaucaguaaacaugauuucuagaaugcuaauaaauagauucacaaugaaacauaaaaaggcuacuuacgaaccggaugucgauuuaggaagcggaaccagaaauauaggaauugaaaacgaaauaccgaauuuagacauuaucgguaagagaauugagaaaauaaaacaagagcacgagacauccuggcacuaugaccaagaucauccguacaaaacgugggcauaucacggguccuacgagacaaagcagacagggucugcaucaucaaugguaaauggggucguacgacuacuuaccaaaccaugggacguaguaccgauggucacacaaauggcaaugacugacaccacaccauucggccaacaaagggucuucaaggaaaaaguggacacaagaacacaagaaccuaaagaagguaccaagaaacuaaugagaauaaccgcagaauggcucuggaaggaacuuggcaagaagaaaacucccagaauguguacuagggaggaauuuacaagaaaaguucguaguaaugcggccuuaggugcgaucuuuacagaugaaaauaaguggaagagugcgcgagaagcaguagaggacagccgcuuuugggaacucguagaccgcgaaagaaaccuacauuuagaagguaagugugaaacaugcguauauaauaugauggguaagcgcgagaaaaaguuaggugaauuugguaaggcuaaggggucuagagcuauaugguacauguggcuaggagcaagguuuuuggaauuugaagcacucggauucuuaaacgaggaucacugguucucaagaggaaauagccuuucaggcguugaaggagaagguuugcauaaguuaggauauauuuugagagacgugaguaagaaggagggaggcgcuauguacgccgaugacacagcagguugggacacaagaauaacucuggaggaccucaaaaacgaggaaaugguaacuaaccauaugaaaggggagcauaagaaacuugcagaagcuauuuucaaauuaacuuaccagaauaaaguuguacguguccaacguccuacaccccgaggaacaguuauggauauaauuaguaggaaggaucaaagagguagcgggcaaguagguacauaugggcugaauacuuuuacuaacauggaagcacaauuaauccggcaaauggaaggggagggaauuuuuaaaucaauccagcaccucacuguaacggaggaaauugcuguacaaaauugguuagccagaguggggcgugaacguuuaucgagaauggcaauaucgggggacgauugcguagugaagccuuuagaugaucgauuugcaucagcacuuacugcauuaaaugacaugggaaaagugagaaaagauauacagcagugggaaccuucaagaggauggaaugauuggacgcaaguaccauucugcucucaucacuuucaugagcuuguaaugaaagacgggagagucuugguuguacccuguagaaaucaagaugaauugaucggacgagcuagaauuagucaaggagcggguuggagucuaaaagaaacugcgugcuuggguaaaucguacgcacaaauguggaccuuaauguacuuccaucguagagaucuaagguuagccgcaaaugcuauaugcagcgcuguaccuagucacuggguaccuacuucaagaacuacuuggucuauacaugcaaaacaugaguggaugacuacugaagacauguuagcgguuuggaaucgaguuuggauacaagaaaacccauggauggaggauaaaacgccgguggagagcugggaagaaguuccuuauuuagguaaaagagaggaucaaugguguggaaguuuaauuggucuuacuucaagagcaacaugggccaaaaacauacaaacggcaauaaaucaaguuaggucacuaaucgggaacgaggaauauaccgauuauaugccuuccaugaagcgauucagaaaagaagaagaagaagcaggaguauuaugguaa

SEQ ID NO: 22569 - RNA, 9876 nt, Artificial Sequence
  derived and/or modified CDS sequence (opt6) from DENV-2__EU596486__SS-prME
acagcugguguaauaauaaugcucauucccacugcuauggcauuucaccugacuacaagaaacggagaaccucauaugauugucggcagacaagaaaaaggaaaaagucuauuguucaaaacagaagauggaguuaauaugugcacucugauggccaucgaccuuggagaauuaugugaagauacaauaacguauaaaugcccucugcuacgacaaaaugaaccggaagacauagacugcugguguaacucaaccucaacgugggucacauacggaacgugcacaacaaccggagaacacagacgggaaaaacgcucuguugcucuagucccccauguuggaaugggguuggaaacaaggacagaaacguggaugucauccgaaggggcauggaaacaugugcagcgaaucgaaacauggauccucaggcauccuggauucacaaucauggccgcuaucuuagcuuauacgauagggacuacgcacuuccaaagggcgcuaauauucauacuucucacagcaguugcaccaagcaugacuaugcgcugcauaggcauauccaaccgggauuucguagaaggaguaagcggagguucauggguagauaucguuuuagaacauggaucguguguaacgacgauggcuaaaaauaaaccuacucuggacuuugaacuaaucaaaacugaagcaaaacaaccggcaaccuugagaaaauacuguauugaagcaaaacuuacaaacacaacuacggaaucaagauguccuacccaaggugaaccaucacucaacgaggaacaagauaaacgcuucauauguaaacauuccaugguugacagaggcuggggaaacgggugugggcuuuucggaaaagguggaauuguaacgugcgcaauguucacuuguaagaaaaauauggagggcaaaguuguacuuccugaaaaucuugaauauacuauaguuauuaccccacauagcggugaagaacaugcuguugguaaugauaccggaaaacacggcaaagagaucaaaauaaccccacaaucaaguauaacggaagcugagcuaaccgguuacgggacaguaacuauggaauguucuccgaggacugggcuugauuucaacgaaaugguacucuuacaaauggaagacaaagcaugguuaguccaucgucagugguuuuuggauuuaccgcuacccuggcuuccuggagcagauacccaaggcaguaauuggauucaaaaagaaacauugguuacuuuuaaaaacccucaugcaaagaaacaagacguaguagugcucggaucucaagaaggugcuaugcauacggcauuaaccggagccaccgagauacagaugaguucaggaaaucugcucuuuacaggacaucucaaaugcaggcucagaauggacaaacuccaauuaaaagguaugagcuauagcauguguacgggcaaauuuaaaauagugaaagaaauugccgagacgcaacacggaaccauagucauacgcguucaauaugaaggugauggaucaccuuguaaaauaccauuugaaauuauggaccuagagaaacguuauguauuaggaagacuuauuacugugaacccuaucgugacugagaaggauucccccguaaauauagaggccgaaccgcccuuuggagauucuuacauaaucauagguguugaaccaggacaacuaaagcuaaauugguuuaagaaaggcucaaguauuggacaaauguucgaaacaacgaugagaggcgcaaagcggauggccauacucggagauacagcaugggauuucggaucguuaggcggaguguuuacgagcauuggcaaagcguugcaucaaguauuuggagcuaucuacggggcggcauucucuggcguaucauggacuaugaagauuuuaauaggaguaauaauuaccuggauagggaugaauagcaggaguacgucucuaagcguaucguuaguacucguugggguaguuacacuuuauuuaggcgucaugguacaagcagacuccggauguguuguaucuuggaaaaauaaagagcuaaaaugugguagcggaauauuuauaaccgacaacguacacacauggacagaacaauauaaauuccaaccugagucaccuucuaaguuagcgucggcaauacaaaaggcacaugaggagggcauauguggaaucagauccguaaccagguuggaaaauuuaauguggaaacagauaacaccugaauugaaucauauccuaucagaaaaugaaguaaaacuuacaaucaugaccggugacauaaaaggaaucaugcaagcuggaaaaaggucgcuaagaccacaaccaacggaacuaaaguauucuuggaagaccuggggaaaagcgaaaauguugucuacagaaucacacaaccaaacuuuccucauagacggaccugaaacggccgaaugcccaaacacuaacagagccuggaacucacuugaagucgaggacuacggcuucggaguauucucuacaaacauuugguugaaacuaagagagaaacaggauguauuuugugauaguaaguuaaugagugcugcaauuaaagauaacagagccguacaugccgauaugggcuauuggauugaaucagcacugaaugauacauggaaaauggagaaagcuagcuuuauagaaguaaaguccugucacuggccgaaaucucauacacuguggaguaacggggucuuagaauccgaaaugauuauccccaaaaauuucgcaggaccuguaucacaacauaacuauagaccaggcuaucacacucaaaccgcugguccauggcaucuaggaaaacuagaaauggacuucgauuuuugugaaggaaccacgguaguaguuacugaagacugcgguaauagagguccaagucuccgaacaacuacagcgucgggcaaacuaauuacagaauggugcugucguaguuguacucugccaccccuacgauauagaggagaagacggaugcugguacgguauggaaauacgcccauuaaaagaaaaagaagaaaacuuaguaaauucauuaguuaccgcaggucauggucaaauagauaauuuuagccugggcguacuugguauggccuuauuucuagaagaaauguuaaggacgaggguaggaacgaaacacgcaauccuccuaguggcagucagcuucguaacacuaaucacgggaaauaugucauuucgggacuugggcagaguaauggucaugguuggugcaaccaugacugacgauauaggaaugggugucacauacuuagcacuauuagcagcauucaagguucggccaacauucgcggcaggacuucuguuaaggaaacuaaccucaaaggaacuaaugauggcgaccauagguauagcccuauugucccaauccacaauuccugaaacuauacuugaauuaaccgacgcacuggcgcucgggaugauggugcucaaaauagugagaaacauggagaaauaucaacuugcuguuaccaucauggcaauuuuaugcguaccuaacgcaguaauacuacagaaugcauggaaaguaaguugcacaauucuggcggcaguuagcguaaguccccuauuacuaacaaguucucagcagaaagcagacuggauaccguuagcccugacaaucaagggacuaaaccccacggcaaucuuccuaacuacucucucccgcacuagcaagaaaagaucauggccauuaaaugaagcaguaauggcaguugggauggucucgauccuugccucaaguuuauugaaaaacgacauccccaugacaggaccccuaguugcaggcggacucuuaacaguaugcuacgucuuaacggggcgaagcgcggaccuagaauuagaaagagcggcagaugugaaaugggaagaucaagcugaaauauccggaucaucacccauucuuucaauuacaauaagugaagacggaagcaugucuaucaaaaaugaagaggaagaacaaacuuuaacuauauuaauacggacaggacuauugguaauuagcggcguguuuccaguuucgauaccuauuacugcggccgccugguaccuaugggaggucaagaaacaaagagcuggaguacuaugggauguaccuaguccuccacccguuggcaaggccgaacuugaagauggagcuuaucguauaaaacaaaggggaauuuucgguuauagccaaaucggagcuggcguguauaaagaagguacauuucauacuauguggcauguuacucgaggugcagugcuuaugcaucgaggaaaacguauugaaccaaguugggcagaugucaagaaagauuugauuaguuaugggggcggguggaaauuggaaggagaauggaaggaaggugaagaagugcaaguacuggcacuagagccagggaaaaacccacgcgccguacaaacuaagccaggcuuauucaaaacuaauacugguacuaucggugcaguaucacuggacuuuucaccuggaacuucagggucgccaauaguugacagaaaaggaaaaguaguaggacuauauggcaacggggugguuacgagaaguggcgccuacguuucagcuauagcacaaacagagaaaagcauagaagauaauccggagaucgaggaugacauuuucaggaagaaaagauuaaccaucauggauuuacauccaggugcugguaaaaccaaacgauacuuacccgcuauaguuagggaagcaauuaaacgaggccuaagaacauuaaucuuagcccccaccagaguugucgcagcugagauggaagaagcacugcguggccugccuauaagguaucaaaccccggcuauacgagcugaacacaccggccgagaaauaguugaucucaugugucaugcaacauuuacgaugaggcuacuaucuccuguacgaguucccaacuauaaccuuauaauaauggacgaggcucauuucacggacccggcgaguauagcagcacguggcuauauaucaacacgaguagaaaugggggaagcagcugggaucuuuaugacugcaacaccaccaggcagcagagacccauuuccgcagucuaaugcuccuauuauggacgaagaacgugaaauaccugaaagguccuggaacagugggcacgagugggugaccgauuucaaaggcaagacaguaugguuuguacccucaaucaaagccggcaacgacauugccgcaugccucaggaaaaauggaaagaaaguaauacaacucagucgcaaaacauuugauucagaguacgucaaaacacgggcaaaugauugggacuucgugguaacgacagauaucuccgaaaugggugcuaauuuucgagccgaacggguaauagacccgaggcgaugcaugaaaccaguuaucuuaacagacggugaagaacguguuauccuagcagguccuaugccaguaacucauaguuccgcagcucagaggcgagguagaauuggaaggaacccuaagaaugaaaacgaccaauacauauauaugggagagccucuugaaaacgacgaagacugugcgcacuggaaggaagcaaaaauguuacuggacaacaucaauacacccgaaggaaucauaccaucaauguucgagccugaaagggaaaaaguagaugcuaucgacggugaauaucgguugagaggagaggcgagaaaaacauucguagauuuaaugaggaggggagauuugccaguauggcuagcuuauagggucgcagcggaagguauaaauuacgcagauagacgcugguguuuugaugggaucaaaaacaaucaaauacuagaggaaaauguugagguugaaauuuggacuaaggaaggcgaaaggaagaaauuaaaaccacggugguuagaugcaagaauuuauagugauccacuagcauuaaaagaauuuaaagaguucgcggcaggacgaaaaagccuuaccuuaaaccucauaaccgaaaugggacgcuugccaacauuuaugacucaaaaagcuagggacgcgcuggauaaccucgcaguauuacacacugccgaagucggcggacgagccuacaaccaugcacuaucugagcugccagaaacacuagaaacucuauuacuuuuaacacuacuagccacagucacagguggaauuuuccuuuuccuuaugucagguaaaggcauaggaaaaaugaccuuaggaauguguuguauaauuaccgcaucaauucuguuaugguaugcacaaauucaaccgcauuggauugcggcauccauaauacucgaguuuuucuuaauuguacuacuaauaccagaaccggaaaaacaaaggacaccgcaagacaaccaauuaacuuaugugguuauugcgauacucaccgugguugcagcaacaauggcuaaugaaaugggauuuuuagagaaaacuaagaaggauuuaggucuagguucgaucaucacacaagaaucagaaaguaacauacuagauauagaucuuaggccggcuuccgcuuggacauuauacgcuguagcuacaacauuuguuacuccgaugcuaaggcauucgauagaaaauucaucagucaacguaucuuugacagcuauagcgaaccaggcgacaguccuuaugggauuaggacgaggauggccauuguccaagauggacauaggugucccacugcuugcaauugguuguuauucucaggucaauccuauuaccuugacagcugcuuuacugcuccuuguugcucacuaugcuauuauugggccgggguuacaagccaaagcuacacgagaagcgcagaaacgagcagcagcuggcauuaugaaaaauccaacaguagauggaauaacagugauugaccuugaaccaauuccuuacgauccuaaauuugaaaaacaguugggacaaguaaugcuuuuaguuuuauguguuacacaggugcuuaugaugcgaacaacgugggcccuuugcgaggcauuaacuuuggcuacaggcccaaucaguacucucugggaagguaacccagggagauucuggaauacaaccauagcgguaagcauggcaaacauauucagaggcucguaucuagcuggagcaggccuccuauucaguauaaugaaaaauacaacaaacacaaggcgagguacagguaauauuggagagacacuuggcgaaaaauggaagucccgacucaaugccuuagguaaaucagaauuucaaauauacaagaaaaguggaauacaggaaguagaucgaacacucgcaaaagaagguauaaaaagaggagaaacugaccaccaugcuguaaguagaggaucugcuaaauuaagaugguucgucgaaagaaacaugguaacucccgaagguaagguuguugaucucggauguggcagagggggauggaguuauuauugcgggggccuaaagaacgugcgggaagugaaagggcugacgaaaggaggucccggacaugaagaacccauccccaugucaacauauggauggaauuuggucagacuacaaucaggcguggaugucuucuuuacaccgcccgagaaaugcgauacguuauuaugugauauaggugaaagcaguccaaauccuacaaucgaagccgggagaacauugaggguacuaaauuuagucgaaaauugguuaaauaacaauacacaauucugcauaaagguguuaaacccauacaugccgucaguaauugaaaagauggaaaccuugcagcgaaaauacggaggugcuuugguuaggaaccccuuaucaagaaauucuacccaugaaauguacuggguuagcaacgcuacagguaauauuguaucaucagucaacaugauaucacggaugcuuauuaacagauuuacaaugaaacacaagaaagcuacuuacgaacccgacguagaucuaggaucugggacaagaaacauagggauagaaaaugaaauaccuaaucuagauaucauagggaaaagaauugagaaaauaaaacaagaacacgaaacuucuuggcauuacgaccaagaucacccauacaaaacuugggcuuaccacgguucauaugagacaaaacaaacugguucagcaaguucaaugguuaacggcguuguucggcugcugacuaagcccugggaugucauacccaugguaacgcaaauggcaaugaccgauacgacgccauuuggccagcaacgagucuuuaaggaaaagguagauacuagaacucaagaaccaaaagaaggaacaaagaaauuaaugagaauuacggcggaguggcuauggaaagagcuagggaaaaagaaaaccccgagaauguguaccagagaagaguucacaaggaaaguucggucaaaugcugcacuaggagcuauauucacggaugagaauaaauggaaaagugcucgggaagcaguagaagauucacgauuuugggaauuagucgaccgggagcgaaaucuucaucuagaaggaaaaugugaaacgugcguguauaacaugaugggaaaaagagagaagaaacuaggagaauuugguaaggcaaaaggaucuagagcuauaugguauauguggcuaggugcacguuuucucgaguucgaagcguuaggguuccugaacgaagaucacugguucaguagaggcaacucauuaaguggaguagaaggagaagggcuccacaaauuaggcuacauucuaagggauguaucuaagaaagaggguggugcaauguaugcugaugacacagcugggugggauacgagaauaacucuagaagaucugaaaaaugaagagaugguuacuaaccauaugaaaggugaacauaagaaauuagccgaagcgauauucaaauuaacauaccagaacaagguaguacguguacaaaggccuacuccucgaggcacagugauggauauaauaaguaggaaggaucaacguggcaguggucaaguuggaacuuacggacuuaauacauuuacaaacauggaagcacaacugauacgacaaauggaaggugaagguauauuuaaaucgauccagcauuuaacgguaacugaagaaauugcaguucagaauuggcuagcgcguguaggcagagaaagauuaucgagaauggcgauuaguggagaugauugcguaguaaagccauuagaugaccguuuugcuucugcacuaacugcuuuaaacgauauggggaagguaaggaaagauauucaacaaugggaaccgucacgcggcuggaacgacuggacucaaguaccguucuguucacaucacuuucaugagcuugugaugaaagauggaagggucuuaguuguccccuguagaucgcaagacgaguuaauaggcagagcaaggaucucccagggugcgggguggucauuaaaagaaaccgccuguuugggaaaaucuuaugcucagauguggacucuuauguauuuccaucgccgagaccucagauuagcugcaaacgcaauuuguagcgcgguaccuucgcauuggguuccgaccucgagaacuacauggaguauccaugccaaacacgaauggaugacaacagaggauaugcuagcuguuuggaauagaguuuggauccaagaaaauccauggauggaagauaaaacacccgucgaaucaugggaagagguuccuuaccucggaaaaagagaggaccagugguguggaucgcuaauuggccuaacaucuagggcaaccugggccaaaaauauacagacugcaauaaaucagguacgcuccuugauagguaacgaagaauauauagauuauaugccuucaaugaagcgcuuucgcaaagaggaagaagaagccggcguacugugguaa

SEQ ID NO: 22570 - RNA, 9876 nt, Artificial Sequence
  derived and/or modified CDS sequence (opt6) from DENV-2__EU687212__SS-prME
acugcuggaguaauuguaauguuaaucccuacagcgauggcuuuucauuuaacaacaaggaacggcgaaccacauaugauaguaggcagacaagaaaaagggaaaagucuauuguuuaaaacagaagaugggguaaauauguguacgcuuauggcaauagaccuaggagaacuaugugaagacacgauaacauauaaaugcccauuguuacgacaaaaugaaccugaagauauagacuguugguguaauagcacaagcacauggguaaccuacggaacgugcacaacgaccggagagcacagaagggagaaacggagcguugcguugguuccucacguugguaugggucuagaaacaagaacagagacauggaugucuucugaaggcgcauggaaacacguccaaagaauagaaacauggauacucagacacccugguuuuacuauuauggcagcaauccuagccuacacaaucggaacaacucauuuucagcgugcacuaauuuuuauauuacugacagcaguugccccaaguaugacaaugcgauguauagggauaaguaaucgagauuuuguugaaggaguaucagggggaaguuggguagacauagucuuagaacacggcucaugcgucacuaccauggcaaaaaauaaacccacacuagauuucgaacucaucaagacagaagcuaagcaacccgccacacucagaaaguauugcauagaagcaaaacuuacaaacaccacgacagaaaguaggugcccaacacagggcgaaccaagccucaaugaggagcaagacaaacgguuuauaugcaagcauucaaugguggaccgcggauggggcaauggaugcggucuguucggaaaagguggaauaguuacgugcgcuauguucacuugcaaaaaaaacauggaagggaaaguaguccagccugaaaaucuagaauauacaauugugauuacuccacauucuggcgaagaacaugcaguaggcaaugacacaggcaaacauggcaaagaaaucaaaaucaccccacagucaagcauaacggaagcggaacuuacugguuauggaaccgugacaauggaguguaguccacguacaggacuagauuuuaaugagaugguucuauugcaaauggaagauaaagcaugguuggugcauagacaaugguuucuugauuuaccguuaccuuggcuuccaggagcugauacacaaggaagcaacuggauucaaaaagagacacuugucaccuucaaaaauccgcaugcgaaaaaacaagauguaguuguacucggaagccaagagggagcuaugcauacggcacugaccggagcaacagaaauacaaaugaguucuggaaauuuacuauuuacaggccaccugaagugucgucuaagaauggacaaguuacaauuaaaggguaugagcuacagcaugugcacugggaaguuuaaaauaguaaaagaaauugcagagacucaacacggcacaauuguaauacgcguacaguaugaaggagacggaucuccgugcaaaauaccguucgaaauaacagaucuagaaaaacgucacguauugggacggcuuauuacaguaaacccaauuaucacugaaaaagauucaccggugaauauugaagcugagccaccguuuggcgacagcuauauaauuauaggcgucgaaccaggacaacuaaaacucaauugguucaaaaaagguucaaguauaggccaaauguuugaaacaacaaugaggggcgccaagagaauggccauucugggagauacagcaugggauuucggaucccuaggcggaguguucacuucgauuggaaaagcucugcaucaaguguuuggagccauauauggagcugccuucuccggcgugucguggacuaugaagauacuuauaggggucaucauuacauggauaggaaugaacucaagaagcacaucucuaagugugagucuaguauugguaggcguagucacauuauaucuaggugccauggugcaagcagauucgggauguguaguaucuuggaagaacaaagaauugaaguguggaucuggcauuuucauuaccgacaauguacauacguggacggagcaauauaaauuucaaccugaaucaccauccaagcuggcgucugcgauacaaaaggcucacgaagaaggcauuugcggaaucaggucuguaacaagguuagaaaaucuaauguggaaacagauaacacccgaauuaaaccauauauugucagaaaacgaaguuaaauuaaccauuaugacuggggauauuaaggguauuaugcaagcgggaaaacguagcuuaagaccacaaccgacagaauugaaauauucguggaaaacuugggguaaagcaaaaaugcugucgacagaaucccauaaccaaacauuuuuaaucgaugggcccgaaacggcugaauguccaaacacaaaucgugcguggaauaguuuagagguagaggacuauggauuuggcguauuuacaaccaauauauggcugaaauugagagaaaaacaggauguauucugugauucaaaauuaaugagugccgcaauuaaagauaauagagcugugcaugcggauaugggauauuggauagagagcgcacuuaacgacacuuggaaaauggaaaaagcuucguucauagaagugaaaucaugucauuggcccaaaucgcauacgcucuggaguaacggaguacuagaaagugaaaugauuauccccaaaucauucgcaggaccaguaagccaacacaauuacagaccaggauaccauacccaaacagcgggaccauggcauuuaggaaagcuggaaauggauuucgauuucugcgaggguacaacaguaguaguaacagaagauuguggaaaccguggccccucgcuuaggaccaccacugcuagugguaaauuaauaacggaaugguguugcagauccuguacacuuccaccauuaagauacagaggagaggauggauguugguauggcauggaaaucaggccauugaaagagaaagaggaaaaucuaguaaauaguuuagucacugcuggacauggacaaauugacaacuuuucgcuuggggucuuaggcauggcgcuauuucuagaagagauguugaggacacgaguuggaacaaaacacgcuauauugcuaguggcaguaucauucguaacauuaaucacagguaacaugucauuucgcgauuuaggucguguaaugguuauggugggagcuaccaugacugacgacauuggaaugggggucacuuauuuagcacuucuugcagcguuuaaaguacgucccaccuucgcugccggauuauuauuaaggaagcuaacuuccaaagagcuuaugauggcaacaauugguauagcacuacuaucacaaucaacuaugccggagacaauauuagaauuaacugacgcacuugccuuagggaugaugguccuuaagaucguuagaaacauggagaaauaccagcuggccguaacaaucauggccauaagcugcguaccuaaugcgguaaucuuacagaaugccuggaaagugaguugcacaauacuagcaacgguuagcgugagcccucuguuauugacaucuagccaacagaaagcugauuggaucccucuagcacuaacgauuaaagguuuaaacccgacugcaaucuuucugacaacccugucuaggacuaguaaaaaaagaucuuggccguuaaaugaggccauuauggcuguaggaaugguaucgauacuggcuucgucacuauuaaaaaacgacaucccaaugacagggccccuaguggccgguggguuacuaacaguaugcuauguucuaacaggaagaucagcugaucuagaauuagaacgagcugcggacgugaaaugggaagaccaagccgagauuaguggcaguagcccgauuuuguccauuacgauaucugaagauggaucgaugaguauaaaaaaugaagaagaagaacaaaccuuaacaauauuaauacgaacaggacuauuaguaaucagugguguguuuccuguuagcauucccauaaccgcagcagcuugguaccuaugggaggugaaaaaacaaagagccggaguuuugugggauguuccuuccccaccuccuguagaaaaagcugaacuagaagacggagcuuaucgaauaaaacaaagagguauccuaggcuauucgcaaauaggagcagggguauacaaagaagguacuuuucauacaauguggcauguaacacgaggugcuguacucaugcauagagguaaaagaauugaaccuucaugggccgauguuaaaaaagauuuaauaaguuauggggguggcuggaaauuagaaggggaauggaaagaaggagaagaaguacagguucuagcgcucgagccgggaaaaaauccaagggcaguacagaccaaaccagggauauucaagacaaauacaggaacaaucggagcuguaagucuagauuucuccccugguacgucaggaaguccuauaguagauagaaaggguaaagugguaggacuguauggaaacgggguagugacucgaucaggagcuuacguaucugcaauugcccaaacagaaaaaucaaucgaagauaaucccgaaaucgaggaugauauauucagaaaaaaaagacuuacuauaauggauuugcacccuggagcaggaaagacaaaacgauaucuaccugcgaucguaagagaagccauaaagagagggcucagaacauugauacuagcgcccacaagaguuguggcugcagaaauggaggaagcgcucagaggacuuccgauucgauaccaaaccccugcuauucgagcugaacauacaggcagagaaauuguagauuuaaugugucaugcgacguuuacaaugcggcuucucaguccaguaagaguaccuaauuacaaucuuauaauuauggaugaagcacauuucacagacccagcauccaucgccgcacguggauauauaucaacaagaguugaaaugggcgaagcagcggggauauuuaugacagcaaccccuccaggaagccgcgacccuuuuccacaaucaaacgcuccaauaauggaugaggagagagagauaccagaacggagcuggaacagcggacaugagugggugacggacuuuaagggaaaaacagugugguuugucccaucaauaaaagcaggaaaugacauugcugccugucuaagaaaaaacggaaaaaaaguuauccaacuuucgagaaaaacguuugauagcgaguacguaaaaacucgugcaaaugauugggacuucguaguuacuacagacauuagugaaaugggugcaaacuuuaaagcggaacguguuauagauccaagaaggugcaugaaaccaguuauccuuaccgauggggaagaacgaguaauauuggccggaccaaugccggugacacacaguagugccgcacaacguagggggagaauagggagaaauccaaaaaacgaaaaugaucaauauauauacaugggugaaccucuugagaaugaugaagauugugcgcacuggaaagaagcgaaaauguuauuagauaacaucaacaccccagagggcauaauucccaguauguucgagcccgaacgugaaaaaguagaugcuauugacggcgaauaccggcucaggggugaggcccgaaaaacauuuguugaucuaaugagaagaggcgacuuaccagucuggcuagcauauaaaguagcggcugaaggcaucaacuacgcugauaggaaauggugcuucgacggaauaaagaacaaucaaauauuagaagaaaauguugaagucgaaaucuggaccaaagaaggagagaggaaaaaacuuaagccgagauggcuagaugccagaaucuauagugacccguuggcccuaaaagaauuuaaagaauuugcggcggggagaaagagcuuaacgcuaaacuuaauaacugaaaugggucgacuaccaacguuuaugacucagaaagcucgaaacgcacuugauaacuuagcaguucuucauacagcagaggcuggugggcgagcauauaaccaugcuuuaagcgaacuuccagaaacuuuagaaacucuauugcuuuuaacauuacuggcuacugucaccgggggaaucuuucuuuuccuuaugagcggcaaagguaucggaaagaugacauuagguauguguugcauaauaacagcuucuauccuccuaugguacgcacagauccaaccacacuggauugcagccucaauaauccuagaauucuuucuuauaguucugcuaauaccagaaccggagaagcaacgaacaccgcaggauaaucaguugacauauguuguuauagcuaucuuaaccguagucgccgcaaccauggccaaugaaaugggauucuuagaaaaaacaaaaaaagaccuagggcuaggauccauaacuacgcaagagucggaaucaaacauuuuggauauugaucuccgcccugcgagcgcguggacauuauaugcaguagccaccaccuucguaacaccaauguugcgacauucaauagaaaacucuucgguuaauguuagucugacagcuaucgcgaaucaagcuacaguccugaugggacuaggaaaaggcuggccucucucaaaaauggauauuggggucccauuauuagcuauaggguguuacagucagguuaacccaauuacucuaaccgcugcccucuuauuacucguggcccauuacgccaucauaggccccggauuacaagcaaaggcuacaagggaggcucagaaacgugcugcugcugggaucaugaaaaacccaaccguugauggaaucacagucauagaccucgaaccaauuccguaugauccuaaauucgagaagcaauuaggacagguaaugcuguuaauacuaugcgugacacaaguucuaaugaugaggacaacuugggcgcucugcgaggcacuaacauuggccaccgggccgauaucuacacuuugggaagggaaccccggaagauuuuggaacacaacaauagcaguaucuauggcaaauauauuccgugguucauaucuagcaggagcugggcuauuguucaguauaaugaaaaacacgacgaacacuagacggggcaccggaaauaucggagaaaccuuaggagagaaauggaagagucguuugaacgcgcuaggcaaaagugaguuccaaauauacaaaaaaucaggaauccaagaaguugacaggacguuagcaaaggaaggaauuaaacgaggcgaaacugaccaucaugcaguuucacgcgggagugcgaaauuaagaugguuuguagaacgaaacaugguaaccccagagggaaaaguaguagaucuuggauguggacgagggggguggucauauuacuguggaggucugaagaacguaagagaagucaaggguuuaacaaagggaggaccgggacaugaggaaccuguaccuaugucuacuuacggcuggaaucuaguacgacuacagucgggaguugauguauucuuuacacccccggaaaagugugauacauugcugugugauaucggagagaguucaccuaacccuaccauugaagcaggacgaacccuccgcguguugaaucuaguugaaaauuggcucaauaacaacacacaauucugcauaaaaguacuaaauccauacaugccaucaguaauugagaagauggaaacccuucaaaggaaauacgguggagcccugguucguaacccauuaucaaggaacuccacucaugaaauguauuggguaagcaaugcaaccggaaacauaguaucaucgguaaacaugauaagcagaauguuaauuaaucgauucacuaugaaacauaaaaaagcaacauaugagccagauguggauuuagguucaggaacgagaaauauugggauagaaucagaaauaccaaacuuagauauaaucgguaaacguauagagaaaauaaagcaagagcacgagacuucauggcauuaugaucaggaucauccauauaagaccugggcauaccauggcucauaugagacuaaacaaacugguagugcaucgucaauggugaaugggguaguccgauuauuaacuaagccaugggacguugucccuauggugacccagauggcaaugacugauacgacacccuuuggucaacagcgaguauucaaagaaaaaguagacacaaggacacaagaaccuaaagaagggacaaaaaagcuaaugaaaaucacagcggaaugguuauggaaagaacuagguaaaaaaaaaacgccgagaaugugcacacgggaagaauucacaaaaaaaguaaggucaaaugccgcucuuggggcaauauuuacugaugaaaauaaguggaaaagugcccgugaagcaguagaagacgguagguuuugggaacuaguagaucgugaacguaacuuacaucucgaagguaagugugaaacuugcguauauaacaugauggggaaaagggaaaaaaaacugggugaauucggaaaagcgaaaggaaguagggcuauuugguauauguggcuuggugcacgcuuucuagaauuugaagcguuaggauuucugaacgaggaucauugguuuucacgugguaauuccuuaagugguguagaaggagaaggauugcauagauuaggguauauauuacgcgaagucggaaaaaaagaggggggugccauguacgccgacgauacagcaggaugggacacaagaauuacuuuggaagauuugaagaaugaggaaaugguaacuaaucauaugaaaggagaacacaaaaaacuagcugaggcgauuuucaaacuuacuuaucaaaauaaggucguacgaguucaacgaccaacgccaagaggcacagugauggacauaauuucccgcagggaccaaagagggucugggcaaguagguacuuacggcuuaaauacauucacaaacauggaagcacaauugauucgucaaauggaaggagaaggaauauucaaaucaauccaacaucuaaccgcuacggaagaaauugcaguacaaaauuggcuugcaagggugggacgagaaagauuaucaaggauggccauauccggagaugauuguguuguaaaaccuauagaugacagauuugcgucugcacuuacugccuuaaacgacauggggaaaguccguaaggauauccagcaaugggaaccuagucggggauggaaugacuggacacaaguaccguucugcagucaucauuuucaugagcuagugaugaaggaugguagaguuuuggucguucccuguagaaaucaagacgaauuaauagggagagcuaggauaagucaaggagcuggguggucguuaaaggagacugccugccuagggaaaaguuaugcucaaauguggacucucauguauuuccaucgcagggaucuuagauuagccgcaaacgcaauuuguagugcugugcccagucacuggguaccaacaucaagaacaacauggucuauucaugccaaacaugaauggaugacuacagaagacauguuagccguauggaacagggucuggauucaagaaaacccauggauggaagacaagacgccuguagaaaguugggaggaggucccguaucuaggaaagagagaggaucaauggugcggauccuuaauugggcuaacaagcagggcaacaugggccaaaaauauacaaaccgcaauuaaccaagugaggagccugauugggaacgaagaauauacagacuacaugccauccaugaaacgauuuaggcgugaagaagaagaagcgggaguccuaugguga

SEQ ID NO: 22571 - RNA, 9876 nt, Artificial Sequence
  derived and/or modified CDS sequence (opt6) from DENV-2__EU660400__SS-prME
acagcagguguaauuauaauguugauaccaacagcaauggccuuccaucuaacuacaagaaauggugaaccacauaugauaguaggucgacaggaaaaagggaaaucauuauuguucaaaaccgaagacggugugaacauguguacuuuaauggccauagaccucggagaauugugugaagacacaauaacauacaaaugcccucuucuaagacagaacgaaccagaggacauagacugcugguguaacucgacgucuacguggguuacauaugggacauguaccaccacaggcgaacauagacgagagaaaagauccguagcauuagucccacauguaggaaugggauuagaaacucgaacugaaacguggaugucuagcgaaggagcguggaaacaugugcaaagaauagaaacuuggaucuuaagacacccagguuuuacgauuauggccgcgauauuagcuuauacaauagguacaacgcauuuccagagagcucugauauucauauuauuaacuaccguagcacccuccaugaccaugagaugcauaggaauuagcaauagagacuuuguagaagguguuucugguggaagcuggguugacauaguucucgaacauggcagcuguguaaccacaauggcaaaaaacaaaccaacucuggacuucgaauugauuaaaacugaagcaaaacaaccggcuacucuacgaaaauacuguauagaggcaaaauuaaccaacacaacaaccgagucacggugucccacucaaggagaacccucguugaaugaagaacaagauaagcgauucauauguaagcauucaaugguagauagaggguggggaaauggcugcggguuguuugguaaaggcggaauagugacuugugcaauguucacaugcaagaagaacauggaaggaaaagugguacugccggaaaaucuagaauacacuauaguaaucaccccgcacagcggagaagaacacgcaguugguaacgauacgggaaaacacgggaaagaaauaaaaauaacaccccagucgucgauuacagaagcagagcuuacaggauacggcacaguuaccauggagugcucaccgagaacgggccucgauuucaacgaaauggucuuguuacaaauggaagacaaagccugguuggugcaccgacagugguucuuggaucuaccauuaccauggcugccuggggcugauacucagggcucuaacuggauucaaaaagaaacacuagugacuuucaaaaauccccaugccaaaaagcaagacguagucguccuagggucgcaggaaggagcaaugcauacagcgcucacuggagcaacugaaauacaaauguccucuggcaaucuccucuucacaggccaucugaaaugccguuugcguauggauaaauuacaguuaaaaggaaugucuuacagcauguguacuggaaaauuuaaaauaguaaaagaaauagcagaaacccaacauggaaccauaguaauacgaguacaauaugagggagacggcaguccaugcaaaaucccauucgaaaucauggaucuagaaaagagacauguccuagguaggcuaauaacggucaauccuauaguuacagagaaagacagucccguuaauauagaagcagaaccaccuuuuggggacagcuauauaauuaucgguguagaaccaggacaauuaaaacucaacugguucaaaaaaggaaguucaauuggacaaauguuugagacaacaaugagaggugcaaaaagaauggcaauacucggagacacugcgugggauuuuggaucucucggcgggguguuuacaucgauagguaaagcgcugcaccaagucuuuggagcaaucuauggugcugcauucagcggcguaucuuggacaaugaagauacuuaucggaguuauuaucacauggauuggaaugaauaguagguccacaucuuuaucagucucacuuguucuaguagguguagugacauuauacuugggugucaugguacaagccgauagugguugugucguaucuuggaaaaauaaagaguugaagugcggaaguggaauauucauaacggauaacguccauacauggacugaacaauauaaguuccaaccagaauccccuuccaaauuagcaagugcuauucagaaagcgcaugaagagggaauaugugggauccgcucagucacaagauuagaaaaucuaauguggaaacaaauaacaccagaacuaaaucacauacuaucagaaaacgaagucaagcugacaauaaugacaggcgacauaaaagggauaaugcaagcaggaaaaagaagccuacguccacagccaacagaauuaaaguacucuuggaaaaccugggguaaagcgaaaaugcucucaacugaaucacauaaucagacauuccuaauagauggcccagaaaccgcagaauguccaaacacuaaucgggccuggaauucacuagaaguugaggauuacgguuuuggcguauuuucaacaaacauuuggcuuaaacuuagagagaaacaagacguguuuugugauaguaaauugaugagcgcugcaaucaaagacaacagggcuguacaugcagauaugggcuacuggauugaaucugcacuaaacgauacauggaaaauggagaaggcuucauuuauugaaguuaaaucaugucauuggccuaagucacauacuuuauggucuaaugggguucuagaaagcgaaaugauaauucccaagaacuucgcuggaccagugagucaacauaauuaccgaccaggcuaucacacacagacagcaggaccauggcaucuuggaaagcuagaaauggacuucgacuuuugugaagguacgacagugguuguaacagaggauugugguaaucgaggaccuagccuucguacuaccacugcaucgggaaaauuaauuacagaaugguguuguagaaguugcacucugcccccguugcgauauagaggagaagaugguuguugguauggaauggagauucgaccacuaaaagaaaaagaagaaaaucucguaaacucguuagucacggccggccauggacaaauagauaacuuuagccuuggagucuuagguauggcauuauucuuagaagagaugcugcgaacuaggguaggaacuaaacaugcaauucuacuuguagcaguuaguuuuguuacgcuaauaacgggcaauaugagcuuuagagaucugggacgcgugaugguuauggucggagcaacaaugaccgaugacauagggaugggcguuacauaucucgcauuacucgcugccuucaaaguucgacccacauucgcugcaggacugcucuuacgaaaacuaaccucuaaggaguuaaugauggccacgauuggaauugcacuacugucacagaguaccauaccggaaacaauuuuagagcuaaccgaugcuuuagcgcuggguaugaugguuuugaaaaucguacggaacauggagaaauaccagcucgcaguaacuauaauggcuauaagcugcguuccaaaugcaguuauucugcagaaugcuuggaaaguuucuugcacaauacuugccgcgguuuccguaaguccucugcuuuugacgagcucgaggcaaaaggccgauuggauaccacuagcacuuacgauaaagggccuaaauccgacagcaauauuccucacuacacuaaguaggacuucgaaaaaaagaagcuggccauuaaaugaagcaguaauggcugugggcaugguaaguauucuagcgaguucauuauuaaaaaacgacauaccuaugacaggcccccuagucgcaggaggacuacuaacaguauguuauguccuaacuggcagaucagcugacuuagaauuggaaagggccgcugaugucaagugggaagaucaagcagaaaucucagguucuaguccaauccuaucgaucacaauaagugaggaugggucaauguccauaaaaaaugaagaagaagagcacaccuuaaccauauuaauacguacuggacucuuaguaauuucggggguauuuccaguaagcauaccaauaacagcagcugcaugguauuugugggaagugaagaaacagcgcgcagggguauuaugggauguuccaagucccccucccguaggaaaggcggaacuggaagauggugccuaccgaauaaaacagcgagggaucuuuggauauagucaaauaggagcaggcguuuauaaagaaggaacauuucacacuauguggcaugucacgcgaggggcuguauuaaugcaucgagggaagcguauugaacccucgugggcagacguuaaaaaagaccucauuagcuaugguggcggauggaaacuugaaggcgaguggaaagagggagaagagguccaaguucuagcacucgaaccuggcaaaaacccccgagcagugcaaacaaaaccgggauuauuuaaaacuaacacaggaacuauuggagcagucagucucgauuucagcccgggaacaucuggaagcccaauaguugauagaaaaggcaaagugguggggcucuaugggaaugggguaguaacucguucuggagcuuauguuuccgccauugcacaaacggaaaaaucgauagaggacaauccagaaauagaagacgauauuuuucgcaaaaaaagacuuacaaucauggaucuccaucccggugccgggaaaacaaagagguaucuuccagcgauaguuagagaggcaauuaagcgcggauuaagaaccuuaauacuugcaccgacaagaguaguagcugcugaaauggaggaggcacuaagaggacuaccuauaagauaucaaaccccagcaauuagagcugagcacaccgggagagaaauugucgauuuaaugugccacgccacauucacgaugagacuacuuagucccguuagaguacccaauuauaaccuaauuaucauggaugaagcccauuuuacagaccccgcuucaauugcagcuagaggguauauaucaacgagaguagagaugggcgaagcugcuggcauauuuaugacggcaacaccuccagggucaagagacccuuuuccccagaguaacgccccaauaauggaugaagaacgcgaaauuccagagagaucuuggaacaguggacaugaaugggucacugauuucaaagguaagacaguaugguuuguuccuuccauuaaagcgggaaacgacauugcggcuugccuuagaaagaacggaaagaagguaauucaguuaucaagaaaaacauuugauucugaauauguaaagacaagggcuaacgacugggacuuuguugucacaaccgauauaagcgagaugggugccaacuucagagcggaacggguuauugauccuagacgaugcaugaaaccugugauauuaacagacggugaggaaaggguaauacuagcuggaccaaugcccguuacacauucaucagcagcucaacgaagaggaagaauuggaagaaaccccaaaaaugagaaugaccaguacauauauaugggggagccacucgaaaacgacgaagauugcgcgcauuggaaagaagcuaaaauguuauuagacaacauaaauaccccagaaggaauaauaccaaguauguuugaacccgaacgugaaaaaguggaugcgauugauggcgaguaccgucuaagaggugaagcuaggaagaccuucgucgacuuaaugcgccggggagauuugccaguuugguuagcauaucggguagcggcagaagggauaaauuaugcagaucgcagauggugcuucgacgggauuaaaaauaaccaaauacuagaagaaaacguggaaguagagauuuggacuaaagaaggugaacgaaaaaaacuaaaaccucgcugguuagaugcacggaucuacucugauccuuuagcacucaaagaguucaaggaauuugcugcaggaagaaaaucauugacgcuuaaucuuauuacggaaauggggcgacuuccaacuuucaugacucagaaggcucgggaugcucuagacaaucuagcgguucuacauacugcggaagucggagggagagccuacaaccaugcacugagcgaacucccggagaccuuggagacccuacuauuauuaacauugcuagcgacugugacggguggaauuuuccuguuuuugaugagugggaaagguauaggaaaaaugacuuuaggaaugugcugcaucauaacggccucaauacugcuuugguaugcccaaauucaaccacacuggauugcagcaucuauuauacuagaauuuuuucucauuguucuccuaauaccagaaccagaaaaacagaggacuccacaagauaaccaacuaaccuauguaguuauugcaauccuaacggugguugcggcgaccauggcuaacgaaaugggcuucuuggagaaaacuaaaaaggacuugggacucggcaguauaacuacucaagagucugagaguaauauucuagacaucgaucuuagaccugcgagcgcauggacucuguacgcagucgcaacuacguuugucaccccaauguuaaggcauaguauagagaacucuucaguuaaugucagccugaccgcaauagccaaucaagccacgguauuaaugggucucggucgugguuggccccuguccaaaauggacauuggggugccacuccuugccauaggaugcuacagucaaguuaauccaauaacauuaacggcugcacuucugcuauuaguugcccauuaugccauaauuggaccuggucuacaagcuaaagcuacaagagaagcacagaagagagccgccgcaggaauaaugaaaaacccuacagucgaugguauaacaguaauagaucuagaacccaucccuuaugauccuaaauucgagaaacaguuagggcaaguuaugcuauuaguacucugcguaacucaaguauuaaugaugagaacuacaugggcgcuuugugaagcacugacauuagccacagguccgauaaguacuuuaugggaaggaaauccaggucguuucuggaacacgacgaucgcagucucuauggcgaauauuuucagagggagcuauuuagcaggugcuggauuauuauucucaauaaugaaaaauacaacaaauacacgaaggggaacuggcaacauaggagaaacucucggggagaaguggaaauccagacuaaaugcucucggaaaaagugaauuucaaauuuacaagaaaaguggcauacaagaaguggaucgaacuuuagcuaaagaaggcauaaaaaggggagagacugaucaccaugccguaaguagaggauccgcuaaauuacgaugguucguagaaagaaauaugguaaccccagagggaaaaguuguagaucuuggauguggcaggggagggugguccuacuacugcggagggcuaaaaaaugugagggaggugaaagggcuaacaaagggugguccaggacaugaagagccaauuccuaugucaacauacgguuggaaucuugugagguugcaaagugguguagaugucuucuuuacuccacccgaaaaaugugacacauuauugugcgauauaggggagucuucuccaaauccuacaauagaggcagggcguacccuaagaguccugaauuuaguagaaaacugguuaaacaauaauacccaauuuugcauaaaagugcugaauccauauaugcccucggugauagaaaaaauggaaacacuucagcgcaaguauggaggugcgcuuguacggaacccacugucgaggaauagcacacacgagauguacugggucagcaaugcaacugggaauauugucucuagcguaaauaugauaagcagaauguugaucaaucgauucacgaugaagcauaaaaaagccacuuaugaaccagauguagacuuagguucuggaacccgaaauauugguauugaaaaugagauacccaauuuagacaucauaggaaagagaauagagaagauaaaacaagagcaugaaacauccuggcauuaugaucaagaucaucccuacaaaaccugggcuuaucacggaucauacgaaacuaaacaaacaggcuccgcuaguucgaugguaaacggaguuguuaaauuacucacgaaaccaugggauguuguucccaugguuacucaaauggcuaugacugacaccacucccuucggucagcaaagaguauuuaaagaaaaagucgauacaagaacacaagagcccaaggaagguacgaaaaaacuuaugcgcauuacggcagagugguuauggaaagaauugggcaagaagaaaacaccucgaauguguacgagagaagaauucacgagaaaaguuagaagcaacgcggcacugggggcgauuuuuaccgacgaaaauaaauggaaaucagcccgcgaagcagucgaagacucaagauucugggaguugguagaccgagaaagaaaccugcaucuagaaggaaaaugcgagacgugugucuauaauaugauggggaaaagagaaaaaaaauugggggaauuugggaaggcuaaaggaaguagagcaauaugguauaugugguugggugcaagauuucucgaauucgaggcuuugggauucuugaacgaagaucauugguuuagucguggcaauucuuuaagcggagucgagggagaggggcuccauaaguugggauauauuuuaagagacguaagcaaaaaagaggggggagcaauguaugccgaugauaccgcuggcugggacacuagaauuacguuagaagaccucaaaaaugaggagauggugaccaaucacaugaagggugagcauaaaaagcuagcugaagcuauauucaaguuaacauaucaaaauaaggugguaagaguacaacgaccgacaccgcgugguacagugauggacauaauuagccggaaagaccagagaggcagugggcaggucggaacguauggacuaaacaccuuuacaaauauggaagcacaacuaauucgucaaauggaaggagaagggauauucaagucaauacaaagacucacaguuacagaagaaauagcaguucaaaacuggcuagcucgaguuggucgcgaaagauuaucaagaauggcgauaucgggagacgauuguguagugaagccauuagaugacagauuugcuuccgcguuaacagcacuuaaugauaugggcaaaguaagaaaagauauccagcaaugggaaccgucaagaggauggaacgacuggacacagguuccauuuuguucucaccauuuucaugaauugguuaugaaagauggaagaguccuaguagucccaugccguaaucaggacgaauuaaucggaagagcucgaauaucacagggagcuggauggucuuuaaaagaaacagcaugucucgguaaaagcuacgcucaaauguggacacugauguacuuccauagacgagacuuaagauuagcagccaaugccauaugcagugcugugccgucacacuggguaccuacaucacguaccacauggaguauacaugcuaaacacgaauggaugacaacggaagacauguuagccgucuggaaccgaguauggauccaagaaaacccauggauggaagauaaaaccccaguagaaagcugggaagaaguaccauaucuugguaaacgcgaagaucaauggugcgguucccuaauaggacucacaaguagagcuacaugggcaaaaaauauacagacagcuaucaaccaaguacgcucccuaauugguaaugaagaauauacggauuacaugccaagcaugaaacguuuucguaaagaagaagaagaagcaggaguucuaugguaa

SEQ ID NO: 22572 - RNA, 9876 nt, Artificial Sequence
  derived and/or modified CDS sequence (opt6) from DENV-2__EU569711__SS-prME
acagcaggaguaauaauuauguuaauaccuacagcaauggcauuucauuugacaacuaggaacggagaaccccacaugauuguagguagacaagaaaaaggcaaaucucuuuuauuuaaaacagaagaugggguuaauaugugcacacugauggcaauugauuuaggagaacuaugcgaagauaccauuacauacaaauguccuuugcugcgucaaaaugaaccugaagacauagacugcugguguaacucgacaucaacauggguaacuuacgguaccuguacuacuacaggagaacaucgucgagaaaaacgcagcguagcauuggugccacacguaggaauggggcuagaaaccagaacagaaacguggaugucaucagaaggcgcauggaaacacgugcaaagaauagaaacuuggauacugcgacacccggguuucacaauaauggcugcuauucuagcuuacacaaucggaacaacucacuuucaacgagcacugauauucaucuuguuaacggcgguagcuccuucgaugacgaugagguguauuggcauuagcaaucgggacuucguggaaggggucucaggcggaucuuggguugacauaguucuagaacauggaucaugcguuacaacgauggcuaaaaauaaaccaacuuuggacuuugaauuaauuaaaaccgaagcaaaacaaccggccacauuacgcaaauauugcauagaagcaaaacugaccaauaccacgacugaaucgagaugcccgacacagggagaaccgucauuaaaugaagaacaggacaaacgcuucauuugcaaacauaguaugguggaucgaggcugggguaacggauguggacuauuugguaaaggaggaaucgucacuugcgcaauguuuacgugcaagaaaaauauggaggguaaaguaguacugccagaaaaucuugaauauacuauugugauaacgccucacucaggugaagaacaugcagucggaaacgauacgggcaaacacgggaaagaaauaaaaauaacaccucaauccagcauaacagaagcagaacuuacugguuacggcacuguaacgauggaauguucaccucgcacuggauuagacuuuaaugaaauggugcuccuacaaauggaagauaaggcuugguuaguucauagacaaugguuuuuagauuuaccucuaccgugguugccuggagcagauacacaggggucuaauuggauacaaaaagaaaccuuaguuacauuuaaaaauccacaugccaagaaacaagacgugguaguacuagguagccaagaaggagccaugcacacagcacugacaggagcgaccgaaauucagaugaguagcggaaauuuacuauucacuggucaucucaaaugucgacuaaggauggauaaauuacaguugaaaggcaugagcuacaguaugugcacgggaaaauucaaaauagucaaagaaauugcagaaacccaacaugggacaauuguuauuaggguacaguacgaaggcgaugggucaccguguaaaauaccauucgagauaauggaccuggaaaaacgucacauucuaggucgcuuaauuaccguaaacccgauaguuacagagaaagauaguccgguaaauaucgaagcagaaccgccauuuggagauaguuauauaauuaucgggguagaaccagggcagcuaaaauugaacugguuuaaaaagggguccucgauuggacagauguuugaaacuacuaugcgaggggccaaacggauggcuauuuuaggcgauacagcaugggauuuuggauccuuagguggugucuuuacuucaauaggaaaagcccuccaucaaguauuuggggcuauauacggagccgcuuuuucaggagugucuuggacaaugaaaauacuaauaggaguuauaauuaccuggauuggaaugaacucaagaucaacaagucuuucgguaucauugguguuaguagggguagugacauuguaucugggggucaugguucaagcggauagcggcugugucguuuccuggaaaaacaaagaauuaaagugcgguucgggaauauucauuacugauaauguacauacauggacagagcaauauaaauuucaaccugaaaguccgagcaaacuagccucggcgauacagaaagcccaugaagagggcauuugugguauaagaucaguuacccgacuagagaacuugauguggaagcaaaucacucccgaauugaaucacauucuuucagaaaaugaaguaaaauugacuaucaugacaggagacauuaaagguauaaugcaggcugggaaaagaucccuacgaccgcagccuaccgaauuaaaguauagcuggaagacauggggaaaggccaaaauguugucaacugaaucacauaaucaaacauucuuaauugacggaccugaaacugcagaguguccaaacacuaacagagcuuggaacucucuggaaguugaagacuauggauuuggaguuuucaguaccaauauuuggcucaaacuaagagaaaaacaggauguauuuugcgauucuaaauuaaugagcgcggcaauaaaagauaaccgugcgguacaugcagauauggguuauuggauagagagugcucuuaaugacacguggaagauggaaaaggcuucuuuuauugaaguuaagaguugucacuggccaaaaucacauacguuauggucgaacggugugcucgaauccgagaugauaaucccuaaaaacuuugcugggccgguuucgcaacauaacuauaggcccggcuaccacacacaaacagcgggaccauggcauuugggcaaacuugagauggauuuugauuuuugugaagggaccaccgucguaguaacagaagauugcgguaauaggggaccaucgcuucggaccacgaccgcuaguggcaaauuaauaacagagugguguugccgcaguuguacuuuaccgccauugagguaucgaggugaagacgguugcugguacggaauggagaucagaccacuaaaagagaaggaagaaaaucuuguaaacagccuuguuacugcaggacacggucaaauagauaauuuuucacuaggagugcuugguauggcucuauucuuagaagagaugcuacgaacgaggguagguacaaagcaugcuaucuuacuugucgcaguaucuuuuguaacccuuauuacgggaaauaugucauucagagaccuuggaagaguaaugguaauggucggcgcgacaaugaccgacgauauaggaaugggaguaacuuacuuggcguuauuagcugcguucaaaguuagaccgacauuugcagcaggauuauuacugagaaaacuuaccucuaaagaguuaaugauggcuacaauuggaauugcgcugcugucacaaaguacaauaccugagacaauauuagagcuaacagacgcgcuagcuuuggguaugaugguguuaaaaauaguucguaacauggaaaaauaucaauuagcuguaacaaucauggcuauaaguuguguaccaaacgcaguuauccugcaaaacgcuuggaaagucucguguacgauccuagcugcaguaagugucaguccuuugcuucucacaaguagucaacaaaaagcggacuggaucccguuagcuuuaacaauuaaaggacuaaaucccacagcaauauuucuaacaacauuaagucggacaaguaagaagcguaguuggccgcugaacgaggcgguaauggcaguugguauggucucaauacuagcuagcaguuugcugaaaaacgauauuccgaugacaggaccccucguagcaggcggacuacuuaccguauguuauguauuaacuggccguagugcggaccuggaauuagagcgugcggcagauguuaaaugggaagaccaggccgagauuucuggaucuucuccaaucuuaaguauuacaaucucugaagauggaucaaugagcaucaaaaaugaagaagaagaacauacuuuaacuauucugauaagaaccggucuccuaguaaucucgggcguguucccuguaucaaucccuauaacagcggccgcgugguaucuaugggaagucaaaaagcagagggcuggaguuuuaugggacgugcccucaccaccaccuguuggaaaagcugaacucgaggacggugcauacagaauuaaacagagaggaauuuucggauauucccagauaggugcugggguauauaaagaaggcacauuccauacgauguggcacguuacaagaggggcgguauuaaugcaucgcgggaagcggauagaaccuaguugggcagacgucaagaaagacuuaaucucuuauggaggaggauggaaacuugaaggggaauggaaggaaggagaagaaguucaaguacuagcccuagagccgggcaaaaauccacgagcaguacaaacuaagccagguuuguuuaaaacaaacacggggacgauaggggcgguuagucuugacuuuucuccugguacaaguggcagcccgauagucgauagaaaggguaagguaguaggacuguacgguaacggaguuguuacuagaucaggugcauauguuucggcaauagcccaaacggaaaaaucgauagaagauaauccugaaauagaagaugacauauuucgaaagaagcgccuaacuauuauggauuuacacccaggggcugguaaaaccaagagauaccucccugcgauuguacgagaggcuauaaaacgaggauugcgcacacugauuuuagccccaacucgcguaguagcagcagaaauggaagaagcauuaaggggcuuaccaauuagauaucaaacuccggcgauucgagcagaacauacaggaagagaaauaguagaccuaaugugucaugcaacguucacaaugcguuuauugagcccaguacguguuccaaacuauaaccugaucauaauggaugaggcucacuuuacagauccugcaucuauagccgcacgaggcuauauaucgacuagaguggaaaugggagaggcagccggaauuuuuaugacagcaacaccgccggggucaagagaccccuuuccgcagucaaaugcuccuaucauggacgaggagcgugaaauacccgagagaaguuggaacagcggacacgaauggguaaccgacuuuaagggaaagaccguaugguuuguuccauccauuaaagcugggaaugacauagcagcgugccuucguaaaaaugguaagaaagucauacaacugagcaggaaaaccuucgacagugaauauguaaaaacaagagcuaacgauugggacuuuguuguuacaacggauaucagcgaaaugggcgcaaacuucagagcugaaagggucauugacccuaggagauguaugaaaccuguaauuuuaacagacggcgaggaacguguaauuuuagcuggaccaaugccagucacacacaguagcgcggcacagagaagaggaagaauaggaagaaacccuaagaacgagaaugaucaguacauuuacaugggagaaccucuagaaaaugacgaagacugugcacauuggaaagaagcuaaaauguuauuagauaauaucaauacucccgaagguauuauaccaucuauguuugaacccgaaagagaaaagguagacgcaauagauggcgaauaucgacucagaggagaggcucgaaaaacuuuuguugaccuaaugcgaaggggcgaccuaccuguguggcuugcguauaggguggcagcugaagggauaaauuacgcggaccgccgaugguguuuugacggaaucaaaaacaaucaaauauuagaggaaaauguagaaguggaaauauggacaaaagaaggagaaaggaaaaaguugaagccuagaugguuagaugcacgaauauauucugacccacuagcacucaaagaauuuaaggaguucgcagccgguagaaaaucucuaacacuuaauuuaauuacggaaaugggaagauuaccgacguuuaugacacaaaaggcccgagacgccuuagacaauuuagcgguacuucauacggcagaagugggaggcagagcguauaaccacgcacuuagugaauugccagaaacccuugagacucuuuuguuacuuacacuauuggcgaccguaacugguggcaucuucuuauuuuugaugaguggcaaaggaauaggaaaaaugacucucgguaugugcugcaucauaacggcaucaauauuacuuugguacgcacaaauacaaccacauuggaucgcggccuccaucauacuugaguucuuucucauuguuuuauuaauaccagaaccugaaaagcaaagaaccccacaggauaaucaacuuacauauguaguuauagcaauucuaacagugguggcggcaacuauggcaaaugaaaugggauucuuagaaaagacuaagaaagaccuggguuuaggaucgauuacaacacaagagagcgagucuaauauauuagauauagaucugcgaccggcaucggcauggacuuuauaugcaguugccacuaccuucguaacaccgauguugaggcacagcauugaaaacaguucugugaacgucucucucacugcgaucgccaaucaagcaacagucuuaaugggacuagguagagguuggccacuaagcaaaauggacauaggaguaccacuauuagcuauugguugcuauagucagguuaacccaauaacacucaccgcagcauuauuacucuuaguagcacacuacgcuauaauaggaccggguuugcaagcaaaagcgacaagagaagcacagaaaagagcggcggcagguauaaugaagaacccaacgguagauggaauaacagugauugaccucgagccaauaccauaugacccuaaguuugaaaagcaacucgggcaaguuaugcuuuuaguuuuaugcguuacucaaguccugaugaugagaacaacgugggcuuuaugugaagcguuaacacucgcaacaggacccauuucaacuuuaugggaaggcaauccaggacgauucuggaauacaacaauagcgguaaguauggcaaacauuuuccgagggagcuaccuagcgggagcaggccuccuauuuucuauaaugaaaaauacgacaaauaccagaaggggaacuggaaacauuggugagacauuaggggagaaauggaaaagccgacugaaugcucuaggcaaaagugaguuucaaauuuacaagaaaucugggauucaggaaguagauagaacacuugccaaggaaggcauuaagcgaggagaaacugaucaucaugccgucucaaggggaagugcaaaacuaaggugguucguagagcguaauauggugaccccagaaggaaaggugguugaucugggauguggaaggggagggugguccuacuacugcgguggacuaaagaacguuagggaaguaaaaggauuaacaaaaggcgggccaggacacgaagaaccaauaccgauguccacauacggauggaaucuugugagacuacaaaguggcguagauguguucuuuacaccgccagagaagugugauacgcuccucugugacauaggagagagcagcccaaauccuaccauagaggccgguagaacccugaggguucucaaucuaguagaaaacugguuaaauaacaacacacaguucugcaucaaaguccuuaauccauauaugcccuccguaauugagaaaauggaaacacuccaaaggaaauaugguggagcccuaguaagaaauccuuuaucacggaacucgacacaugaaauguauugggugagcaaugcuacagguaacauaguauccagugucaacaugauaagcaggaugcuuauaaauagauucacuaugaaacacaagaaagcaacuuaugaaccggaugucgacuugggaucggguacucguaauauagguauugagaaugaaauacccaacuuagauauaauugggaagcgcauagagaaaauaaaacaggaacacgaaacgucuuggcauuaugaucaagaucaccccuauaagacaugggcguaucacggaucauaugagacaaaacaaacugguagugcaucaaguaugguuaaugggguuguacgacuauugacuaagccuugggacgugguuccaauggugacacaaauggccaugaccgacacaacuccauuuggacaacagagaguauuuaaggaaaaggucgacacacgaacccaagagcccaaagaaggaaccaagaaacuuaugagaauaaccgcggaaugguuguggaaagaacuugguaagaagaaaacaccacggaugugcacuagagaagaguucacaagaaaaguuagaaguaaugcagcacugggagcaauauuuaccgaugaaaauaaauggaaguccgcccgagaagcaguugaagauucacgauuuugggagcuaguugaucgagagcgcaaucuacaucucgaggggaaaugugaaacuugcguauauaauaugauggguaaaagggagaagaaacuaggagaauuugguaaagcgaaaggaucacgagcuauaugguacaugugguuaggugcacgguuuuuagaguucgaagcucugggcuucuuaaaugaagaucacugguuuaguagaggcaacagccuuucaggggucgaaggugaaggacuucacaaauuagguuacaucuuaagagacgucuccaagaaagaagguggugcuauguaugccgaugauacugcagggugggauaccagaauaacacuugaagacuuaaagaaugaagaaaugguaacgaaucauaugaagggggaacauaagaaauuagcugaagcaaucuucaaacuuacauaccagaauaagguagucagaguucaacgaccgacaccacgaggcacagucauggacauaauaagucguaaagaccagcgaggaaguggacaaguuggaacuuauggacucaauaccuucacgaauauggaagcacaguuaauuagacaaauggaaggcgagggcaucuucaagagcauacaaaggcuaacaguaaccgaagaaauagccguucaaaauuggcuagcacgaguaggaagggaacgauuaucacgaauggcuauaucgggugacgauuguguaguaaaaccccucgaugauagauuugcaucagcacuaacugccuuaaaugacaugggaaaagugagaaaggacauacaacaaugggaaccaucuagagguuggaaugauuggacacagguuccuuuuugcucacaccauuuucaugaauugguaaugaaagauggcagaguccucgucgucccuuguagaaaccaggacgaacuuauagguagggcacguauaucgcaaggagcuggguggagucugaaagaaacagcuugccugggcaagucguacgcccagauguggacauuaauguauuuucaccggcgagacuuaagguuagcagcuaacgcuauauguuccgcggucccuagucacuggguacccacgucccgcacaacauggucgauucaugcaaaacacgaauggaugacaaccgaggacauguuggcaguauggaauagaguguggauacaagaaaauccguggauggaagauaaaacccccguagaaucgugggaagaagugccuuaucuagggaaaagagaagaucaauggugcgggucgcuaaucggacuaacgagccgcgccacaugggccaaaaacauucagacagcgaucaaucaaguccggucuuuaauugguaacgaagaauauacugauuauaugccaaguaugaagagguuuagaaaggaagaagaagaggcuggaguucuaugguga

SEQ ID NO: 22573 - RNA, 9876 nt, Artificial Sequence
  derived and/or modified CDS sequence (opt6) from DENV-2__EU569712__SS-prME
accgccggaaugauaaucauguuaauuccaacagcgauggcguuucauuugaccacuaggaacggugaaccacauaugauuguaggaagacaagaaaaaggaaaaucacuacucuuuaaaacugaagacggagugaauaugugcacucucauggcuaucgaucuaggcgaauuaugugaagacacaauaacguacaaauguccuuuacuucgccaaaaugaaccagaagauaucgauuguuggugcaauucaacaucaacuuggguuacguaugggacaugcacgacuacaggagaacauagaagggaaaaacggucaguggcguuaguaccacauguugguauggguuuagaaacaagaacagaaaccuggaugucuucagaaggagcauggaaacacgugcaaagaauagaaaccuggauuuuaagacacccagguuucacaauuauggccgccauacuugcuuauaccaucgggacuacccauuuccaaagagcucuuauauucauccucuugacggcaguagcucccagcaugaccaugcgauguauagggauaucgaauagagauuuugucgaggggguuaguggcgguucaugggucgacauuguauuggagcacggaagcugcguaacgacgauggccaaaaauaaaccgacacuagauuucgaacucauuaaaacugaagcgaaacaaccugcuacacuacgaaaauauuguauagaagcuaaauuaacaaacacaacaacugaaucaagaugcccaacacaaggagaaccaagccuaaacgaagaacaggacaaacgguucauaugcaaacauuccaugguagauagaggauggggaaacggcugcggcuuauuuggcaaaggagggauaguaaccugugcuauguuuaccugcaagaaaaacauggaagguaaaguaguccuaccugaaaauuuggaauacacaauuguaauuacgccacauuccggugaggagcaugcaguagguaaugauacuggcaaacaugggaaagaaauuaaaauaacuccacaaaguucaauaacagaagcugaacugacaggauacggcacuguuacaauggagugcaguccgagaacagggcuagauuucaacgaaauggucuuauuacagauggaagacaaagcauggcucguacauagacaaugguuucuagacuuaccuuuaccuugguuaccaggggcugacacacaaggcaguaauuggauucaaaaagaaaccuuaguuacuuuuaaaaacccgcacgcuaagaaacaggauguagucguacuggguagccaagagggagcgaugcacacagcauugacaggcgcgacagagauacaaaugucaaguggaaaucuacucuuuacaggucaccugaaaugucgacucagaauggauaaacuacaacuuaaaggaaugaguuauaguauguguacaggaaaauuuaaaauaguuaaagagauagcagagacacaacacggcacaauugugauaagaguacaguacgaaggcgaugggaguccauguaaaauaccauuugaaauaauggaucuagaaaaacgauauguauuaggacgauugauaacgguaaauccuauugugacugagaaagauucaccaguuaauauagaagcagaaccaccauucggagacagcuacaucauuaucgguguugaaccaggccaacuuaaauuaaacugguucaagaaagguucgaguauaggacaaauguuugaaacgacgaugcguggagccaaacgcauggcgauauugggugacaccgcgugggauuucggaucacuagggggaguauuuaccaguauagggaaagcacuucaccaagucuucggugccauauauggugcagccuucucggguguaucauggacuaugaaaauucugauagggguuaucauaacauggauagguaugaacagucgaagcacaucacuaucagugucucugguauugguuggaguagugacuuuauaccuaggaguuaugguacaagcggauucaggguguguagucucuuggaaaaauaaagagcucaaaugugguucagggauauuuauaacggauaauguacauaccuggacugagcaauauaaauuccaaccagaaucacccaguaaauuagcuucagcaauccaaaaagcucacgaagagggaauaugcgguauaagauccguaacuagguuagaaaaucuaauguggaaacaaauaaccccugaauuaaaucacauauuauccgaaaacgagguaaaauuaacgauaaugacaggcgauauaaaagggauaaugcaggcagguaaaagaucacuacgcccucagccgaccgaacugaaauauucguggaaaacuuggggaaaggcaaagaugcuuaguacagaaucacauaaccaaacauuucuuauagacggaccagagacugcggaauguccgaacacgaacagggcuuggaacucguuggaaguggaagacuauggauuuggaguguuuucaacaaacaucuggcuaaaacugagggaaaaacaagauguauucugugauuccaagcucaugucggcagccauuaaagauaacagggcuguucaugcugacauggguuacuggaucgaaucagcacuaaaugauacuuggaaaauggaaaaagcgaguuucaucgagguuaaaagcugucauuggccgaaaucucauacguuguggucaaacggcguauuagagucagagaugauuauccccaaaaauuuugcagguccaguuucucaacauaacuaccggccgggauaucauacacaaaccgcggguccguggcaccuggggaaauuagagauggacuuugauuuuugcgaaggaaccacaguugucgugacagaagacugugguaacagaggaccaaguuuaagaaccacaacagcauccgguaaauuaauaacagaaugguguugccgcagcuguacucugcccccauuaagguacagaggagaagauggauguugguaugguauggaaauaaggccucucaaagaaaaagaggaaaauuugguuaacagcuuaguuaccgcuggacacggacaaauagauaauuuuucauugggaguauuaggcauggcacucuuuuuggaggaaaugcugaggacuagaguagguaccaagcaugcgaucuuacugguugcaguuaguuuuguaacucuuauuacaggaaacaugucguucagagaccucggcaggguuauggucauggugggcgccacuaugacagaugacauagggaugggaguaacauaucuugcucuauuagcugcauuuaagguuaggccaacauucgccgcaggguuacuacuaagaaaauuaacaagcaaagagcuuaugauggcuacuaucgguauugcucuacuaagccaaucgacuauaccagagacgauccuagaauugacagaugcgcuggcacucgggaugaugguguuaaaaauugugagaaacauggaaaaauaucaguuagcaguuaccaucauggcgauucucugugugcccaaugcuguuaucuuacaaaaugcguggaaagugucauguacgauccucgcagcugucaguguaaguccauugcuuuuaaccucaucacaacaaaaagcagauuggauuccacuugcacuaacuauaaaaggucuuaacccgacagcaauuuuccucacaacacuuucuagaaccucuaaaaagagaagcuggccacugaaugaagcgguuauggcgguaggaauggugucaauuuuagcuagcagcuuacugaaaaaugauaucccaaugaccgguccauuaguagcuggcggguuauuaaccguuuguuauguauuaacuggaaggagugccgaucuggaauuagagcgggcggcugaugucaaaugggaagaucaagcagagaucagcggcucaaguccaaucuuaucaauaacuauaucagaggacggcucuaugucgaucaaaaacgaagaagaggaacaaacccuaacaauucucauccgaacgggcuuauuggucauauccgggguauuucccguaagcauaccaauuacggcggcugcgugguaucugugggagguaaagaaacagagggcuggagucuuaugggacguaccauccccaccuccaguugaaaaagcugaacuugaggacggagccuaccgcauuaaacaaagaggaauuuucggauauagucaaaucggcgcaggaguuuauaaggagggcacuuuccauacuauguggcacguaacucguggagcaguucuaaugcacagaggcaagaggaucgaacccucaugggcagacgucaagaaagaucuuauaucauaugggggcggguggaaacucgaaggagaguggaaagaaggggaagagguucaaguucucgcuuuggaacccggcaaaaaucccagagcaguacaaaccaagccaggacuauuuaaaacuaauaccggcacaauaggagcuguuagucuggauuucagcccuggaacuucaggaucuccaauaguagaccgaaaagggaaagucguuggauuauaugguaaugggguggucacacggucaggagcauauguauccgcuauagcgcaaacagagaaaagcauagaggauaacccggaaauagaagacgacauuuucaggaaaaagcgacugacgauaauggaucuccacccuggugcaggaaagacaaaaagauacuuaccugcaaucguucgagaggcaauuaaacgagggcucaggacgcuaauauuagccccgaccaggguagucgcagcagaaauggaggaagcucugcggggucuaccuauucgauaccaaacuccugcaauaagagccgaacacacuggcagagaaaucguagaucugaugugucaugcuacauucaccaugcgauuacuaucaccuguucgugucccgaauuauaaucucauuauaauggacgaagcccauuucacagaucccgcgaguauugcggcuagaggcuacauuucuacaagggucgagaugggugaagcggccggaauuuucaugacugccacucccccagguagucgagacccauucccucaaucaaaugcaccaauaauggacgaagaaagggaaauuccugagaggaguuggaacucaggccaugaauggguaacagauuucaaaggaaaaacugucugguuugucccaucgauuaaagcuggaaaugauauugcugccugucuaaggaaaaauggaaagaaagugauucaacucucaaggaagacauucgauagugaauacguaaaaacgcgagcgaacgacugggauuucgucguuacuacagauauaucagaaaugggcgcuaacuuucgggcggaaaggguuaucgauccccgccgauguaugaaaccuguuauuuuaaccgacggagaggaaagaguaauucuggcggguccaaugccuguaacacauagcagugcugcgcaaagaagaggcaggauaggaagaaaucccaaaaaugaaaaugaccaauacauauacaugggcgaaccucuagaaaaugaugaggauugcgcgcacuggaaggaagcuaaaauguuauuggauaacauaaauacacccgaagguauuauuccgaguauguuugaaccugaacgugaaaaagucgaugcaauagacggcgaauaccgguuacggggagaagcccggaaaacuuucguagaucuuaugagaagaggcgaucuccccguguggcuagcauacaggguggcggccgaagguauaaauuaugcagauagacggugguguuuugacggaauuaaaaacaaucagauacuggaagaaaacguagaaguagaaauauggaccaaagagggggaaaggaagaaauuaaaaccgcgaugguuagaugcucgaauauacucugauccgcuagcauuaaaggaguuuaaggaguucgcagcagguagaaaaagccuuacauuaaaccuaauaacggagaugggacgauuaccaacauuuaugacacaaaaagcuagggacgccuuggauaacuuagccguguuacauaccgccgagguugguggacgggccuauaaucaugcccuaucagaauuaccagagaccuuggaaacucuauuguuguugacacuucucgcaacaguaacaggaggaauauuucuauuucuuaugagugguaaggggauaggcaaaaugacacuagguaugugcugcauaaucaccgccucuauacuucuaugguaugcucagauacaaccucacuggaucgcugcgagcauuauccuagaguucuuuuuaauaguucuuuuaaucccagaaccugaaaaacaaaggacuccacaagauaaucagcuuaccuaugucguuauagcgauccuaacagucguagcugcaacaauggcgaaugagauggguuuucuugaaaagaccaagaaagaccuaggguuaggaaguauaauaacucaggaaucugaguccaauauucuugauauagauuuaagaccggcaucagcauggacguuguaugcuguugccaccacuuuuguaacaccaaugcuuagacacucuauagaaaauucaucuguuaauguuucauuaaccgcaauagcuaaucaagcgacuguacuaaugggacucgggcgaggauggccucuaaguaaaauggauauagguguacccuuauuagcgauaggauguuauucucaaguuaaccccaucacuuugacagccgcucuauugcuuuuagucgcucacuaugcuauaauaggacccggucugcaagcaaaggcaacacgagaagcgcagaaaagggccgcugcagguauaaugaagaacccaacaguugacgguaucacgguuauugaucuggaaccaauacccuacgauccuaaauuugaaaaacaacucggucaagugaugcuccuuguauuguguguaacgcaaguuuuaaugaugcgcaccacgugggcacucugugaagcauuaacccuagcuacugguccaauuucuacguuaugggaaggcaaccccgggcgauucuggaauacgaccaucgcaguaagcauggcaaauaucuuucgaggaucauaucuggcaggcgcaggucuucucuuuaguauaaugaaaaauacaacgaacacacgaagagggacuggcaacauaggggagacauugggagaaaaguggaagaguagguuaaaugcacuugggaaaagcgaguuccaaaucuauaagaaaucggggauucaagaaguagaucgaacuuuagcgaaggaaggaauuaaaagaggugaaacagaccaucacgccgugucgcgagguucagcuaaacuacgcugguuuguugaaagaaauaugguaacgccugaaggcaaaguagucgacuuggguuguggacgugguggauggucauauuauugugguggacugaaaaaugugagagaaguuaaagggcuaacuaagggagggcccggccaugaggagccaauuccuaugucaaccuacggguggaauuuaguccguuuacagagcgguguagaugucuuuuucacuccuccugagaaaugugauacacuacuaugugauauuggcgagucaucaccgaauccuacaauagaagcaggccgaacucuacgaguacuaaaucuaguggaaaauugguuaaacaacaauacgcaauuuuguauuaaaguuuuaaacccuuauaugccaucuguuauagagaaaauggagacucuacaaagaaaguaugguggugcauuaguuaggaacccacuuucuaggaacucuacacaugagauguauuggguaagcaaugcaacaggaaacauuguuuccagcgugaauaugaucucacgaaugcugaucaacagauuuaccaugaaacauaaaaaggccacguacgaaccagauguagacuuaggaagugggacuagaaauauuggaauugaaaaugaaauuccgaaucucgacauaaucggaaaaaggauagaaaagauuaagcaagaacacgaaacaucauggcauuaugaucaagaucauccauauaagaccugggcauaccacggcuccuacgaaacuaaacaaacuggaagugcaucuucuauggugaacggcguuguaagacuccuaacuaagccgugggacguaguaccaauggucacccaaauggccaugacggauaccacaccguucggccaacaaagaguauuuaaggaaaaaguugauacacguacccaggagccaaaggaaggaacaaagaaacugaugagaauaacugcggaaugguuguggaaagaacuaggcaaaaagaaaacuccccgaauguguacuagggaagaguuuacgcgaaaaguaaggucuaacgcggcccucggggcgauuuuuaccgaugagaauaaguggaaaucagcuagggaagcaguggaagacucccgauucugggagcuaguagauagggaacgaaaccuccacuuagaaggaaaaugugaaaccuguguauacaauaugauggguaagagagagaagaaauuaggggaguuugguaaagcgaagggaucacgcgccaucugguauaugugguuaggugcaagauuccuggaauuugaggcacucggguuucuaaacgaagaccacugguuuucccgugguaacucuuuaucuggaguagaaggagaaggauuacauaaauuaggauauauccuacgggacguaucuaagaaggaaggcggcgcaauguacgccgaugacacagcggguugggauacacgaaucacucuggaggauuugaaaaaugaggaaauggucacaaaucacaugaaaggcgaacauaagaaacuagcugaagcuauuuuuaaacuaacuuaucagaauaaagucgugaggguacagcgcccaacuccgcguggcacgguaauggauauuauaagucgaaaagaccaaagagguagcggccaggucgggacauacggauugaacacauucacuaacauggaagcccaauuaauaagacagauggaaggcgaaggcauuuucaaauccauucaacaucugacgguaacggaagagauagcaguuagaaacugguuggcuaggguaggcagagaaagacuaaguagaauggcuauuaguggcgaugauuguguaguuaagccuuuagaugacagguuugcuagugcucuuacugcacuaaaugauauggguaaaguccggaaggauauucaacagugggaaccuucgcgaggcuggaaugauuggacccaaguccccuuuugcagucaccauuuccaugaauugguuaugaaagacgguagaguguuaguaguuccaugucgcaaucaggaugaguugauaggccgggcaaggauuucccaaggggcaggguggagccuuaaagaaacggccuguuuagguaaaucauacgcacaaauguggacuuuaauguauuuucacaggcgagaccucagacuagcagcuaacgcaauauguagcgccguuccaucacauuggguaccaacuucgcgaacaacauggagcauacaugccaaacaugaguggaugacaaccgaagauaugcuagcaguuuggaacaggguuuggauacaggaaaaucccuggauggaagauaaaacuccugucgagaguugggaagaaguuccguauuuggguaagcgagaagaucaguggugugguucgcuaaucggccuaacuagcagggccaccugggccaaaaauauacagacagcaauaaaccagguaagaucguugauagguaaugaggaauauacagauuacaugccaaguaugaaacgguuucggaaagaggaagaggaagcgggaguacuaugguaa

SEQ ID NO: 22574 - RNA, 9876 nt, Artificial Sequence
  derived and/or modified CDS sequence (opt6) from DENV-2__EU596487__SS-prME
acggcaggcgugauaaucauguuaauacccacggcaauggcguuucacuuaacgacacgaaauggagaaccccacaugauuguuggacgacaagaaaaaggaaaaucauuacuauuuaaaacagaagauggaguaaauaugugcacgcuuauggcuauagaccuaggagaauuaugcgaagacacuauuacauacaaauguccgcuauuacggcagaaugaaccagaagauauagacugcuggugcaauucgacgagcacauggguaacguauggaacuugcaccaccacgggggaacauagaagagaaaaacggucuguggcuuuagucccccacguuggaaugggacuagaaacgcgaacagagaccuggaugucuucagaaggggccuggaaacacguucagagaauugaaacuuggauacuaaggcacccgggcuuuacuauaauggcggccauauuggcuuacacgaucggaaccacacacuuucaaagagcucuuauauuuauacuacuaaccgcuguggccccuucaaugacaaugagguguauagguauauccaauagggauuucguagaaggcguaagcggcggauccuggguagacauagucuuagaacacgggaguugcgucacaacaauggcgaaaaauaaaccuacucuagacuuugaacuaauaaaaacagaggcgaaacaacccgcuacuuuaaggaaauauugcaucgaagcgaaauugacaaauacaaccacagaaucacguugcccgacucagggggagccaucuuugaaugaagaacaagauaagcguuucauauguaaacacagcaugguugaucgaggauggggcaauggaugcggacuauucggaaaaggaggaaucguaaccugcgcuauguuuacaugcaagaaaaauauggaaggaaaaguuguucuaccagaaaaccuugaguauacaauaguuauaacgccccauaguggagaagaacacgcugucggcaacgacacuggaaaacauggaaaagaaaucaaaauaacaccucaaagcaguauuacagaagcagaacuaacuggcuauggaaccguaaccauggaaugcucuccgcguacuggauuggacuuuaacgagaugguauugcuucagauggaagacaaagcauggcuagugcacaggcaaugguuccuagaccuaccccuaccuugguuaccaggagcagacacccaagguagcaauuggauucaaaaagaaacguugguaacauucaaaaauccccaugcuaagaaacaagauguagucguccuagggucacaagagggcgcaaugcacacagcacuuacuggagcaacagagauccaaauguccuccgggaaccuucucuucaccggucaucuaaagugucguuuaagaauggauaaauugcaguuaaaaggaaugaguuauucuauguguacaggcaaauucaaaaucguaaaagaaauagccgaaacacaacacgggacuauagugauccguguacaguacgaaggugauggaucccccugcaaaauaccauucgaaauaauggauuuagagaaaagacacguucuuggacgauuaauuacugucaacccgauagucaccgaaaaagacuccccuguaaacauugaggccgagccacccuucggagauagcuauauaauaauagguguugaaccugggcaacugaaacucaacugguuuaagaagggcucaagcauuggucagauguuugaaacuacuaugcguggugcgaagagaauggccaucuugggagauaccgccugggauuuuggaagucuaggugguguauucacuagcaucggcaaagcacugcaucagguuuucggagccaucuacggggcagcauuuaguggcgucuccuggacuaugaagauacuaauaggugugaucaucacuuggauaggaaugaacucccggucgaccucacuaucaguuucguuaguguuaguaggcguaguaacauuauauuuagggguuaugguacaagcggauagugguugcguuguuucauggaagaauaaagagcuaaaaugcgggucaggaauauucauuacagacaauguacauacauggacagaacaguauaaguuucaaccagaaucaccaucaaaauuggcaagugcaauccaaaaggcacaugaagaaggaauaugcggcaucaggucuguuacgagacuagaaaauuuaauguggaagcagauuacaccagaguuaaaucauauuuuaagugaaaacgaaguaaaguugaccauaaugaccggagauauuaaaggaauaaugcaagcgggaaagagaucucuacggccacaaccuacugaacucaaguauucguggaaaacauggggaaaagccaaaauguugucaacugaaagucauaaucaaacauuccuuauagacgguccagaaacugcugagugcccaaauacuaaucgagcauggaacuccuuagaaguagaagauuauggauucgggguguucaguacgaacaucuggcugaaauuacgagagaaacaagacguauuuugcgacucaaaauuaaugucagcugcuauaaaggauaauagggccguucaugcugauaugggguauuggauagaaagugcauuaaacgacacauggaagauggaaaaggccucauuuauugaaguaaagucgugucauuggcccaaaucgcauacgcuauggagcaauggaguguuagagagugaaaugauuauaccuaaaaauuucgcugguccuguaagucagcauaauuacagaccgggauaucacacacaaaccgcaggaccauggcauuuaggaaaauuggaaauggauuuugauuuuugcgaagguacaacaguuguaguaaccgaagacugcggaaauagagguccaagucugagaacaacuacagcuagugguaaauuaauaaccgaguggugcugcaggagcugcacacuuccuccccuacgguaucgaggugaagaugguuguugguacggcauggaaauucgacccuuaaaagaaaaagaagaaaaucucguaaauucccugguuacugcuggccacggucaaaucgacaauuuuagucuaggaguacuuggaauggcuuuauuuuuagaggaaauguuaagaacgagagucgguacaaaacacgcuauucuauuaguugcaguaucauuugucacauuaauaacggguaauaugaguuuccgagaucuaggaaggguaaugguuaugguuggagcuacaaugacugaugauauuggaaugggcguuacuuaccuugccuuguuggcugcguuuaaaguacgcccaacauucgcugcggggcuauugcuuagaaaauuaacaucaaaagaauuaaugauggcaacuauaggcaucgcccuuuuaagucagucuacuauacccgagacaauccuagaguuaacugaugcucuugcccuagggaugaugguuuuaaaaaucguucgaaauauggaaaaauaccaguuggcagucacaauuauggccauaaguuguguaccuaaugcuguaauucuccagaacgcguggaaagugucuuguacaaucuuagcugcgguuagcguaucacccuuauuguuaaccaguucucagcagaaagcugacuggaucccuuuagcauugacuauuaaaggacuaaacccgacggccauuuuccuuaccacucugucucgaacaucuaagaaacgaagcuggccacucaaugaagcaguuauggcugucgguaugguuagcauacucgcuucuucacugcucaaaaaugacauccccaugaccgguccucucguugcgggaggcuuacuaacaguaugcuacguguugacaggaagguccgcagaucuugaguuggagcgugcagcugacguuaaaugggaagaccaagcagaaauaagcgggucuagcccaauacuaagcauuacaaucagugaagaugguucaauguccaucaaaaaugaggaggaagaacauacucuaacaauucuaauacgcacaggacucuuagugauuagcggaguauucccugugucgauaccgauuacagcagcugcaugguaccuuugggaggucaagaaacaacgugcaggaguguuaugggauguaccaucacccccgccagucggaaaggcagaacuagaagauggugccuauaggauaaagcagcgaggaauauuuggauacucccagauuggagcggguguuuauaaagaggguaccuuccauacuauguggcauguaacgaggggugcgguacuaaugcaucgagguaaaagaauagaaccuuccugggcagaugucaagaaagaucuaauaucauacggggguggauggaaacuagagggugaauggaaagaaggagaagaaguacaaguacuagcgcuagagccuggaaagaauccgagagcuguacaaaccaagccaggucuuuuuaaaacgaauaccggaacaaucggggcugucucacuagauuuuucaccuggaacaucaggauccccaauaguagauagaaaagguaaagugguuggucuuuaugguaauggcgugguuacgcguucaggagcguaugugagugccaucgcacaaacagagaaaaguauagaagacaacccugaaauugaagaugauaucuucagaaagaaaaggcucacuauuauggaucuacauccaggagcagggaagacaaaaagauaucuuccugcaaucguucgagaggcaaucaaaagaggacuacgaacauugauuuuagcaccaacuagaguuguagcggccgaaauggaagaagccuugaggggacuuccaauucgcuaccaaacaccggcaaucagagcagagcacacaggaagggaaauaguggauuugaugugccacgcuacuuucacgaugcgucugcucucuccuguuagaguaccgaacuacaaucuaauuauaauggaugaagcacacuucacagauccagcaaguaucgcagcgcguggauacauaucaacucggguagaaaugggcgaagccgcggguauauuuaugacggcaacaccgccgggaagucgugacccauuuccacaaucuaaugcgccaauaauggaugaggaacgcgaaauacccgaaagaagcuggaauagcggacacgaguggguuacugacuuuaagggaaaaaccguaugguuuguaccgaguauuaaggcagggaaugauauugcugccugccuaaggaaaaaugguaaaaaggucauacaacugagcagaaaaacuuuugauuccgaguauguaaaaacuagggcuaaugauugggauuucguaguaacuaccgacauaucagaaaugggcgccaauuucagagcugaacgcguuauagauccgcggagaugcaugaaaccuguaauacuaacagauggagaagaacgagucauauuagcggguccaaugccaguuacacacucuucugcggcccaaaggagaggcaggauaggcagaaauccaaagaaugagaacgaucaauauauauauaugggagaaccguuggaaaaugaugaagauugugcccauuggaaagaagcgaaaaugcuguuagacaauauuaauacaccagaaggaauaauuccuaguauguucgaaccugaacgagaaaaaguggacgcgauugauggagaauacagauuaagaggcgaagcgagaaaaacauuuguugacuugaugagaagaggggauuuaccuguuuggcuagcuuauaggguggcagcagaaggaauaaacuacgcggauagacgaugguguuuugacggaaucaaaaauaaccagauacucgaagaaaauguagaaguagaaauauggacaaaagaaggugagagaaagaaacuaaaacccagaugguuagacgcucguauauauagugauccguuagcuuuaaaagaauuuaaagaguucgcggcggggcguaagagccucacgcugaaucucauaacagaaaugggccgucuaccgacauuuaugacccagaaggcccgggacgcauuagauaauuuagcuguccuacacacagccgaaguaggcggcagagcguauaaucaugcauuaagugaacucccugaaacuuuggaaacuuugcuauuauuaacuuugcuggcaacugucacaggagguauauuuuuguucuuaaugagugggaaggguauagguaaaaugacuuuagggaugugcuguauaauuacugcgagcauuuuacuaugguacgcucaaauucagccgcauuggaucgcugcaagcaucauauuagaauuuuuccugaucguguuauuaauacccgaaccagagaagcagaggacaccucaagacaaucaacugacuuauguugucauagcgaucuuaacaguaguagccgcaaccauggcuaacgagaugggauucuuagagaaaaccaagaaggauuuaggacuaggcagcauaacuacacaagaaagugagucaaacauacucgacauagaucuaagaccggccucggcauggacacuauacgcagucgcgaccacauucguaacaccaaugcuacgacacucuaucgagaauaguucuguuaaugucucccuaacggcuauagcgaaccaggcuacaguacuuaugggccuaggacgcggauggccucuuaguaaaauggacauugguguaccauugcucgcaauugguuguuauucgcaagucaauccgauuacgcuaacagccgcguugcuacuauuggucgcacacuaugcgauuauugggccuggacuucaggcaaaagcaacacgcgaggcacaaaaacgagcagccgcagguauaaugaaaaacccuaccguugacgguaucacaguaauagauuuagaaccuauacccuaugauccaaaauucgaaaaacaacuuggacaaguuaugcuauuaguacuaugcgugacgcagguacuuaugaugcguacaacaugggcacuaugugaagcauuaacauuggcaaccgguccaaucucaaccuuaugggagggaaauccaggucgauucuggaauacgacgaucgcaguaaguauggcaaauaucuucagaggcucguacuuagcaggcgcaggauuacuuuuuagcauaaugaaaaauaccaccaauacuagacgaggcacagggaacaucggugaaacgcuuggagagaaauggaaaucuagguuaaacgcauuagguaagucagaauuucaaauauauaagaagucaggcauacaggaaguggauagaacccucgcgaaagaagggauaaagcguggcgaaacagaccaccaugcagugagucguggaucggcuaaauugcgaugguuuguugagcgcaauauggugacuccggaagguaaagugguagacuuaggcuguggaagaggagguuggagcuacuauugcggcggccucaaaaauguuagggaagucaaagguuuaacuaaagggggucccggacaugaggagccaauaccaaugagcacauauggguggaaucuaguucgauuacaaucuggugucgacguauuuuucacacccccagaaaagugcgauacccuacuaugugauauuggcgaaagcagcccaaauccgaccauugaggccggacguacucuaagggugcucaacuuaguugagaacuggcuaaacaacaacacacaguucuguauaaagguauuaaauccuuacaugccaagugucauugaaaagauggaaacgcuccaaagaaaauaugguggagcauuaguacgcaauccacucucaagaaauucaacucacgagauguauuggguguccaaugcgaccggaaacauaguaucaucaguuaauaugauuucccgcaugcucauaaaccguuucacaaugaagcauaagaaagcuaccuaugagccggauguggaccucgguaguggaacaaggaauauaggaauugaaaacgaaauuccuaaccucgacaucauagggaaaagaauagagaaaauuaaacaggaacaugaaacuagcuggcauuaugaccaagaccauccuuacaaaacaugggcauaucacgguaguuaugagaccaagcaaacugggagcgccucgagcaugguaaauggcguugugaaacuucucacgaaaccuugggacguagucccgauggugacucagauggcaaugacagacacaacaccauuuggacaacaaagaguauuuaaagaaaaagucgauacgagaacucaggagccaaaagaagguacaaagaaacucaugcgaauuacggcggaaugguuauggaaagaguuagguaaaaagaaaacuccccgaauguguacccgcgaggaguucacucguaagguccguaguaaugcagcucuaggcgcaauuuuuacagaugaaaauaaauggaaaagcgcgcgagaagcuguagaagauucaagguuuugggagcuaguggaucgagagagaaaccuucaucuagaaggaaaaugugaaacuugcguauauaacaugauggguaaaagggagaaaaaguuaggagaauuugguaaagcaaaggguagccgcgccauaugguacauguggcuuggagccagguuuuuagaguucgaagcauuaggauuuuuaaaugaagaucauugguuuucaagggguaauucauuaagcggagucgagggggaaggcuuacauaaacuuggauacauucuaagagauguuucaaagaaagaaggaggugcaauguaugccgaugacacagcggggugggacacgagaauaacauuagaagaccuuaaaaacgaggagaugguuacgaaucauaugaaaggcgaacacaagaaguuagcggaagcuaucuucaaacuuacauaccaaaacaaggucguacguguacagagaccuacaccaagaggcacuguuauggacauuauaucuagaaaagaucaacgagguucaggacaggucggaaccuauggacuaaacacguuuacaaauauggaggcucaauugauacgccaaauggaaggagaagguauauucaaaucuauccagagauugacaguaacugaagaaauagcaguacagaacugguuagcgcggguaggccgagaacgcuuaagucgaauggcuauuaguggagacgacugcguuguaaaaccauuagaugauagauuugcuucggcuuuaacagcucuaaaugauaugggaaaaguccggaaagacauacagcaaugggagccuucuagagguuggaaugauuggacccagguaccuuucuguucacaucacuuucacgagcuaguuaugaaggauggaagggucuuaguugucccgugcagaaaccaagacgaacuuauuggccgagcaagaauaucacaaggggcaggguggucucugaaggaaacagcuugcuuagguaaaagcuaugcccaaauguggacauuaauguauuuccaccgccgugacuugagauuagcagcgaacgcgauaugcagugcaguaccgucgcauuggguacccacaucgagaacaacguggagcauucaugcaaaacaugaauggaugaccacagaggauaugcucgcaguauggaacagaguauggauucaagagaauccauggauggaagacaagacaccuguagaaucaugggaagaaguaccuuaucucggcaagcgagaagaucaaugguguggcucacuuauugguuugacaucgagagccacuugggcaaagaacauacaaacggcgauuaaucaagugcgaucccuaauaggcaacgaggaauauacagacuacaugccaucaaugaaaagauucagaaaagaggaagaagaggcggguguuuugugguaa

SEQ ID NO: 22575 - RNA, 9876 nt, Artificial Sequence
  derived and/or modified CDS sequence (opt6) from DENV-2__EU569713__SS-prME
acagcggguguaauaauaaugcuaauuccgacagcuauggcauuucaucuaacgacuagaaacggagaaccacacaugauaguggguaggcaagaaaaagggaaaucucuguuauuuaaaaccgaagacgggguaaauauguguacacugauggcaauugauuuaggugaacucugugaagauaccauaacuuacaaaugcccgcuacuuagacagaaugaaccugaggauauugauuguugguguaauucuacaucaacguggguaaccuauggaacgugcacgacaacgggggaacauagaagggagaaaagaagugucgcucuaguaccacauguaggaauggguuuagaaacccgaaccgaaacuuggauguccucugaaggugcauggaaacacguacaacguauagagacuuggauucuacgucauccaggcuuuaccaucauggcagcaauucucgcauauaccaucggaaccacgcauuuucaaagagcacuaauauucauauugcuaacagcagucgcuccgaguaugacaaugcgaugcauaggaaucaguaaccgggacuucguagagggaguauccggaggguccuggguggauauuguauuagaacaugguucaugugucacuaccauggccaaaaacaaaccgacucuugauuuugaacucauuaaaacggaagcgaaacagccagcaacucuacgaaaauauuguauagaagccaaacuaacuaauacgacuacagaaucacgauguccuacacagggagaaccuagucuaaacgaagaacaagauaaaagguuuaucuguaaacauucaauggucgauagaggcugggggaaugguugcggauuguuuggaaaaggcggcauagugacaugugcaauguuuacaugcaagaaaaacauggaaggaaaaguggucuugccagaaaaucuggaauacacaauuguaauaaccccucacaguggagaggaacacgcaguuggcucagacacagguaaacauggcaaagaaauuaaaauaacuccacagucaucaauuacagaggccgaauugaccggauauggaacgguaaccauggaauguagcccgagaacuggauuggauuuuaacgaaaugguuuuacugcaaauggaggauaaagcauggcucguucacagacaaugguuccucgacuugccguugccguggcuacccggagcugauacacagggaaguaacuggauucagaaagagaccuuaguaacauuuaaaaauccucacgccaagaaacaagacguagucguacuagguucucaagaaggggcaaugcacacagcucuuacuggcgcaacggaaauacaaaugucgagcggaaaucuauuguuuacgggccaccuaaaaugcagacuacgaauggauaaauuacaacugaaagguaugagcuacaguaugugcacgggaaaauuuaaaaucguaaaggaaauagcugaaacacagcauggcacgauagugauucgcguacaauacgaaggagacggauccccuuguaaaauccccuuugagauaauggauuuagaaaagcgauauguauugggaagacuaauaacuguuaauccaauaguaacugaaaaagacaguccaguuaauaucgaagcagaaccgccauucggcgacucguauaucaucauuggcguagaaccuggccagcugaaauuaaauugguucaagaaagggucaucaauuggacagauguucgaaacgacaaugcgaggugcaaaacggauggcaauauuaggggauacugcgugggacuucggcucucuaggaggaguauucaccucaauuggcaaggcucuacaucaaguuuuuggcgcaauauauggugcagcuuuuaguggugugucauggacuaugaagauauugauagguguuauaauaacuuggauaggaaugaauagcaggucgacaucuuuaucagucagcuuaguuuuggugggaguggugacacuguauuuaggugucaugguccaggcagauaguggaugcgucguaucuuggaaaaacaaagaguuaaaauguggcucggggauauuuauuacagauaacguccauacauggaccgagcaauauaaauuccaaccagagucgccaucgaaauuagcaagcgccauacaaaaagcacaugaagaggguauuugugguauuaggucaguuacucgacuugaaaaccuaauguggaagcagaucacaccagagcuaaaucauauauuaucugaaaaugaagccaaacugacaauaaugaccggagauauuaaagguaucaugcaagcagggaaaagaucacucagaccucaaccaacagaacuuaaauacucauggaaaaccuggggcaaagcaaagauguugaguacagaaagucacaaucagacauuucuaauagauggucccgaaaccgcagaaugucccaauacuaauagggcauggaauagcuuggaaguggaggacuauggauucggaguauucagcacuaacauauggcuaaaauugcgagaaaagcaggauguauucugcgauaguaaauuaaugucagcagcaauaaaagauaaccgugcaguccaugcagauaugggauauuggauagaaagcgcuuugaacgauacauggaagauggaaaaagcaucguucauagaaguuaaguccugucacuggccuaaaucacauacguuauggucaaacggaguacucgaaucagaaaugauuauccccaaaaauuucgcgggucccguaagccaacacaauuauaggcccggauaucacacccagaccgcagggcccuggcacuuaggaaaauuagaaauggauuucgacuuuugcgaagggacgacaguuguaguaacagaagauugugguaauagaggcccaucccugaggaccacgacggcaagcggaaaauuaaucaccgaauggugcuguagaucguguacauuaccuccacuuagguaucggggugaagauggauguugguacggaauggaaauacguccauuaaaagaaaaggaggaaaaccugguaaacagccucguaacugccggucauggacagauagauaauuuuaguuuaggaguucuaggaauggcccuauuucuagaggagaugcuuaggacucggguggguacaaaacaugccauccucuuaguagcuguaaguuucguaacauuaauaacaggcaacaugucauuuagggauuuaggaagaguuaugguuaugguaggagcgacaaugacagacgauauaggaauggguguaacuuaucuagcacuauuggcagccuuuaaaguaagaccuacauuugccgccggucugcuauuaagaaaacucaccaguaaagaacuaaugauggcaacgauaggaauagcuuugcucucacagucgaccaucccugaaaccauacucgaacuuacugacgcauuagcucuuggcaugaugguacucaagauaguacgaaauauggaaaaauaucaguuagcaguaacaauaauggcuauucucuguguccccaaugcgguaauacuucaaaaugcauggaaaguauccuguacaauauuggccgcaguaucagugaguccgcuacugcucacaucaucucagcagaaagcagauuggauaccuuuagcuuugacaauaaaaggucugaauccaacagcgauauucuugaccacucuaucccgaacaucgaaaaagcguucuuggccccuaaaugaagccguuauggcuguaggaaugguaagcauccucgcaagcaguuuacugaagaaugauaucccaaugacggguccguuaguugcaggcggcuuauugaccgucugcuaugucuuaacgggcagauccgcagaucucgaguuagaaagagcagcagauguuaaaugggaagaucaggcagaaaucucgggaaguaguccuauacugucaauaaccaucagcgaagaugguagcaugucgauuaaaaaugaagaggaagaacagacauuaacaauucuuauaaggaccggguuauuaguaauaucaggaguauucccgguuaguauaccgauaacugcugcagcaugguaccuuugggaagugaagaaacaaagggcugguguacugugggaugugccuucuccuccucccguagguaaagccgaguuggaggauggcgcauacagaauuaagcaacgaggaauuuucggauauucucaaauuggagcaggagucuacaaggaaggaacuuuccauacuauguggcauguaacccgaggugcaguccuuaugcacagaggaaaaaggauagaaccuucaugggccgauguuaaaaaggaucuuauuucguacgggggugguuggaaauuagagggagaguggaaagaaggugaagaaguccaaguauuagcuuuggaaccaggaaagaacccucgggcuguucaaacaaaaccuggccuauucaaaacgaauacugguacaauaggugcugugucauuagacuucucaccuggcacuagcgguaguccgauaguagauagaaaagggaaaguuguaggauuauacgggaauggcguggugacaagauccggagcguaugucucagcaauagcacaaacagagaagucaauagaggauaauccggaaauagaagaugauauauuuaggaaaaagcgacuuacaaucauggaucuucacccaggugccgguaagacuaaaagauaccucccagccauuguacgagaagccauaaaacgaggguugcgaacauuaauuuuagcccccacacguguugucgccgcggagauggaagaagcgcugcgcggccuacccauuagauaccaaacgccagcgauucgugcagaacacaccgguagagaaauaguagacuugaugugccacgcaacguucacaaugcgccucuuaaguccagucagagugccaaauuauaaucuaauaauaauggacgaagcccacuucacugaucccgccaguauugcagcaagaggauauauaaguacacgggucgaaaugggagaagcggccggaaucuuuaugacagcaacacccccggguucccgcgauccguuuccccaaucuaacgcuccaaucauggaugaagaacgagaaauaccugaaaggucguggaacagcggccacgaauggguaacggacuucaaagguaagacaguaugguuugucccuaguauuaaagccggaaaugacauagcagcauguuugcguaagaacggaaagaaaguaauacaguuaucucgaaaaaccuuugacagcgaauaugucaaaacuagagccaacgauugggauuuuguaguuacaacagauauaucggaaaugggcgccaauuuucgagccgaacgagugaucgacccgagacgaugcaugaaaccaguaauauugacggauggagaagaacggguuauauuagcaggaccaaugccagucacgcauaguagcgcugcucaaaggagagguagaauaggcagaaauccuaaaaaugaaaaugaucaauauauauauaugggggaacccuuagagaaugaugaagauugcgcucauuggaaagaagcgaagauguugcuagauaauauaaauacacccgaagggauuauuccaucaauguuugaaccagagcgggaaaaaguugaugcgauugauggugaauacagauuaagaggagaggcaagaaagacauuuguagauuuaaugcggagaggugaccuaccagucuggcuagcguauaggguggcugcggaaggaaucaauuaugcugacaggcggugguguuuugacggcaucaaaaacaaccagauucuugaagaaaauguugaaguagaaauauggacaaaagaaggggaacgaaagaaauuaaaaccaagguggcucgacgcucgaaucuacuccgauccguuagcguuaaaagaguuuaaggaauuugccgccgggcguaagucauuaacucugaauuuaauaacggaaaugggcagauugccgacauuuaugacucagaaagcaagagaugcgcuagauaaucuagccguauuacacaccgccgagguaggaggucgggcauauaaccacgcacucucagaacuuccagaaacacuggaaacgcugcuacuuuugacauuauuagcgacuguuacaggagguauauuucucuuuuuaaugaguggaaaagguauaggcaaaaugacacuaggaauguguuguauuauaacagcgaguauuuuauuaugguaugcgcaaauucaaccgcauuggauugcagcuucgauuauuuuagaguucuuucuaauagucuugcuaauucccgaaccugaaaagcagaggacuccucaagacaaucaauuaacguauguuguaauagcuauacucacaguaguagcagcaacuauggccaaugagaugggguuccuagagaagaccaagaaagaucuuggccugggaagcauaauaacacaggaaucagaaucuaacauauuggauauagauuuacgacccgccuccgcuuggacacuuuaugcuguugccacgacauucguuacgccuauguugcggcacuccauagagaacucgucagucaauguuagucuuacugcgauugccaaccaagcuacuguauuaaugggacuuggaagaggauggccuuuauccaaaauggauauagguguaccgcuucucgccauuggauguuacagccaagugaauccgauuacacuuacagcggcauuacuucucuuaguggcucauuacgcaauuauaggaccaggauugcaggcuaaagcaaccagagaagcacaaaagagggcugcugccgguauuaugaaaaauccgacaguagauggaauaacuguuaucgacuuagaaccuauuccguaugacccaaaauuugaaaagcaacuuggucaaguaaugcuccuaguauugugcgugacacagguucuaaugaugcgcacuacaugggcuuuaugugaggcacuaacccuagccaccgguccaauaaguacguuaugggaaggaaacccagggcgauuuuggaauacaacaauagcgguaucuauggccaauauuuuucgaggauccuauuuggcaggggcaggacuguuauucucuauaaugaagaacacaacaaacacgcgaaggggcacgggaaacauaggagagacacugggugaaaaauggaaaagucgacuuaaugcccugggcaagagcgaguuccaaaucuacaaaaagagcgggauccaagaaguggauagaacauuggcaaaggaaggaauaaaaagaggagaaacggaccaccacgcaguguccagaggaucggcuaaguuacgcugguucguagaacgaaauaugguaacaccagaagguaaagucguagacuugggauguggcaggggagguugguccuauuacugugggggcuugaaaaacguaagggaagugaaaggauuaacaaagggaggaccuggucaugaagaaccuauaccaaugaguacuuauggauggaauuuagugcgcuugcaaagugggguagauguauuuuauaccccaccagaaaagugugacacccuauuaugcgacaucggcgagaguuccccaaauccaacaauugaagcuggaagaacauugagggugcuaaaccuaguagagaauuggcucaacaauaacacucaguuuugcauaaaggucuugaaccccuacaugcccucaguaauugagaaaauggagacccuacagcgcaaauauggaggcgcgcuuguaaggaauccacuuagcagaaacucgacacaugagauguacugggucucuaacgcuacagggaauauagugucauccguaaauaugauaucgagaaugcuuauuaauagguucaccaugaaacacaagaaagcuacuuaugagccggauguagaucucggaucagguacuaggaauauugguaucgaaaacgaaauaccaaacuuggauauaauagguaaacguaucgagaagauaaagcaagaacaugaaaccucauggcauuaugaccaagaccauccauauaaaacaugggcguaucacgguagcuacgagacaaaacaaacggguucugcgaguucaaugguaaaugguguaguuagacuccucacgaagccuugggauguaguuccaauggucacccaaauggccaugaccgauacuacacccuuuggacaacaacguguuuuuaaagagaaaguagauacccguacacaagaaccaaaagaagguacaaagaaguuaaugcgaauaacugcugagugguuauggaaagaauuagggaagaagaaaacaccacggaugugcacacgagaagaguucacccgaaaaguaagaucgaaugcggcucuaggagcuaucuucacagaugaaaauaaguggaaaucagccagagaagcaguugaagauucgagauuuugggagcuaguugaccgagaaagaaaucuacaccuagaaggaaaaugugaaacaugcguauauaacaugauggguaaaagagagaagaaauuaggggaguucgggaaggccaaaggcucuagagccauuugguauaugugguugggagccagauuuuuagaguucgaagcccugggauuucuaaaugaagaucauugguuuaguagaggaaauagucuaaguggcguggaaggcgaggggcuucauaaacuagguuacauuuugagggacgugucuaagaaagaaggaggugcaauguacgcugaugauacggcaggcugggauaccagaauuacauuagaagaccuuaaaaaugaagagaugguaacuaaccauaugaaaggggaacauaagaaacuagccgaagcaaucuucaaacuaacauaucaaaauaaagucguaagaguacaacguccaacaccuaggggaacaguaauggauauaauaaguagaaaagaucaaaggggaucaggucaaguaggaacguauggauugaacacuuucaccaauauggaggcacaacuuaucaggcagauggaaggcgaagguauauucaagucuauucagcauuuaaccguuacugaagagaucgcaguucaaaauugguuagcucgaguaggaagggagagguuaagcagaauggcaauauccggcgaugauuguguaguaaaaccccuugacgaucguuuugcaucugccuuaaccgcauuaaacgacaugggaaaaguucgaaaagauauucaacaaugggaaccuucgagaggguggaacgacuggacgcaaguuccauuuuguucacaccacuuucacgaguuaguaaugaaagacggaaggguauuagucguacccugccggaaccaagaugaacuaaucgguagggccaggauuucacaaggagcgggguggucauuaaaagaaacagcaugcuuaggcaaaagcuaugcucagauguggaccuugauguacuuucacagacgggacuuacgucuagcggcuaacgccaucuguucagcaguaccaagccauuggguaccaacgucgaggacgacauggucaauacaugcgaagcaugaauggaugacgaccgaagacaugcuugcuguauggaaucguguuuggauccaggaaaaucccuggauggaagacaaaacgccggucgagaguugggaagaaguaccuuaucuaggaaagagagaggaucaauggugcggcagccuaauuggacuuacaagccgggcaacgugggccaaaaauauucaaacugcuauaaaucagguuagaucacugaucggaaacgaggaauauacugauuauaugccaaguaugaaaagauuuaggaaagaggaagaaaaagcgggaguacucugguag

SEQ ID NO: 22576 - RNA, 9876 nt, Artificial Sequence
  derived and/or modified CDS sequence (opt6) from DENV-2__EU569714__SS-prME
acugcgggagugauaauaauguuaauaccuacugcuauggcuuuccaccuuaccacacguaacggugaaccgcauaugauuguaggacgacaagaaaaagggaagucauugcucuuuaaaaccgaagacggugugaauaugugcacuuuaauggcaauagauuugggcgaacucugugaagacacaauuacauacaaaugcccacuuuuaagacagaaugaaccagaagauauugauugcuggugcaauagcacuucuacauggguaacauauggaacuugcacaacgaccggagaacaucgacgugagaagcguagcguggcguuaguaccacacguagggaugggacuagaaacaaggacagaaacauggaugucaagugaaggagcauggaaacauguccaacgcauagaaacuuggauacugcgucauccagguuuuacaauaauggcagcaauccucgccuauacgauaggcacgacucauuuccaacgugcccugauuuuuauacuauuaacagcaguggccccaucaaugacaaugagauguaucggaauaagcaauagagauuucguugaagggguaucuggaggaaguugggucgauauaguacuagaacauggcucuugugucaccacuauggccaaaaauaaaccuacauuggacuucgaacucaucaaaacagaagcuaaacaaccugcgacacucagaaaauauuguauugaagcaaaacuaacgaauaccaccaccgaaagcagauguccuacacagggagaaccaagccucaacgaagaacaagauaaaagauuuauaugcaaacauucaaugguggacagaggcugggggaauggaugcggacuuuuuggaaaaggcggcauaguuacuugugccauguucaccuguaagaaaaauauggaaggaaaagucgucuugccagaaaauuuagaauacacgaucgucauaacuccgcauucaggcgaagaacaugcgguugggaaugauaccggaaaacaugguaaagaaauaaaaauaacgccacaaagcucaauaacagaagcagaauugacaggauacggcacaguuacgauggagugcagccccagaacaggacucgacuucaaugaaaugguacuccugcagauggaagacaaagcauggcuuguucauagacaaugguuucuagaccuuccacuuccauggcuucccggugcggauacacaggggagcaacuggauacagaaagaaacccucguaacauucaaaaauccacaugccaaaaagcaagauguaguuguacucggaagccaagagggugcaaugcauacugcauuaacaggagccacugaaauccaaaugagcucaggaaacuuguuguuuaccggucaccucaagugcagguuacguauggauaagcuacaacuaaaaggcaugaguuauagcaugugcacaggaaaguucaaaauugugaaggagauagcugagacacaacauggcacaauuguaaucagaguucaauaugaaggagauggcagucccuguaaaauaccuuuugaaauaauggaccuugaaaagcgacauguguuagggcgacuaauuacaguaaauccaauagucacggagaaagacucuccagucaacauugaagccgaaccgccuuuuggagauagcuauauaauuauaggagucgaaccaggacaguugaaacuaaauugguuuaagaaaggaaguucuauagggcaaauguucgaaacuacgaugaggggcgcuaagagaauggcaauucucggagacaccgcuugggacuuuggcucacuuggaggaguuuuuacaucgauagggaaagcgcuacaccaaguguuuggagcgauauauggagccgcuuuuucaggaguuaguuggacgaugaaaauauuaaucggggucauaauaacauggauugguaugaauagcagaagcacgagucuuucugucucauuaguauuaguagguguaguuacucuauauuugggaguuaugguucaggcagacucaggguguguugugucguggaagaacaaagaauuaaaaugcggaagugggauauuuauaacugauaauguacacacauggacugaacaauacaaguuccaacccgaaucaccaucaaaguuagcaagugcuauucaaaaggcucaugaagaggguaucugugggauucgcagcguaacgagacuagaaaauuuaauguggaaacaaauaacaccugaacuuaaucacauauugucagaaaaugaggucaaacuaacuauaaugacuggugauauuaaagguauaaugcaagcaggcaaaaggucucuaaggccacaaccgaccgagcuuaaauacucauggaaaaccuggggaaaagccaaaauguugucaacagaaagccauaaccaaacguuuuuaaucgaugggccagagacagcggaaugccccaauacaaaucgggcauggaacucgcuagagguagaggauuacggauuuggaguauucucaacgaacauauggcuuaaacuucgagaaaagcaagauguguuuugugacagcaagcuaaugucagcggccauaaaagacaauagagcugugcaugccgauaugggguacuggauugaaucggcuuuaaacgauaccuggaaaauggagaaggccuccuucauugaagucaaauccugccacuggccgaaaucacacacccucuggucaaauggaguccucgaauccgaaaugauaaucccgaaaaauuuugcuggaccaguuucucaacauaacuaccguccaggauaucacacucaaacugcggggcccuggcaucugggaaagcucgaaauggauuuugacuuuugugaagguacaacugucguuguaacagaagacugugggaacaggggacccagcuuacguacaacgacugcuuccggaaaacuuauaacagaaugguguugucgaucuugcaccuugccaccauugagauaucguggagaggauggaugcugguacgguauggagauacgaccguuaaaggagaaagaagaaaacuuagucaauagucucgugacagcgggccacggacagaucgauaacuuuucccuggguguccuuggaauggcauuauuccuagaagaaaugcuacggacgcgaguugggacaaaacaugucauucuucuuguagcuguuaguuuugugacucuaauaacggguaacaugucuuucagggaccucgguagggugaugguaaugguuggcgcuacaaugacagacgauauaggaaugggcguuacuuaccuagcuuuauuggcugcguuuaagguaagaccaacauuugcggcuggguuacuauuaaggaagcuaaccagcaaagaacuuaugauggcaaccauuggcauagcucuauugucacaaucgacgauuccugagaccauuuuagagcuaacagacgcacuugcuuugggcaugaugguauuaaaaaucguaaggaauauggaaaaauaccagcucgcgguuacaauuauggcaauaagcugcguuccuaaugcagucauccugcaaaacgcauggaaaguuucuuguacuauacuugcaguaguuuccguuaguccuuuauuacuaacaaguagucaacaaaaagcggauuggauaccuuuagcucuaacuaucaagggcuuaaauccuaccgcaauauuuuugaccacccuaagucgaacgaguaagaaaaggaguuggcccuuaaaugaggcagucauggcagucgggauggucaguauauuagcuaguucucuacuaaagaacgacauuccaaugacaggacccuuaguagcaggcggauugcucacaguauguuacguauuaaccggucguuccgcggaccucgaguuggaaagggcugcugaugugaaaugggaagaucaagcagaaaucucggguaguaguccaauacuaucuaucacaauuagugaagaugguaguaugaguaucaaaaacgaagaagaagaacaaacacucacaauauuaauacgaacaggcuuauuggucauuucggguguauuucccguuucaauacccauaacggcagcugcaugguacuugugggaaguaaagaaacagagggcaggcguucuaugggacguuccuucgccuccgcccguagguaaagcagaacuagaagacggcgcuuauagaauaaaacaacgugguaucuuuggauauucccagauaggagccgguguauauaaagaggguaccuuucauacaauguggcauguuacaagaggggcgguacuaaugcaucgggggaaacgaaucgaacccucuugggcagauguuaagaaagaucucauuucguauggaggagguuggaaacuagaaggagaauggaaagaaggcgaagaaguccaaguacuggcgcucgagccagguaaaaauccucgcgcgguucagacgaaaccuggucuauucaagacaaauacaggaacgauaggagccgugagcuuggacuuuuccccagguacaaguggaagcccaauaguagaccggaaaggcaaaguagucggacuauaugggaacgguguuguaacaagguccggugcguacgucucagcaauagcucaaacagaaaagucaauagaagacaauccggagauugaagacgacaucuuucgaaagaaacgucuaacgauuauggaccuccacccaggcgcaggaaaaacaaaaagauaccucccggccauuguacgagaggcuauaaaaagaggacuccguacuuuaauauuagcgccgacuagaguaguagcagcagaaauggaagaggcccuaagaggacuaccaaucagguaucaaacgccagcaauaagagcggagcauaccggacgggaaauaguugaccugaugugccaugcuacauuuacaaugcgacuacugucaccuguaagggucccaaacuauaauuugaucauaauggacgaggcccauuuuacagacccagcaucaauugcggcgcguggauauauaucuacccggguugaaaugggggaggcagcuggaauuuucaugacggcuacuccgccaggcuccagggauccauucccacaaucaaaugcgccaauaauggaugaggagcgggagauuccggagcggucuuggaacagcggucaugaauggguaacagacuuuaaaggaaaaacaguaugguucguaccaucaauuaaggcuggcaaugauauagcggcauguuuacguaaaaacgguaaaaaggucauucaguuaagccguaagacauuugacucugaguauguaaaaacacgagcaaaugacugggauuuugucguaacaaccgauauuagcgaaaugggagcaaauuuuagggcagaaagagugauagacccacgacgauguaugaaacccgugauccuuacggauggcgaagaaagaguaauacuugcggggcccaugccaguaacacauagcagugcagcgcaaagaagagggcgcauuggccgaaaucccaaaaaugaaaacgaucaguacauuuacaugggugaaccacuagagaacgaugaagacugcgcccauuggaaggaagcaaaaaugcuauuagauaauauuaacacgccagaaggaauaaucccaagcauguucgaacccgagcgcgagaaaguugacgcaauagacggagaauauagacuacgcggagaagcaaggaaaacauuuguggacuugaugcgccgaggugacuugccuguguggcuggccuaucgcguugcagcagaagguauaaacuacgcagacagaagauggugcuuugaugggauaaagaacaaucaaauuuuggaagaaaauguagagguagaaaucuggacaaaggaaggagaacggaagaaauuaaagccucgcugguuagaugcgcguauuuauagcgauccauuagcucuaaaagaauuuaaagaauuugcggcaggacgaaaaaguuuaacauugaauuuaauaacagaaauggggagauugccaacuuuuaugacccagaaggcgagagacgcucuugauaaucuugcgguccuacacacagcagaaguuggugguagagcauacaaccacgcguuaagugagcuacccgagacguuggaaacacuccuucuccuaacucugcuagcagcuguaacaggagggauauuucuuuuccucaugaguggcaaagguauuggaaaaaugacguuaggaauguguugcauaauuacggcuagcauucuucugugguaugcccagauacaaccacauuggaucgcagcaucaaucauucuagaguucuuuuuaauaguccuauuaauaccagaaccugaaaaacagcgaacuccacaggauaaucaauuaaccuauguaguuauagcuauauugacuguaguagcugcaacuauggccaaugaaaugggcuuucuagagaaaacuaagaaagaucuagggcuugguaguauuauuacccaggagagugaguccaauauacuagauauugacuuaagaccugcgucagccuggacauuauacgccgucgccaccacguucguaacgccuaugcuucgucacucaauagaaaauucuucagugaacguuucauuaacugcaauagcgaaccaagcgacaguauugaugggacugggaaggggguggccucugucaaaaauggauauaggaguuccauuauuggcuauaggguguuacucccagguuaauccuauaacccuuacugcagcucuuuuacuuuugguggcccacuaugcaaucaucggaccuggauuacaagcuaaagcaacucgugaggcacagaagagagcagcugcagggauaaugaaaaacccuacuguagacggaaucacaguaaucgacuuagaaccaauaccuuacgauccuaaauucgaaaaacaacuuggccaaguuaugcugcuaguacuuuguguuacccaaguacuaaugaugcgaacgacuugggcguugugugaggcacuaacgcuggcaacaggaccaauaucaacuuugugggagggaaauccggggcgauucuggaacacuacaauagccgucagcauggcgaacauauuucggggcucauaccuugcgggugcuggccuauuauuuucgaucaugaaaaauacuacaaauacaagacgggguaccggcaacauaggugaaacccucggugagaaguggaaaagucgauuaaaugccuuggggaaauccgaguuccaaauauauaagaaauccgggauccaagaaguagacagaacucuagccaaagaagggaucaagagaggagaaaccgaucaucacgcagugaguagagguuccgccaaacuaaggugguuugucgaaaggaauauggugaccccggaaggaaaggucguagaucuuggcugugggagagguggcuggucauauuauugcggaggacuuaaaaauguacgagaaguuaaaggacuuacaaaagguggaccaggucacgaggagcccauucccaugucuacuuacggguggaacuuaguccguuuacaaucuggaguagauguauucuuuacgccgccagaaaaaugcgauacgcucuugugugauauuggcgaaucgucccccaauccuacaauugaggcaggucggacucuucguguacuaaaucuaguagaaaauuggcuaaauaacaauacacaauuuugcaucaaaguuuugaacccauauaugccaucaguaauagagaaaauggagacauuacaaagaaaauacgguggggcguugguucgaaacccucugucuagaaacucuacgcaugaaauguacuggguaaguaacgccacaggaaacauuguaucuucgguaaauaugauaucucgcaugcugauaaauagauucaccaugaaacacaaaaaggcaacguaugaaccggacguugauuuaggcucagggacaagaaauauagguauugaaaacgaaauaccuaaccuagacaucauaggaaagcgaauagagaaaauuaagcaggaacaugaaacaucauggcacuacgaccaagaucauccauacaagacaugggcguaucacggaucauacgaaacaaaacaaacgggauccgcaucuagcaugguaaauggaguaguccgcuuguuaacgaaaccaugggauguggugccgaugguuacccaaauggcgaugacagauacgaccccauuuggucaacaaagaguuuuuaaagaaaagguagacacacgaacucaggaacccaaagagggaacaaagaaauuaaugagaauaacugcggaaugguuauggaaagaauuagguaagaagaaaacgccgagaauguguacacgggaagaguucacucggaaaguacggucaaacgcagcacuuggggcaauuuuuacagacgagaacaaauggaaaagcgcgagagaagcgguagaagauagcagauucugggaauuaguugaccgcgaacgaaaccuacaucuugaaggaaaaugugaaaccuguguuuacaacaugauggguaaacgagagaagaaauuaggagaguucggaaaagcaaaggguucaagagcaauaugguacauguggcuaggugcaagauuuuuagaauuugaggcuuuaggcuuccucaaugaggaucauugguucagcaggggaaacagcuuaucagggguugaaggugaaggauugcauaaguugggguacauauugcgcgacguuaguaagaaagaaggaggagcaauguaugcagaugauacagcagguugggacacaagaauaacacuagaggauuugaaaaacgaggaaaugguaacaaaucacaugaaaggagaacacaaaaaguuagcggaggccaucuucaaacucacauaucagaauaagguaguaagaguacaaagacccaccccaagaggcacaguaauggauauaauaucaaggaaggaucagagagggagcggccaaguaggaacauacgggcuaaauacguuuacuaauauggaagcacaauuaauuaggcaaauggaaggagaaggaaucuucaaaucaauucaacacuuaaccguuaccgaggaaauugcgguucagaauuggcuugcgaggguaggacgagagaggcuuucacgcauggccaucucaggugaugauugcguggugaaaccacucgacgaucgcuuugccucagcucucacagcccuaaacgauaugggcaaagugagaaaagauauccaacaaugggagccaucacgagguuggaacgacuggacgcaagugccauuuuguagucaucacuuccaugaauuagugaugaaagaugguagagugcuaguaguacccugcagaaaucaagacgagcuaauuggacgagcaagaauuagccagggagcugguuggucgcuaaaagaaacagccugccuaggcaagaguuaugcacaaauguggacgcuaauguauuuucaccggcgagauuuaagacucgcagcaaacgcaaucugcagugcagugccaagucacuggguaccgacguccaggacaacauggaguauacaugcuaaacaugaauggaugacuacggaagacauguuagcgguauggaaucgaguauggauacaagaaaacccauggauggaagacaaaacaccaguagaauccugggaggaaguuccauaccugggcaagagagaagaccaaugguguggcucccuaauaggccuuacaaguagagcuaccugggcaaagaauauucaaacugcaauaaaucaaguccgcucauuaauuggaaaugaagaguauaccgauuauaugccaaguaugaaaagguucagaaaagaagaggaagaagcagggguuuugugguaa

SEQ ID NO: 22577 - RNA, 9876 nt, Artificial Sequence
  derived and/or modified CDS sequence (opt6) from DENV-2__EU569715__SS-prME
acugcuggaguaaucauaaugcucauuccaacagcaauggcuuuccaucuuacaacuagaaauggagaaccccacaugauaguaggaagacaagaaaaagguaaaucucucuuauucaaaacagaagaugguguuaauauguguacacugauggcaauugaucuaggugaguuaugcgaagacaccauaacauauaaauguccgcuacuacggcaaaaugaaccagaagauauugacuguugguguaauucaaccagcacuuggguaacuuauggcacguguacaacuacaggcgaacacagaagagagaaaagaucaguugcacuuguaccgcauguaggaaugggguuagaaacgcgaacagaaacuuggauguccuccgaaggcgcguggaaacauguacagaggauagaaacauggauauuacgacacccaggauuuacaaucauggcggcaauacuugcauauacaaucgguacuacccauuuccaaagagcguuaauauucauucuuuugacugcaguugcaccaagcaugacuaugcgcugcauaggaauaucaaaucgcgacuucguagaaggcguaucugguggaagcuggguagauauugugcucgaacauggauccugcgugacgacuauggccaaaaauaaaccaacauuggacuucgaacucauuaaaacagaagcuaaacaaccugcaacacuuagaaaauauugcauugaagcaaaacugacuaauacaacuacagaaucucgcuguccaacgcagggugaaccuucacuaaaugaagaacaagacaaacguuuuauauguaaacauucuaugguggaucgaggauggggaaaugguugcgguuuauuugggaaaggagguaucgucacaugcgcaauguuuacgugcaagaaaaauauggaagggaaaguuguucuccccgagaaucuggaauacacuaucguaauaacgccacacuccggugaagaacaugcuguuggcaaugauacugggaaacacgggaaagagauuaaaauuaccccacaauccagcaucacggaagcagaacuaacugguuacggaacugucaccauggaguguucacccaggacaggacuggacuuuaacgaaaugguucuacuucaaauggaagacaaagcauggcucgugcauagacaaugguuccuugaucucccauugccauggcuuccaggagcggauacacaaggcucaaauuggauucagaaagaaacgcuaguuaccuuuaaaaauccucaugcaaagaaacaagauguaguuguauuggggucacaagaaggugcaaugcauacggcguuaacaggagcuacagaaauacagaugucuucgggaaauuuauuguucacuggccaccuaaaauguagacuacgaauggauaaacuucaacucaaaggaaugaguuauucaauguguaccggaaaauucaaaauuguaaaagaaauugcagagacucaacacggcaccauugugauucgaguacaauaugaaggugaugguucaccuugcaaaaucccuuucgagauuauggaccuugaaaaacgccauguguuagguagauugauaacagugaacccuaucguuacagagaaagacagccccgugaauaucgaagcagagccgccauuuggagauucuuauauuauuauaggugucgaaccuggacaacucaaacugaacugguucaagaaaggaucaaguauaggacagauguuugaaacaacaaugagaggagccaaacgaauggcaauacucggagacacggcaugggacuucgggucauuagguggaguauuuacaagcauugguaaagccuuacaucaaguauucggggcaauuuacggagcagcguucucaggaguaucguggaccaugaaaauuuuaauugggguaauuauaacguggauaggcaugaacucaagaaguacaagucuuucagucagccuaguccuagugggaguuguuacacuauauuugggcguuaugguacaagccgauucugggugugucguuaguuggaaaaauaaagaacugaaaugcggaucuggaauuuuuauaaccgacaacguacauacuuggacugaacaauacaaauuucaaccugaaucacccuccaaacuagcgucggccauacagaaagcccaugaagagggaauuuguggaauacgaucuguuacuagauuggaaaauuuaauguggaaacagauuacuccagaauuaaaucauauacugagugaaaacgagguuaaacuaacaaucaugacuggugauauaaaagggauaaugcaggcaggcaaaaggucauuaagaccacagccuacugaauuaaaauacaguuggaaaacguggggaaaagcuaaaauguuaaguaccgaaucgcacaaucaaaccuuucuaauagacgggccagagaccgcugaaugccccaauacaaaucgagcauggaacucgcuugaaguugaagauuacggauuugguguguucagcaccaacauauggcucaaacugagagaaaaacaagauguuuucugcgauagcaaauuaaugucagcagcaauaaaagacaauagagcaguacaugccgauauggguuauuggauagaaucugcauuaaacgacacuuggaaaauggagaaagcaucuuuuauagaagugaaaucgugucauuggccuaaaucacauacccucuggucaaauggaguauuggaauccgaaaugauuauaccgaaaaauuucgccggaccuguuucgcagcacaauuauagacccggauaucauacucaaacagccggucccuggcaucuagggaaauuagaaauggauuuugauuuuugugaagggacaacuguuguggugacugaggauugcgggaacagggguccgaguuuaagaacuacgacugcuucuggaaaauuaaucacagagugguguuguagaucuuguacguugccuccuuuacgauaucgcggugaagauggaugcugguacggaauggaaauucgcccguugaaagaaaaagaagaaaacuuagugaacucguuagucaccgccggccauggucaaauagacaacuuuucauuaggaguauuaggcauggcccucuucuuagaggaaaugcuuaggacaagagucggaacuaaacacgccauucuacuuguagcuguuucauucguaacacugauaacggggaauaugucuuuccgggauuuagggcgaguuaugguuauggugggugcuaccaugaccgaugauauagggaugggaguaacuuacuuggcauuacuagcagccuucaaaguaagaccaacauucgccgccggacuauuacuacgaaagcugacaucaaaagagcuuaugauggcaacaauaggcaucgcuuugcucucccagucgacgauucccgagacaauuuuagaacuaaccgacgcguuggcacuugguaugaugguuuuaaaaauaguacgaaauauggaaaaguaucagcuagcugugacuauuauggcaauuagcugugugccaaaugcagugauauuacaaaacgcauggaaagugaguuguaccauauuagccgcaguaagcgucucaccacuccuccuaacaucuucgcaacaaaaagcagacuggauuccucuagcacucacuauaaaaggacucaacccuacagcgaucuuucucacaacguuaucaagaacuuccaagaaacggagcuggccucuaaaugaagcagugauggcuguuggcauggucaguauauuagcaucuaguuuacuuaaaaaugauauuccuaugacaggaccuuuagucgcgggcggucuuuuaacaguauguuauguguuaacaggaagaagcgcggaccuagaacuagaacgagcagcagacgucaaaugggaagaccaagccgaaauaaguggguccucacccauacuuucaauaacuauaagcgaagacgguucgaugaguauaaagaaugaagaagaagaacacacgcuaacaauacuuaucaggacaggcuuauuaguaaucuccggcguguuuccuguaucaaucccuauaacugcagcugcgugguaccuaugggaggucaagaaacaaagggcaggaguacuaugggauguaccgagucccccaccugucggaaaagccgagcuggaagauggugcuuacagaauaaaacaaagggguauuuucggcuacucucagaucggggcugguguauacaaggaaggaacuuuccacaccauguggcauguaacaaggggagcaguccuaaugcaucgagggaaacgaauagagccuucgugggcugaugucaagaaagaccuuauuucuuauggagguggauggaaguuagagggugaguggaaagaaggcgaagaaguucagguucucgcacucgaaccaggcaaaaaucccagggcugugcagacaaaaccuggucuauuuaaaacgaauacgggaacuauuggggccguauccuuagacuuuucuccagguacaaguggaagucccauaguggaccguaaaggaaaaguagucgguuuauauggaaauggaguagucaccagaaguggggcuuaugucucugcuaucgcacaaacugaaaagucaauagaagauaacccggaaauagaagaugauauauuuagaaagaaaaggcuaaccaucauggacuuacaucccggcgcagguaaaacaaaaagauaucuuccggcaauaguacgagaggcuaucaaaaggggacuuaggacauugauacuggcuccuacacgaguaguagcggcugaaauggaagaggccuuaagaggauuaccuauacgauaucaaacaccagcaauucgugcugaacauacaggacgagaaauuguugaucucaugugucacgcgacuuucacuaugcgucuacuaucgccgguaagaguucccaauuauaaucuaauaauaauggacgaggcucacuuuacagaccccgcuucaaucgcggcuagaggauauauaaguacgcgcguggagaugggcgaggcagcaggaauauucaugacugcaacaccacccggaucuagagauccauucccucaaucaaacgcacccauuauggacgaagagagagagauaccggagcgaucauggaacaguggucaugaaugggucacagauuuuaagggaaaaacuguuugguuuguaccaaguauuaaagccggaaacgauauugcggcuugcuugaggaaaaaugguaagaaaguaauacaguuaucuagaaaaacguuugacagugaauacguuaaaacgcgggcaaaugauugggauuuugucguaacgacugauaucagugaaaugggagcaaauuuuagagcagagagagucauagacccaagacguuguaugaaaccaguaauuuuaacagauggugaagagagaguuauacuggcuggacccaugccgguaacacauucgagugcagcccaaagacgagguagaauagguagaaauccaaagaaugaaaaugaucaguauauuuauaugggggagccacuagaaaaugacgaagauugugcccacuggaaagaagcaaaaauguuguuggauaauauuaauacaccugaaggaauuauaccaucaauguucgaaccagaacgggaaaaaguagaugccauagacggugaauacagacuacgaggagaagcgcggaaaacauuuguggaccuuaugagacguggagaucuuccuguauggcuugcuuaccgggucgcagcggaaggcauuaauuaugcugauaggagaugguguuuugaugguaucaaaaauaaccagauacucgaagagaauguugagguagaaauauggacuaaagagggggaacguaagaaauuaaaacccagaugguuggacgcccguauauauucggauccauuagcucuaaaagaauuuaaggaauuugcagccggccgaaagucauuaaccuuaaauuuaaucacugaaaugggucgauuaccuacuuuuaugacacaaaaagcucgggaugcacuagauaacuuggcgguacuccauaccgcagaagucggcggcagagcuuacaaccacgccuuaagcgaacuucccgaaacacuagaaacucuacuauuacuuacauuacuugcaacagugacagguggaaucuuucuuuuccugaugucuggaaagggaauagguaaaaugacauuagguauguguugcauaauuacagcgucgauacuucuaugguaugcacaaauacaaccucauuggauagcagcuuccauuauauuagaguucuuucuaaucguguuguuaauaccagaaccagaaaagcaaagaacaccacaagauaaucagcuuacauauguuguuaucgccauccuaacuguaguagcagccacuauggccaaugaaauggguuuucuagagaagaccaagaaagaccugggguuagggucuauuaccacgcaagaaagugaaaguaacauucuagauauagaccuacgacccgccucagcguggacccuguacgcaguggcuacaacauuuguaacaccuauguuacggcacuccauagaaaauaguucaguaaacgugagcuugacagcgauugcuaaccaggcaaccguauuaauggggcuugguagaggguggccacuaagcaaaauggacauagguguaccccugcuugcaaucggcuguuauucacaaguaaauccaauuacgcuuacagcagcacuacuucuucuugucgcacauuaugcuauuauagggcccgggcuacaggcuaaggcaaccagagaagcucagaaaagagcagccgcugguauaaugaaaaauccaacagucgaugggauaacagugauagaccuugaaccaaucccuuacgaccccaaauuugagaaacaacucgggcaagucaugcugcuagucuuguguguaacucagguacuuaugaugagaacaacuugggcuuugugcgaagcgcugacacuagcaacgggaccgauaucuaccuuaugggaagguaacccagguagauucuggaacacaacaauugccgucaguauggccaauauauuucgcggauccuaccucgccggggcagggcuuuuauuuagcauaaugaaaaacacaacuaauacacgacgcgguacuggaaacauuggugaaacgcucggagaaaaguggaaaagucgauuaaaugcuuuaggaaaaucggaguuccaaauuuacaagaaaucuggcauucaagaagucgaucgcacacuggcaaaagaaggaauuaagcgcggcgagacagaucaccacgcugucaguagaggaucagccaaacugcgaugguuuguggaaaggaauauggugacaccugagggcaaaguagucgauuuaggaugcggcagagguggcugguccuauuacugugguggccuaaagaauguccgagagguuaaaggguugacaaaaggagggccuggucacgaggagcccaucccuaugucuacauacggauggaaucucguuaggcuacaguccgguguggacguauucuuuaccccaccagagaaaugcgauacucuauuaugugacauuggagaaucuucaccgaacccuacuaucgaggcagggcgaaccuugcgaguccuaaaccugguugagaacugguugaacaauaacacacaauucugcauaaaagucuuaaacccuuauaugccuucuguaauagagaaaauggaaacacuucaacgcaaauaugguggggcauuaguaaggaauccccuuucgcgaaauagcacacaugagauguauugggugagcaacgccacugggaacauaguaucaucgguaaauaugauuagccgaaugcuaaucaauagauuuacuaugaaacauaagaaagcaacauacgaaccagauguggauuuggggagugguacccgaaauauaggaauugaaaaugagauuccaaaucuugauaucauaggaaaacgcauugagaaaauaaaacaggaacaugaaacuagcuggcacuacgaccaagaccauccauacaagaccugggcauaucaugggagcuacgagacaaagcagacagggagugcaagcuccaugguuaauggcgucguuaagcuccuaaccaaacccugggacgugguccccaugguaacucaaauggcaaugacugauacaacuccauucggucaacagagaguuuuuaaagaaaaaguagauacgcgaacucaagagccuaaagaaggaaccaagaaauugaugaggauaacagcagaaugguuauggaaagaauuaggcaagaagaaaacaccaagaauguguacaagggaggaauuuacaagaaaaguacgaucaaacgcugcgcucggagccaucuuuacagacgaaaauaaauggaaaucggcuagagaagcgguugaagauaguagauuuugggaguuaguggauagagaacgaaauuugcauuuagagggaaaaugugagacuugugucuauaacaugauggguaaacgugagaagaaauuaggcgaauuugggaaagcaaaaggaagcagagcuauuugguauauguggcuaggcgcuagguuuuuggaguucgaggcacugggauuuuuaaaugaagaucacugguuuucgagagggaauaguuugaguggaguggagggcgaagggcuacauaaauuagguuacauacugcgugauguaaguaagaaagaaggaggagcuauguacgccgaugacacugcugguugggacacccguauuacuuuagaagaccugaaaaaugaagaaaugguaacgaaccacaugaagggggaacauaagaaacucgccgaagcuauauuuaaauugacauaccaaaacaaagucguuagaguacaaagaccuacuccuggaggcacggugauggacaucauaagcagaaaggaccaacgggguaguggacagguuggaaccuacggacugaauaccuucaccaacauggaggcccaacuaauaaggcaaauggagggugagggaauuuucaaaucaauacagagguuaaccgucacagaagaaaucgcuguacaaaauugguuagcacguguggggagggaacgacugucgcguauggccauaucaggugaugauuguguaguuaaaccacuagaugaucguuuugcaagugcccucacugcacuuaaugauauggguaaagucaggaaagauauccaacaaugggaaccaucccguggcuggaacgacuggacacaagucccguuuuguucacaccacuuucacgaacucgucaugaaagaugguagaguucuaguagucccaugcaggaaccaggaugaacuaauaggaagggcaagaauuucccaaggggcaggauggucacucaaagagacugcauguuugggaaagucguacgcacaaauguggacuuugauguacuuccacagaagggacuuaaggcuggcagcuaacgcaauauguucugcagugcccucucauuggguucccaccagucgaacaacuuggagcauacaugccaagcaugaauggaugaccacggaggacaugcucgcaguuuggaacagaguuuggauacaagagaacccauggauggaagacaagacucccguggaaagcugggaagagguucccuacuuaggaaaaagggaagaucaguggugugguucguuaaucggccuaacaagccgugccacaugggccaaaaauauacaaacagcaauaaaucaaguacgcucuuuaaucgguaacgaagaauauacggauuacaugccaucaaugaaaagauuuaggaaagaagaagaagaggcggguguacuaugguaa

SEQ ID NO: 22578 - RNA, 9876 nt, Artificial Sequence
  derived and/or modified CDS sequence (opt6) from DENV-2__EU569716__SS-prME
accgcuggaguaauaaucaugcuaauaccuacggcgauggcuuuucaccuuacuacccguaauggagaaccgcauaugauagucggaagacaggaaaaagguaaaucauuacuuuuuaagacagaagacggaguuaacauguguacgcuaauggccauagauuugggagaacuaugugaagauacaaucacauacaagugcccucuguuaagacagaacgagccagaagacauugacuguuggugcaacucaaccuccacauggguaacauaugggaccugcacuacgacuggagaacaucgaagagagaaaagaucgguugcacuagugccucacguugguaugggauuggaaacgcgaaccgagacauggaugucgucagaaggagcauggaaacauguccaaagaauagaaacauggauauuaagacauccaggauucacaauuauggcugcaaucuuagcauacaccaucggaacuacucacuuccaacgagcucuaauauuuauuuugcuuacagcaguggcaccaaguaugacgaugaggugcauaggaauuuccaaccgagacuuugucgagggaguaagcggggguucuuggguugauauaguuuuagaacauggaucgugugugacuacuauggcaaagaauaaaccgacacuagauuucgaguuaauaaagacggaggcuaaacagccagcgacacuaagaaaauauugcauugaagcuaaauugacuaauaccacaaccgaaucgaggugcccuacccaaggggaaccaucacucaaugaagagcaagacaaacgauuuauuugcaaacauucgauggucgaccguggaugggguaauggaugcgggcuauuugggaaaggagguauuguaaccugugcaauguucauuugcaaaaaaaauauggaaggaaagguaguacugccggaaaauuuggaauauacaauagugaucacuccacauucgggggaagaacaugcagugggaaaugauacuggaaaacacgggaaggaaaucaagaucacgccacagaguaguauuaccgaagcagaacuuacuggcuacggaacagugacuauggaaugcagucccaggacagguuuagacuucaacgaaauggucuugcuccagauggaagauaaagcauggcuaguccacagacaaugguuucucgacuuaccauuacccuggcugccaggugcugauacccaaggcucuaacuggauacaaaaagagacauuagugacauucaaaaacccacaugcuaagaaacaagacguuguuguacucgggagccaagaaggggcaaugcauaccgcucuaacaggggcuacggagauucaaauguccagugggaaucuauuauucacaggccauuuaaaauguagacuucguauggauaaacuacaacuaaagggaaugagcuacaguaugugcacaggaaaguuuaagauuguaaaggaaauugcagagacgcaacacggaacuauaguaauucggguucaauaugagggagacggaagcccuuguaaaaucccauucgaaaucauggauuuggaaaaacguuauguuuuaggacgccucauuacugucaauccgauuguaacagaaaaagauaguccaguaaauauagaggcagaacccccuuuuggugauuccuauauaaucauuggaguugaacccggucaacugaaauuaaacugguucaaaaaaggaaguaguauaggucaaauguuugaaacuacaaugagaggcgccaaacgaauggcgauauuaggugacacagcaugggacuucggaaguuuagguggagucuuuacuagcauagggaaagcacuacaucagguauuuggugcuauuuauggagcagcuuucaguggcgugucauggaccaugaaaaucuuaauaggaguuauaaucacauggaucggaaugaauagcagauccacgucauuaucaguuucacucguccugguagguguugugacccuguaucucggagugaugguacaagcagauucagguugcguuguuaguuggaagaauaaggaguuaaaauguggaagcggaaucuuuauuacugacaauguccauaccuggaccgagcaauacaaguuucaaccugaaagcccaucaaaauuggcuucugcgauacaaaaggcacacgaggaagguauuuguggaauacggaguguaacuagguuagaaaaucugauguggaaacaaaucacaccagaauuaaaccacauauuaucggaaaacgaaguuaagcuuacaauuaugaccggcgacauaaaagggauuaugcaggcgggaaagagaucccugcgaccacaaccuacggaacucaaauauuccuggaagaccugggguaaagcaaaaauguuaagcacugagucacacaaucagacauuucucauugacggaccugaaacagcagaauguccaaacacaaaucgagcuuggaauucccuagaaguugaagacuacggauuugguguuuucaguaccaacauuugguuaaaauugagggaaaaacaagacguguuuugugacaguaaauuaaugucagcagcaauuaaagacaauagagcaguccaugcggauaugggcuauuggauugaaucagcccuuaaugauacuuggaagauggaaaaggccucuuucauagagguaaagaguugccauuggccgaaaagccauacauuguggucaaacggaguuuuggaaagcgaaaugauaauaccuaaaaauuucgcuggcccaguaucgcaacacaauuaccgaccaggauaucauacgcagacugcugggccauggcaccucggaaagcuugagauggacuuugauuuuugcgaagguaccacuguagugguaacagaagacuguggaaaucgagggccgagcuuaagaaccacuacggcaaguggaaaauugauaacagagugguguugccguaguugcacauuaccgccgcuacguuauaggggcgaagaugggugcugguacggaauggagauaaggccacuaaaagaaaaagaagaaaacuuaguaaacucgcuaguaacggcaggucacggccagauagauaacuucaguuugggcguucuugggauggcguuguuucuggaagaaaugcuuagaacaagaguaggaacaaaacaugcaauauuauuggucgcaguaucauuuguaacgcugaucacaggcaauaugagcuuccgagauuuaggaagaguaauggugaugguuggugcgaccaugacugaugauauuggaauggggguaacuuaucuagcccucuuagcugcguuuaagguacguccuacauuugcugccggcuuauuguuaagaaagcucacuagcaaagaacucaugauggcaacaaucggaauagcuuuguuaucucagaguaccauaccggaaacaauccuggaauuaacugaugcacuugcucucggcaugaugguacuuaaaaucguaaggaacauggaaaaguaucaguuagcaguaacuauuauggcuauucuuuguguuccgaaugcaguaauauuacaaaacgccuggaagguaucaugcacaauuuuagcagcaguaaguguaucaccauuauuacuaacgucaucacaacaaaaagcagauuggauuccacuugcacucacuauaaagggauuaaaucccacagccauauucuugacaaccuuaaguaggacaucaaagaaacggucauggcccuugaaugaagcaguuauggcaguagguauggucucuauauuagccaguaguuugcugaaaaaugacauaccaaugacaggaccguugguugcuggaggcuuauuaacuguauguuauguacuuacaggaagaucggcugacuuagaauuagaacgcgcagcugacguaaagugggaggaucaagcagaaauuucuggaucaucaccaauauugucaaucacaauaagcgaagauggaucaaugaguauaaagaaugaggaggaagaacaaacuuuaaccauauuaauaagaacagguuuacuagucauuucuggaguauuuccaguaagcauacccauaaccgcugccgcaugguacuugugggaaguaaaaaaacaacgcgccggaguacuuugggacguacccaguccuccaccaguugggaaggcugaacucgaagauggagcuuaucgaaucaaacaaagagguauauucggauauucacagauaggcgcagguguuuauaaagaaggaacuuuucacaccauguggcauguaacacguggggcgguucugaugcaucgaggaaagcgaaucgagccuuccugggcugauguaaagaaagauuuaaucucauauggaggagguuggaaacuagaaggugaauggaaagaaggggaagaaguccaagucuuggccuuagaaccggguaaaaacccaagggcaguacaaaccaagccaggucucuuuaagacaaauacaggaacaauuggcgccguaucucuggauuuuaguccaggaacaucagggucaccuauuguggacaggaaaggaaaagugguuggacuauauggaaacggugugguuacaagaucgggcgccuacgugucggccauagcucaaacagagaaaagcaucgaagacaaccccgagauagaagaugauaucuucagaaaaaagagguugacgauaauggaccuucacccaggcgcuggaaaaaccaaaagauaccucccagccauagugcgcgaagccauaaaacgagguuuaagaacauuaauucuugcgccaacgagagucguugcugccgaaauggaagaggcacuaagaggacuacccauaagauaucaaacaccugccauacgagcugaacacacugguagggagauuguagaccuaaugugucacgcuacguuuaccaugcgacugcuuucuccugugcgggugccaaauuauaauuugauaauaauggacgaagcacauuucacggauccagcaaguauugccgcaaggggguauauuucuacacggguugagaugggugaagcugcaggaauuuucaugacagcaacaccaccagguucacgugacccguuuccccaaucaaacgccccaauuauggaugaagaaagggaaaucccugaacgauccuggaacagugggcaugaaugggucacagauuuuaaagguaaaacagugugguuuguacccucgauuaaagcugggaaugauaucgcagcuugcuuacgaaagaauggaaaaaaaguuauacagcuaucccgaaagaccuucgauagugaauaugugaagacaagagcuaaugauugggacuuugucguaacgacugauauuucggaaaugggugcuaacuucagggcggaaagagucauagauccaagaaggugcaugaagccagucaucuugacugauggcgaagaacggguaauacuugcagggcccaugcccguaacucauagcucagcggcucaacgcagaggacguauaggcagaaauccaaaaaaugaaaacgaccaauauauuuauaugggugaaccauuagaaaaugaugaagacugugcgcauuggaaagaggcaaaaauguuacucgauaauauaaauacaccagaggguauaauccccucaauguuugaacccgaaagggaaaagguagaugcgaucgacggagaguauagacucaggggagaagcaagaaagacauucguugauuugaugagacgaggagaccuaccgguuuggcuugcuuauagaguugccgcggagggaauaaauuaugcugacagaagauggugcuuugacgggaucaagaacaaucaaauucuagaagaaaauguugaaguagaaauuuggacuaaggaaggugaaaggaaaaagcuaaagccacgauggcuggacgcgaggauuuauagugacccccuggcauugaaagaauuuaaagaguucgcggcuggccguaaaagcuugacccuaaaucugauuaccgagaugggacgguuaccaaccuuuaugacccaaaaagcacgcgacgcacuggauaaucuggcaguuuuacauacugcugagguaggagggagagcuuauaaccacgccuuaucagaacuaccggaaacuuuggaaacauuauugcuauugacauuguuggccacagugacggguggcaucuuucuguuuuuaaugucuggaaaaggaauaggcaagaugacgcucggcaugugcugcaucauuacagcaagcauacucuuaugguaugcacagauacaaccccacuggauagcggcgucaauuauauuggaauuuuuucuaaucguucugcuaauaccagagccugaaaaacaaaggacgccacaggacaaucaacuaacauauguugucauagcaauacuaacagucguugcggcaacaauggcuaaugaaauggguuuucuugaaaaaaccaaaaaggauuuaggacuagggucaaucauaacccaagaaucagaaucgaacaucuuggauaucgacuugcgaccagcuagcgcuuggacauuguacgcuguugcuacaacuuuuguuacuccaauguuaaggcauucgauagaaaauucgucugucaacguaucccucacggccauagcaaaucaggcuacgguacucaugggucuagggcggggauggccccugaguaaaauggauauaggugucccucuacuagcaauuggaugcuacagccaagucaacccaauuaccuugacagcugcucuacucuuacucgucgcacauuaugcaaucauugguccugggcuacaggcgaaagcaacccgggaagcacaaaagagggccgcagcuggaauuaugaaaaauccaacagucgacggcaucacgguaauagacuuagaaccuauaccuuacgauccaaaauuugaaaagcaauuaggacaaguaaugcuacuaguuuuaugcgucacucagguucuuaugaugaggacuacaugggcccucugugaagcucuuacuuuagcuacugguccaauaucaacauugugggaaggcaauccaggucgguuuuggaacacuacgauagcuguuucgauggcuaacaucuuuagagguucuuaccuggcaggagcgggacuucucuucaguauaaugaaaaauacaacaaacacaaggagagguacgggaaauauaggagaaacguuaggagaaaaguggaagucgagacucaaugcccuggggaaguccgaauuucaaauuuauaaaaaaagugguauucaagaagucgacagaacacuggcaaaagaaggaauaaagcgaggggaaaccgaucaucacgcaguuagccgaggcagugccaaauuaagaugguucguugaaagaaacaugguuacaccagaagggaaaguaguugauuuagguuguggaagagggggaugguccuauuauugugguggguuaaaaaauguaagagagguuaaggguuuaacuaaagggggcccuggacacgaggaaccgauaccaauguccacguacggauggaaucuaguaagauuacaaucaggcguugacguauuuuuuacccccccugagaaaugugacacacuccuaugugacauaggggaaucgaguccgaauccaacuauugaggcaggaaggacacuaaggguacuaaaucuuguagaaaauugguuaaauaacaacacucaauuuugcaucaagguacuaaauccauauaugccuucaguaauagaaaaaauggaaacacugcaaagaaaauacggaggagcccuaguaaggaauccauugucacgaaacuccacccacgagauguauuggguauccaacgcaacaggaaacaucgucaguucagucaauaugaucagcagaauguuaauuaauagauucacgaugaaacauaaaaaagcaacuuacgagccagauguagauuuaggaagugguacaagaaauauagggauagaaaacgaaauaccgaauuuagacauaauagggaagcgcauugagaaaauuaaacaggaacaugagacaucguggcacuaugaccaagaccauccauacaaaacaugggcauaccaugggucguacgaaacaaaacagaccggguccgccucaucgauggucaaugguguaguaagacucuuaacgaaaccaugggauguuguuccaauggucacucaaauggcaaugacugauacaacuccuuucggucaacagagaguuuucaaagaaaaaguugauacgagaacucaagaacccaaagagggcacgaaaaaauuaaugaggauuacagcagaaugguuauggaaagaguuagggaaaaaaaaaacgccacgaauguguacccgugaggaauuuacaaggaaaguccgaaguaaugcagcauuaggugcuauuuucaccgaugaaaacaaauggaagagcgcuagagaagcaguagaggacucccgcuuuugggaguuaguagacagggaaagaaaucuucacuuagagggaaagugugaaaccuguguauauaauaugauggguaaacgugaaaagaaacucggugaauuugguaaagcgaaagguucaagggcuauaugguauauguggcugggggcccgcuuucuugaauucgaagcuuuagguuuuuuaaacgaagaucauugguucucacggggaaauucgcuaucgggaguagaaggagaagggcuucauaaauugggguacauauugcgggauguuuccaaaaaagaggggggggcaauguaugcagaugacacggcaggcugggauacuagaauuacauuagaagaucuuaaaaaugaagaaauggugacaaaucauaugaagggggaacacaaaaaauuagccgaagcgauauuuaaguuaacuuaucagaauaaggugguucgcguucaaaggccaaccccacgcggcacaguaauggacaucauuucaagaaaagaccaaagggggucuggacaagucgguacauauggcuuaaauacauuuacuaauauggaagcgcaacucauaagacaaauggaaggugagggaaucuucaaauccauacaacauuuaacggucacagaagagaucgcgguacaaaauuggcuagcacgaguggguagagaacgccucucuagaauggcaaucucaggagaugacuguguuguaaaacccuuagacgauagauuugccucagcauuaacugcacucaaugauauggguaaaguccguaaggauauucagcagugggaacccagucgaggguggaacgauuggacucagguaccauuuuguagucaccacuuucacgaauuaguuaugaaggauggucgcguauuggugguuccauguaggagucaggaugaacucauaggaagagcacgaauuagccaaggugcagguuggucguuaaaagaaacugcuugcuuagggaaaucauacgcacaaauguggacgcuuauguauuuccaucgcagagauuuaagacuugccgcaaaugcuauuugcagugcgguaccaagucacugggugcccacaucgcgaaccacuuggagcauccacgcaaagcacgaauggaugaccacggaggacaugcuagccguauggaaucgaguguggauucaagaaaacccauggauggaggacaagacccccgucgagucaugggaagaaguaccguacuuagguaaacgagaagaccaauggugugguucgcuaauuggguuaacaagcagagcaacgugggcaaagaauauucaaacagcaauuaaccaaguacgaaguuugauagguaaugaagaauacacagacuacaugccuucaaugaaaagauuuagaaaagaagaagaagaggccggcguauuaugguag

SEQ ID NO: 22579 - RNA, 9876 nt, Artificial Sequence
  derived and/or modified CDS sequence (opt6) from DENV-2__EU569717__SS-prME
acagcuggaguaauuauaaugcuuauaccaacagcgauggcauuccaccuuacaaccagaaacggggaaccacacaugauaguugguagacaggaaaaagggaaaucucuucuauuuaaaaccgaagaugguguaaacauguguacucuaauggcaauugauuuaggggaacucugugaagacacuauaaccuauaaauguccguuguuaagacagaacgaaccugaagauauagacuguuggugcaauucgacuucaacaugggugaccuacgguacaugcacuacaacgggggaacauagaagggagaaaagaagcguugcacugguaccgcacguaggaaugggcuuagaaacgaggacugaaacauggaugaguagugaaggcgcuuggaaacacguacaaaggauagaaacauggauucuuaggcauccgggguucacuauaauggcugcgauucuagcauauacaauuggaacaacacauuuucaacgcgcuuugaucuuuauauuacucacagcaguagcaccaucaaugacaaugcguuguauaggcaucucaaaucgagauuucguugaaggcguaucuggagggucgugggucgauauaguuuuagaacauggaucauguguaacaacgauggccaaaaauaaaccgacccuugauuuugaacucaucaagacagaagcuaaacaaccagcaacucuaagaaaauacuguauugaagcgaaauuaacuaacacuacaacugaaaguaggugcccaacacagggagaaccaaguuugaaugaagaacaagacaaaagauucauuuguaagcauucgauggucgauagaggauggggaaauggauguggauuauuugguaaaggaggcauagucacgugugcgauguucaccuguaaaaagaacauggaagguaaaguaguauugccugaaaacuuagaauauacaauaguuauaacaccacauagcggcgaagaacacgcagucggaaacgacacaggaaagcacggaaaagaaauaaaaauaacgccucaaucuaguaucacugaagcagaacuaaccggauauggaacggugaccauggaauguucaccccgcacgggcuuggacuuuaaugagaugguauuacuucagauggaggauaaggcuuggcuugugcaccgccaaugguuccuggauuuaccguuaccguggcuuccgggugccgacacacaagggucaaacuggauccaaaaagaaacacuuguaacuuucaaaaacccucacgcaaagaaacaagauguuguuguucugggaagucaagaaggugcgaugcacaccgcuuugacgggggcuacagaaauacaaaugucuagugguaauuuguuguuuacuggucaucuuaaaugcagacuaaggauggauaaauugcaacugaaagguaugucauauucuaugugcacaggaaaauuuaagauaguuaaagaaaucgcugaaacacaacacgggacuauugugaucagagugcaauaugagggugaugggucaccauguaaaauaccuuuugaaaucauggaucuugagaaaagacacgugcuaggaagauugauuacgguaaauccuauugucacggaaaaagauucaccaguaaacauugaagcugaaccuccauucggcgacaguuacauuauuauuggagucgaacccggacaacuaaaauuaaauugguucaagaaaggcuccagcauaggacagauguucgagacaaccaugcgcggagcaaagaggauggcuauucucggagauaccgcuugggauuuuggcucauuagguggaguuuucacgucaaucgggaaagcccuucaucaaguauuuggcgcaauauauggagcagcauuuucagguguaucauggacaaugaaaaucuugauugguguaauuaucacauggauagggaugaacuccagaaguacgagcuuaagcgugucauuaguucucgugggaguugugacauuauacuuaggaguaauggugcaagcagauagugggugcguaguaucauggaaaaauaaagagcugaaaugugguucagguauauuuaucacugauaauguacauacuuggacagaacaauacaaguuucaaccugaaucgccaaguaaacuugcaucugcaauccagaaagcucaugaggaggguauuuguggaauuagaagcgugacacgacuugaaaauuugauguggaaacaaauaacaccggaguuaaaucauauuuuaucagagaaugaaguuaaacucacaauaaugacuggagacauaaaagggauaaugcaagcaggaaagagaaguuuaagaccccaaccaacagaguugaaguauaguuggaaaacuuggggaaaggcuaaaaugcugucaaccgagucccacaaucaaacauuccuuauugauggucccgaaacugcugagugucccaauacgaaucgggcauggaacucguuagaaguugaggacuauggauucgguguuuucucaacaaauaucuggcuuaaacuacgugaaaaacaagacguauuuugugacaguaaacucaugucagcagcuaucaaggacaaccgugcaguacaugcagacauggguuacuggauagaaagcgcgcuuaacgauacauggaagauggagaaagcgaguuuuauagaagugaaaucaugucacuggccuaaaagucauacuuuaugguccaacggaguguuggaaucggagaugauuauaccuaaaaacuucgcagguccaguuagucagcacaacuauaggccaggauaucacacacaaaccgcaggaccauggcaucugggcaaauuggaaauggacuucgauuuuugcgaaggcacgacagugguggugacggaagauugugguaaccgaggcccaaguuuacgaacuaccacagcaagugggaaacuaaucacagagugguguuguagaucguguacucuaccuccacuuagauauaggggugaggauggauguugguauggaauggagauucggccuuuaaaagagaaagaagaaaauuuaguaaacucauuggucacagcaggacauggucaaauagauaacuucucuuuaggugucuugggaauggcacuauuuuuggaagaaaugcuacgaaccagaguugguacaaaacaugcuauuuugcuaguagcaguuucguuuguuacauuaauuacugguaauaugucguuuagggacuuagguagagugauggucaugguaggggccacuaugacugaugauauuggaauggguguuacauauuuagcccuucuagcugcuuucaaaguacgaccaacguuugcagcuggguuacuauugcgaaaacuuacaaguaaagaauuaaugauggcuacaauugggauagccuugcuuucccaauccacuauaccagagacuaucuuagaacuaacagacgcauuagcacuaggaaugaugguauuaaagauugugaggaacauggaaaaguaccaacuagccguuacuauaauggcaauaucuugcguaccaaacgcggugauauuacaaaacgcguggaaagugagcugcacaauucuagccgcagugucuguuucaccauugcugcugacaagcagucagcaaaaagcggauuggauuccucuagcgcuaacaauaaaggguuugaacccuacugccauauuucuuacgacccuaagcagaacuucuaagaaacgcaguuggccucuaaacgaagcaguaauggcuguuggcaugguuagcauacuugcgaguagccuucucaaaaaugacauaccgaugaccgggccgcuaguagcaggaggauuacucacaguauguuauguauuaacgggaagaagcgcagauuuagaacuagaacgagcugccgauguaaagugggaagaccaggcggagauaagugggucaagcccuauauuaucgauuacuaucagcgaagacggaaguaugucuaucaaaaaugaagaagaggaacacacuuugacaaucuuaauaagaacaggauugcugguuauaaguggcguuuucccaguaucuauaccaaucaccgcagcagcaugguaucuuugggaggugaagaaacaacgugcggggguacuaugggauguaccuuccccaccgcccguugguaaagccgaacuagaggauggcgcuuauaggaucaagcaaagggguauauuugguuauucccaaauaggcgccggaguuuacaaagaagggacauuucauacaauguggcauguuacccggggagcaguauuaaugcacagagguaaaagaauagaaccgucaugggcugaugugaagaaagaccugauaucuuacgggggagguuggaaacuagaaggagaauggaaagaaggcgaagagguucaaguuuuggccuuagaaccgggcaaaaauccccgagcaguccagacaaaaccagguuuauuuaagacaaauacaggaacuauaggugcaguuaguuuagacuuuucaccuggaacaucaggaaguccaaucguagacagaaaagggaaaguugucggacuauauggaaauggcgugguaacuagaucuggcgcauauguuucugcuauugcccaaacagaaaagucgauagaagauaauccagaaauagaagaugacauuuucagaaagaaaagacuuacaauuauggacuuacacccuggugcaggcaaaacaaaaagguaccucccagcaauuguuagggaagcuauaaaaagaggucugaggacuuuaauacucgcgccgacucgagucguugcugccgaaauggaagaagcucugcgaggccugccaaucagauaucaaacuccagcgauccgggcagaacauacugguagagagaucguagaccuuaugugucacgcuacauucacgaugcgacuucugucgccuguaagaguaccuaacuacaaucuaauuaucauggaugaggcacauuuuacagacccagccagcauagcagcaagaggguauauuaguacucggguagaaaugggagaagcagcaggcaucuucaugacggccacuccuccugggucacgagauccauucccgcaaagcaacgcaccgauuauggacgaagaaagggagauacccgagcgcaguuggaauagcgggcaugaauggguaacagauuucaaagggaagacuguuugguucguacccucaauaaaagcuggaaaugacauagcugcguguuuaaggaagaacggcaagaaagugauccaacucucgcgcaaaacguucgauucagaauacgucaagacaagagcuaaugauugggacuuuguuguuaccacugacauaucugaaaugggagcaaauuuuagagccgaaagaguaauagacccacgucguuguaugaaacccgucauauugacagauggcgaagaacgcguaauucuagcaggaccaaugcccgucacacauucaagugcagcccaaagacgagggagaauaggaagaaaucccaaaaaugaaaaugaucaguauauuuauaugggagagccgcuggagaaugacgaagacugugcacauuggaaggaagcuaaaaugcuacucgauaacaucaacaccccagagggaaucauuccaagcauguuugaaccggaaagagaaaaagucgacgcuauugauggagaauacagacuaagaggugaagcaaggaaaaccuucgucgaucuuaugagaagaggggauuugccuguuuggcuggccuauagagucgcagcagaaggaauuaacuaugcagaucgccgauggugcuuugaugguauuaaaaauaaucaaauauuggaagaaaacguugaaguagaaaucuggacuaaagaaggagaaaggaagaaauuaaaaccuagauggcuggaugcucguauauauagcgaucccuuggcucucaaagaauuuaaagaauuugcagccgggaggaaaucucugaccuuaaauuuaauuaccgagaugggcagauuaccaacuuuuaugacacagaaagcacgagaugcacuggauaacuuagcuguauuacauacagcagaaguagguggaagggcuuacaaucaugcucuaagcgaauuaccugaaacacuagagacguuacuauuguuaaccuugcuagcuacugucacuggagggauuuuucuuuuccucaugaguggaaaggguauugggaaaaugacccugggcaugugcugcauaauuacagcuagcaucuuguuaugguacgcccaaauacaaccacauuggaucgccgccucuauaauacuagaauuuuucuugauuguucuucuaauaccggaaccagaaaaacagagaacaccacaagauaaccaacuaacauauguaguaaucgccauucuuacgguuguagcagcuaccauggccaacgagaugggauuuuuagaaaagacaaagaaagaucuaggacucgguaguaucacuacucaagaauccgaguccaauauauuagauauagaucuucguccugcuucagcauggacccuauacgcaguugcaacaacguucguaacgccgauguuacggcauucaauugaaaauuccagcguuaacguuaguuuaacagcaauagcgaaccaagcuacaguguugaugggcuuggggagggguuggccgcuuucaaaaauggacauagguguaccacuuuuagcuauaggcuguuacucccaagucaauccaaucacauuaacggcagcuuuacuauuacuuguagcucauuacgccauaauaggcccuggccugcaagcaaaagcuacaagggaagcacagaaaagggcagcugcaggaauaaugaagaacccuacaguagauggcauaacagugauugacuuagaaccgauaccuuacgaucccaaguucgaaaaacaacucggccaaguuauguuauuaguacuaugugugacacaagugcuaaugaugcguacaacaugggcgcuuugugaggcuuuaacucuugcaacgggccccauuucgaccuugugggaaggaaauccugggcguuucuggaacacaacaauagccguguccauggcuaauauauuucgagguucuuacuuagcaggcgcgggccugcuuuucaguauuaugaaaaauaccacaaauacuagacgugguacugggaauauaggagaaaccuuaggggagaaauggaaaucaaggcuaaaugcacuugguaaaucagaguuccaaauauacaagaaaucaggaauccaagaaguggaccgcacucuggcuaaagaagguauuaagagaggagaaaccgaccaccaugcgguaucacgaggaucagccaaacuacgaugguuuguugaaaggaauaugguuacaccggaagguaaagucguggauuuaggcuguggaagaggagguuggucauauuauugcgggggccuaaagaacguaagggaggugaaaggguuaaccaaaggaggcccgggacacgaagaaccgauaccuaugagcacuuacggguggaauuuaguucgucuucaaaguggugucgauguauucuuuacacccccagagaaaugugacacuuuacucugugauaucggugaaucgaguccuaacccaacgauagaggcuggacgcacacugagaguuuuaaauuugguugagaauuggcugaauaauaauacacaauucuguauaaaagucuuaaauccauauaugccaucuguaauugagaaaauggagacucuucagagaaaauacgguggcgccuuaguucgaaauccgcuaucuaggaacucgacacaugagauguacugggucucaaaugccacaggcaauaucguaucaucagucaacaugauaagccgcauguuagucaaucgcuucacgaugaaacacaagaaagcuacguacgaaccagauguagaccuaggaaguggaacgagaaauauaggaauugagaaugaaauuccuaacuuagacauuauuggcaaaagaauagagaaaauaaagcaagaacaugaaacaucuuggcacuaugaucaggaucacccuuauaaaacgugggccuaccauggaagcuaugaaaccaaacaaacaggcucugccagcuccaugguaaauggagucguacgccuacuuaccaagccaugggaugugguaccaauggucacacaaauggccaugaccgauacuacgccuuucggacaacagaggguauuuaaagaaaagguugauaccagaacacaagaaccaaaggaagguacuaagaaacuaaugcggaucaccgcugaaugguuguggaaagaguuaggcaaaaagaaaacacccaggaugugcacuagggaagaguuuacucguaaaguaagaucuaaugcagcguuaggagcaauauuuacagacgaaaauaaauggaaaucagcaagggaagcgguggaagacuccagguuuugggagcuaguugaccgagaacgaaauuuacauuuagaaggaaaaugcgaaacauguguguauaauaugaugggaaaacgagagaagaaauugggugaguucggaaaagcaaaaggaaguagagcaaucugguauauguggcugggagcuagauucuuagaauuugaagcauuaggauucuuaaaugaagaccacugguuuagucgaggaaauagcuugagcgguguagaaggagaaggguuacacaaacuaggcuacauauuaagggacguaagcaagaaagaagggggagcaauguaugcugaugauacagcugguugggauacgaggauaaccuuagaagaucuuaaaaacgaggagauggugacaaaucauaugaaaggugaacauaaaaagcuagcugaagcgauuuucaagcuaacuuaccaaaacaaagugguacguguucaaaggccaacgccaagggguacugucauggauauaauuuccagaaaagaucaacgggggucaggucagguagggaccuaugggcuaaauacauucacaaacauggaagcucaguuaauacggcaaauggaaggugaaggaauauucaagucgauucagagacuaacggucacagaagagauagcaguacaaaauugguuggcaaggguaggccgagagcgacuaagcaggauggcaauaucaggcgaugauuguguaguaaaacccuuagaugaccgcuuugcuagugcccuaacagcucugaacgacauggguaaggugaggaaagauauacaacaaugggaaccuagucgaggauggaaugauuggacccaaguaccguuuuguagucaccacuuccacgaacugguaaugaaagauggcaggguucuuguaguacccugucguaaccaagaugaauuaauugggagagccagaaucucucaaggugccgguuggagcuuaaaagaaaccgcauguuuagguaaaucauaugcacaaauguggacccugauguauuuccaucgacgugaccugagacuggcagcaaacgcuauauguucugcggugccgagucauuggguaccaacaagcagaacgacguggucaauucacgcaaaacacgaauggaugaccaccgaagauauguuagcaguauggaaccgugucuggauacaagaaaaccccuggauggaagacaagacgccgguugaauccugggaagaaguucccuauuuaggcaaaagagaagaucaauggugcggaagucuaauuggauuaacguccagggcuacuugggcaaagaauauucaaacagcgauaaaccaaguaaggucccuaauaggcaacgaggaauacacagacuauaugccuucuaugaaaagauuucgaaaagaagaagaagaagcuggugugcuaugguag

SEQ ID NO: 22580 - RNA, 9876 nt, Artificial Sequence
  derived and/or modified CDS sequence (opt6) from DENV-2__EU569718__SS-prME
accgcggguguuauaaucaugcucauaccgacggcuauggcauuucaccugacuacucgaaauggugaaccacacaugaucgugggccgacaagaaaaaggaaaauccuuauuguuuaaaacggaagacggaguuaauaugugcacucuuauggcuauugaucuaggugaacuaugugaagauacuaucacuuacaaauguccacuucuccgacaaaaugaaccagaagauaucgauuguuggugcaauuccacaaguacuuggguaacguacggaacauguacuacgacaggagaacauagaagagaaaaacgaagcguagccuuaguaccacaugugggaaugggucuagaaacaagaacugaaaccuggaugucaagugaaggugcauggaaacauguacaaagaauagaaacauggauccuuagacacccaggauuuaccauaauggcagcaauacuugcauacacaauagggacaacccacuuucaacgagcucuuauuuuuauucuauuaacagccguagcaccgaguaugaccaugcgauguauagguauuucuaauagagacuuuguugaaggaguauccggagguucaugggucgauauaguacucgaacacggcaguuguguaacaacaauggcgaaaaauaaaccgacacuagacuucgaauuaauuaaaacagaagcuaaacaaccugcaacccuacgcaaauauuguaucgaagcaaaacuaacaaacacaacuacagagucgcguugcccgacccagggagagccaagucuaaaugaggaacaagauaaaagauuuauaugcaaacauagcaugguugaccgaggaugggguaacgggugcggcuuauuuggaaaaggugguauagugacaugugcaauguuuacguguaagaaaaauauggaaggcaaagugguacuaccagaaaaucuagaauauacgauugugauaacgccacacucaggagaggaguaugccguugggaaugacacugguaaacauggaaaagagauaaaaauuacgccgcaauccaguauuaccgaagcggaacuuacuggcuauggaacaguuacaauggagugcucgccgcggaccggccuagacuuuaacgaaaugguucuauuacaaauggaagacaaagcguggcuaguucaccgucaaugguuucuugaucuaccuuugccguggcucccaggcgcagauacucaaggaagcaauuggauacaaaaagaaacuuuagugacauuuaaaaacccucaugcgaagaaacaagauguggucguauuaggaagucaagagggggcuaugcauacagcacuaacaggagcgacagaaauccaaaugucaucaggcaaccuguuauuuaccgggcauuuaaaauguaggcuucguauggauaaacuacaacuaaaagggaugucauauucaauguguacuggaaaauuuaaaauuguaaaagaaaucgcugaaacgcagcaugggaccauugucauacguguccaguaugaaggagauggaaguccuugcaagauuccuuuugaaauaauggaucucgaaaagcgccaugucuuagggcgacucauaacugucaauccgauaguuacugaaaaagacucaccaguaaacgucgaagcagaaccgccuuucggagauuccuacauuauaaucggcguagagccgggacaacucaaacucaauugguucaagaaagguucuuccaucggacaaauguucgaaacuacuaugaggggagcuaagcggauggcuauauugggcgacacagcaugggauuucggcucucuaggagguguguuuacaagcauaggaaaagcacuacaucaaguuuuuggagcuauauauggagcggcguuuagcggaguaaguuggacaaugaaaauauuaauuggggucauuauaacuuggauagggaugaacucacguucaacaucauuaucaguaucucuggucuuggucggagucguaacauuguaccugggagucaugguacaagcagauaguggaugcguaguauccuggaaaaacaaagaacuuaaaugcgguucugggauuuuuauuacagauaauguacauaccuggacagaacaguauaaauuccagccugaaagcccaucaaaauuagcuucugcaauacaaaaagcgcaugaagaagggauauguggcauacguagcguuacuagacuagagaauuuaauguggaaacaaauaacaccggaauugaaccacaucuugagcgagaacgaaguuaaacucacuauuaugaccggugauaucaaaggaauuaugcaagcaggaaaacguagucuacgcccacaaccaacagaacuaaaauauucauggaaaacuugggggaaggcgaagaugcuauccacugaaucucacaaucaaacauuccuuauagauggacccgaaacugccgaauguccaaacacuaacagagcuuggaacucuuuggagguagaggacuauggauucgguguauuuucgacaaacauuuggcuuaaauuaagagagaaacaggauguauucugcgauucaaaacuuaugucagcagcaauaaaagauaaccgagccguacaugcggacaugggauacuggauugaaucggcacugaacgauacauggaaaauggagaaagccaguuucauagaggucaaaucaugucacuggccuaagucacauacacuauggaguaaugguguacuggaaagugaaaugauaauuccgaagaauuuugcugggccaguaagucaacacaacuauaggccagguuaucauacgcaaaccgcugggccguggcacuuaggaaaauuagaaauggacuucgacuucugugaaggcacgacaguggucgugacugaggauuguggaaauagaggaccgucguugcgaaccaccaccgcgucaggcaaauugauaacagaaugguguugcaggucuuguacucuucccccacuacgcuaccgcggagaagauggauguugguacgguauggaaauaagaccguuaaaggagaaagaagaaaaccuugucaacaguuuagucaccgcagggcaugggcaaauugacaauuuuucacuuggcguucuuggaauggcuuuauuuuuagaagaaaugcuccguacacgcgugggaacaaaacacgcuauacuauuaguugcaguaucguucguuacacuaauaacgggaaacaugucauucagagaucuaggacgagucauggucaugguaggggcaacgaugaccgaugauaucggaaugggcguaaccuaucuugcacuccucgcugccuucaaaguucgaccaacauuugcagccggacugcuuuugaggaagcugacaagcaaggaacuuaugauggcuacaauuggaauagcacuccugagucagucaacaauaccagaaacgauccuugagcugaccgacgcauuagccuuagguaugaugguucuaaaaauaguacguaauauggagaaauaccaacuagcugugacaauaauggcaaucaguugugugcccaacgcaguuauacuacaaaacgcauggaaagugaguuguacuauucuagccgcgguuuccguaucuccauuacuuuugacauccucccagcagaaggcggauuggauacccuuggcauugaccauaaagggauugaacccaacggcuauauucuuaaccacccuauccagaacaucuaagaaacgaaguuggccauuaaaugaggcuguaauggcagugggaaugguaucaauauuggcuucgucacuccucaaaaacgauauaccuaugacagguccauuaguugcaggaggacuucuaaccgugugcuauguacuaacaggaaggucggcagaccuugagcuagaacgggcagcagacguaaagugggaagaucaagcagaaauaaguggaagcucaccaauuuugucuauuacaauaagugaagacgguaguaugucaauuaaaaaugaagaagaagaacaaacacuaacaauauuaauaaggacgggacuucuagucaucucaggcguguucccagucucuauuccaauaacggcggcggcaugguaucuaugggaggucaagaaacaaagagccgggguacucugggaugugccgucacccccucccgugggaaaagcugaauuagaagacggcgccuauagaauuaaacagcgagggauauucggcuacagucagauuggcgcggggguguauaaagaaggcaccuuccacacaauguggcacguaacuaggggagcgguauugaugcaucgagguaaaaggauugagccuaguugggcugacguaaagaaagauuuaauaaguuacgggggaggauggaaauuagagggagaguggaaagaaggcgaagaaguccagguuuuagcguuagagcccgguaaaaauccucgcgcgguacagacgaaaccgggauuauuuaaaacgaauaccgggacuauaggcgccguaucauuagauuuuucaccgggaacuuccggcaguccaauagucgaucguaaggguaaagucguaggucucuacgguaacggaguggugacaaggucuggagcguauguaucagcaauagcucaaacagagaaaagcauugaagauaaccccgaaauagaagaugacauauuuaggaagaaacgauuaacaauuauggauuuacaccccggggcaggcaaaacaaaacgcuacuuaccggcaauaguacgagaagcaauuaaacgaggacucagaacccuaauauuagcaccaacucgugucguugccgcagaaauggaggaagcacuuaggggacuaccgauacgcuaucagacgcccgcaaucagagcagagcauacugguagagaaaucguagaccucaugugucaugccacauuuacaaugagauuauuauccccuguacgugucccuaauuacaacuuaauuauuauggaugaagcacauuucacugauccggcaaguauagccgcgagaggguacauauccacgagaguagaaaugggugaagccgcugguauauuuaugacagcuaccccaccuggcuccagggacccauuuccacaaaguaaugccccaauaauggaugaagaaagagaaaucccagaaaggagcuggaacagcggacaugaauggguaacugacuuuaaaggaaaaaccgucugguucguaccaaguauaaaggcaggaaacgacaucgcugcuuguuuaaggaaaaaugggaagaaaguuauacaauuaagccgaaaaacauucgauagcgaguacgugaagacaagagcuaaugauugggauuucguagucaccaccgacauuucugaaaugggagcuaacuuuagagcugaaagaguaauugaucccagaagguguaugaaaccuguaauauuaacugauggagaagagagagugauacuggcagguccaaugcccgugacacacucaucggcggcucaacgaagaggacguauuggaagaaauccuaagaaugaaaacgaucaguauauuuacaugggagagccauuagaaaaugacgaagauugcgcacauuggaaagaagcgaaaauguuauuagacaauauuaacaccccagaaggcauuauaccgagcauguuugaacccgagcgggaaaaaguagaugcuaucgacggagaauaucgauuacgaggagaggcgcguaaaaccuuuguagaccuaaugcggaggggugaccuaccagucuggcuagcuuaucgaguagccgcggaggguaucaacuacgcugacagacgaugguguuucgacggcauuaagaauaaccaaauuuuggaagaaaacguagagguugaaauauggacaaaagaaggggagagaaagaaauugaaaccccgaugguuggaugcaaggauauacucugaucccuuagcacucaaagaauuuaaagaauuugcugcuggacguaagagcuugacacuaaacuuaauaacugagauggguagauugccuacuuucaugacgcaaaaagcucgagacgcuuuagauaaccucgcugugcugcauacggcugaagugggagggaaggcauauaaccacgcguuaucagaauugccagaaacauuagaaacgcucuuacuucuaacacuacuagcgacugugacuggugguaucuuucuauuucucaugucgggaaaagggauaggaaaaaugacccuaggcaugugcuguauaauaacugcaucaauucugcucugguacgcacaaauacagccucauuggaucgcagcuucaauaauacuugaauuuuuccuuauaguccuauuaauuccugagccggaaaaacaaaggacaccacaagauaaccaacuaacauacguaguaauagcuauacugacgguaguggcggcaacaauggcaaacgaaaugggauuuuuagagaaaaccaagaaagauuuaggauuaggaucgauuaccacacaagagagugaaucuaacauccuggauauugaccuuagaccagcgucugcuuggacauuguacgcaguggcaacaacguuuguaacaccuauguuacgacauaguauagaaaauaguuccguuaacguaucgcuuacggcaauagccaaucaggcuaccguacucauggguuugggccgugguuggccguuaaguaaaauggauaucggaguuccucuucuagccauaggauguuacagccaggugaauccaauaacacuaacggccgccuuacuuuuguuaguagcgcacuaugccaucauagguccaggauuacaagccaaagccacacgagaagcucaaaaacgagcagcggcuggcauuaugaaaaacccaacaguagacggaauaacuguuauugauuuagaaccgauacccuaugacccaaaguuugaaaaacaauuagggcaaguuauguugcucguauuauguguuacacaaguguuaaugaugcguacaacaugggcacucugcgaagcgcuaacauuagcaacuggaccgaucaguacuuuaugggaagggaauccaggaagguuuuggaauacuacgauagcuguaucaauggcaaacauauuucgagggucauaccucgcuggagcaggguuauuauucucuauaaugaaaaauacuacaaacacuagacgaggaacuggcaauauuggggaaacccuaggagaaaaguggaagagucgauuaaaugcuuuaggaaagagugaguuccaaauuuauaaaaagucgggaauacaagaaguggaucgaacuuuagcaaaggaggggauaaagcgaggugaaaccgaccaccaugccguaagucgcgguucugcuaaauugaggugguucguugaacgcaauaugguuacaccugaaggaaaaguaguggauuuaggaugcgggagaggcggauggucauacuacugcggaggccuuaaaaaugucagagaaguaaaaggguuaacuaaaggcgggccgggucacgaagaacccauaccaaugucuaccuacggauggaauuuggucagacuacaaagcgggguagauguguucuuuacaccacccgaaaaaugcgacacacugcuaugcgauauaggggaaaguucuccaaacccgacuauagaagcaggucgaacacuuaggguauuaaacuuagucgaaaauuggcugaauaauaauacucaguuuuguaucaagguguugaauccguacaugccuucgguuauugagaaaauggagacucuacaacgaaaauaugguggagcuuugguaagaaacccacuauccagaaacucaacccaugaaauguauuggguuucaaacgcuacgggaaacauaguauccagcguuaauaugauaagucgaauguugauaaaucgauucacaaugaaacauaagaaagcgacguaugaaccugauguagauuuagggucggggacacgaaauauuggaauagagaacgaaauaccaaauuuagacauaauagguaaaagaauagaaaagaucaagcaagaacaugagacaucauggcauuacgaccaagaccauccuuauaaaacaugggccuaucacgguaguuacgaaacaaaacaaacugggagcgcgucuuccaugguuaauggugucgucagauuacuaacaaaaccgugggauguaguccccaugguuacucaaauggccaugacagacacaacgccauucggacaacaaagaguauuuaaagaaaaggucgacaccaggacccaagagccgaaggaggguacgaagaaacucaugcgaauaacugcagaauggcuauggaaggaacuuggaaagaagaaaacaccaagaaugugcacacgagaggaauuuacacguaaaguuagaucaaaugcagcacuaggcgccauauuuaccgacgaaaacaaauggaaaagugcacgugaggcugucgaagauucaagauucugggaauuaguugauagagaacguaaucuccauuuagaaggaaaaugugagacauguguuuacaauaugaugggaaaaagagagaagaaacuuggagaauuugggaaagcuaaagggucaagagcaauaugguacauguggcuuggugcacguuucuuagaauuugaagcauuaggauuuuuaaaugaagaccauugguucucucgaggcaauaguuuaaguggcguugagggagagggucuucacaaacuagguuauaucuugagggacguaucaaagaaggaaggaggagccauguaugcggaugacacggcaggaugggauacgaggauuacgcuugaagaucucaaaaaugaggaaaugguaacgaaucacaugaaaggagaacacaagaaauuagcagaagcgauuuucaaauugacguaucagaauaaagucgugcgaguacaacggccuacucccaggggaaccgucauggauauaauaaguaggaaggaccaacgagguagcggacaagugggaacauauggacuaaacaccuucacuaauauggaggcucaacuuaucaggcagauggaaggcgaaggaaucuucaaaaguauacaaagacuuacaguuacugaagaaauugccguacaaaauuggcucgcacguguuggacgugaaagauugucacgcauggccauaucgggugaugauugcgucgucaaaccacuagacgaccgauuugcguccgcacuuaccgcacuaaacgauaugggaaaaguaagaaaagauauacagcaaugggaaccgucaagaggauggaaugacuggacacaaguaccuuuuugcucgcaucacuuccacgagcugguaaugaaggauggucguguacuugugguuccuugcagaaaucaagaugaguuaauaggacgagcucgcauaagucaaggagcagguuggucauuaaaagaaaccgcuugccucgguaagucauaugcccaaauguggacucucauguacuuucauagacgcgaccuuaggcuugcagcuaacgcaauuugcucggcaguuccuagucacuggguucccacaagccgaaccacauggucaauacacgcaaagcaugaauggaugacuacggaagauaugcuggcagucuggaauagaguauggauacaggaaaacccguggauggaagauaaaacaccggucgaaucgugggaagaaguaccuuaucucggaaagagagaggaucaaugguguggaucacugauagggcuuacuucaagagccaccugggcgaaaaauauacaaacugcaaucaaccaaguccggagcuuaaucggaaacgaagaguacacggacuacaugcccuccaugaaaagauucagaaaggaagaagaagaagccgggguuuuaugguaa

SEQ ID NO: 22581 - RNA, 9876 nt, Artificial Sequence
  derived and/or modified CDS sequence (opt6) from DENV-2__EU596488__SS-prME
accgcaggaguaauuauaaugcucauaccaaccguaauggcuuuccauuuaacaacaagaaauggugaaccucauaugaucguagggcgucaagaaaaaggaaaaucuuuacuuuucaaaacagaagauggcguaaauauguguacauuaauggcgauugauuugggagaauugugcgaagauaccauuacguacaaauguccucuacuaaggcaaaaugaaccagaagacauagacuguuggugcaacaguaccaguacauggguuacuuaugguacuuguacuacgacaggagaacaccgcagagagaaacgaucaguggcacuuguaccccauguaggaaugggacuagaaacaagaacagaaacauggaugaguagugaaggagcauggaaacauguacaaaggauagaaacuuggauauuacggcauccugguuucacgauaauggcagcuauccuugcuuacacaauugguaccacucacuuucaacgagcucuuauuuuuaucuuacuaacagcaguagcuccaagcaugacaaugagaugcaucgguauuaguaacagagacuuuguugagggcguaucaggaggaagcuggguagacaucgucuuagaacaugguucaugugugacuaccauggcgaaaaauaaaccgacauuagacuuugaacuaaucaaaacagaagcaaaacaaccagcaaccuuacgaaaauauuguauagaagcaaaacucacuaacacgacgacagagucacgauguccgacccaaggcgaaccaucccuaaacgaagaacaggauaaacgauuuauuugcaaacauuccaugguagaucgaggaugggguaauggcuguggucucuuugguaaagguggaauugucaccugugccauguuuaccuguaagaaaaacauggaaggcaaagucguauuaccagagaaucucgaguauacgauaguuauuacaccucacucaggagaagaacacgcuguuggaaaugacaccggaaaacacggaaaagaaauaaaaauaacuccacaaucauccauaacagaagcagaacucacgggguacgggacgguuacgauggaauguaguccuagaaccggguuagacuucaacgaaaugguccuacuucagauggaagauaaagcguggcuaguccaccgucaaugguuccuagauuuaccucuaccauggcuuccaggugcugacacgcaaggaaguaacuggauucagaaagagacauuaguuaccuucaaaaauccccaugcuaagaaacaggauguggugguuuugggcagucaagagggagcgaugcauacugcauuaacuggagcuacagagauacagaugucaucaggcaauuuacuauuuacuggccacuugaaauguagguugaggauggauaaacuacaacuuaaagguaugagcuauucuauguguacgggaaaauuuaaaauugucaaagaaauagcagaaacacaacaugggaccauaguuauaagagugcaauacgaaggugaugguagcccauguaaaauuccauucgagauuauggaccuggagaaaagacauguacuaggacggcuuauaacaguaaaucccauuguaacggaaaaagacuccccagugaacauagaagcugaaccgccguuuggggacaguuacauaaucaucggaguggaaccaggucaacucaaacugaacugguuuaagaaaggcucaucaauuggacaaauguuugaaacgacaaugcguggugcaaaaagaauggcgauacuaggugacacggcaugggauuuuggguccuugggcgguguuuucacaaguaucggaaaggcacugcaucaaguauucggagcaauauauggagccgcuuuuucagggguaucauggacaaugaaaauauuaauugggguuauuauaacauggauaggaaugaauaguagaucuaccagccugucagucagcuugguauuaguggggguaguuacgcuuuaucuuggaguaaugguacaagcagauacagggugcguaguuucguggaagaauaaggaauuaaaaugugggucagguauauucauaacugacaauguacauacguggacugaacaauacaaguuccaacccgaaagcccaucgaaacuugcgucugcaauacaaaaggcucacgaagaagggauauguggaauacgaagugucacuagauuagaaaauuuaauguggaaacaaauaacucccgaguuaaaucauauccucagcgagaacgagguaaaauuaacuauuaugaccggagacauaaaaggaauuaugcaagcugguaaaagaucauugaggccacaaccgacagaacuuaaguauucauggaagacaugggguaaagcgaaaauguuaaguacagaaagccacaaucaaacuuuucuaauagacggaccugaaacagcagaguguccuaacacaaauagagcguggaacucacuugaaguggaggauuacggauucggaguauuuucaacaaauauauggcucaaauuacgugagaaacaagauguauuuugugacucuaaacugaugagugcugcgauaaaagacaauagagcuguacaugcugacauggguuauuggaucgaauccgcuuuaaacgauacuuggaaaauggaaaaagcuagcuuuauagaaauuaaaagcugucauuggccgaagucgcauacgcuauggucaaauggaguauuagaaucagaaaugauuauaccaaagaacuucgcgggaccaguaucacaacauaacuauagaccuggauaucauacacagacugcaggcccuuggcaucuaggaaaauuagaaauggauuuugauuuuugugaaggaacgacgguggucguuacagaagauugugggaacaggggaccaucguugagaacaacuaccgcgucuggaaaacuaauuaccgagugguguugucguucaugcacacugccuccucuucgguauagaggugaagacggaugcugguacggaauggaaauacgcccauuaaaggagaaagaagagaaucuagugaacuccuuagugacugcuggacauggucaaauagauaacuuuucucucggaguccugggcauggcgcuuuuucuagaggaaaugcuaaggacccgaguaggaacuaagcaugcuauuuuguuaguagccguuucauuugucacacuuauaacugguaauauguccuuuagggaucuagguagaguaaugguaauggugggggcaacaaugacagaugacauuggcauggguguaacauaucuugcauuauuagcugcguucaaaguaagaccuaccuuugcggcaggccuacugcucagaaagcugacgaguaaagaacucaugauggcaacuauugguauagcccuacugucacaaaguacgauacccgaaacaauauuggagcuuacagaugcgcuggcuuuagguaugaugguauugaaaauaguacgcaacauggaaaaauaucaacuggcuguaacaaucauggcuauaucuuguguaccgaacgcuguuauauuacaaaaugcuuggaaagugagcuguacgaucuuggcagcugucaguguauccccgcuccuucugacaagcagccaacaaaaagcagauuggaucccguuagcgcugacaaucaaggguuuaaacccuacagcgauuuuccuuacgacucuaucaaggacauccaagaaaaggagcuggccacuaaaugaagcggucauggccguaggcaugguaucaauacuugcaaguucuuuacucaaaaacgacauaccaaugacaggcccccuaguagcagggggucuauuaacaguaugcuacguauuaacggggcgaagcgcugaucuugaauuagaacgagcugcggauguaaaaugggaggaccaggcagagauaagugguaguaguccaauacuaucgauuacgauaucagaggaugggucuaugucgauuaagaacgaagaagaagaacauacucuaacaauacuaaucaggacaggauuauuagugaucucggggguguuuccagugucgauaccuauaacugccgcugcaugguacuugugggaagucaagaaacagcgagcaggagucuugugggacguaccgucaccaccgccgguuggcaaagcagaauuagaagauggugcauauagaauaaaacaacgaggaauuuuuggauacucgcaaaucggugccgguguguacaaagaaggaaccuuccacacaauguggcauguuacaagaggggcuguauuaaugcauagaggaaaaagaauagagccuagcugggcggacgucaagaaagaucuaaucucauaugggggaggauggaaauuggagggagaauggaaagaaggugaggaaguacaggugcuagcuuuggaaccugguaagaacccacgggcaguacaaacaaaaccuggcuuauucaaaacaaauacuggaacuauuggagcugucucacuugacuuuucaccaggaacuucagggaguccaaucgucgauagaaaaggcaaagucgucggccuauaugguaacggagucgucacgagaucuggugcuuaugucucagcaauugcacaaacggagaaaagcaucgaagauaauccggagaucgaagacgauauauuuagaaagaaacgauugaccauaauggaucugcauccaggagccggaaaaaccaagagguauuuaccagcuauaguaagggaggcaauuaaacgcggacuuagaaccuuaaucuuggcucccacgcguguggucgcagcggaaauggaagaggcccuaagagggcuaccuaucagguaccaaacucccgccauaagagccgaacauacagggagagaaauuguugacuuaaugugucaugcgacauuuacuaugagacuucucuccccaguaagaguaccaaauuauaauuuaauaauaauggaugaagcacauuuuacagacccagccucgauagcagcuagagguuauaucaguacucgaguugaaaugggagaagccgcaggaauauucaugacugcgaccccgccugggucaagagaucccuucccgcagucaaacgccccaauuauggacgaagagagagaaaucccugaaaggucauggaacucuggacaugagugggugacagacuucaaaggaaaaacaguuugguucguaccuuccauuaaagcuggcaaugacauugcugcgugcuuacguaagaaugguaaaaaggucauccaacucagccgaaaaacauuugacucagaauauguuaaaacacgugccaacgauugggauuuugucguaacaacugauauaagugaaaugggcgcaaacuucagagcggaacgaguaauagauccuagaagauguaugaagccagucauuuuaacugacggcgaagaacgaguaauccuugcaggcccaaugccaguuacucauucaucagcagcgcaaaggagaggaagaaucgggcgaaacccaaagaacgaaaacgaccaguacauuuauaugggagaaccucuugagaacgaugaggacugugcucacuggaaagaagccaaaauguuauuagacaauauaaacacaccugaaggcauaauucccaguauguuugaaccggagcgagaaaagguagaugcaauugauggugaauaucggcuaagaggagaggcaagaaaaacauuuguagaucuaaugcgaagaggugauuuaccagucuggcuggcauacagggucgcggcagaaggcauaaacuaugcugaccgacgcugguguuucgaugguauuaaaaauaaucaaauauuagaagaaaaugucgaaguagaaaucuggacaaaggaaggagaaaggaagaaacuaaaaccuagguggcuagacgcgaggaucuacagcgacccauuggcacuaaaagaguuuaaggaauuugcagcaggccgaaagucucugaccuuaaaucucauuacagagaugggucguuuaccgacuuucaugacccaaaaagccagggaugcccuagauaauuuagcaguguuacacacagcggaaguaggaggacgagcauacaaccacgcacuuucggaauuaccagaaacacuagaaacgcucuugcuucuuacauuacuagcuaccguaacaggagguauauuucucuuucugaugucugguaaaggaaucggaaaaaugacuuuagggaugugcuguaucaucacggccucaauacuacugugguacgcucagauacaaccgcacuggauagcggcaagcaucaucuuggaauuuuucuuaauuguucuacucauaccagaaccugaaaaacaaagaacaccccaagacaaccaacuaacuuaugucguuauagcaauacuuacaguugucgcagccacaauggcgaaugaaauggguuucuuagaaaagacgaagaaagaucuaggucuagggaguauaacuacucaagaaucagaauccaauauccuagauauagaucugcguccugccucugcguggacuuuauaugcugucgcaacuacauuuguaaccccaaugcuacgacacuccauagagaacucaagcgugaacgugagccuaacagcgaucgccaaucaagcgaccguccuaaugggacuaggaaggggcuggccauugagcaagauggacaucggugugccacucuuggcgauuggaugcuauucacagguaaauccaauaacccuuacagccgcacuguuauuauuaguugcacauuaugcaauuauuggcccaggcuugcaagcaaaagcuacgcgcgaggcacagaagaggacagcggcugguauuaugaagaacccgaccguggacggcauuaccgucauugaucuggaaccaauuccguacgaccccaaauuugaaaaacaacuaggacaaguaauguuauuaguauugugcgugacccaaguccugaugaugaggacuacaugggcucuaugugaagcacuaacacuggcaacgggaccaauaucaacgcugugggaaggcaauccggguagguuuuggaauacgacaauugcaguuucaauggcaaacauauucagaggaucauacuuagcaggagccggacuacuauuuucaauuaugaagaacaccauuaauaccaggagaggaacugguaauauaggggagacacuaggagaaaaguggaaaucaagauuaaacgcacuuggaaaauccgaauuucaaauauacaagaaaucggggauucaggaaguagaucgaacucucgccaaggaggguauaaaacguggugaaacugaucaucacgcuguaagucgaggcucugccaaacuccggugguuuguggaaagaaacauggucacccccgaagguaagguaguggaucuaggauguggaagagggggcuggucauacuacuguggagguuugaaaaauguccgagaagucaagggauuaaccaaaggagguccaggccaugaagaacccauuccaaugucgacuuauggguggaaccuaguuagacugcaaucaggagucgaugucuucuucacacccccagaaaagugugauacuuuacuaugugauauuggagagucaucgcccaauccgacaauugaggcaggcaggacacugcgaguacuaaaucucgucgaaaauuggcuaaauaacaacacucaauuuuguguaaaaguucucaaucccuauaugccgucagucauagagaaaauggagacgcuacaaaggaaauacgguggggcucuaguuagaaacccuuuaucaagaaacucgacccaugaaauguauuggguaucgaaugcaacuggaaacauaguuaguagcgucaacaugaucaguaggauguuaaucaaccgauuuacuaugaaacacaagaaagcgacauaugaaccugacguagauuuagguucgggaacaagaaacauaggaauugaaaaugaaauacccaaccucgauaucauagggaagcgcauugagaaaauaaagcaagagcaugaaacaucuuggcauuacgaucaagaccauccguacaaaacaugggcuuaccauggguccuacgagaccaaacaaacuggcucagccaguucaauggugaacgguguugugaaauuguuaacaaaaccuugggacgugguaccaauggucacacaaauggcaaugacagacaccacaccauuuggacagcaaagaguauucaaagaaaaaguggauacuagaacccaagaaccaaaagaaggaacgaaaaagcuaaugagaauuacagcagagugguuauggaaagagcuggguaagaagaaaaccccucgaauguguacaagagaagaguuuacacgaaagguucgcaguaaugcagcacuuggcgcuauauuuacagaugaaaauaaauggaaaucagcgagagaagcaguagaagauucaagguucugggaauuaguugaucgugagagaaaucugcaccuugaaggaaaaugugaaacaugugucuauaacaugaugggcaaacgggagaagaaacuuggagaguuuggcaaagcaaaagguagcagagccauaugguacaugugguuaggagcaagguuccuagaguucgaagcacuagguuuccuuaaugaagaccauugguucaguagagguaauagucuaagcgggguagaaggugaaggccuucauaaacuugguuauaucuuacgagauguaucuaagaaagaaggcggagcaauguaugcagaugauacugcagguugggacacacgaaucaccuuagaggauuugaaaaacgaggaaaugguuacuaaucauaugaagggcgaacauaagaaacuagcugaagcgauuuucaaguuaacauaucagaauaagguaguacggguccaaagaccaacuccccgaggaacgguaauggacauaauuagccgaaaagaccagcgaggaagcgggcaaguaggaaccuauggucuaaauacauucacgaauauggaagcucaauugauuagacaaauggaaggagaagggauuuuuaaauccauacaacgucuuacaguaacggaagaaauugcaguucaaaacugguuggcaagaguaggaagagaaagguuaucacgaauggcuauauccggcgacgacugcgucgucaaaccguuagacgauagauuugcaagcgcauugacagccuuaaaugauauggguaagguacguaaagauauacaacagugggaaccaucuaggggauggaaugauuggacacaaguucccuuuuguagucaccauuuccaugaguuagugaugaaagauggaagaguuuuaguuguaccuuguagaaaccaagacgaacuuauaggacgugcacguauaucccaaggcgcuggguggucauuaaaagaaaccgcauguuuagguaaaaguuaugcacaaauguggaccuuaauguauuuucauagaagggaucuuagacuugccgcaaaugcuauauguagcgcaguuccaagccauuggguaccaacaucacgcacuacguggagcauucaugcuaaacacgaauggaugacaacagaagauauguuagccguauggaacagaguauggauucaagaaaacccauggauggaagacaaaacaccuguggaaucaugggaggaggucccuuacuugggcaaaagggaagaucaauggugcggauccuuaauaggacugaccucaagggcgaccugggcgaaaaauauacaaacugcuauaaaucaaguacgcucauuaaucgguaaugaagaauauacagacuacaugccgucaaugaagcgcuuucgaaaagaagaagaagaagcaggcgugcuaugguaa

SEQ ID NO: 22582 - RNA, 9876 nt, Artificial Sequence
  derived and/or modified CDS sequence (opt6) from DENV-2__EU596489__SS-prME
acggcgggagucauuaucaugcuaauacccacagccauggcauuccaucuaaccacaaggaacggcgaaccccacaugauagucgggaggcaggagaaaggcaaaaguuuacucuuuaaaacagaagacggcguuaauauguguacgcuuauggcuauugauuuaggugagcuuugugaggacacaauaacauauaaaugcccauuacuaaggcaaaaugaaccggaggauaucgauugcugguguaauucuacaucaaccuggguaacuuacgguacauguacuacgacuggagaacacagacgagaaaagaggucuguggcauugguaccacacguagguaugggacuagagacacgaacagaaacuuggaugaguuccgaaggcgcuuggaaacacguucagaggauugaaacuuggauacugcgucauccaggauuuacgacuauggcggcaaucuuagcuuauacaaucgggacgacucacuuucaaagggcacuuauauucauauuauugacagccguagcacccucuaugacaaugagguguauuggaauuaguaauagagacuuuguugaaggggucaguggaggcucaugggucgacauaguucuagaacaugguagcuguguuacuaccauggcgaagaauaaaccuacucuugacuuugaacuaauaaaaaccgaagcgaagcaaccagcaacacuaagaaaauauuguauagaggcgaagcuaacaaauacaacaacagaaucaagauguccaacccaaggagaaccaucccuaaaugaagaacaggauaaaagauucauauguaaacacaguauggucgaucguggguggggaaauggguguggauuauuugguaaaggagguauaguuacaugcgccauguuuacaugcaaaaaaaauauggaagguaaaguuguacuuccagaaaaucuugaauauacaauagugauuaccccucacagcggugaagaacaugcugugggaaaugauacuggcaaacacggaaaagagauaaaaauuacuccucaaucaucaaucacugaagcugaauuaacgggauauggaacaguaacuauggagugcucccccaggacaggauuggauuucaaugaaaugguuuuguuacaaauggaagacaaggcaugguuaguacauagacagugguuccuugaccucccauuaccaugguuaccuggcgcugauacccaagguaguaauuggauucaaaaggaaacacuaguuacauuuaaaaauccacaugccaaaaaacaagauguugugguacuugguucccaagagggugcuaugcacacagcacuuacaggugcgacagaaauacaaaugucuucagguaaucuauuauuuacuggucaucucaaaugcagguuacgaauggauaagcuacagcucaaaggcaugucguacucaauguguacaggaaaauucaaaauugugaaagaaauagcagaaacccagcauggaacaauaguaauccggguacaauacgagggugacggaucgccuuguaagauuccauuugaaauaauggaucuugaaaaacgucacguacuaggccguuuaaucacggucaacccgauuguaacugaaaaagauaguccggucaacauugaagcggaaccucccuucggcgacucuuauauaauaaucggcguugaacccggccaauugaaauuaaauugguuuaaaaagggaucgaguauaggacaaauguuugagacaacaaugaggggagcgaaacgaauggcaaucuuaggggauacugcgugggauuucggauccuuaggaggcgucuucacuuccauugguaaggcucuucaucaaguauucggagccauauauggagcggccuucaguggggugucauggacaaugaaaauacuuauuggagugauaauaacauggauaggaaugaacagccggucgacuagucucucuguaucuuugguuuuagucggcauagucacacuauaucuagguguuaugguacaagcagauacuggguguguagugagcuggaaaaauaaagaauuaaaguguggaagcgggauuuucauaaccgacaauguccauacauggacugaacaauacaaguuccagccagaauuuccuaguaaacucgcaucggcuaucaaaaaggcccacgaagagggcauaugugguauaagauccguuacaagguuagaaaaccucauguggaaacagaucacaccggaguuaaaccacauucuuucagagaaugaaguuaaacuuacaaucaugaccggugauauuaaagguauaaugcaagcaggcaagagaucgcuucgaccucagccaacagaauuaaaauacucuuggaaaacaugggguaaagcaaaaaugcuuuccacggaaagucauaaccaaaccuuuuugaucgacggaccggaaacugcugaauguccaaacacaaauagagcuuggaacucucuugaaguagaagacuaugguuucggaguauuuagcacgaauauuugguuaaaacuacgggaaaagcaagacguguuuugugauucaaaauuaaugucggcggcuauuaaagacaaucgagcaguacaugcagacaugggauauuggauagaaucggcacuaaaugauacguggaagauggaaaaagcaucguucauagaaauuaaaagcugccauuggcccaaaucccauacacuauggucgaacgguguuuuagaaagugaaaugaucauaccaaaaaacuuugccgguccugucagccaacauaacuauagaccaggguaccacacucaaacagccgggccuuggcacuugggcaaauuagaaauggauuuugauuucugugaggggacuacggucguagugaccgaagacugcggaaacagaggaccuucccuuaggacaaccacugcuucaggcaagcuaauaacugaauggugcugucgcagcuguacauuaccaccguuaagguaucgaggggaagacggguguugguacgggauggaaauuagaccguugaaggagaaagaagagaaucuaguaaauagucucguaacagccgggcauggacaaauagacaauuucagcuuaggcguauugggaauggcuuuauuuuuagaagaaaugcuacgcaccaggguagguacuaaacacgccauucuccugguagcgguaagcuuuguaaccuuaaucacaggaaacaugucguuuagagacuuaggaagaguaaugguuaugguaggggcuaccaugaccgaugauauaggaaugggagucacauaucuagcacuccuugcagcguucaaaguuagaccuacuuuugcggcuggauugcucuuaagaaaauuaacuagcaaagaacuaaugauggccacaauuggaauagcuuuauuaagucaaaguaccauucccgaaacaauacuagaacuuacagacgcgcuagcccuaggcaugaugguccuaaagauuguacggaauauggaaaaguaccaguuagcgguaacgauuauggcgaucagcugcgugccuaaugcgguaauauuacaaaaugcguggaagguuagcuguacuauuuuagcggcagucagugugucaccgcuacuucuuacauccucacagcaaaaagcggacuggauaccacuagcauugacuauuaagggccuaaauccuacugcaauauuuuuaacaacacuaucucgaacuuccaaaaaaagaagcuggccucuuaacgaggccgugauggcagugggaauggucaguauccuagcgucaagcuuauuaaaaaaugauauaccaaugacaggaccuuuaguugcgggaggccuuuuaacuguaugcuauguccuaacgggaaggucugcagaccucgaauuggaaaaggcugcagacguuaaaugggaagaucaggcugaaaucucagggaguaguccuauccuaucgauuacgauuucagaagaugguuccaugucuauaaagaaugaagaagaagagcacacacuaacaaucuuaauacguacaggauuacuaguaaucagcgguguauuuccugugagcauaccaauuacagccgcagccugguacuuaugggaaguuaagaaacaaagggcgggagucuugugggauguuccgagcccaccaccaguaggaaaagcagagcucgaagauggggcauauaggaucaaacaaagagguauauuuggauacucgcaaaucggugcagggguauauaaggaagguaccuuucauacuauguggcauguaacccguggcgcaguacuaaugcaucgaggaaaacgcauagaaccgucuugggcagaugucaaaaaggaccuuauaucauaugggggugguuggaaacucgagggagaauggaaagaaggggaagaaguacaagucuuagcacuagaaccaggcaagaauccucgggcaguacagacuaagccaggauuguuuaaaacgaacacuggaacgauaggagcuguuagcuuagacuucucaccgggaacuucuggcucuccaauaguggaucguaaagggaaaguuguaggauuauauggaaacggcguagugacaagaucaggagcguauguuucagcaauugcgcaaacagagaaaaguauagaagacaauccugaaauagaagacgacauuuuucguaagaaaagacuuacaauuauggaucuacacccaggugcaggaaaaacuaaacgauaccuuccugccauuguacgagaagcaauaaagaggggguugcgaacauuaauuuuagcaccgacaagaguaguggcugcggaaauggaagaggcauuacgaggauuacccauacgguaccaaacgccugcuauaagggcagaacacacgggacgagagauuguagauuugaugugccaugcuacauucaccaugagacuuuuaagccccguacggguuccaaauuauaaccuaauuaucauggaugaagcucacuuuacggacccagcuagcauugcugcgaggggguauauuucaacuagaguagaaaugggagaggcagcagguauauuuaugacagccacuccgccuggcucuagagauccauucccccagaguaaugcaccaauuauggaugaagaaagagaaauacccgaacguaguuggaacuccgggcacgaaugggugacagauuucaaaggaaaaacaguaugguuuguaccaaguauaaaggcgggaaacgauauagccgccugucuaagaaaaaacgguaaaaaaguaauucaauuaagucgcaaaacguuugacagugaauacguaaagacaagagcgaaugacugggauuuugugguuacuacagacauaucugaaaugggcgcuaauuucagagcagaaagagugauagacccucggcgguguaugaaaccagucauucugaccgauggagaggaacggguuauucucgcuggcccaaugccaguaacgcauuccucagcagcucagcgacguggcagaauagggagaaauccgaaaaaugaaaaugaucaguacauuuauaugggagaaccguuagagaacgaugaggauugcgcacauuggaaagaagcgaaaaugcuguuagacaacauaaacacaccggaagguauuaucccgaguauguucgaaccugaaagagaaaaaguggacgcgauugacggugaauaucgucuaaggggcgaagcacgaaaaaccuuuguagacuuaaugcggagaggcgauuuaccuguaugguuagcauacagaguagccgcggaaggaauuaauuacgcggaccgacgauggugcuucgauggaauaaaaaauaaucaaauauuggaagaaaauguugaaguagaaaucuggaccaaagagggggagaggaaaaaacuaaaaccaaggugguuagacgcgcggaucuauagugacccauuagcauugaaagaauuuaaggaauucgcagcagggcgaaaaucacuuaccuuaaaucucauuacagaaauggguagacugccaacguuuaugacucaaaaagcaagagacgcucucgauaaucuagcugucuuacauacugcugaaguuggggggcgagcuuauaaucaugcuuuaagcgaguuaccugaaacccuagaaacucuauugcuacuaaccuuauuagcaacuguaacuggggguauuuucuuauucuuaaugucgggaaaagguauagggaaaaugacucuagguaugugcuguauaaucacugcaucgauucuacugugguaugcucaaauacaaccgcacuggauagcugcaucuauaauacuggaauucuuucugauuguauuacuaauuccagaacccgagaaacagagaacuccccaagacaaucaguuaacguacguaguaauagcuaucuugacugucguagccgccacaauggcgaaugaaauggguuuccuggaaaaaaccaagaaggaccuaggccuaggaucuauuacaacucaagaauccgaauccaauauuuuagauauagaucuacgaccugcaucggcguggacuuuauaugcaguggcaacaacguuuguuacaccaaugcucaggcauagcaucgaaaacagcagcguuaacguuucguugacagccaucgcaaaucaggcaaccguauugauggguuugggacggggguggccacuuaguaagauggauauuggaguaccauuauuagcaauaggauguuauucacagguaaauccaauuacacuaacagcggcgcuucuauuacuaguagcucacuaugcgauaauaggaccaggacuucaggcaaaagcgacacgagaagcacaaaagagaacugcagcaggaaucaugaaaaacccgacaguggaugggauaacuguuauagacuuagagccaauaccauaugauccaaaauucgaaaaacaguuaggccagguaauguuacuaguacuaugcgugacgcaagugcuuaugaugagaacaacuugggcacugugugaagcucuaacauuggcaacagggccaaucucgacacuaugggaagguaauccgggcagauucuggaauaccacuauagcgguaagcauggccaacaucuucagagguuccuaucuagcaggcgccgggcuauuguucaguauaaugaaaaacacuacuaauacaagaaggggaacagggaacauaggcgaaacgcuaggggaaaaauggaaaaguagacuaaacgcuuuagggaaauccgaguuccaaauuuacaaaaaaucugguauacaagaaguagauagaacauuagcaaaagaaggaauaaaaagaggugagacagaccaucaugcaguuucacgagguagcgcaaaacuccggugguuuguagaaagaaacauggugacuccagaaggaaaaguaguggauuugggauguggaaggggcgguuggaguuauuacuguggcggacuaaaaaacguuagagaaguuaaggggcuuacuaaagguggaccugggcaugaagaaccuauuccuaugagcacauaugguuggaaucugguacgauuacaguccgguguugauguguuuuucacgccuccugagaaaugcgacacgcugcuaugcgacauaggagaaucaucaccaaauccuacaauagaggccggacgcacauuaagaguauuaaauuuaguggaaaauugguuaaauaauaacacacaguuuugugucaaaguguugaauccuuacaugccgucgguuauagaaaaaauggaaacucuccaaagaaaauacgguggcgcacuaguuagaaauccacuuucaagaaauagcacccacgaaauguauuggguaucaaaugccacagguaauauuguaagcucagucaauaugauaagucgaaugcuuauaaaucgcuuuacaaugaagcauaaaaaagcaacauacgaaccagauguagaucuagggucagggacaagaaacauaggaauagagaaugagaucccaaaucuugauauuauagguaagcgaauagaaaaaauuaaacaagagcacgaaacuagcuggcacuaugaucaagaucauccauacaaaacaugggcauaccauggaucauacgagacuaaacaaaccggaucggcuucgucaaugguuaacgguguuguuaaauuauuaacuaaaccgugggauguuguaccaaugguaacucaaauggccaugacugauacaacacccuucggccaacaaagaguguuuaaagaaaagguagacacacgcacucaggaaccaaaagagggaacuaaaaaacuuaugagaaucacggcggaaugguuauggaaagaacuggggaaaaaaaagacaccaaggauguguacgcgagaagaguuuacucgcaagguaagaaguaaugcggcccuuggcgcuauauuuacagaugagaacaaauggaagagugcucgagaagcaguagaggacagucguuucugggaauugguggauagagaacgcaauuuacaucuagagggaaaaugugaaacuuguguguauaauaugauggggaaacgugaaaaaaaauugggugaauuuggaaaagcaaaaggaucuagggcgauaugguauauguggcuaggugcuagguucuuagaauucgaagcacucggguuccuaaacgaggaccacugguucagccgcggaaauucguuaagugggguugaaggugaaggauuacauaaacuuggguauauucuacgagacgucaguaaaaaagaaggaggagcaauguacgcugaugacacagcgggaugggauacacgaauuacauuggaagaucugaaaaacgaagaaaugguaacgaaccacaugaagggagaacacaaaaaauuagcggaagcaauauucaaauuaacauaucagaauaaaguaguccgaguacaacgcccuacaccgaggggcacuguuauggacaucauuaguagaaaggaccagagaggaucaggccaaguagguacauacgguuuaaacacuuuuacaaauauggaggcacaauugauaaggcaaauggaaggugagggcauauuuaaaaguauacaacgucuaacaguaacagaggaaauagccguacaaaacuggcucgcccggguagggcgggaacgacuuagucgcauggcaaucagcggugaugacugcguugucaaaccguuagaugauagauucgcaucagcauuaaccgcuuuaaaugacaugggcaaaguuagaaaagacauacagcagugggaaccgagccgcgguuggaacgauuggacucaaguuccauuuuguagccaucacuuucacgagcuaguaaugaaagacggucgaaugcucguaguccccugcagaaaucaagacgaacuuauaggcagggcacgaauuagucaaggagccggauggucacuuaaagaaaccgcaugcuuaggcaaaagcuaugcgcaaauguggacuuuaauguacuuucauagaagagaucuacggcuagcggcaaaugcaauauguagcgcaguucccagucauuggguaccaacuagucgcacgacauggucaauccaugcuaaacacgaauggaugaccaccgaggauaugcucgcgguuuggaaucgaguguggauucaagaaaacccauggauggaggacaaaaccccaguggagagcugggaagaaguaccguaccucggaaaaagagaagaucaguggugugguagccuuauaggacuaacuucacgugcaaccugggcaaaaaauauccaaacagcgauuaaucagguucgaucguuaauaggcaacgaagaauauaccgauuauaugccaaguaugaaaagauuccgaaaggaagaagaagaggcaggugucuuaugguag

SEQ ID NO: 22583 - RNA, 9876 nt, Artificial Sequence
  derived and/or modified CDS sequence (opt6) from DENV-2__EU596490__SS-prME
acagcaggaguaauuauuaugcugauaccaaccguuauggccuuucacuuaacaaccagaaauggagaaccacauaugauuguaggaagacaagaaaaagggaaaucccuauuguucaaaacggaagacggagucaacauguguacgcuaauggcaauagacuuaggagaauuaugugaagacacaauaacauauaaaugcccuuugcuacgucaaaaugaaccugaagacauagacuguugguguaacaguacgaguacaugggucacuuacgguaccugcacuaccacaggugaacauagaagggaaaaacggaguguagcuuuaguaccacaugugggaauggggcuagaaacacggacugaaacguggaugaguucugaaggagcauggaaacacguacaaaggaucgaaacguggauacuucgacacccuggauuuaccauaauggcagcuauacuagcauacacuauuggaacaacacauuuucaacgugccuuaauauucauauuacugacagccgucgcaccaagcaugacgaugcgauguauuggaauuaguaacagagacuuuguagaaggagucagugguggaagcuggguugauaucguacuugaacacggaucguguguaaccacaauggcgaaaaacaaaccuacguuagauuuugaauuaauaaaaacggaagcgaaacaaccagcuacguuacgaaaauacugcauagaagcaaaacuaacgaauaccacuacggagucgaggugccccacucaaggcgaaccaagccuaaacgaggagcaagacaaacgauuuaucuguaaacacuccaugguugacagaggcugggggaauggaugcggacuauuuggcaaaggagguauagucacuugcgcgauguucacauguaagaaaaauauggaaggcaaaguaguuuuacccgaaaaucuagaauacacaauuguaauuacgccacauagcggugaagaacaugccgucggcaaugauaccggcaaacaugggaaagagaucaaaaucacuccgcaaucuaguaucacagaagcggaacuuaccggguauggaacaguuacaauggaauguucaccaagaacugguuuagacuucaacgaaaugguauuguuacaaauggaagauaaagcgugguugguccaccgucaaugguuccuagaccugccccugcccuggcuaccaggagcagauacacagggaucgaacuggauacaaaaagaaacucuugugacauucaaaaauccgcaugcuaagaaacaagauguuguuguccuaggaagucaagagggagccaugcacacagcucuuaccggagcaacugaaauacagaugucaagcgguaaucuacuauuuacaggucaccuaaaaugucgucuaagaauggauaaauuacaauugaaagguaugagcuauaguauguguacagggaaauuuaaaauaguaaaagagauagcugagacucaacauggcaccauuguuauuagaguacaguaugaaggugacgguagcccguguaaaauuccauuugaaauaauggaucucgaaaaacgucacguauugggaagacucauuacagugaacccaauugugacagaaaaagauaguccugugaacauugaagcugaaccgcccuucggagauuccuacaucauuauaggggucgaaccuggucaauugaaauuaaacugguuuaaaaaggggaguuccauuggacaaauguuugagacgacgaugagaggugccaaacggauggccauacuaggagauacagccugggauuuugguuccuuaggugguguuuucacaaguaucgguaaggcguuacaucaaguauuuggugcuauauacggugcagcuuucaguggaguaucauggacgaugaagauccuuauaggaguaaucauaacauggauuggaaugaacuccaggucaacgagucuuaguguaagccuaguucucguaggagucguaaccuuguaucuagggguaaugguacaagcggacacaggcuguguaguuucguggaaaaacaaagagcuaaaguguggcucggggauauucauaaccgauaacguccacaccuggaccgagcaauauaaauuccaaccugaaagccccucuaaauuagcuagugccauccaaaaggcacaugaggaggggauuugcgguauccguagugucacgagauuggaaaauuuaauguggaaacaaauuacaccagaacuuaaucacauucuaucggaaaaugaagugaaauuaacaauaaugacuggggauauaaaaggaauaaugcaagcagggaaaaggucacuacgaccacaacccacugaauuaaaauacucauggaaaacgugggggaaagcaaagaugcuaucgacggaaucgcauaaucagacuuucuuaauugacgguccugaaacagcggaaugcccgaacaccaauagggccuggaauagucuagaggucgaggauuauggguuuggcguauucagcacgaauauauggcuaaagcugcgugagaaacaagauguauuuugugauaguaaauuaaugucagcagcaaucaaagauaauagggcaguucaugcagacaugggauacuggaucgaaagugcgcuaaaugauaccuggaaaauggaaaaggcaucauuuauagaaaucaaaucaugccacuggccuaaaucgcacaccuuauggaguaacgggguguuagaaagugaaaugauaauccccaaaaauuuugcuggaccgguuucucaacacaacuauaggcccggcuaucacacacagacagcuggaccguggcaucuugguaaacuugagauggacuuugauuucugugaggggacuaccgugguggugacggaggacuguggcaauagaggaccgucguugcgaacaacaacugcgagugguaagcugauuacggaaugguguuguagaucaugcacacuuccaccacugagguaucguggagaagacggauguugguauggaauggaaauucgaccauuaaaagagaaagaagaaaauuuaguuaacagucugguaacugcuggccacggccaaauagacaauuuuagcuuaggugugcugggaauggccuuguuucucgaggaaauguuacgaaccagaguagggacuaaacacgccauauuauugguagccguuucguuugucaccuuaaucaccggaaacaugaguuuucgagaccuagggagaguuaugguaaugguaggagcgacuaugacugaugacauuggcaugggagucacauaucuugcauuacuagcagcuuucaaaguaagaccaacauuugcagcgggccuauugcuucguaaacuaacaaguaaagaauuaaugauggcaacuauaggaauugcuuugcucucucaaucaacgaucccagaaacgauauuagaauuaaccgacgccuuagcauuaggaaugaugguacuaaaaauaguuaggaacauggaaaaauaucaguuagcgguaacaauaauggcuaucagcugcguuccgaaugcaguaauucuucaaaaugcauggaaaguaaguuguacaauuuuagcugcuguaucagucucuccauuauuauuaacaucaagucaacagaaggcagauuggauaccacuagcuuuaacaauaaaaggauugaacccuaccgcaauuuuucuaacuacucuaagucggacaagcaagaaaagaucauggccauugaacgaggcagucauggcaguuggcauggugaguauauuagccucaucguuacuuaaaaaugauaucccaaugacggguccccuaguugcuggcggcuuauugacaguuuguuacgugcuaaccgggagaucagcagauuuggaguuagaaagagcagcagacguaaagugggaggaucaagcagaaauaagcggaucaucucccauauugucgauuacuaucagugaagauggauccaugaguaucaaaaaugaagaggaggaacacacacuaacaauacuuauucgaacaggguuauuaguaauaucagggguuuuucccguuagcauuccuauuacugcagcugcuugguaucuuugggaagugaagaaacaaagagcgggagugcuuugggauguacccaguccgccuccagugggaaaagcugagcuugaagacggagcuuauagaauuaaacaacgagguaucuuuggguacagucagauuggggccgguguauacaaagaggguaccuuccacacuauguggcacgugacgaggggugcaguuuugaugcaucgcgggaaaagaauugaaccaucgugggccgauguuaagaaagaucugaucaguuaugguggagguuggaaauuagagggggaguggaaagagggggaggaggugcaaguuuuggcauuggaaccuggcaaaaaccccagggcugugcagacuaagccuggacuauucaaaaccaauacgggcacgauaggugcaguaucacuggauuuuaguccaggaacaagcggcagcccgauaguagauaggaaaggcaaagucguuggauuauaugguaacggagugguaacuaggagcggagcguacgucucagccauugcucaaacugagaaaucaaucgaagauaacccagagauagaggaugauauauucaggaagaaaagauugacaauaauggaucuacacccaggagcuggaaaaacgaaacgauaucuuccagcaauaguaagggaagccauaaaaaggggccuacgaacacucauuuuggcacccacuagagucguagccgcagaaauggaagaagcacuucggggucuaccgauuagguaucagacacccgcaauccgggcagaacauacaggaagagaaauaguggaucuuaugugucacgcaacauucacuaugcgauuacucucacccgucaggguuccaaauuacaaucuaauaauuauggacgaagcacacuucacagauccugccucuaucgcagcgcgcggcuauauuucuacgagggucgaaaugggcgaagcugcagguauuuucaugacugccacaccaccaggaucgcgagacccguuuccacaaaguaaugcaccuauaauggaugaggagcgagagauaccggagcguucuuggaacucaggccaugaaugggugacugauuucaaagggaaaaccguuugguuuguaccuucgauaaaagccggcaacgauauugcugcaugucugcggaaaaaugguaagaaagucauccaacuuucuagaaaaaccuuugauagugaauauguaaaaacaagggcgaaugauugggauuucguaguuacaacagacaucucggaaaugggggcuaauuucagagcagaacgaguaauugacccuagaagaugcaugaagccugugauauugacagauggagaagaaaggguaaucuuagcggguccaaugccgguuacccauaguucugcggcccaacgacggggaagaauaggacgaaauccuaaaaaugagaacgaccaguauauauauaugggagaaccgcuagaaaacgaugaagacugcgcccauuggaaagaagcaaaaauguuauuagauaacauuaauacaccagaaggaauaauuccgucgauguucgaaccagaacgagaaaaaguagaugcuauugauggcgaauaccgauugaggggcgaagcucgaaagacauuuguggaucuaaugagaagaggcgauuuaccaguauggcuagcauauaggguugcugcugaggguauaaauuaugcagauaggcgcuggugcuucgacggaaucaagaauaaucaaauacuagaggagaauguagaaguagagauauggacgaaggagggagaaaggaagaaacuaaagcccagaugguuagaugcaagaauauacucggauccauuagcguuaaaggaauuuaaggaauuugcggcaggacgaaaaucguugacacuuaauuugaucaccgaaaugggaagacuuccgaccuucaugacccaaaaggcacgcgacgcauuagacaacuuagccguguuacacacagcugagguaggagggagggcauauaaucacgcucuaagugaacugccugaaacacuagaaacuuugcugcuauuaacucuacuugcuacaguaacggguggcauuuuucuauuucuuaugucaggaaaaggaauuggcaaaaugacucuaggaaugugcuguauaauaacugcaucuauucuccuuugguaugcucaaauucagccccauuggauugcagcuucuauuauauuagaauuuuucuuaaucgugcuccuaauaccagaaccagagaagcagcguacuccacaggauaaucaacuuacauauguuguaauagcaaucuuaacagucguagccgcaacuauggcaaaugagaugggcuuucucgagaaaaccaagaaagauuuaggguuaggaucaauaacgacgcaagaaucagaaucaaacauacucgacauugacuuacggcccgcaucagcauggacuuuguaugcaguggccaccacauuuguuacuccaaugcuacgacauucuauugaaaauaguucaguuaauguaucacugacagcuaucgccaaucaagcaaccguacugauggguuuaggaagaggauggccacuaucuaaaauggauguuggcguaccguuacuggcgauugggugcuauucucagguuaaccccauaacgcuaacagcagcauugcuacuccuuguugcucacuaugcaauaauuggcccuggucuacaagcuaaggccacaagggaagcacaaaaacgaacggcagcagguauaaugaaaaaucccacgguugaugggauuacaguuauugauuuagagccuauaccauacgacccgaaauucgaaaagcaauuaggacaaguaauguugcucguauugugcguaacgcaaguccuaaugaugagaacuacaugggcgcugugcgaggcauuaacauuagccaccggcccaauuucuacacugugggaaggaaacccuggaagguuuuggaacacuacaauugcagucaguauggccaauauuuuccguggaucauauuuagccggggcaggacuucuuuucucuauuaugaaaaacacaaccaauacgagacgagguacaggaaauauaggugagacauuaggcgagaaguggaaaagucgucuuaacgcacuuggaaaaucggaguuccaaauauauaagaaaucagggauacaggagguagaccgaacauuggcgaaagaaggcaucaaacggggugaaaccgaccaucacgcaguaaguagagguuccgcgaaacugcgaugguuuguagaacguaacauggugacuccagagggcaaaguaguugauuuaggaugcggaagaggaggcuggagcuauuauugcggaggccucaaaaaugucagagaaguaaagggauuaacaaagggagggccuggacacgaagaaccaauaccaaugucgacuuauggguggaaucucguacgccuucaaaguggaguugaugucuucuuuacaccacccgagaagugugauacacuacugugcgauauuggagaaucaucucccaacccuacgauagaagcaggacgcacacuuaggguacuaaauuuaguugaaaauugguugaauaauaauacacaguuuugcgugaagguauuaaauccuuauaugccaagcgucauagagaaaauggaaacucuacaaagaaaauaugguggagcauuggucagaaacccauugucuaggaauagcacacaugaaauguauuggguaagcaaugcuacagggaacauuguaaguagcgucaauaugauaucaaggauguugaucaauagguuuacuaugaagcacaagaaagcaacuuaugagccagauguagaccucgggucggguacuagaaacaucggaauagagaaugaaauuccaaaccuggauaucauagguaaaagaauugaaaagaucaaacaagagcacgaaacaucuuggcacuacgaucaggaccacccauauaagacgugggccuaccaugggaguuaugaaacgaaacaaacggggagcgccaguucaaugguaaacgguguagucaagcuacugacuaaaccgugggauguuguuccaauggucacgcaaauggcaaugacggacacuacuccauuuggucagcaacgaguauucaaagaaaagguagacacgaggacucaggaacccaaagaagggacaaagaaacuaaugcguaucacugcugaauggcuuuggaaagaacugggcaaaaagaaaaccccuagaaugugcacgagagaagaauuuacuagaaaaguuagaagcaacgccgcucuaggugcaauauucacggacgaaaacaaauggaaaucagcucgagaagcaguagaagauucucgauucugggaauugguugacagagaaagaaaccugcaucuagaagggaaaugugaaaccuguguuuauaacaugauggggaaacgagagaagaaacuaggggaguuuggaaaagccaaaggaagcagagcaauuugguauauguggcugggugcuagauuccuugaguucgaagccuugggguuccuuaaugaagaccacugguucagcagaggaaacucccuaagcggagucgaaggcgaaggguuacauaaauugggauauauacuuagagacguuaguaagaaagaggguggggcuauguaugcagacgauacugcaggaugggacacaaggauaacguuagaggaucuuaaaaacgaggaaauggugacaaaucauaugaagggugaacauaagaaauuagcagaagcuauauucaaguuaaccuaccagaacaagguuguccgaguacagcgaccuacaccuagaggcacagugauggacauaaucuccagaaaagaucagagagggucaggacaggucgguaccuacggauuaaauacauuuacaaauauggaggcccaguugauuaggcagauggaaggugagggaauauuuaaaagcauucagagauugaccgugaccgaagagauagcaguacaaaacugguuagcaagaguuggaagggagcgucuaagcaggauggcaauuagcggcgacgauugcgugguaaagccucucgacgaucguuucgcauccgcccuaacugcguugaacgacauggggaaaguucguaaggacauacaacaaugggagccuaguagaggauggaacgacuggacgcaaguaccuuuuugcucucaucauuuccacgagcuaguuaugaaagauggaagaguauuagucgucccaugucgcaaucaagacgagcuuauuggcagagcuagaauuucacaaggagcagguuggagucuuaaggaaacggcauguuuagguaaaucauacgcacaaauguggacacuaauguauuuccaccguagagaccuucgguuagcagcuaaugcaauaugcagugccguaccgucucacugggucccuaccagucguacaaccuggucgauccaugcgaaacacgaauggaugacaacagaggauaugcuagcuguguggaacagaguuuggauccaagaaaauccuuggauggaagauaagacgccuguagaaucaugggaggaaguacccuaccuggggaaaagagaagaucagugguguggcagcuuaauuggguuaacaucuagggcuacaugggcaaagaacauacaaaccgcuauaaaccaagucagaagucuaauaggaaaugaagaauacacugacuauaugccaucaaugaagagauuucguaaagaagaagaagaggcugguguacuaugguaa

SEQ ID NO: 22584 - RNA, 9876 nt, Artificial Sequence
  derived and/or modified CDS sequence (opt6) from DENV-2__EU596491__SS-prME
accgcagggguuauaauuauguuaauaccgacugugauggcauuucacuugacuacacguaacggagaaccucauaugauaguugggagacaagaaaaagggaaaucgcuucucuuuaaaacagaagauggaguuaacauguguacgcucauggcaauagaucuaggggaacuuugugaggauacgauaacauacaaauguccacuacuaagacaaaacgagcccgaggauauugauugcugguguaacaguacaucuacguggguaaccuacggaacaugcacuacaacuggagaacaucgcagggaaaaacggucuguugccuuaguaccgcacguagguaugggucucgaaacaagaacagaaacuuggaugagcucagaaggugcguggaaacauguacaaagaauugaaaccuggauccuaaggcauccagguuuuacuauaauggccgccauauuagcuuacacuauaggaacgacgcauuuucaaagagccuugauauucauccuacuaacugccguagcaccuaguaugacuaugcgcugcauaggaauuuccaaucgcgacuuuguugagggcguuucaggaggaaguugggucgauauaguccuugaacauggguccuguguaaccacuauggcgaaaaacaaaccaacauuggacuuugaacuaaucaaaacagaggcaaaacaaccagcaacucuucgaaaauauugcauugaagcgaaauuaacuaauacaacgacugagagucgcugucccacccaaggagaaccaagucucaaugaagaacaagauaaacgcuucauuugcaaacauucuaugguagauagaggauggggaaacggauguggacuauuuggaaaaggcggaauagucacaugcgcaauguuuacaugcaagaaaaacauggagggcaaaauagugcaaccugagaauuuagaauacacaauagugauuacuccacauaguggcgaagaacaugcaguuggaaacgacacaggaaaacaugguaaggaaauuaaaauuacaccacaaagcagcacuacagaagccgaauuaacugguuaugggacuguaacaauggagugcagcccaagaacggggcuagauuuuaaugagaugguucuccuacaaauggaagauaaggccugguuagugcaccgucaaugguuucuagauuugccauugccaugguugccaggagccgacacccaagguaguaauuggauacaaaaagaaaccuuaguuacguucaagaauccacaugccaagaaacaagacguagucguacugggaagucaagagggggcaaugcauacggcgcuuaccggggccacugagauucaaauguccucugguaaccuccuauuuacuggacaucuaaaaugucguuuaagaauggacaagcuacaacuaaaagguaugucauacaguaugugcaccgguaaauuuaaaauaguaaaagaaauagcugagacacaacacgggacaauaguaauaagaguacaauaugaaggagauggaucccccugcaagauaccguuugaaauuacggaccuggaaaagcgucauguccucggacgguuaauuacagucaaccccauuguuacagagaaggaugcaccaguaaauauagaagcagaaccacccuucggagauaguuacauuaucguuggcgucgaaccugggcaacuaaagcugaacugguuuaagaaagggucuucgaucggacaaauguucgagacaacgaugcgaggagcaaaacguauggccauauugggcgacaccgcgugggauuuuggaucucuaggaggggucuucacuucaauagggaaagcacuucaucagguauucggugcuauuuauggcgcagccuucucuggagugucauggacuaugaaaauacuuauugguguuauuauuaccuggauagggaugaacuccaggagcacuucucuuucaguaucacugguccuaguugggguuguaacacucuauuuaggagcuguaguacaagcugacagcggcugugucguguccuggaaaaacaaagaauuaaaaugcgggucgggaauauucauaacggacaauguccacacauggacagaacaauauaaauuccaaccugagucaccuucgaaacucgcuucagcuauacaaaaagcucaugaagaaggaauaugcgggauaagaucuguuacaagguuagaaaaccuuauguggaagcaaauuacaccggaguugaaccauauacuaagugagaaugaaguuaagcuaaccauaaugacaggugauaucaaagguauuaugcaggcuggaaagagaagccuccggccucagccgacagagcucaaguacagcuggaagacauggggaaaagccaaaauguuaucuacagagucacacaaccagacuuucuugaucgacgggccagaaacggcugaaugcccaaacacuaacagagcuuggaauaguuuagaggucgaagacuacggauuuggagucuucacaacgaauauauggcuaaaacuuagagaaaaacaggaugucuuuugcgacuccaaauuaaugucagcggcaaucaaagauaaucgagcaguucacgcugacaugggcuauuggauagagagcgcacucaaugauacuuggaagauggaaaaagccagcuuuauagaagucaaauccugucacuggccaaaaagucacacuuuauggaguaauggagugcuagaauccgagaugauuauaccgaaaaacuucgcuggaccuguaagucaacauaacuauagaccaggcuaccauacacaaacggcuggaccauggcaucuuggcaaauuagaaauggacuuugauuuuugugaaggaaccacaguuguuguuaccgaagauuguggaaaccgagguccgucacuuaggacuaccacagcuagugguaaacuaauuacagaauggugcugucgaucguguacacuuccaccgcuuagauauagaggugaggacggcuguugguauggcauggaaauaaggccauuaaaagaaaaagaggaaaaucucguuaacagcuuagucacggcuggccauggucagauugauaacuuuucacuaggggucuuaggaauggcauuauuccucgaggaaaugcuaaggacucggguuggcacuaaacacgcuacccuccuaguagcccucucuuuuguaacacuaauaacaggcaauauguccuucagagacuuagggcgaguaaugguaaugguaggugcaacuaugacugaugacauaggcaugggaguaacuuaccucgcuuuauuggcggcuuuuaaaguucggccaacuuuugcagcaggcuuauuacuacgcaaauuaacaaguaaagaacuaaugauggcaacaauagguauugcguuacuaucucaauccacauuacccgaaacgauacuugaacugacagaugcgcucgcauuggggaugaugguucuuaagauuguccgaaacauggaaaaauaucaacucgcaguaacuauaauggcuauaucgugcguaccaaacgcaguaaucuugcaaaacgccuggaaaguaucauguacaauucuagcggcagucucgguaucgccauuauuauuaacaucaucacaacagaaagcugacuggaucccucuggcacuuacaauaaaagggcugaauccaacagccauauuccuuaccacauuaucccguacgaguaagaaacguucauggccucugaacgaagcaauaauggcaguagggauggugagcauuuuggcuucuucauugcugaaaaacgauaucccaaugacugguccucuuguugcaggagggcuucucacuguauguuauguguuaaccgguagaucagcagacuuggaacuagagcgagcagcugauguaaaaugggaggaccaagcggaaauauccgggucuucucccaucuuaucuauuacuauaucugaagacggcucaaugaguauuaaaaacgaagaggaagaacaaacacuuacaauacugauucgaacagggcuauuaguuaucagcggaguguuuccuguuucaauucccauaacagcagcugcgugguaucuaugggaagugaagaaacaaagggccgguguucuaugggacgucccuucaccaccucccguagguaaagcggaacuugaagacggugcuuacagaauaaaacaaagagguauccuuggauacucacaaauaggagcugguguuuauaaggaaggaacauuucacacaauguggcacguaacacgcggugcuguacuuaugcaucgaggaaaaagaauagagccaagcugggcggauguuaagaaagauuugaucucauauggaggaggauggaaauuagagggcgaauggaaagagggagaagagguucagguacuagcauuggaaccagggaaaaauccgagggcuguccaaacaaaaccagguauuuucaaaacaaauacggguacaauaggagccguaucgcucgauuucaguccaggaaccucgggaagcccaauagucgauagaaaggggaaagucguuggccuguacgggaauggaguaguaacaagaucaggugcguauguuucagccauugcucaaacagagaaaaguauugaggauaacccagaaaucgaagacgacauuuuucguaaaaagaggcuaaccaucauggacuuacauccaggugcuggaaaaaccaaaagauaucuuccagcuaucguacgggaagcaauaaaaagaggacucagaacauuaauucuagcaccaacaagaguaguggcagcggaaauggaagaggcuuuaagagggcuuccuauucgauaucaaacacccgccauucgugcggagcauaccggucgcgaaauuguagaucuuaugugccaugcaacauuuacgaugagacuucucagcccaguaagagucccaaacuacaaucuuaucauuauggacgaagcacauuucacagaccccgccucaauagcugccaggggauacauuaguacaaggguggagaugggagaagcugcagguauuuucaugacagcgacacccccgggcaguagagauccauuuccacaaucaaaugcacccauuaucgacgaagaaagagaaauuccggaacguucauggaauaguggacaugaauggguuacagauuucaaggggaaaaccguuugguucguaccuucuauaaaagcaggaaacgacauagcagcgugucuaaggaaaaauggcaagaaaguaauacaacuuagucggaaaaccuuugauagugaguacguaaaaacuagagcgaaugauugggacuucgucguaaccacugauaucucggagaugggagcaaauuucaaagcggaaagaguuauagauccgcgacgauguaugaaaccgguuauauuaaccgauggugaagaaagaguuauauuggcaggaccaaugccuguaacgcauucgucagcagcccaacgaagaggaagaauagggcgaaaccccaaaaaugaaaaugaccaauacauuuauaugggugaaccuuuagaaaaugaugaagauugcgcgcacuggaaagaagcgaaaauguuacuggauaacauaaacacacccgaggggauaaucccuucuauguuugaaccugaacgagaaaagguggaugcaguagauggagaguaucgcuuaagaggagaagcaaggaagacguucguugaucugaugcgaagaggagaccucccagucuggcucgcuuacaaaguugccgcagagggaaucaacuaugcggaucgcaaaugguguuuugauggcaucaaaaauaaucaaauccuagaagagaauguagaaguggaaauauggacaaaagaaggggaaaggaaaaagcuaaaaccaagauggcuggacgcgcgaauuuauucggauccuuuagcauuaaaggaguuuaaagaauuugcugcggguagaaaaucguuaacuuuaaauuuaauaacugagauggggagauuacccacauuuaugacucaaaaagcgcggaacgcacuagauaaccuagcaguucuacacacugcagaaguaggaggcagagcucauaaccaugcacugucagaacuaccagaaaccuuagaaacgcuguuacuauugacccugcuagcuacuguaaccggagggauauuucuuuucuuaaugagugguaaaggaauaggaaaaaugacucuaggaaugugcugcaucauaacagcauccauauuauuaugguaugcccagauucaaccucauuggauagcagcaagcauuauuuuagaguucuuuuuaauuguauuauugauucccgaaccagagaagcaacgaacaccacaagauaaucagcuaacauacguuguaauagcuauuuuaacaguaguugccgcaaccauggcaaaugaaaugggguuuuuggaaaagaccaagaaagacuuagguuuugguucuaucacgacacaagaaucugaaucaaauauccuagacauugauuuacguccagcaagugcguggacccuauaugcuguugcaacuacuuucguaacaccaauguuaagacauaguaucgaaaauaguucaguuaaugucagcuuaacggcgaucgcaaaucaggccaccguucuaaugggauuaggcaagggauggccauuaucaaagauggauauuggcguuccucucuuggccauagguuguuauucacaaguuaauccuauaacgcugacagcggcacuacugcuacuuguagcacauuacgcaaucauagguccgggacuccaagcaaaagcuacaagagaagcccaaaagagggcugcggcuggaauaaugaaaaaccccacaguggauggaauuacuguuauagauuuggaacccauacccuacgauccaaaauuugaaaaacaacuuggacaaguuauguugcugauucuauguguaacucaaguccuaaugaugagaacaacaugggcucuuugugaggcgcuuacuuuggcgacaggcccuauaaguacuuuaugggaaggaaauccaggacgauucuggaauacaacgauugccguaucaauggcuaauauuuuuaggggcucguaccucgcaggggcugguuuacuauucaguauuaugaaaaacacaacgaauacuagaagaggaacagggaaugucggugagacacuaggagaaaaauggaagaguagguuaaaugcauugggaaagucugaguuucaaauauauaaaaagucaggaauacaagaaguagaccgaacuuuagccaaagaagggauaaaaagaggugaaacggaucaccacgcgguaaguagagguucugcgaaacuaaggugguuuguagaaaggaacaugguuaccccagaggguaaaguugucgacuuaggaugugguagagggggauggucauauuacugcggaggauugaagaacguacgagaagugaaaggauugacuaaaggaggacccggccaugaagaaccaauaccaaugucaaccuaugguuggaaccuugucagacuacaaaguggaguggauguauucuuuaccccaccugaaaagugcgacacacuacugugcgauaucggggaaaguagccccaacccuacuaucgaggcagggaggacauugaggguacuaaaccuuguagagaacuggcugaauaacaauacccaauuuuguaucaaaguccuuaauccguacaugccauccguaauagagaaaauggagaccuugcaacgcaaauacggaggggcucuuguaagaaauccccugagcaggaacucaacacacgaaauguauuggguaucaaaugcaacgggaaacauaguaaguagugucaauaugaucucucgaaugcucauuaauagauuuacaaugaagcauaagaaagcaacguacgaaccggacguagaccugggcagcggcacuaggaauauugguauagaaucagagauaccaaacuuagacauaauuggaaaaaggaucgagaaaaucaaacaagaacaugaaacaucauggcauuacgaucaagaccauccauacaaaacaugggcauaucacggaucuuacgagaccaaacaaacaggcucagccucaagcaugguuaauggaguaguacgauuauuaacaaaaccgugggacguaguaccaaugguaacgcagauggcaaugacugauacaacacccuuuggucaacaaagaguauucaaagaaaaggucgauacuaggacacaagaacccaaggaagguaccaaaaaguuaaugaaaauuacugcggaaugguuguggaaagaguugggcaaaaagaaaacccccagaaugugcacccgugaagaauuuacaaggaaaguucguucuaaugcugcucuuggggcuauuuuuacagaugaaaauaaauggaaaucagcaagagaagcaguugaagauggucgauuuugggaauuaguugauagagaaagaaaucuccauuuagaggguaaaugugaaacauguguauacaauaugaugggaaaaagagagaagaaacuuggagaauuuggaaaagcaaaaggaucucgggccauuugguauauguggcuaggagcaagauuucuagaauuugaagcacucggcuuuuugaaugaagaucauugguuuucaaggggcaauucauuguccggaguugaaggagaagguuuacaccgacuaggauacaucuugagagaagugggcaagaaagaaggaggggcaauguaugccgacgauacggcugguugggauacaaggauuacuuuagaggaucucaaaaaugaggagaugguaacgaaucauaugaagggagaacacaagaaacuugcggaagcuauauuuaagcuaaccuaccaaaauaaggucguaagaguacagagaccaacgccccgagggacuguaauggauauaaucagccgaaaagaccaacgggguagcggacaaguugguacauacggacuaaauacuuuuacuaacauggaagcacagcuuauacggcaaauggaaggagaagggauuuucaagagcauacaacaucuaacagcuacugaggaaauugcaguacagaauuggcuggcacgagugggaagggagaggcuaucacgcauggcaaucaguggcgacgacuguguagugaaaccgauugaugacagauucgccucagcauugacggcacuuaaugauaugggaaaaguuaggaaagauauucaacaaugggaaccauccagaggauggaaugauuggacacagguaccauuuugcagucaccacuuucaugagcuaguaaugaaagacgggcgaguuuuaguuguaccauguagaaaucaagacgaacugaucgguagggcccgcaucucccaaggggcaggauggagccucaaggaaacagccugcuuagguaaaagcuacgcgcaaauguggacucuuauguauuuucacagacgugaccuucgauuagccgcuaaugcgauauguucggccgugccaucccauuggguaccaacuucaagaaccacuuggaguauucacgcaaaacacgaauggaugacgacggaagauaugcuagcuguuuggaauaggguguggauacaagaaaacccauggauggaagacaaaacacccguggaaucuugggaggaagugccauacuuaggaaaaagggaagaccagugguguggaucuuuaaucggacucacaagccgagccacuugggccaaaaacauucagacugccauuaaucaaguacgcagcuuaaucgguaacgaagaauacacggauuacaugccaaguaugaagagauuuaggagagaggaagaagaagcggggguauuaugguaa

SEQ ID NO: 22585 - RNA, 9876 nt, Artificial Sequence
  derived and/or modified CDS sequence (opt6) from DENV-2__EU677141__SS-prME
accgcagggguaauaauuaugcucauucccacagcuauggcauuucacuuaacaacaaggaauggggaaccacauaugauuguaggucgccaagaaaaaggaaaaucuuugcuuuucaaaacagaagauggagugaauauguguacauugauggcaauugaucuaggagaauuaugcgaagacacaauaacauacaaauguccauuguugcgacaaaaugaaccagaagauauagauugcuggugcaacucaacuucgacuugggucacuuaugggaccuguacaacuacaggugaacaccgaagagaaaaacgaagcguagcacuuguuccgcauguuggaaugggacuagaaacacguacagaaacguggaugagcagugaaggagcauggaaacauguucaacgaauagaaacuuggauacuacgacacccuggauuuacuauaauggcagcaauacucgcuuauaccaucggcacuacucauuuccaacgcgcgcuuaucuuuauccucuuaaccgcuguugcuccgucaaugacaaugagauguauuggaauaucgaauagggacuucguagaaggagucagugggggaucuuggguagacaucguguuagaacacggaucaugcgucacaacaauggcuaaaaauaaacccacgcuagauuuugaacucaucaaaaccgaagcaaaacaaccugccaccuuaaggaaauacuguauagaagcaaaacuuacaaauacaacaaccgaaucccguugccccacacaaggugaaccgaguuuaaacgaggaacaagauaaaagguuuauuuguaaacacucaaugguagaucgggguugggguaauggaugugguuuauucgguaaaggaggaauagucacuugugcgauguucacgugcaagaaaaauauggaaggaaaaguaguauugccugagaaccuggaguacaccauagucauaaccccgcauucaggugaagaacaugcggugggaaacgauacggggaaacaugguaaagagauaaaaaucacuccucaaaguucaauaacggaagcagaguuaacaggguaugguaccgucacaauggaguguucaccaaggaccggguuagauuuuaacgaaaugguuuuacugcaaauggaagacaaggcuugguuaguacacagacaaugguuucuggauuuaccguuaccauggcucccaggagccgauacgcaaggaaguaacuggauacaaaaagaaacauuaguuacauuuaaaaauccacacgcaaagaaacaagacguagugguacuaggaagucaggaaggagccaugcauacagcccuuacgggcgcgacagagauucaaaugagcuccggaaacuugcuauucaccggucaucuuaaaugucgucucagaauggacaaacugcaacucaaagggaugaguuacucaauguguacugguaaauuuaaaauagucaaagaaauagcugagacacaacauggaacuauuguaauuaggguccaguacgaaggagaugguucgccauguaaaauuccauucgaaauuauggacuuagaaaaacguuacguauugggucguuuaaucacaguaaaccccauuguaaccgguaaggauucuccgguaaacauugaagccgaaccgccguucggcgauuccuauauaauaauuggugucgaaccuggccaguugaaacuaaauugguucaaaaaggguucuucuauuggacaaauguucgagacaacaaugagaggggcgaaacgcauggcaauacugggcgauacagcaugggauuucggaucacuaggagggguauucacaaguaucgggaaagcacuucaucaaguauucggugcaauuuauggagcagcuuucaguggagucucauggacgaugaaaauccuaauuggaguaauuauuacauggauagggaugaacagcaggagcaccagcuugucagucagccuaguccuuguaggaguagugacacuuuacuuggggguaauggugcaggcagauaguggaugugugguauccuggaagaacaaagaauuaaaauguggaaguggaauauucauaacggauaacguacauacauggaccgaacaauacaaguuucagcccgaauccccaucaaaauuagcaucggcuauucaaaaggcacacgaggaaggaauauguggcauacggucgguuacuagacucgaaaaucucauguggaaacaaauaacaccagaacuaaaccauauacuguccgaaaacgaggucaaacuaacaauaaugacaggagacauuaaggguauaaugcaggcggguaaaagaucuuugcguccucaaccaacagaauuaaaauauucauggaaaacaugggguaaagcgaaaauguugucuacagagucacacaaucaaaccuuucuaauagacgguccagagacagccgaaugcccaaacacuaaucgcgccuggaauaguuuagaaguugaagacuacggauuugggguguuuaguacaaauauuugguuaaaacugcgcgagaaacaagauguauucugugauucaaaauuaaugucagcagcgauaaaagacaacagggcgguacacgcggacauggguuacuggauugagagugcuuuaaacgacacauggaagauggaaaaagcgagcuuuauagaagucaaauccugucacuggcccaaaagucacacccuaugguccaacggaguauuagaaagcgaaaugaucaucccuaaaaauuuugcaggaccggucucucagcauaauuaucguccugguuaucacacacaaacugcagggcccuggcaucuagguaaauuagagauggacuucgacuucugugaaggcacaacaguagucguaacugaagacuguggaaauagagggccgucucuccggacaacgaccgcaucggguaaacuuauaacggaaugguguuguagaucuuguacacuuccuccacuacgcuaucguggagaagauggaugcugguacgggauggaaauuagaccacugaaagagaaggaagagaaucucguaaauaguuugguaacggcaggucaugggcagaucgacaauuucucccuagguguucugggcauggcucuauuucuagaggaaauguugcgaacaagaguuggaacaaaacaugcaauauuauuaguggccguaaguuuuguaacauuaauaacagggaacaugucauuucgcgaucuagggagaguuaugguuaugguuggcgcaacuaugacagacgacauagggaugggugucacuuacuuagcacucuuagcagcguucaaaguaagaccuacauuugcagcgggguuacuauuacggaaacuaaccaguaaagagcuuaugauggccacaauaggaauagcccuacuuagucaaucgacaauucccgaaacuauacuggaauugacugaugcacucgcacuagguaugaugguucuuaaaauugucagaaacauggaaaaauaucaauuggccgugacaauuauggccauuuuauguguuccaaacgcaguuauacugcaaaacgccuggaaaguuuccugcacaaucuuagcugcgguaaguguaaguccucuacuucuaacaucuagucaacaaaaggccgauuggauaccauuagcccuuacgauuaagggauuaaaccccacggcaauauuuuugacgacacugucuagaacauccaagaaaagaucuuggccacucaaugaggcugucauggccguugggaugguuaguaucuuagcaagcucauuacucaaaaaugacauaccuaugacggguccacugguugccggaggucuacucacaguguguuauguacuaacaggccgauccgcggaucuagaacucgaaagagcugcagacgucaaaugggaagaucaagccgaaauuagcgggagcaguccuaucuuaagcauaacuauaucagaagauggguccaugucgaucaaaaaugaggaagaagaacaaacuuuaacaauauuaauacgaaccgggcuacuugugauuuccgguguuuuuccuguaucgauaccgauaacugcugcagcgugguauuugugggaggugaagaaacagagggcugguguuuuaugggacguucccagucccccuccaguagguaaagcagaauuagaagauggagcauauagaauuaaacaaagaggcauuuuuggauauucccaaaucggagccgguguguauaaagaggguacuuuucauacaauguggcacguuacgcgaggggcaguacuaaugcaucgagguaagcguauugagccuucaugggcggauguaaagaaagacuuaauaaguuacggcggcggauggaaacuugagggagaauggaaagaaggagaagagguucagguccuggcuuuagaaccaggcaaaaauccaagagccgugcaaacuaaaccaggacuuuuuaaaacaaacacaggaacuauuggcgccguaagccuugacuuuuccccgggcacaagcggcucaccgauaguagauagaaaaggaaaaguagugggucuauacgggaauggagugguaacgcggaguggagcguacgugagugcuauagcacaaacugaaaaaucaauagaagauaacccagaaauagaagaugacaucuuuaggaagaaacgguuaacaaucauggaucugcacccuggagcaggcaaaaccaaaagauaccugcccgcaauaguacgagaagcaauaaaacgcggcuuaaggacacuuaucuuagcccccaccagaguaguagcagcugaaauggaggaagcgcugcggggccuaccuauacguuaccagacaccggcuauccgugcugaacacacuggaagagagauaguugauuuaaugugccaugccacauucacaaugagacuacuuucucccgugcgcguacccaauuacaaucuuauaaucauggaugaagcacauuuuacagauccagccaguauagcagcuagaggauauauaucgacccguguugaaaugggggaagcugcgggaauuuuuaugacagcaacaccacccggcagucgcgaucccuuuccucagucaaaugcaccuauaauggacgaagaaagagaaauaccagaacgguccuggaacucugggcacgaguggguaacggacuuuaaaggcaaaaccguaugguuugugccaucaaucaaggcugguaaugacauugcagcaugcuuaaggaaaaauggcaaaaagguuauccaauugaguagaaaaacuuuugauagugaauauguaaaaacucgugcuaaugauugggacuucgucguuacaacagauauuucagaaaugggggcaaacuuccgugccgaacgcguuauugauccacgacguugcaugaagccagugauucuuacagacggcgaggaaagggucauacuggccggaccuaugccaguaacacauucuagcgcagcgcaacgacgagguagaauagggcggaacccuaaaaaugaaaacgaucaguauauuuauaugggugagccacuagagaacgaugaggacugcgcgcauuggaaagaagccaagaugcuauuagacaacauaaacacuccggaagguauuauuccaucuauguucgagcccgaaagagaaaaaguggacgcgaucgauggugaauaccguuuaagaggugaagcacguaaaacauucgucgacuuaaugcgccggggagauuuaccuguuuggcucgccuauaggguagcugcagaaggcauuaauuaugcagauagaagauggugcuucgauggaauuaaaaauaaucaaauucucgaagagaacguagaaguugagauauggacaaaggaaggcgaacgaaagaaacuaaaaccgaggugguuagaugcucguauauacucagauccgcuagcgcuuaaggaauuuaaagaauuugcagcaggaaggaaaagucuuacccuaaauuuaauuacagaaauggggcgauugccaacauuuaugacccagaaagccagggacgcacuagauaaccuagcaguguuacauacagcagaagugggaggacgcgcauauaaucacgcacucucggaauuaccugaaacuuuagagacgcugcucuugcuaacauugcucgcgacugucacgggcggaauauuucuuuuucuaaugagcgggaaggggauaggaaagaugacguugggaauguguugcauuauaaccgcaagcauucuucucugguaugcacagauacaaccgcauuggauagcagcuuccauuauauuagaguucuuccuuauuguauuacuaauuccggaaccugaaaaacaaagaacaccccaagauaaucaacuaacauauguagucauugcaauacucacugucguagccgcaaccauggcuaaugagaugggcuuccuugagaaaaccaagaaagacuuaggacucgguaguauuauuacgcaagagucagagagcaauauucuggacauagaccugaggccugcgucggcuuggacguuauaugcaguagcaacuacuuuugucacaccgauguugagacacucaauagaaaauuccagcguaaauguuagcuuaacagcuaucgcuaaccaggcgacagugcugaugggauuaggucguggcuggccucucagcaaaauggacauagggguuccauuauuggccauagguugcuauucucagguaaauccgaucaccuugaccgcugcucuauuauuauuaguugcgcauuaugcuauuauagguccagggcuacaagccaaagcgacccgggaagcccagaaaagagcugcagcaggcaucaugaaaaauccaacuguugaugguauuacgguuaucgaucuagaaccuauuccuuacgaccccaaauuugagaaacaauugggccaaguaaugcucuuagugcuaugugugacccaaguucuaaugaugagaacuacaugggcccugugcgaagcccugacauuggcaaccggccccaucaguacuuugugggaaggaaauccuggacgauucuggaauacuaccauagcgguuucgauggcuaauaucuucaggggaaguuacuuagccggagcaggauuacucuucuccauuaugaagaauacaaccaauacaagaaggggcacagggaauauaggcgaaacauuaggggagaaauggaaaaguaggcuaaaugcauuaggaaaaagugaguuccaaauuuauaagaaaaguggaauccaggagguagauagaaccuuagcaaaagaaggaauaaaaaggggagaaacugaucaucaugcaguuaguagaggaagcgcaaaacuaagaugguuuguugaacgaaacaugguaacaccagagggaaaaguaguagauuugggcuguggcagagguggauggucauauuauugcggagggcugaaaaacguucgugaaguuaagggucuaacaaaaggaggaccagggcacgaagaacccauucccaugucaacguauggauggaauuugguaagacuacaaucaggggucgacguauucuuuacgccuccagaaaaaugcgauacauuguuaugugacaucggggaaagcagcccaaauccaaccaucgaggcaggaaggacuuuaagagucuuaaacuuagucgaaaacuggcuaaauaauaauacacaguucuguaucaagguccugaauccguauaugccaucaguuauagagaaaauggaaacgcuucaacguaaauacgguggugcccuuguaagaaauccauuaucccgaaauuccacucaugaaauguauugggucaguaaugcuacagguaacauaguaucauccguaaauaugauaaguagaauguuaaucaaucgauuuacaaugaagcauaaaaaggccaccuaugaaccagauguggaccuuggaaguggaacacgaaauauagguauugaaaacgaaauacccaauuuagauaucauugggaaacggauugaaaagauuaaacaagagcaugagacaagcuggcauuaugaccaggaucauccauacaaaaccugggcuuaucauggcucuuaugaaacaaaacaaacuggguccgccaguagcaugguaaauggaguugugagauuacuaacaaaaccuugggacguaguuccaauggucacacaaauggcgaugacagauacaaccccauuuggccaacaaaggguguuuaaggaaaaagucgauacccguacacaagagccaaaagagggaacuaagaaacuaaugaggauaacggcagaauggcuauggaaagaacuaggcaagaagaaaaccccuaggauguguacuagagaagaguucacaaggaaagugagauccaaugcggcauuaggagcuauauuuacugaugagaacaaauggaaaagcgcaagagaagcagucgaagacaguagauuuugggaacuuguggacagggaacggaauuuacaucuagagggaaaaugcgaaacauguguuuauaacaugauggguaaaagagagaagaaauugggagaguuugggaaggcaaaaggcaguagagcaaucugguauauguggcuaggagcaagauuucuggaauuugaggcucuagguuucuugaaugaagaucauugguucucaaggggaaauucacuaagcggcguugaaggagaaggacuucauaaguuggguuacauauuaagagacguuaguaagaaagaaggcggugcaauguaugccgacgauaccgcuggaugggacacucgcauuacauuagaagacuuaaagaaugaagaaaugguaacgaaccauaugaaaggugagcauaagaaguuagccgaagcuauauucaaauuaacauaucagaauaaaguaguaaggguacaacgaccaacaccaaggggcacuguuauggacaucauuagcagaaaagaucagcggggcuccggacaaguaggaacuuaugggcugaauaccuucacuaacauggaggcccaacucaucagacagauggaaggugagggcaucuuuaagaguauacaacacuuaacagucaccgaagaaauagcuguacagaauugguuagcacgagugggucgagagcguuuaagccgaauggccaucucuggggaugacuguguagucaagcccuuagacgaccgauuugccagugcacucacagcguuaaaugacaugggaaaagugagaaaggacauacagcaaugggaaccuucccgaggauggaacgauuggacgcaaguuccuuuuuguucacaucacuuucaugaguuggugaugaaagauggcagaguccuaguaguaccguguagaaaucaagacgaguuaauagguagggcucguauuucucaaggagcuggcuggucacucaaagagacagcaugcuuaggaaaaagcuaugcccaaauguggacuuuaauguauuuucauagaagggauuuaagacuagcggcaaacgcuauuugcagugcuguaccaucucauuggguaccuacgucucgaacaacuuggucaauacaugccaaacacgaauggaugacaaccgaagauauguuagcaguuuggaaccgagucuggauacaagaaaacccguggauggaagacaaaacaccgguugaaucaugggaggaagucccuuaucuaggcaagcgagaagaucaaugguguggaucauuaaucggucuaaccucuagagcaacuugggcuaaaaacauacaaacugcaaucaaccaaguaaggagcuuaauugggaacgaggaauauacagauuacaugccgagcaugaagcgauuuaggaaagaagaagaagaagcaggaguucuaugguaa

SEQ ID NO: 22586 - RNA, 9876 nt, Artificial Sequence
  derived and/or modified CDS sequence (opt6) from DENV-2__EU677144__SS-prME
acagcaggaaugauaauuauguuaauaccaacugcaauggcguuucauuuaacaacccgcaacggcgaaccacauaugauagucgggagacaagaaaaagggaaaucucuguuguuuaaaaccgaagaugggguaaauauguguacauugauggcaauugaucuaggcgaauugugcgaagauacaauaacuuacaaaugcccgcugcuaagacaaaacgaaccagaggacauagauuguugguguaacagcacgaguaccugggugacuuaugggacuuguacaacgacaggcgaacacagacgcgagaaaagaaguguugcccugguaccacacguuggaaugggucuagagaccagaaccgagaccuggaugucuagcgagggggcguggaaacaugugcaaagaauagaaacauggauucuccgacauccaggcuuuacuauaauggcugcuauucuagcauacacgauaggcacgacacacuuucaaagagcuuuaauuuucauacuauuaacagcaguugcaccuucuaugacuaugagaugcauagguauuucuaaucgggacuuuguugagggagucucagguggauccuggguagacauaguuuuagaacauggaucuugcguuaccacuauggcgaaaaacaaaccaaccuuggauuuugaauugauaaaaacagaggcaaaacagccugcaaccuugagaaaauauugcauagaggcuaaauuaacgaauacuacaacugaaucgcgaugcccaacucaaggcgaaccaaguuuaaaugaggagcaggauaaacgauucauuuguaaacauucuaugguugaccgaggaugggguaaugguugcggacuguuuggaaaaggugguaucguuacuugugcuauguuuaccugcaagaaaaacauggagggaaaaguuguauugcccgagaaccuggaauauaccauuguuauaacuccacacucaggggaagaacacgcgguuggaaacgacacggguaaacauggaaaagaaauuaaaauuacuccacaguccaguaucacagaggcagaacuuacaggauauggaaccgucacgauggaaugcucaccaagaacaggauuagacuuuaacgagaugguacucuuacaaauggaggauaaagccugguugguacauagacaaugguuucuugauuugccuuuaccauggcuaccgggggcugacacgcaaggacuaaauuggauccaaaaagagacucuaguaacauuuaaaaacccacacgcgaagaaacaagauguaguaguuuuagguucgcaagagggcgcuaugcauacagcuuuaacaggagcaacagaaauucaaaugucuucaggaaauuuacuuuucacaggacauuuaaaauguagacuccgaauggauaaauugcagcuuaaaggaaugaguuacaguauguguacgggaaaauuuaaaauagucaaagagauagcggaaacacaacacggaacaaucgugauacgaguacaguaugaaggggacggauccccuugcaaaauaccauuugagauuauggauuuagaaaaacgguacguucuugguagacuuauaacaguuaacccuauagucaccgaaaaagacucaccaguaaauauugaagcugaaccgcccuuuggugacagcuauauuaucauuggcguagaaccggggcaauuaaaauuaaacugguuuaagaaaggcaguucgauagggcagauguucgaaacaacaaugcgcggagcaaaaagaauggcuauacucggagauacagcaugggauuuuggaucucuaggagggguuuuuacauccauaggaaaggcuuuacaucaaguuuucggugccauauacggcgccgcauuuucggguguauccuggacgaugaagaucuuaauaggaguuauaauaacauggauaggaaugaacucccguucaacaucucuaagcguuagucucguucuaguaggaguaguaacccuuuaccucggaguaauggugcaagcggacucaggaugcguagucuccuggaaaaacaaagaacuaaaaugcggaagcggcauuuucaucacggacaauguacauacuuggacugaacaauacaaguuucaaccagaauccccgucuaagcuggcaucggcuauucaaaaagcacacgaagaaggaauauguggcauacgcucaguaacucgccucgaaaaucuaauguggaaacaaaucacaccagaacugaaucauauuuugagcgaaaacgaaguuaaauugacuauaaugacgggagauauaaagggaauaaugcaagccggcaaaaggagcuuaagaccccaaccuacagaauuaaaguauaguuggaaaacuuggggaaaagccaaaaugcuaucgacugagucgcacaaucaaacauuccuuauugacggaccggagacagcagaauguccaaacacgaaccgggcuuggaacucucuagaaguugaagauuacggauuugguguauuuucaacgaauauaugguuaaaguugagagaaaagcaagacguauuuugcgacaguaaguugaugagugcagccauaaaagacaaucgggcagugcacgcagauaugggauauuggauagagucugcacuuaaugacaccuggaaaauggaaaaagcauccuucauugaagucaaaucgugucauuggccgaaaucucauacuuuauggucaaauggugugcuagaaucugagaugauaauacccaaaaacuuugcggggccgguuagccaacacaauuacagacccggguaucauacacaaacggcgggcccauggcaucuuggaaagcuagaaauggacuucgacuucugcgaagguacaaccgugguggucaccgaggacugcgguaacagaggaccuucuuuacggacgacaacagcuucaggaaaauuaaucacugaaugguguuguagaucaugcacauuacccccuuuaagauaucgcggcgaagacgguuguugguauggcauggaaauccgaccgcugaaagaaaaagaagaaaaccugguaaauucccuaguaacggcgggacaugggcaaauagacaacuuuucccuuggaguucucgguauggcauuauuuuuagaggaaaugcugagaacuagaguuggaacuaaacaugcaauacuguugguugcaguuucuuuuguaacccugauuacgggaaauaugaguuucagagacuuaggaagaguaaugguaaugguaggagccacaaugacagaugacauugguaugggaguuacauaucucgcuuuguuagcggcauuuaaaguaagaccaacauucgcggcuggauuguuacuaagaaaguuaacaucaaaagaacucaugauggcgacuauagggauagcuuuacuaucgcaaagcacaauaccagaaacaaucuuagaauuaacagaugcauuagcguuaggaaugaugguauuaaaaauaguaagaaauauggaaaaauaucaauuagccguaacaaucauggccauauuaugugugccuaacgcugucauacuacaaaacgcauggaaaguaucaugcacaauacuugccgcugugucuguaucuccacuucuauuaacuucaucgcagcaaaaagccgacuggaucccauuggcccuaacaaucaaaggguugaauccuacagcgauuuucuuaaccacucuuagcagaacaaguaagaaacgcaguuggccauuaaacgaggcgguuauggccguugguaugguaucaauauuagcguccucuuuacucaaaaacgauauuccaaugacugggccgcuaguagcaggaggauuauuaacaguauguuauguuuuaacaggucggucagcagaccuugaauuagaaagagcugcagauguuaaaugggaagaccaagcggagaucagcgguucuagccccauccuauccauaacuauaucagaagacggaucuaugaguaucaaaaacgaagaagaagaacaaacauuaacuauauuaauucgaacgggccugcuagugauaaguggaguauucccaguauccauaccgaucaccgcugcagcaugguaucuaugggagguuaagaaacagcgggcuggaguuuugugggacguaccgucaccucccccaauggagaaagcugaacuugaagauggggccuauagaauuaaacaaagaggaaucuuuggauacucacagauaggggcaggagucuacaaagaagguacguuccauacuauguggcauguaacuaggggagcuguuuuaaugcaccguggaaaaagaauagaaccguccugggcugauguaaagaaagaccuaauaucuuacggcgguggauggaaacuugaaggcgaauggaaagaaggugaagaaguacaaguauuggcauuagagccagggaaaaacccccgugcaguccaaacaaaacccggccucuucaaaaccaacacggguacgauaggagcagucagccuagauuucucaccaggaacaagugggucaccuauaguagaccgcaaaggaaaaguugucgguuuauauggaaacggugucguuacuaggucaggugcuuacgucagcgccauugcacaaacagagaaaucgauugaagacaauccugaaaucgaggacgauauuuucaggaagaaacgacuuacgauuauggacuuacacccaggcgcaggaaaaacaaaacgauauuugccagcgauuguuagagaggcuaucaaaagaggguuaagaacuuuaauacuagcuccaacgaggguagucgcagcugaaauggaagaagcucuacgaggguuaccgauucgauaccaaacgccggcaauccgugcggagcacacaggaagagaaauuguugaucuuaugugccacgccacauuuacaaugagauuacuaucaccaguccgaguaccaaacuauaaucuaauaauuauggaugaagcgcacuucacugauccagcaucaauagcagcgagaggguacauaucuacgcgaguagaaaugggugaggcugcuggaauauucaugaccgcuaccccaccgggcagcagagaucccuucccucagagcaacgcucccaucauggaugaggagagggaaauaccagagagaucguggaacuccggccacgaaugggucaccgacuucaaaggcaaaacggucugguucguaccuagcauaaaagcugguaaugauauagcagccugcuugaggaagaauggaaagaaaguaauacaacuaagucgaaaaacauuugauucagaguaugugaaaacuagagccaaugacugggauuucgugguaacaacagacauuucagaaaugggggcaaauuucagagcggaaagaguaauagaucccagacgcuguaugaaaccuguaauacugacagacggagaggagcguguaauauuagcagguccaaugccuguaacucauaguucagcagcucagcgaaggggaaggauuggaaggaauccuaaaaacgaaaacgaccaguauauuuauaugggggaacccuuagaaaacgacgaggauugugcgcauuggaaagaggcaaaaauguugcuugacaacauuaacacaccagaaggaauuauaccuucaauguuugaaccagagagagagaaaguagacgcuauagauggcgaauaucgacuucguggagaagcaaggaaaacuuuuguugaucuaaugagaaggggagaccucccugucugguuggcguaucguguagcagcggaagggauuaauuaugcugauagaagauggugcuuugacggaauuaaaaacaaucaaauuuuagaagaaaauguagaaguagaaaucuggacaaaagaaggcgagcgaaagaaauuaaaaccgagauggcuagaugcccgaauuuauagugacccauuagcguugaaagaauuuaaggaguucgcagccggucgcaaaaguuugacuuugaaucuaauaacggagaugggaagacuaccuaccuucaugacacaaaaggcaagggacgcacuagacaaucucgcaguuuuacauaccgcagaaguaggugggagagcguacaaccaugcauuaucugaguuaccggaaacgcuugagaccuuauuacuacuuacacuucuggcuacuguuacaggggguaucuuuuuguuuuuaauguccgggaaagggauuggaaaaaugacacuuggaauguguuguauaauaaccgcgaguauacuuuuaugguacgcacaaauacagccucauuggauagcagcaucuaucauucuagaguucuuccuaauaguacuauuaaucccagaaccagagaaacagagaacuccccaagauaaccaacuaacuuauguaguaauugccauacugacaguuguagcugcgacaauggcaaaugagaugggauuuuuagagaaaacgaagaaagaccugggacuaggaucgauaaucacacaagaaagugaaucuaauaucuuggacaucgaucuacguccagcaagugcguggacccucuacgcaguagccacgacuuuuguaacaccuauguuacgacacagcauagagaacagcaguguaaacguaucucuaacagcgaucgcuaaucaggcaaccguucucaugggccugggacguggauggccacuuucgaagauggauauuggaguuccguuacuagccauuggauguuauagucaaguuaacccaauaacucugacugccgcccuacuuuuacuuguugcgcauuacgccauaauaggcccaggauuacaagcuaaagcaacgcgagaggcacagaaaagagcagcugcaggcauaaugaaaaacccaacggucgauggcauaacaguuauugaccucgaaccuauaccuuacgacccuaaguuugaaaaacaauugggucaaguaaugcuccuaguuuuaugcgucacucagguauuaaugaugcgaacaacuugggcauuaugcgaagccuuaacacuagcuacaggaccuauaucgacauugugggaaggaaacccgggccgauucuggaacacaaccauagcaguaaguauggcuaacauauuuagggguaguuacuuagcaggggcgggucuacucuuuucaauaaugaaaaauacaacaaauacaagacgagguacaggaaauauuggagaaacgcuaggagaaaaguggaagucaaggcucaaugcacuagguaaauccgaauuucaaauuuauaagaaaaguggaauacaagaaguugaccgaacccuagcgaaagagggaauuaaaagaggagaaaccgaucaccaugccgugaguaggggaucugccaaacuacgaugguucguagagcgaaauauggucacacccgaaggaaaggucguagaucuaggcugcgguagaggaggguggagcuacuauuguggagggcucaaaaacgucagagaagugaagggccucacuaagggagggccaggucacgaagaaccgauccccaugaguacauaugguuggaaucuggugagauuacagaguggaguagauguauucuuuacacccccugagaagugugauacuuuguugugugauauaggagaaucaucuccgaaccccacuaucgaagcuggcaggacguuaagaguucuaaacuugguagaaaacuggcuaaacaauaauacacaguucuguaucaaagugcucaacccauacaugccaucaguaauagagaaaauggaaacacuccaaagaaaauauggaggagcacuugugcgaaauccgcuaucaaggaauaguacucaugaaauguauuggguaucaaaugcaacuggaaacauaguaucgucggugaacaugauaagccgaaugcuaaucaauagauucacaaugaagcauaagaaagcuacauaugaaccggacguggaucugggaagcggaacuagaaauauuggcaucgagaaugaaauaccaaauuuagacauaauagggaagcguauagagaaaauaaaacaggaacaugaaacuuccuggcauuacgaucaggaucacccauauaaaacuugggcauaucauggcucauaugagacaaaacaaacagggagugcauccucaauggugaauggagugguucguuugcuuacuaaacccugggacguugugccuaugguuacacaaauggcaaugacagacacaacuccguuuggccaacaaagaguuuucaaagaaaagguagauacuagaacacaagaacccaaagaaggaacuaagaaauuaaugagaauuaccgcagaauggcuauggaaagagcuaggcaaaaagaaaacuccacggauguguacuagagaagaauuuacaaggaaagucagaagcaaugcugcccucggugcaauuuucacggaugagaauaaauggaaaucugcaagagaagccguagaggauagucgauucugggaacucgucgaucgggaaagaaaucuacaucuagaagguaaaugugaaacuugcguauauaacaugaugggaaaaagagaaaagaaguugggggaauuugggaaagcuaaaggcagucgggcaauaugguauauguggcucggagcacgcuuucuagaguucgaggcgcuuggguucuuaaacgaggaccauugguuuagcagagguaauaguuugaguggaguagaaggagagggauuacauaaacucggguauauacuuagggacgucagcaagaaagaagggggugccauguaugcugacgauacugcugguugggacacgcguauaacacucgaagacuugaagaaugaagaaauggucacaaaucacaugaaaggcgaacauaagaaguuagcagaagcgauauucaaauuaacauaccaaaacaaagucgugagaguacaacgaccgacaccaagagguaccguuauggauauuauaucccgaaaggaucaaagaggcucuggacaaguaggaacguacggacugaacacuuucacaaauauggaggcacaauugauaaggcagauggaaggagaggggauauucaaaucaauccagcauuuaaccguaacugaagagauugcaguccgcaacugguuagccaggguugggagagaaagauuaaguaggauggcaauaaguggcgaugauuguguagucaagccguuggaugauagauucgcuucagcauuaacagcucucaaugacaugggaaaaguucguaaagauauccaacaaugggagccgucaagagguuggaaugauuggacacaaguaccauucuguucucaucauuuccaugaacuuguaaugaaagauggacgaguauuagucguuccgugccguaaucaagacgaacuaauuggucgagcccggauaagucaaggggcgggguggagucuaaaggaaaccgcgugccugggcaaaucauacgcccaaauguggaccuuaauguacuuucacagaagagauuuaagacuggcugccaacgcuauaugcucggccguucccucgcacuggguaccaacgucucgaacaaccuggucaauacacgcuaagcaugaauggaugacaaccgaagauaugcucgcgguauggaacagaguauggauacaagaaaauccauggauggaagauaagacgccaguagaaucaugggaagagguaccuuauuugggaaaaagagaagaucaaugguguggaagccugauugguuugacaagucgggcaacgugggccaaaaauauucaaacugcgauaaaucagguaagaucacugauagggaacgaagaauauacagauuacaugccauccaugaagagguuucgaaaagaggaagaagaggcuggagucuugugguaa

SEQ ID NO: 22587 - RNA, 9876 nt, Artificial Sequence
  derived and/or modified CDS sequence (opt6) from DENV-2__EU677145__SS-prME
acagccggaguaauuguaaugcugauuccgacggcaauggcauuucaucuuaccacacgaaauggugaaccacauaugauugugggacgacaagaaaaaggaaaaucguuacuuuuuaaaacagaagacggagucaacaugugcacgcugauggcaauagauuuaggagaacuaugugaagauacaauuaccuacaaauguccgcuuuuaagacaaaaugaaccagaagacauagacugcugguguaacuccacaucuacguggguuacauauggaacuugcacuacaacaggugaacauagaagagagaaaagaucaguagcuuuaguaccacacguagggauggggcuagaaacaaggacugagacuuggaugucuagugagggugcuuggaaacauguacaacgaauagaaacuuggauacuacgucauccaggauuuacuauuauggccgcaauauuagcguauacaauuggaacuacucauuuccaaagggcccucauauucauacuacucacagcagucgcaccuuccaugacuaugcguuguauaggaauaaguaacagagauuuuguggaaggcguuucuggagguucauggguugauauaguauuagaacacgguagcuguguaacaacaauggccaaaaauaaaccgacucuagacuuugaacuaauuaaaacagaagcaaaacaaccugcgacccuuagaaaauacuguaucgaggccaaauuaacgaauaccacuacagaauccagauguccaacgcaaggagaaccgucacuaaaugaagaacaagauaaaagauuuaucugcaaacauucaaugguugaccgcggauggggcaauggaugcggacuauuuggaaaaggggguauaguaacgugugcuauguucacaugcaagaaaaauauggaaggaaaaguuguucaaccggaaaacuuagaguauaccaucguaaucacgccucauucuggugaagaacaugcagugggaaacgauacaggaaaacacggcaaagaaauuaaaauaacuccacaaagcucaaucacagaggcugagcuaaccggcuauggcaccguaacaauggaaugcucuccuagaacaggccuugauuuuaaugagaugguauuacuccaaauggaggauaaagcaugguuaguacauagacaaugguuuuuagaucucccauuaccauggcucccaggcgcugauacucaagggucaaacuggauucaaaaagaaacgcuuguuacauucaaaaauccacaugcuaagaaacaggauguaguuguuuuaggcucacaggaaggggcaaugcacacugccuugacaggggcaaccgaaauucaaaugaguaguggaaauuuacuauucacgggacauuuaaaauguaggcuacgcauggacaaacuccaauuaaaagguaugagcuauagcaugugcacagguaaguucaaaauuguuaaggagauugccgaaacacagcauggcacgauaguaauaagaguacaauaugaaggagauggaaguccaugcaaaauaccuuucgagauuacagauuuagagaaacgucauguauugggccgucugaucacugucaauccuauuauaacggaaaaagauucaccggucaauauugaagcggaaccgccuuucggugauagcuacauaauaauuggcguugaacccggccaguuaaagcuaaauugguuuaagaaaggcuccaguauaggccaaauguuugaaacuacaaugcguggggcgaaacgaauggccauacuaggugauacagccugggacuuugguuccuuaggcggagucuucacuagcauaggaaaagcccuacaucagguauuuggugcaauuuauggcgcggcauucucaggaguuagcuggacgaugaaaauauugauaggaguaauaauaacuuggaucggcaugaacagcaggucaaccucgcugucaguaucuuuaguuuuaguuggaguuguaacccuuuacuuaggagcaauggugcaagcagacucugguugugucgucaguuggaaaaauaaggaacuaaaauguggaagcgguaucuuuauaacagacaauguacacacauggacagagcaguauaaguuccaaccggaaucaccgucgaaguuagcaucggcuauucagaaagcucaugaggaaggaauuugugguauacgcucaguuacaagguuagaaaaucuaauguggaagcaaauaaccccugagcuaaaucauauacuauccgaaaaugaaguaaaguuaacaauuaugacaggagauauaaaaggaauaaugcaagcaggaaaacgaucuuuacggccgcaacccacggaguuaaaauauaguuggaaaacgugggguaaggcgaaaauguugagcacagaaagucacaaucaaacauuuuuaauugauggacccgaaaccgcagaaugucccaauacaaaucgagccuggaacucuuuggagguggaggacuauggauuuggaguauuuacgacaaauauuugguugaaacuuagagaaaagcaagauguguuuugugauucuaaauugaugagcgcagcaauuaaggacaaucgagcaguucaugcagauaugggcuauuggauugaaucugcccuuaaugauacuuggaaaauggaaaaggcuuccuucauugaggugaaaucuugucauuggccuaaaagucacacuuuauggucgaauggcguauuagagucggaaaugauaauuccaaaaucauuugccgggccugucagccaacauaacuacaggccagguuaccacacgcaaacggcgggacccuggcaucucggaaaacuugagauggauuucgacuucugcgagggaacuacaguagugguuacagaggauugcgguaaccgaggcccuagcuuaagaacaacaacagcauccgguaaacuuaucacugagugguguugccguucuuguacauuaccuccucucagauaucgaggugaggaugguuguugguauggcauggaaauuagaccacuuaaggaaaaagaagagaaucuagucaauagccuggugacggcuggucaugggcagaucgacaauuuuucgcucggaguauuaggaauggcacucuuucuagaggaaaugcuccgaacucguguagggacgaaacacgccauucugcuaguagcggucucuuucguaaccuuaauaaccggcaauaugucuuuuagagaccuaggacgagucauggugaugguuggagcaacaaugacagacgauauaggcaugggaguaacguacuuagccuuauuagccgcguuuaaggucagaccuacguuugcagccggacugcugcuucguaaauugacaaguaaagagcuuaugauggcgacaauuggaaucgcacuauuaucucagagcacaaugccugaaacaauacuugaacuaacggaugcucuagcacuagguaugauggucuuaaaaauugugagaaacauggaaaaauaccaauuagcgguaacaauaauggcaauaucaugcguucccaaugcaguaauccuacaaaaugccuggaaggucaguuguacaauucuugcgacuguguccguauccccauuguuacucacuuccucucagcaaaaagcugauuggauaccucucgccuugacaauuaaaggauuaaacccuacagcaauauuuuugaccacuuuaucacgaacaagcaagaaaagaagcuggccuuuaaaugaagccaucauggcaguuggcauggugucgauauuagcaucgucacuacuuaaaaacgacauaccgaugacuggcccucuuguagcuggaggccuccuaacaguaugcuauguacuaaccggcagaagcgcagaucuagaauuggaaagggcagcagacguuaaaugggaggaucaggcggaaauaucgggauccucgccaauauuaagcauuaccauuagcgaagaugggucuaugagcaucaaaaaugaggaagaagaacagacuuuaacaauuuuaauacguacaggauugcuagucauaucaggaguauuuccaguauccaucccaauaacagcagcagccugguaucuuugggaagucaagaaacaaagagcaggaguguuaugggaugucccaucaccgccaccaguggggaaagccgaacuagaggauggugcuuaccgaauuaaacaaaggggaauccugggauacucccaaauaggcgcgggaguguauaaagaagggacuuuccacacgauguggcauguaacacgaggcgcuguauuaaugcaccguggaaaacgaaucgagccaucaugggcggauguaaagaaagaucugauauccuauggggguggcuggaaauuagaaggagaguggaaagaaggagaggagguacaaguacuugcauuggaaccaggcaaaaacccacgagcaguucagacgaagccuggaauauucaagacaaauacuggcacaauaggcgcagucucucuagauuucaguccagguacaagugguaguccaaucguggacagaaaagggaaaguuguuggauuguacggcaacggaguaguuacuagaaguggggcauauguaucagcaauugcccaaacagaaaaauccauagaagacaauccagaaauagaagacgacauuuuucguaagaaacgacuuaccauuauggauuuacacccaggggcuggaaaaaccaaaagguacuugccagccauaguuagagaagcaaucaagaggggauuaagaacgcuuaucuuagcaccaacccguguuguagcugcagaaauggaagaagcguuacgcggacugcccaucagauaccaaacuccugcuauacgagcugaacauacaggacgugaaaucguugacuugaugugucaugcaaccuuuacuaugaggcugcuaagcccaguucgcguaccuaacuacaaucuaauuauaauggaugaagcacauuuuacagacccagccagcauagcagcccgaggguauauuuccacgcguguagagaugggagaagcagcggguauuuuuaugacagccaccccaccaggaucaagagaucccuuuccccagucgaaugcacccauaauggaugaagaaagggaaauuccagagagaucauggaacaguggccaugaguggguaaccgacuuuaaggggaaaacaguaugguuuguacccagcaucaaagcuggaaacgauauagcggcuugucuucguaaaaaugggaagaaggugauacaacuaaguaggaaaaccuucgauucagaauacguaaaaacuagggcaaacgauugggauuucguaguuacaacugacauaagcgaaaugggcgcgaauuuuaaagcugaaagaguaauugauccccggagaugcaugaaaccuguaauauugaccgauggagaagaaagagugauacuagccggcccgaugccagucacucauucaucagcagcccaacggagaggccggaucggaagaaaucccaaaaacgaaaacgaccaauacauuuacaugggagagccgcuagaaaacgacgaagacugugcgcauuggaaagaagcaaagauguuauuagauaacauaaauacaccagaagggauuaucccaucuauguucgaaccugagagggagaagguugacgcaaucgacggagaguauagauugcguggagaagcccgaaaaacauucguggauuuaaugaggcggggugaucugccaguauggcuugcuuaccgaguagcugcagaaggaauaaauuaugccgaccguaaauggugcuuugaugggaucaaaaacaaccaaauauuggaagaaaacguagaaguagaaauauggacaaaagaaggugagaggaagaaauugaaacccagauggcucgacgcucgaaucuacagcgacccguuggccuuaaaagaauuuaaagaguuugcagcuggacgaaaaucgcugacccuuaaccuuauaacagaaaugggcagauuaccuacauucaugacccaaaaagcgagaaaugcauuggauaaucuggcgguguugcacacagcugaagcuggugggagagcauauaaucaugcuuuaagugaacugccagaaacgcuagaaacucucuuacuauuaaccuuauuagcuacggugacaggugguauauucuuauuccuaaugucuggcaaaggcauuggaaaaaugacguuggguauguguuguauuauaaccgcgucaauacuccucugguacgcacaaauucagccccauuggauugcggcgucaauaauucuagaguucuuucuuauaguguuacuuauaccugaaccugaaaagcaaaggacaccgcaagacaaucaauuaacguacguuguaauagcuauauuaacggugguggcagccacgauggcaaaugaaaugggauuccuggagaaaacgaagaaagauuugggauuaggaucuaucacuacacaagaaucggaaucaaauauccuugacauagauuuaagaccagcgucggccuggacauuauacgcaguggccacaacguuuguaacaccaaugcuuagacauaguaucgaaaauucgaguguuaauguauccuuaacugccauugcaaaucaggcaacaguauuaaugggguuaggaaaaggauggcccuugucaaaaauggacauagggguuccuuuauuagcaauagguuguuauagucaaguaaacccaauuacacuaacggcagcucuauuacuccuuguagcucacuacgcuaucauuggacccggacuucaggcaaaagcaacccgcgaagcucagaaaagagcugcugcagguauaaugaaaaauccaacaguagauggcauuacugugauagauuuagaaccgaucccauacgauccaaaauucgagaaacaauugggacaaguaauguuauugaucuuauguguuacacaaguuuuaaugaugaggacaacgugggcccuaugcgaggcgcuaacccucgcuacgggaccgauuaguaccuuaugggaaggcaacccugggagguucuggaacacuacaauugcuguaaguauggcaaacauauuucgcggcagcuaucuggcgggggcuggguugcucuuuaguaucaugaaaaauacgacaaauacucgaagaggaacagguaacauaggagaaacauugggggaaaaauggaaaagucgacuaaacgcacuugguaaaagugaguuccaaauauacaagaaaucaggaauccaagaaguugauagaacguuagcaaaagagggaauuaaaagaggagaaacugaccaucacgccgugaguagaggcucugcuaagcugcggugguuuguggaacgaaauaugguaacuccggagggaaaagugguugaccuuggauguggaaggggaggauggaguuacuauugcggaggucuaaagaacguccgagaaguuaagggucuuacaaagggaggucccggucacgaagaaccuguaccaaugucuacuuauggauggaaucucguaagguuacaaucggguguagaugucuucuucacacccccugaaaagugugauacauuacuaugugacauuggcgaaucguccccgaauccgacgauagaagcaggcagaacauugagaguacuaaacuuagucgagaacuggcuaaauaauaauacacaauuuuguauaaaaguguugaauccuuauaugccuagcguaauagagaaaauggagacacuccaaagaaaauauggaggggcacucguaagaaacccuuuguccagaaacaguacucaugaaauguacugggucagcaaugccacaggaaacauagucucuucagugaauaugauauccagaaugcuaaucaacagauucaccaugaaacauaagaaagcuacauacgaaccagauguggauuuggguucugguacccgaaacauagguauagaaagugagauaccuaacuuagauauaaucggcaagaggauugagaaaauaaaacaagaacaugaaacaucuuggcauuaugaccaagaucacccguauaagacgugggcauaucacgggucauacgaaacaaaacagacaggauccgcaaguaguaugguaaauggaguaguccgguuacucacaaaaccaugggacgucguuccgauggucacgcagauggcgaugacugauacgacgcccuucgggcaacaaaggguauuuaaagaaaagguugauacaagaacgcaggaaccaaaagagggaacuaagaaacuaaugaaaauaaccgccgaauggcucuggaaagagcugggaaagaagaaaacaccaagaauguguaccagggaagaauuuacaaagaaaguaagaaguaacgcugcgcuaggggcuauauucacggaugagaacaaauggaaaucugccagagaagcaguugaggaugguagauuuugggaacugguagauagggaaagaaauuuacaccuugaaggaaaaugcgaaacuugcguguauaauaugauggggaagagagagaaaaagcucggagaguucggaaaggcgaaaggaaguagggcuauuugguauauguggcuaggugccagauuuuuagaauuugaggcccuaggauuucugaacgaagaccauugguuuucucgaggaaauucucuuucugguguagaaggugaagguuugcaucgauuggguuauauucugcgcgagguaggcaagaaagagggaggagccauguaugcagacgauacugcgggaugggacacaagaauaacacuagaagaucucaaaaaugaagaaauggugacaaaccauaugaagggcgagcauaagaaauuagcugaagcgauuuuuaaacuuacuuaucaaaauaaagugguaaggguccaacgaccaacaccuagagguacagugauggacauaauaucgagaagagaccaaagaggaucagggcagguugggacauauggauugaauaccuuuaccaacauggaagcacaauuaaucagacaaauggaaggagaagggauuuuuaagucaauccaacaccuuacagcuacggaggaaauagcuguacaaaauuggcuugcuagaguagguagagagcguuuaagccgaauggcuauuuccggggaugauugugucgugaaaccuauagaugaucgguuugcaucggcucuuaccgcauugaaugauauggguaaaguccgaaaagauauacaacaaugggagccaucacggggauggaaugacuggacacaaguaccuuucuguagccaucacuuucacgagcuaguuaugaaagaugguagaguuuuagucguacccugucgcaaccaagaugaauugauaggcagagcacgcauaucucaaggcgcaggauggagccuaaaagaaacagcguguuuaggaaaaucuuaugcgcaaauguggacccugauguauuuucacagacgagaccugcggcuugccgcaaacgccauuugcagugcaguuccuagucauugggucccuacgagccgaacaacuugguccauacacgcaaaacacgaauggaugacaacagaagacaugcuagccguuuggaaucgaguguggauucaagaaaacccuuggauggaggacaaaaccccaguugaaucaugggaggaagugccauaucuuggcaaacgcgaagaucaauggugugguaguuugauaggacuuacgucaagggccacaugggcaaagaacauucagacugcaauaaaccaaguaaggaguuugauagguaaugaagaauauacugacuauaugccuucaaugaagcgguuucguagggaagaagaagaggcaggcguucugugguga

SEQ ID NO: 22588 - RNA, 9876 nt, Artificial Sequence
  derived and/or modified CDS sequence (opt6) from DENV-2__EU677146__SS-prME
acgguagguguuauaguaaugcucauaccuaccgcgauggcauuucacuuaacuacuagaaacggggaaccacacaugauuguuggaagacaagagaaagggaaaucacuguuauuuaaaacugaagacgggguuaauauguguacuuuaauggcaauugauuuaggagaauugugugaagacacaauuacauacaaauguccuuuacuaagacagaaugagccagaagacauagacuguugguguaauaguacaaguacgugggugaccuacggaaccuguacaacaacuggugaacacagacgagagaaaagaucgguugcacucguaccccacgugggaaugggauuggaaaccagaacggagaccuggaugucaagugaaggugcuuggaaacauguucaacgaauugaaacauggauccugagacacccagguuucacgauuauggcugcgauccuugcuuacacaauagggacuacccacuuucaaagagcuuuaauuuuuauuuuacuuacagcuguagcgccuucaaugacuaugagguguaucggaaucuccaaucgagauuuuguagagggaguuucgggaggcucuuggguagacauuguacucgaacacggcucauguguaacaacuauggcuaaaaacaaacccacauuagacuuugaauugauaaaaacggaagcaaaacaaccagcaacacuacguaaauacuguauugaagcgaaauuaacaaauacuaccacagagagucgauguccuacccagggagaaccaucucuaaaugaagaacaagauaaaagauucaucugcaaacacucaaugguggaccgaggaugggggaauggaugcggccucuucgggaaaggagguauaguaacaugcgcaauguucacuuguaagaaaaauauggaaggcaaagucguacuuccugaaaacuuggaauacacuauagucauaacuccccauucaggagaagaacaugcuguaggaaaugacaccggaaaacaugguaaagaaauuaaaauuacuccacaaucgucuaucacugaagcagaacuaacgggauacgguacaguuacuauggaauguaguccaaggacaggauuggauuucaaugagaugguacuccuucaaauggaagacaaagcaugguuaguacacaggcaaugguuccuagacuugccuuuacccuggcuaccaggagcugacacacaagggucuaauuggauacagaaagaaacauuaguaaccuucaaaaacccacaugcaaagaaacaagacguggucgucuuggguucacaagagggggcaaugcauacagcauuaacgggagcaacagaaauccaaaugucgucagguaaucuccuguuuaccggccacuugaaaugucgucuaagaauggauaaacuccaacugaaaggaaugaguuacucaaugugcacugggaaauucaaaauaguuaaagaaauagcagagacgcaacacgguacaauaguuaucaggguccaauaugaaggggacggcucgccauguaaaaucccauucgaaauaauggaucuagagaaacgacaugugcugggucgacuuauaacggucaauccuaucgucaccgagaaagauagcccaguaaauaucgaagcugaaccaccauuuggugauagcuacauaaucauuggggucgaaccaggccaacucaaacuaaacugguuuaagaaaggcaguaguauagggcagauguucgaaacuacaaugagaggggccaaaagaauggcaaucuugggugacacagcaugggauuuuggcagucuaggugguguguucacuagcauaggcaaagcacuucaucaaguuuucggcgcaaucuacggugcugccuuuucaggaguaaguuggaccaugaaaauucuaauaggaguaauaaucaccuggauaggcaugaauagucguucuacaucucugagcgucucauuaguauuaguuggaguaguaacacuauaccuugggguaaugguccaagcugacucagguugugugguuaguuggaaaaauaaagaauuaaaaugcggaucaggaauauucauuacagacaauguccauacuuggaccgagcaguauaaauuccaaccugagucccccucgaaacuugcaucugccauacaaaaagcgcacgaagaaggaauaugcggaauacguagcguuacccgauuagagaaucuuauguggaagcaaauaaccccagaacuuaaccauauccuguccgaaaaugaagcaaaacuuacaaucaugacaggagauauuaaggggaucaugcaagccggcaaaagaaguuuaagaccacagcccacugaauuaaaauauucauggaaaacaugggguaaagcaaagaugcuaucaacagaaucacauaaccaaacauucuuaaucgauggucccgaaacggcagagugcccuaauacgaacagagcuuggaacucacucgaaguagaagacuacgguuucgguguuuuuagcacuaauauauggcucaagcuaagggaaaagcaagauguuuucugugacagcaaauugaugucagccgcuaucaaagacaacagggcaguacacgcagacaugggauauuggauugaaucagcuuuaaacgacacauggaaaauggaaaaggcuucauucauagaaaucaaaagcugccacuggccuaaaucucacacauuaugguccaacggaguauuggaaucggagaugauaauacccaaaaauuuugcagggccugucucucaacauaauuacaggccaggguaucauacacagacggcgggcccuuggcaccucggaaaauuagagauggauuuugacuuuugcgaaggcacgacaguggugguaacagaagauugcgguaaccgcggaccuucacugaggacaacaacugcuagcgguaaauuaaucacagaguggugcugccggaguugcacucucccaccccuaagauaucgaggagaagauggguguugguaugguauggaaauacguccauugaaagaaaaggaggaaaaccugguaaauucacuuguaaccgcgggacaugggcaaauagauaauuuuucauuggggguacuagguauggcacucuuuuuggaggaaauguuaaggacucgcguugguacuaagcaugcaauauugcuuguugcaguaucguuugugacacuuauuaccggcaauauguccuuuagagauuuaggcagagucauggucaugguaggagcaacaaugacagacgauauaggaaugggcguaaccuauuuagcucuccuagcugcauucaaaguaagaccaaccuucgcugcuggauuguuacugaggaaguuaacaaguaaggaguugaugauggcuacaaucggcaucgccuuauuaagucaaucaaccauuccagaaaccauacuugaguugacugaugcgcucgcccuuggaaugaugguacucaaaaucguaagaaauauggagaaauaucaguuagcaguaacaauaauggccauuucaugugugccaaacgcagugauacuccaaaacgcauggaaagucaguuguacaauauuagcugcuguaaguguuagccccuuacucuugacaaguagccaacaaaaagcagauuggauaccucucgcucuuaccauaaaggguuugaacccaacagccauauuuuuaacuacauuaucgagaaccagcaagaaacgaaguuggccacucaaugaggcgguuauggcuguagggaugguuucuauccucgcuucuucacuacucaaaaacgacaucccuaugacugguccccuagucgcugggggacuguuaacagugugcuauguccuaacaggacgaagcgcagacuuagaacuagaaagagcugcagauguaaaaugggaggaucaagcugaaauaucaggauccucaccaauucuuucaaucacaauaagcgaggaugggucgaugaguaucaaaaacgaggaggaggaacauacauuaacaauccuaauaagaacgggucugcuaguaaucaguggcguauuuccgguuucaauuccgauuacagcagcagccugguaucuaugggaaguuaagaaacagcgagccggaguccuaugggaugucccuaguccuccacccgugggaaaagcugagcuggaagauggggcguacaggauuaaacagagagggaucuuugguuauagucaaauuggcgccgguguuuauaaagaaggaaccuuucauacgauguggcaugugacaagaggagcuguuuuaaugcaucgugguaaacgcauagagccuucaugggcagaugucaagaaagaccuuauuaguuauggaggaggauggaaacucgaaggggaauggaaagaaggagaagaagugcaggucuuagcacuagagccagguaaaaauccccgagcagugcaaaccaaaccuggccuuuuuaaaacgaauacugggaccaucggagcgguaucguuagauuuuucgccuggaacaagcggcucaccaauuguugauaggaagggaaaaguuguaggauuauaugguaauggugucguaacaagaagcggugccuacgucucagcaauugcucaaacggaaaagucuauagaagacaaucccgagauagaagaugauauauuuagaaagaaaagacuaacaauuauggacuuacauccaggggcagguaaaacaaaaagguauuugccagcaauugugagggaggcuauuaagcgcggauuaaggacucuaauauuggcgccaaccagaguaguugccgccgaaauggaagaagcacuccguggauugccuaucagauaucaaacuccggcgauccgggcagaacauacuggacgugaaaucguugaccuuaugugucaugcuacauuuacaaugcgcuugcugagcccgguuagaguuccaaauuauaaucuuauuauuauggaugaagcucauuuuacagauccugcuucaauagcugccaggggauauauaucaacaaggguagagaugggagaagcagcaggaauauuuaugacugcuacacccccggggagccgagacccauucccacaaucuaacgccccaauuauggaugaggagagagaaauuccugaaagaucauggaacucgggucacgaaugggugaccgauuuuaaagguaaaacaguuugguuugucccguccauaaaagccggaaaugauauagcugcaugcuuaaggaaaaaugguaagaaagugauucaauugucaagaaaaacuuuugacagugaauacguuaagacaagggcaaacgacugggauuucguaguaacuacugauauaucggagaugggagccaauuuccgugcagagagagugauagacccacgaagauguaugaaaccaguaaucuuaacugauggcgaagaacgcgugauucuggcuggaccuaugccagugacacacucuagcgcagcgcaacgacgugguagaaucgguagaaaucccaaaaacgaaaaugaucaguacauuuauaugggagaaccccuugaaaaugacgaagacugcgcacauuggaaggaagcuaaaauguuacuagacaacaucaacacuccagaaggcauaaucccuucuauguuugagccggagcgcgaaaagguugaugcaaucgacggugaguaccguuuacggggugaagcaagaaaaaccuuuguugaucuuaugcgacggggagaucuuccggucuggcuugcguauagaguugcagcggagggaauaaauuacgcugaucguaggugguguuuugauggcauuaagaauaaccaaauauuagaagagaacguagaaguggagaucuggacgaaagagggagaacggaagaaauuaaaaccaagauggcuagaugcgagaaucuacagugauccguuggcccuaaaagaguucaaggaauuugcggcggguagaaaaagucuaacucuaaacuugaucacugaaauggggagacuaccuacauuuaugacucagaaagcgcgagacgcucuagacaaccucgcuguucuacauacggccgaaguaggaggcagagcauacaaucaugcucugucagaacuaccagaaacgcuugagacacuauuacucuuaacacuacucgccacuguaacaggggguauauuucuauuuuuaaugaguggaaaaggaauaggaaaaaugacccuaggaauguguuguaucauaacagccagcauauuguuaugguaugcucaaauacaaccacauuggauagcagcaucaauuauacuggaguucuuucugauagucuuacuaauaccugaaccugagaaacaaaggacuccacaagauaaucaauuaaccuacgugguuauugccauuuuaacagucguagcggcgacaauggcaaacgaaaugggcuuucuagaaaagacuaagaaagauuuaggacuaggaaguauuacaacccaagaaucggaaucuaauaucuuagauaucgaucugaggccagcgagugccuggacauuauaugcuguagcgacuaccuuuguuacaccaaugcuacgucauaguaucgaaaauaguucaguaaauguaucccucacagcaaucgcaaaucaagcaacaguauuaaugggucucggaagaggcuggccacuaaguaaaauggauauuggagugccauugcuugccauaggauguuauucucaaguuaauccaauuacauuaacagcagcucugcucuugcuaguugcccacuacgcuauuauuggaccaggauugcaagccaaagcaaccagagaagcacaaaagagaacugcugcaggcauuaugaaaaauccaaccguagaugguauaacgguuauagaccuugaaccaauacccuaugauccaaaauucgaaaaacaacugggacaaguuauguuauuaguccugugugucacacaagugcuaaugaugagaacuaccugggcuuugugugaagcacuuacguuagccacaggacccauaaguacccuuugggaagguaacccaggcagauuuuggaacaccaccauagcgguaucuauggcuaauauuuuccgugguucauaucucgcgggcgcuggacuuuuauucaguauuaugaaaaacacgacgaauacuagacgggguacagguaacaucggugaaacccuaggcgaaaaauggaaaagcagacucaacgcauuagggaaaucugaauuucaaaucuacaagaaaucagguauucaagaaguagacaggacauuagccaaagagggaauaaaacgcggagaaaccgaccaucacgcaguaucaaggggaucagcuaagcugagaugguucgucgagcggaauaugguaacuccagaggggaaaguaguggacuuggguugcggaagggguggauggucguacuacugugggggccugaagaacgucagagaagucaagggguuaacaaaaggcggcccaggacacgaagaaccaaucccgaugaguacguacggauggaacuuaguaagauuacaaucaggcguugauguuuucuuuacacccccugagaaaugugauacacuauuaugugacauaggugaaucaaguccuaaccccacuauagaggcaggacgaacauuaaggguccuuaaucuaguagagaauuggcuaaauaauaauacgcaguuuugcauaaaggucuuaaacccauauaugccgagcgucauagaaaagauggaaacucuacaacgaaaauauggaggugcucugguaaggaacccucucagucgaaauaguacacaugagauguacugggucaguaaugcaacaggaaacauugucagcuccgucaauaugauaaguagaauguuaauuaauagguucacuaugaaacacaagaaagcaacauaugaacccgauguagaccucgguucggguacgagaaauaucggaauagaaaaugagauaccuaaucuggacauuauaggaaagagaauugagaaaauuaaacaggagcaugaaacaucauggcacuacgaccaggaccaccccuauaagaccugggcauaucaugguucauaugaaacaaaacagacagguucagcauccagcaugguuaauggaguaguuaaauuauugacgaaaccaugggacguaguaccuauggucacacagauggcaaugacggacacuacaccuuuuggucagcaaagaguuuuuaaggagaagguggauacgagaacucaggaacccaaagaagguacgaagaaacuuaugcgcauuaccgcugaaugguuauggaaagagcugggcaagaagaaaacgcccagaaugugcacccgcgaagaauuuacgcguaagguucgcucaaaugcagcacuuggagcaauauucacagacgaaaacaaauggaaaucagcucgugaagcggucgaagacaguagguuuugggagcuaguagauagagaacgcaaucuacaucucgaaggaaaaugugaaacaugcguauauaauaugauggguaaaagagagaagaaauuaggugaguuuggaaaagccaaagguagcagggcaauaugguauaugugguuaggagcaagauucuuagaguuugaagcacuuggguucuuaaaugaagaccauugguuuagcagagggaauagucuuagcgguguugaaggugaaggacuacauaaauuaggguauaucuuaagagauguaagcaagaaagaaggcggggcuauguaugcagaugauacugccgguugggacacuagaauaaccuuagaggaccuuaaaaacgaagagaugguaacaaaccacaugaaaggagaacacaagaaacuagcggaggcgauauucaaacuaacauaucaaaauaaaguaguuagaguucaaagaccuacaccaagaggaacaguuauggauauaauuucacggaaagaccaaagaggaucuggacaaguggguacuuauggacuuaacacauucacgaacauggaagcucaauuaauacgccaaauggaaggggaagguauuuuuaaaucaauucaacguuugacaguaacugaggaaaucgccguacaaaauugguuggcuagaguuggcagagaaagguuaagucgaauggcuaucagcggcgaugauugugucguaaaaccacuugaugauagauuugccuccgcguugaccgcucuuaaugauauggguaagguaaggaaagacauacaacagugggaacccucgagaggcuggaacgacuggacccagguaccguuuuguagucaccauuuucacgaauuaguaaugaaagauggucgggucuuaguuguaccauguagaaaccaagacgaauuaauuggacgagcgagaauaagccaaggugcaggcugguccuuaaaagaaacggcaugucugggaaaaucuuacgcgcaaauguggacuuuaauguacuuucacaggagagauuuaagauuggcggccaaugcuauuuguagcgcugugccaucacacugggugcccacuucaagaacuaccuggucaauccaugcgaaacacgaauggaugacaacggaggacaugcuugcugucuggaaucgggucuggauccaagaaaauccauggauggaggauaaaaccccaguggagucaugggaagaaguaccauaucuaggaaaacgggaagaucaaugguguggcucauugaucggauugacuucacgagcuacgugggccaaaaacauucaaacugcaauaaaucaagucagaucauuaauagguaacgaggaauacaccgauuauaugcccucaaugaagcgcuuucgcaaagaagaagaagaggcaggaguacugugguga

SEQ ID NO: 22589 - RNA, 9876 nt, Artificial Sequence
  derived and/or modified CDS sequence (opt6) from DENV-2__EU687214__SS-prME
acugcugggguaauaauaauguugauuccuacugcaauggcuuuccauuuaacgacaagaaauggcgaaccucacaugauaguaggaagacaagaaaaaggaaaaucuuugcuuuuuaaaacagaagauggggucaauauguguacuuuaauggcaauagacuugggagaacuaugcgaagauacuauuacauauaaauguccuuuauuacgccaaaaugaaccggaagauaucgauuguugguguaauuccacaaguacauggguuacguaugguacguguaccacaacaggagaacauagaagagagaaaagaucgguugccuuaguaccacacguugggaugggauuagaaacacguacugaaacuuggaugaguucagaaggugcguggaaacauguucaaaggauugaaacuuggauacugcgccacccuggauuuacaauuauggcagcaauccuugcuuauacaauagggaccacacauuuccaaagggcgcuaauauucauuuuauuaacggcaguggcgccaagcaugacaaugagaugcauugguauuucgaaucgugauuucguagaagggguaagcggaggcucguggguggauauaguuuuagaacacggaucauguguaaccacaauggcuaaaaauaaaccaacauuggauuuugaacuaauaaaaaccgaagcaaaacagcccgcaaccuuacguaaauauuguauugaagcaaaauugacaaauaccacuaccgaaucacgcugcccuacccaaggugaaccaucgcucaaugaagaacaagauaaaagauuuaucuguaaacauaguaugguagauaggggauggggaaauggauguggauuauuuggcaagggagguaucgugacaugugcaauguucaccuguaagaaaaauauggaaggaaaaguaguucugccagaaaacuuagaauacaccauugugauaacaccccauuccggugaagaacaugcagucggaaacgacaccgguaaacacggcaaagaaaucaaaaucacaccgcaaucuuccaucacugaagcagaacuaacaggguacgguacagugacaauggaauguucaccgaggacuggauuagacuucaaugaaaugguacuguuacagauggaagauaaggcuugguugguacaucggcaaugguuuuuggaucugccauuaccguggcuuccuggagccgacacucaaggaaguaacuggauacaaaaagaaaccuuaguuacauuuaaaaacccccacgccaagaaacaagacguuguuguacugggaagccaagaaggagcaaugcacacugcucuaaccggcgcaacagaaauacagauguccucgggcaaucuacuuuuuacuggucacuugaaaugccgacuacguauggauaaguuacaacucaaagguaugucauauagcaugugcacaggaaaauuuaaaauaguaaaagaaauugcugaaacacaacacgggacaauaguaauccggguccaauaugaaggugauggaucaccauguaaaaucccuuucgaaauaauggauuuagaaaagcggcacguucuagggagguugauuacuguaaacccuauaguaacugaaaaagauucaccaguaaacauagaagccgaaccuccauuuggugacuccuauauaauaauuggaguugaaccuggacaacuaaaguugaauugguuuaagaaagguaguucaaucgggcaaauguuugaaacgacaaugagaggagcgaaaaggauggcuauauugggagauacagcuugggauuuuggaagucuaggagggguguuuacaucuaucggaaaggcccugcaucaaguauuuggugccauuuauggugccgcguuuaguggugucaguuggaccaugaaaauccugauuggugucauuauuacauggauaggaaugaacucccguagcaccucccuuucagucagccuaguguuaguagguguagucacauuauacuuagguguaaugguacaagccgacacaggguguguggugucauggaaaaauaaagaacuuaaaugcggaagcgguaucuucauuacugacaauguacacacauggacagaacaauauaaauuccaacccgaaagucccaguaaacuagccucggcaauucagaaagcacacgaggaaggaauuuguggaauacgaucagucacaagauuagaaaaccuaauguggaaacaaauuacucccgaacuaaaucauauauuaucagaaaacgaagugaaacuuacuauuaugacaggagauauuaaagggaucaugcaagcaggaaaacgcucucugcgaccacaaccuacggaacucaaauacaguuggaaaaccuggggcaaagcuaaaauguuaucaacagaaucacacaaccaaacguuucuuauagauggaccagaaacagcagaaugcccgaacacaaaucgagcauggaacucgcuggaaguagaagauuaugguuuuggcguauuuagcacaaacauaugguugaaacuucgggagaaacaagacguauucugcgauucgaaauuaaugucggcagcgaucaaagacaauagagcuguucacgccgauaugggguacuggauagagucugcauuaaaugacacguggaaaauggaaaaagccucauuuauagaaauaaaaaguugccauuggccaaaaucacauacucuauggaguaauggugugcuggagucagaaaugauuauuccuaaaaacuuugcagggccaguuucccaacauaauuaucguccuggauaucacacucaaacagccggaccuuggcaccuuggaaaacuugagauggauuucgauuuuugcgaggggacaacuguuguaguaacagaagauugugguaaucgagggccgaguuugagaacaacaacagccuccggaaaacuaaucacagaaugguguugucguagcuguaccuuaccuccccuuagauacaggggcgaagauggauguugguauggcauggagauuaggccacuuaaggagaaagaagagaaucuuguuaauucauuaguaacggcuggacacgggcaaauugauaauuuuucauugggcguucuaggaauggcucuuuucuuggaagaaaugcuaagaacuagagucggaacaaagcacgcgauccuccuugucgcagucagcuucgugacuuuaauuacaggaaauaugucauuucgugacuuggguagggugaugguaaugguaggggcaacaaugacagacgauauugggauggggguaacauaccuagcccuuuuagcugcuuucaaaguuaggccgacauucgcggcuggcuuauuacuucgaaaguuaacaucgaaagaauuaaugauggcuacaauuggcauagcgcuuuuaagccagagcaccauacccgaaaccauuuuagaauuaacagacgcauuagcacucggaaugauggugcuaaaaauaguaagaaacauggaaaaauaccaauuagcaguuacaaucauggcaauaagcuguguaccuaacgccguaauacuucagaacgcguggaaagugagcugcacgauacuagcagccguaucuguaucaccuuuguuauugacuagcagccaacaaaaagcagacuggaucccauuagcacugacuauuaagggauuaaauccuacggcuauuuuccuuacgacgcuaaguagaacgucaaagaaaagaucguggccauuaaacgaagcgguuauggcagucgguauggucucaauauuggcaucuucucuacuaaagaaugauauaccuaugacgggaccauuaguggcaggaggacuacugacaguuuguuauguacuaacuggaagauccgcugaccuagaacucgagagagcagcggaugucaaaugggaggaccaagcugaaauuaguggaagcucacccauucuauccauuacuauaagcgaagacggcagcaugagcauuaaaaaugaggaagaagaacacacacuaacaauucuuauuagaacaggauuauuaguaaucucuggaguuuuuccuguaaguauuccaauuaccgccgcugcuugguaucuaugggaaguuaaaaagcagagagccgguguccugugggauguaccuucuccaccuccaguggguaaggcagaacuagaagauggugcuuaccguauuaaacaaagaggaauauuuggauauucacaaauaggugcaggcguguauaaagaagguacuuuucauaccauguggcacguuacaagaggagcuguacuuaugcaccgcgguaaaagaauagaacccucaugggcagaugugaagaaggaccuaauaaguuauggaggugguuggaaauuagagggagaauggaaggaaggagaagaagugcaaguguuagcccuagaaccuggaaagaauccaagagcaguccagacaaaacccggguuauuuaagacaaacaccgguacaauaggcgcugucucuuuggauuuuucuccaggaacaagugggucaccuauuguugacaggaaaggcaagguuguaggacuuuauggaaacgggguaguaacccgcagcggcgcauacguaucagcuauagcacaaacagagaaaucuauagaagacaacccagaaaucgaagacgacaucuuucguaagaaaagacuaacuaucauggaucuucauccgggagcgggcaaaaccaaaagauaccuaccugcaauaguacgggaagcaauaaaaagaggacugcguacguugauacuagcacccacacggguagucgcggcagaaauggaagaagccuugcgaggauuaccuauccguuaccaaacuccugccauacgcgccgaacacaccggaagggaaauaguagaucuuaugugucaugcaaccuucacuaugcguuuauugagcccaguucgagugccaaauuacaaucuuaucauuauggacgaagcgcauuucacagaccccgcgucuauagcagcaaggggauacauuagcacaagaguagaaaugggggaagcggcgggaaucuucaugacggccacuccaccagguagucgagaucccuucccccagaguaaugccccuaucauggaugaagagagggaaauaccggaaagaucuuggaacagcggacaugaaugggugacaaauuuuaaagguaaaacagugugguucguuccaucgauaaaagcgggaaaugacaucgcagcuugccucaggaaaaauggcaaaaaggucauacaacucaguagaaagacauuugauuccgaauauguaaaaacgcgagcuaacgacugggacuucgucgugacaacagauauaucagaaaugggugcgaauuuccgcgcggaaagaguuauagauccccgaagauguaugaaaccggugauacuuaccgacggugaagaaaggguuauuuuagcagguccuaugccaguaacacacucauccgcagcucaacgacgcggacggauuggcagaaacccgaaaaaugagaaugaccaauauaucuacaugggggagccacucgagaacgacgaagacugugcucacuggaaggaagcuaaaaugcuacuagauaauauuaacacgccugaaggaauuauuccuagcauguucgaaccugaaagagagaaagucgacgcgauugacggcgaguauaggcuaagaggugaagcaagaaaaacguuugucgauuugaugaggcgaggagaucuaccaguauggcucgcuuauagagucgcggcagagggaaucaauuacgcugaccgacgguggugcuuugacgguauuaagaacaaucaaauauuggaagaaaauguugaaguagaaauauggacuaaggaaggggaacguaaaaaguuaaaaccgagaugguuggacgcacguaucuacagugacccgcuagcccuuaaggaguucaaagaguucgcugccgggcgcaaaucucugacacuuaauuuaauuaccgagaugggacgacuaccuacuuucaugacucaaaaagcucgcgacgcuuuagauaauuuggcgguauuacauacggcagaaguagguggacgagcauacaaccacgcgcuaagcgaauuaccagaaacauuagagacccuauuacuucuuacccuacuugccacagucacaggagguauauuccuauuuuugaugagcgguaagggcauaggaaaaaugacauuaggaaugugcuguauaauaacagccucaauuuugcucugguaugcgcagauccaaccccauuggauugcugccaguaucauuuuagaguucuuuuugaucguuuuauugauuccggaaccugaaaaacaaagaacaccccaggauaaucaauuaacguacgucguaauugcuauacuuacuguaguagcagcaacaauggcgaacgagaugggguuccuggagaaaacuaaaaaggaucuaggguugggaucaauuacaacccaggaaucagaauccaauauauuagauauagaucugcgcccugccagcgcauggacuuuguacgcuguagccaccacauucgucacgccgauguugcgacauucgauugaaaacaguagcgugaacgucaguuuaaccgcuaucgcgaaccaggcaacaguuuuaauggggcuaggaaggggguggccauuaucgaaaauggacauuggcguaccucuacuagcaauaggcuguuacucgcaggucaacccuaucacacuuacagccgcacucuugcuauuaguagcgcacuaugccauaauaggaccuggacuacaagccaaagcuacuagagaagcgcagaaaaggacugcagcuggaauaaugaaaaauccgacaguagacggaauaacggugaucgaucuagaaccaauaccauacgauccgaaauucgaaaaacaacuuggccaagugaugcuuuuaguucuauguguaacccaaguauuaaugaugagaacaacaugggcacugugcgaggcauuaacauuagcaacuggcccuauuuccacucucugggagggaaauccggggagauuuuggaauacgacaauugcgguaucaauggcuaacauauuucgggguucauacuuagcuggagcuggguuacuauuuagcauuaugaaaaacacuacuaauacuagacguggaaccgggaauaucggagaaacacuaggcgagaaauggaaaagcagauuaaaugcauuggggaaaagugaguuccaaaucuauaagaaaucuggaauacaggaagucgacagaacauuggcaaaagaaggaaucaaaagaggagaaacugaucaccacgcuguuagcagaggauccgcuaaacuacgaugguucguugaaagaaacaugguuacaccggaaggaaaaguagucgacuuagguuguggaagaggggguuggucuuacuauugcggcggacucaaaaauguacgggaaguaaaaggauuaaccaaaggagguccaggucaugaagaaccaauuccaaugaguacauaugguuggaauuugguuagacuacagucaggaguggauguguuuuucacucccccggaaaaaugugauacgcuuuuaugcgauauaggcgaaucaaguccuaauccaacaaucgaagccggaaggacccugaggguccuuaaccuagucgaaaacugguuaaauaacaauacacaauuuugcguaaaaguacuuaauccauacaugccaucaguaauagagaaaauggaaacauugcaacgaaaauacggcggagccuuaguaagaaauccucuaucgagaaauucuacgcaugagauguauuggguaucaaacgcgaccggaaauauagugucgaguguaaacaugauaagccgaaugcuuauuaacagguuuacaaugaagcacaagaaagccaccuacgaaccagauguagaucuagguaguggaacacgaaauauugguauagaaaacgaaauacccaaccucgauaucauaggaaagcguauagaaaagaucaagcaagagcaugaaacaucauggcauuacgaccaggaccauccuuauaagacuugggcauaccauggaucauacgaaaccaaacagacagguucggcaucgaguaugguaaauggaguagucaaauugcuuacaaagccaugggaugucguacccaugguaacucaaauggcaaugaccgauacaacaccguuugggcaacaacgaguguuuaaagaaaaaguggauaccagaacacaagaacccaaagaaggaacuaagaaauuaaugcgcauaacagcagaaugguuauggaaagaacuaggcaagaagaaaacacccagaauguguacuagggaggaauuuacacguaaaguccguagcaaugcagcacuuggugccaucuucacggacgagaacaaauggaaguccgcgagagaggcgguugaagacagucgguucugggaauuaguugauagagaacgaaaccuacaucuugaagggaaaugcgaaacauguguuuacaacaugaugggaaaaagagagaaaaagcuaggcgaguucgggaaagcuaagggaucacgugcgauaugguacaugugguuaggggcacgauuuuuagaguucgaagcccuuggauuuuuaaaugaagaccacugguucagucgaggaaacagucuaagcggcguugagggugaaggccuacauaagcucggauauaucuuacgugacgucucaaagaaagaagguggggcaauguaugcugacgauacagcagggugggauacacgcauuacauuagaagaucuuaaaaaugaagaaaugguaacaaaucauaugaaaggcgaacauaagaaacuagcugaggcgauauuuaaauuaacauaucaaaauaaaguggugagaguucagcgaccuaccccaagaggaacaguuauggauauuauaagccguaaggaucagagaggcaguggucaaguagguacauacgggcugaacacuuucaccaacauggaagcccaguuaauacgccaaauggaaggagaagggauuuuuaagaguauccaaagacuuaccgugacagaagaaauagcuguacaaaacuggcucgcacguguuggacgagaaagacuaucacgaauggcuaucucaggcgacgacugugugguaaagccauuagaugaccgauuugcaagugcucucauugcauuaaacgacaugggaaaaguacgaaaggauauacaacagugggaaccaucucgaggcuggaaugauuggacacaaguaccauucuguucgcaucauuuucacgagcuaguaaugaaggaugguaggguucuuguaguuccaugcagaaaccaagacgagcugauuggacgcgcuagaauaucgcaaggggcaggcuggaguuuaaaagaaacagccugccuggggaaaucguaugcucaaauguggacucugauguacuuucauagacgugauuuacgguuagccgcgaaugcaauuuguagcgcuguacccagucauuggguucccacaucucgaaccacuuggagcauucaugcuaaacacgaauggaugacaacggaagacaugcuggccgucuggaauagaguauggauccaagagaauccuuggauggaagauaagaccccgguagaaagcugggaagaggugccauauuuaggaaagcgugaagaccaaugguguggcuccuuaauaggacucaccucaagggcaacaugggcuaaaaauauacaaacagcaauaaaccaaguccgaucuuuaauaggcaacgaagaauauaccgauuacaugccguccaugaaacgauucaggaaagaagaggaagaggcaggagugcugugguag

SEQ ID NO: 22590 - RNA, 9876 nt, Artificial Sequence
  derived and/or modified CDS sequence (opt6) from DENV-2__EU687215__SS-prME
accgcaggaguaauaaucauguugaucccaacagcuauggcguuccauuuaacaacuaggaauggugaaccacacaugauaguugguaggcaagaaaaagguaagagucugcuguuuaaaaccgaagacgguguaaauauguguaccuuaauggccauagaccuaggagaguuaugugaggacacaaucacauauaaaugcccccuauuaaggcagaaugaaccggaggauauagauugcugguguaauuccacuucuacgugggucacguacgggacauguacuacaacuggcgagcaucgcagggaaaaaagauccguagcccuaguuccacauguaggaaugggacucgaaacacgcacagaaacguggaugaguuccgaaggcgcuuggaaacacguccaacggaucgaaacauggauauugcgacacccuggauuuacgaucauggcggcgaucuuagcauauacuaucggaacaacucacuuccagcgggcccuaauauuuauacuauuaaccgcaguggcuccaaguaugacaaugcgauguauaggcauuucgaaccgugauuuuguggaaggagucucaggagguaguuggguagacauaguuuuggaacaugguuccuguguuacgacuauggcaaaaaauaagccaacucuagacuucgaacuaauaaaaaccgaagcaaaacaacccgcaacacuaagaaaauauugcauagaagcuaaguuaacgaacacaacaacugaaucucguugcccgacacaaggcgaaccuucucugaaugaagaacaggauaaaagguucauuuguaaacauagcauggucgauagagguugggguaauggaugcgggcuguucggaaagggcggaauagugacgugugccauguuuaccugcaaaaaaaauauggaaggaaaaguaguucugccugaaaaucuugaauauacuauaguaauaacaccacacuccggcgaagaacacgcgguaggcaacgauacagguaaacauggcaaggaaauaaagauaacaccacaauccagcauuacggaggcagagcucacaggcuacggcacuguaacaauggaauguucaccucggacuggucuagauuucaaugaaaugguucuacuacaaauggaagacaaagcaugguuaguccacaggcaaugguuccuugaccuaccuuuaccuuggcucccaggggcggauacacagggaagcaacuggauacaaaaagaaacccuagucacguuuaaaaacccacaugcaaagaaacaagauguggucguacuaggaagucaagaaggcgcaaugcauaccgcccuaacuggagcuaccgaaauacagaugagcucagguaauuuacuuuuuacggggcaucucaaaugccgacuucgaauggacaaacuacaacuaaaagguaugaguuauucaaugugcacaggaaaauuuaaaauugugaaagaaauagcagagacccagcaugguaccauuguaauacgaguacaguacgaaggugaugguagucccuguaaaauuccauuugaaaucauggauuuagagaaaagacacguauuaggaagacuaaucacuguaaacccaaucguaacagaaaaagacucuccagucaauauagaagccgaaccaccguuuggagacucuuacauaauuauuggcguugaaccuggccaauugaaauugaauugguucaaaaaaggaagcagcauuggccaaauguuugaaacaacaaugaggggggccaaacgaauggccauuuugggugauacagcgugggauuucggaagucucggcgggguauuuacaucuauagguaaggcauuacaucaaguguucggagcgauuuauggugcagcauuuagcggagucucauggacuaugaaaauacugaucggagucauuauuacuuggauagggaugaacagcagaaguacgagucugagcguaucuuuagucuugguaggaguaguaacucuauauuuagguguaaugguacaagccgauacuggauguguaguaaguuggaaaaacaaggaacuaaaauguggaucaggaauauuuauaacagacaauguacacacauggacugaacaauacaaauuucaaccagaaucuccaucuaaauuggcuucagcgauacagaaagcacacgaagaggggauaugugguauaagaucaguuacuagguuggaaaauuuaauguggaaacaaaucacgccugaacuaaaccauauuuugucagagaaugaagucaaacuuaccauaaugacuggagacauaaaggggauaaugcaagcaggaaaacguucucuaagaccucagccuacagaacuaaaauauucguggaaaacaugggguaaagcaaaaaugcuuucaacagaaucccauaaccaaacauuuuugauagauggaccggagacagcggaaugcccuaauacaaacagagcguggaacagucucgaaguugaagacuauggauuuggugucuuuucaacaaauauauggcuaaaacuuagagagaaacaagauguuuuuugcgauucaaaacucaugagcgccgcaauaaaagacaaccgagcuguacacgcagacaugggauacuggauagagucugcacugaacgacacguggaaaauggaaaaggcaucauuuauagagauaaaaucaugucauuggccuaaaucccauacuuuguggucgaacggaguacucgaaucugagaugauuauuccaaaaaacuucgcaggaccaguuucucaacacaauuaccgaccuggauaccacacucaaacagcaggccccuggcaucuugguaaauuagagauggauuuugauuuuugcgaaggaacaaccguagucgugacagaagacugugggaacagaggaccaucucuaagaacgacuacggccagugggaaguugauaacugagugguguuguagaucaugcacuuuaccacccuuaagguaucgaggugaggaugguuguugguacgguauggaaauuagaccauugaaagaaaaagaagaaaacuuaguuaacucacuagugaccgcuggucacggccaaauagacaauuucagucuaggaguauugggaauggcacuauuccuagaagaaauguugcgcacaagaguagguacaaagcaugcuauacuccuagucgccgugagcuucguaaccuuaaucacagggaacaugucauuccgagaucucggaagaguaaugguuaugguuggugcgacaaugacggaugacaucggaaugggaguaacauaucuugcacuccuagcugcuuuuaaagugcgaccaacauuugcagcaggacuauuacuaagaaaacuaacuucgaaagaacuuaugauggcgaccauaggaauugcacuccucucucagucgacuaucccugagacaauauuagaacuuacugaugccuuggcacugggaaugaugguguuaaaaauaguucguaacauggagaaauaccaauuggcaguuacaauaauggcaaucucuugcgucccuaaugccguaaucuuacagaacgccuggaaagugagcuguacaaucuuagcggcagugucuguuucaccguuauuauuaaccuccagccagcagaaagcagauuggauuccgcucgcuuuaacaauuaaaggguuaaacccaacugcuauauuuuugacuacccugucccgcacuucaaaaaaacgaucuuggccauugaacgaagcuguaauggcaguugguaugguaucaaucuuagcguccucuuuacuaaaaaacgauauaccaaugacagguccgcuggucgcagguggacugcucaccguaugcuauguccuaaccggcagaucugcagaucuugaauuagaacgcgcugcggacguuaaaugggaagaccaagcggaaauaaguggaucaucacccaucuugucuaucacuauaucugaagauggaaguaugagcauuaagaaugaggaggaggaacauacauuaacaaucuuaauuaggacaggcuuauuagucaucucgggaguguuuccaguauccauaccuaucacagcagcugcaugguaucuaugggaaguuaaaaaacagagagcuggaguucuaugggaugugccuucuccuccccccguaggaaaagcugaacuagaagacggagcuuauagaaucaaacaaagagguauuuucggauacagucagauuggggcaggaguauauaaagaagguacauuccacacuauguggcacguaaccagaggugcaguauuaaugcauagagggaaacguauagaaccaucuugggccgaugucaaaaaagaccuaauuuccuaugggggaggcuggaaacuagaaggugaauggaaggagggagaggaagugcagguacuugcgcuugagccagguaaaaacccacgagcaguucaaacaaagccagggcuuuuuaaaacuaaaacuggaacgauuggagcagucucccuggauuuuaguccuggcacauccgguucacccauaguggauaggaaagguaaaguugugggguuauauggaaauggagucguuacacguuccggggcauaugugucggcaaucgcacaaacagaaaaaagcaucgaagacaaucccgaaauugaggacgacauauuccguaaaaagcgccucaccauuauggaucuacacccgggagcugguaaaacgaagagguauuugccugcuauaguuagggaagccauuaagagaggacuuagaacgcugauucuugcaccaaccagaguaguggcagcugaaauggaagaagcccuaaggggucugccuaucagguaccaaacaccugcaauucgugcugagcauacaggucgggaaaucguugauuuaaugugucaugccacuuuuacgaugaggcuacuuaguccagugagggugccuaacuauaauuuaauaauaauggacgaagcucauuucacagauccagccucaauagcugcccggggauauauaaguacgaggguagaaaugggcgaggcugccggaauauucaugacugcuaccccaccaggaagccgagauccauucccccaaucuaacgcaccaauaauggacgaagagagagagaucccagaaaggagcuggaauucaggccaugaauggguuacagauuuuaaaggaaaaacagucugguucguacccucaauaaaggccgguaaugacauagcugccugccuuaggaagaacggaaaaaaagugauucaacuuaguagaaaaacuuucgacagugaauauguaaaaacucgagccaaugauugggauuucguugucacuacagauaucucagaaaugggggcuaauuuccgugcagaacguguaauagauccuaggcguuguaugaaacccgugauuuuaacagauggggaagaacgagucauacuugcugguccaaugccugucacacauucaagugcagcucaaagaagaggaaggaucggcagaaacccaaaaaacgaaaaugaccaguauauauacaugggcgaaccguuagaaaaugacgaagacugugcgcacuggaaagaagcgaaaaugcuuuuggacaauauaaacacuccagaggguauuauuccaaguauguuugaaccugaacgagagaagguugacgcgaucgacggagaauaucgccuaagaggugaagccaggaaaacguuuguugaccuaaugcguagaggugauuuaccaguaugguuggcauaucgagucgcagcagaagguauaaauuacgcugaucguagauggugcuuugacgguaucaaaaauaaucagauacuggaagaaaacguugagguggagauauggacuaaagagggagaaagaaagaaacuuaagccucgguggcuagacgcaaggauauauuccgacccacuugccuuaaaagaguuuaaagaauuugcagcagggaggaaaagcuuaacccucaauuugaucaccgaaaugggaagacucccgacauuuaugacacaaaaagcuagggaugcuuuagauaaucuagcggugcuacauacggcagaaguugguggacgagcauauaaccaugcacuaucugaauuaccagagacauuagagacacuguuguuacuaacccuuuuagcgaccguaacuggagguauauuccuauuucuaauguccgguaagggaauaggaaagaugacacuugguauguguugcauaauuacugcaagcauacuccuaugguaugcacagauucagccucacuggauagcagcgagcauaauauuagaauucuucuuaauagugcuuuugauuccagaaccugaaaaacagcgaacuccacaagauaaucaacucacuuacguaguaaucgcgauacugaccguaguagcagcuacaauggcaaaugaaauggguuuccuagaaaagacuaaaaaagaucugggguugggaucuaucacaacacaggaaagugaaaguaauauuuuagauauagaucuacgcccugcaucggcuuggacccuauacgcugucgcgacggcguucguaacuccaaugcuacgacacaguauugaaaauucaagcgugaacguaucucuaacagcaauagcaaaucaggcaacaguccuuaugggcuugggacgaggauggccacuuucgaaaauggacauaggagucccacuuuuagcaaucgguuguuacucacaagugaacccaauaacuuugacagcggcauuacugcuccucguggcacacuacgcaauuauaggcccuggacuacaagcaaaagcaacuagggaggcacaaaaacgcaccgcagcagggauaaugaaaaacccaaccgucgauggaauaacuguaauagacuuggaaccaauaccuuaugacccaaaauuugaaaaacaacuaggucagguuaugcuucuaguucucugugucacucagguauugaugaugcgcacaacuugggcauugugcgaagcauuaacccuagcgacagguccuauaucgacauuaugggaagguaacccuggaagguucuggaauacuacuauagccguauccauggcuaauauuuuucguggcaguuaucucgccggagcaggacuccuauucucgauuaugaaaaauacaacaaacaccaggcgggguacugguaauauuggugaaacguuaggcgaaaaguggaaaucacgauuaaacgcguuaggaaagucugaguuucagauauacaaaaaaaguggcauucaagaaguugauagaacguuagcaaaagaagguauaaagagaggggaaacagaucaucaugcaguaucuagagguagcgcuaaauuacgcugguuuguagaacgcaauaugguaacgccagagggaaaaguagucgaucuggggugugguagggggggauggucuuacuauugcgggggccuuaaaaauguaagagagguuaagggguuaacaaaaggcgggccaggccacgaagagccgaucccaaugaguacguacggguggaaccuaguuagacugcaguccggagucgacguauucuuuacccccccagaaaaaugugacacguuauuaugcgacauaggcgaaagcagccccaaccccacuauagaagcuggaagaacucucagaguacucaaccuuguagaaaacugguuaaacaauaauacacaguuuuguguaaaaguccucaauccauacaugccaagcguuauugagaagauggaaacccuccaacguaaguaugguggugcacuugucagaaauccccuaaguagaaacagcacucacgaaauguauuggguaaguaacgcuacagguaauauaguauccagcguuaauaugauaagcagaauguuaauuaacagguuuacuaugaaacacaagaaagcaacuuaugaacccgauguagauuuggguagugggacuagaaauauaggaaucgagaacgaaauucccaacuuagacaucauaggaaaaagaauugaaaaaauaaaacaggaacacgaaacuagcuggcacuacgaccaggaucauccauauaaaacuugggccuaucauggcagcuacgagacaaaacaaaccgguucugccagcucaaugguaaacggugugguaaaacuacugacuaaaccgugggauguaguuccaauggucacacaaauggcaaugacagacacgacaccuuuuggucaacaaagaguguucaaggaaaaaguggauacucguacacaagaaccuaaagaggguacaaaaaaacuuaugaggaucacagcggaaugguuguggaaagaacuggguaaaaaaaagacgcccaggaugugcacacgggaagaauuuacuaggaaaguacgaucaaaugcagcauugggcgcaauuuucaccgaugaaaauaaauggaaaucugcuagagaagcaguugaagacaguagauucugggaauuaguggauagagagaggaaccuacaucuugagggaaaaugcgaaacuugcguuuauaauaugaugggcaaacgggaaaaaaaauuaggggaauucggaaaggcaaaaggcagucgugcuauuugguacaugugguuaggugcccgauuuuuggaauuugaggcauuagguuuucugaaugaagaccauugguuuucaagggguaauagcuuaucaggcguggaaggagagggacuacauaaacuaggauacauacuuagagauguaaguaagaaagaagguggagcaauguacgcagaugacacagcagguugggauacaaggauaaccuuggaagacuuaaaaaaugaagagaugguaaccaaucauaugaaaggcgagcauaagaaacuagcagaagcuauauucaaauuaacguaucaaaauaaaguaguccgaguccaaaggccgacacccagagggacaguaauggauauaauuucucguaaagaucaaagggggagcggacaagucgggacuuacggccuaaauacguucaccaauauggaagcucaguuaaucagacaaauggagggagaaggaaucuuuaaaucuauccagcgacuaacugugaccgaggaaauagcaguacaaaauuggcuggcacggguaggucgggagcgccuaucacgcauggcuaucucgggagaugacuguguugucaagccgcuagaugacagauucgcuucggcccucacagcacuaaaugacauggguaagguucgcaaagacauucagcaaugggaaccguccaggggauggaacgauuggacgcaaguaccauucugcagccaccacuuccacgaauuaguaaugaaagaugguagaguucuaguuguucccuguagaaaccaagaugaacuuauaggccgggcuaggauaagccagggugcaggauggucucuuaaggagacagcuugucuagguaaaaguuacgcacagauguggacguuaauguauuuucacagacgcgaucuaagacuagcggcuaacgcuauaugcagcgcugucccuucucauuggguuccuaccaguagaacaaccuggucaauccaugcaaaacaugaguggaugacaacagaagauauguuagcuguauggaauaggguauggauacaagaaaauccuuggauggaggacaaaacgccgguggaaucuugggaagaaguccccuaucucggaaagagggaagaucaauggugcgggagucugauaggucugaccucacgugcuacuugggcaaaaaauauacaaacagcaaucaaccagguacgaucacuaauaggaaaugaagaguauaccgacuacaugccuaguaugaaaagauuucgaaaagaggaagaggaagccggaguacucugguaa

SEQ ID NO: 22591 - RNA, 9876 nt, Artificial Sequence
  derived and/or modified CDS sequence (opt6) from DENV-2__EU687216__SS-prME
acggcuggcguuauaguaaugcuuauuccaacugcuauggcuuuucacuugacaacuagaaauggagaaccucauaugauuguggggcgacaagaaaaaggaaaaucuuuacuauuuaaaacugaagaugguguuaauauguguacuuuaauggcaauagaucuaggagaacuaugcgaggauacaauaacauauaaaugcccgcuuuugcgucaaaaugaacccgaagacauagauuguuggugcaauaguacgucaacuuggguuaccuaugggacaugcacaacaacuggugagcacagaagggagaaaagaaguguugcauuagucccucauguaggaaugggucuugaaacuagaacagaaacauggaugucuuccgagggagcauggaaacauguucaaaggauagaaacguggauauuacgucacccugguuuuacaauaauggcagcaauucuggcauauaccauaggaacuacacacuuucaaagagcucuaauauuuauacuauuaaccgcaguagcaccaaguaugacuaugagaugcauaggcauauccaaucgagauuucgucgagggagugaguggaggcucauggguagacauuguacuagaacaugggucuuguguaacuaccauggcuaaaaacaaacccacacuggauuuugaguuaauuaaaacggaagcaaaacaaccagcaacuuugaggaaauacugcauugaagcgaaauuaaccaacacuacaacugaaaguagauguccgacacagggugaaccuucccuaaacgaagaacaagacaaacguuucauauguaaacauucgaugguugaucgaggcugggguaauggauguggccuauuugguaaaggcgguaucguaacgugugcaauguucacaugcaagaaaaauauggaaggaaaaauagugcaaccagaaaacuuagaauacacuauaguuaucacuccacauucaggagaggaacacgcaguaggaaaugacaccggaaaacauggaaaagaaauuaaaaucaccccacaaaguagcacaacagaagccgaguuaacagguuauggcaccgucacuauggagugcucaccuaggacgggguuggacuuuaaugagauggugcuacuccaaauggaggauaaagcguggcugguccacaggcagugguuuuuagaccuaccacuacccugguuaccaggggcugauacacaagguucuaauuggauccaaaaagaaacgcuagucacuuuuaaaaauccucacgcgaagaaacaggaugugguaguauuaggaucucaggagggugccaugcacacggcauuaacaggugcgaccgaaauccaaaugagcucagggaaucucuuauuuacggggcauuuaaaaugucgacucagaauggauaaacuacaacucaaaggcaugucauauaguauguguacuggaaaauuuaagauuguuaaagaaauagccgaaacgcaacaugguacaauaguaauaaggguucaauacgaaggagauggcucacccuguaaaauacccuuugaaauuacagaucuagagaaaaggcauguuuuaggaagguuaauaaccguuaaccccauaguuacagagaaagacucuccaguaaauaucgaagccgaaccgccguucggggacucauauauaauuguuggaguggaaccaggacaacugaaacuaaacugguuuaagaaaggaagcucuaucggacagauguucgagacaacaaugcguggagcuaaaaggauggcaauacucggugauacugccugggauuuuggcagccucggaggugucuucacgagcauagguaaggcauuacaccagguauucggagcaaucuacggagcagcuuucaguggaguaucguggacaaugaaaauauugauugguguaauaauaacauggauagguaugaauagcaggucaaccuccuuauccguuagccuagucuuaguggggguaguuacacuauauuuaggagcgaugguccaagccgauucaggauguauugugucguggaagaacaaagaacuaaaaugcggaaguggaaucuuuauaacugauaacguacauacauggacagaacaauauaaauuucaaccagaaaguccaucuaaacuugcgagcgcuauucaaaaagcacacgaagaaggaauauguggaauaaggucgguuacaagacuagagaaucuaauguggaaacaaaucacaccggaauuaaaccauauucuaucggaaaaugaagugaaacuaacaauuaugaccggagauauaaaaggcaucaugcaagcuggcaaacguagcuuaagaccacaacccacagaguuaaaguauucauggaaaacguggggaaaagcuaagauguuaagcacagaaagccauaaccaaacuuuccuaaucgaugguccugaaacugcagagugucccaauaccaacagagcuuggaacucauuagagguagaggacuaugguuucgguguguuuacuacgaacaucuggcuaaaacuucgugaaaaacaagauguauuuugcgacagcaaacugaugucagcagcuaucaaggacaauagggcuguucacgcagacauggguuacuggauagaaucugcccuuaacgauacauggaagauggagaaagcgucguucauagaaguuaaaaguugccauuggccaaaaucccacacgcucuggucgaacggcgucuuagaguccgagaugauaauccccaaaaauuucgcagguccuguuucacaacauaacuacaggccaggcuaucauacacagacugccggaccguggcaccuggguaaguuggaaauggauuuuaacuuuugcgaagggacaaccguaguuguuacagaagacuguggaaaccgaggcccaucuuuaagaacaacuacagcuucaggaaagcuaauaacggagugguguuguaggucauguacuuuaccaccuuuacgcuauagaggugaagaugggugcugguacggcauggaaauaagaccucucaaggaaaaagaggaaaauuugguuaacagcuuagugacagcgggucauggccaaauagacaauuuuagucuaggaguauuggguauggcacuuuuucucgaggaaaugcuuaggacgaggguaggcacaaaacacgccauauuacucguagcccucucauuugucacgcuaaucaccggaaacaugagcuuuagagaccuagggcguguaaugguaaugguuggagcuacaaugaccgaugauaucgguaugggcguaacauauuuagcgcuacucgccgcauucaaaguuagaccaacguucgcugcggguuuguugcucagaaaauugacgucaaaagaacuaaugauggccacuauuggcaucgcucuacucucacaaaguacacugccugaaacaaucuuggaacugacugaugcacuugcucuaggaaugaugguuuuaaaaauaguuagaaauauggagaaauaucaacuagccguuacaauuauggcgauuucaugcguccccaacgccgucauucuacaaaacgccuggaaaguuaguuguaccauacuggcagcuguuaguguuucuccauuauuacuuacaucaucacaacaaaaagcggauuggaucccacuagcucuuacgaucaaaggguuaaacccaacagccaucuuucuaaccacucuaaguagaacaucuaagaaacgaaguuggccuuuaaaugaagcaauuauggcuguugguaugguaaguauucuggcauccagccuccuuaaaaacgacauuccaaugacggguccucuaguggccggaggguuacuaacuguaugcuauguacuuacugggagaagugccgauuuagaacuggagcgagccgcugacguuaaaugggaagaccaagccgaaauaaguggaaguucuccuauacuaagcauaacaaucucugaagaugggaguauguccauuaaaaaugaggaagaggaacaaacacucacuauucuuauccgaacugggcuguuagucauuucaggcguuuuucccgucaguauuccuauuacagcggccgcaugguauuuaugggaagugaaaaagcagagagcuggggugcucugggacguaccuucaccgccuccuguagggaaagcagaacuugaagauggcgcguacagaauaaaacaacgagggauucuugguuauagccaaauaggagccgguguauacaaagaaggaacuuuucacacgauguggcauguaacaagaggagcgguuuuaaugcauaggggaaaaagaauugaaccuucaugggcagacguuaagaaagauuugauuaguuacgggggcgguuggaaauuagagggagaguggaaagagggugaggagguacaaguacuagcacucgaaccagggaagaauccacgugcaguccagacaaaaccgggaauauuuaaaacaaauacugggacaauuggugcugucaguuuagacuuuucgccugggacaagcgguucaccgauaguugauaggaaaggcaaaguuguaggcuuguacggaaacggcguuguaacgcgauccggagcuuaugugucagcaauugcgcaaacugaaaaaucaauagaagauaacccagaaauagaagaugacauuuuuagaaagaaacgccuuaccauaauggaccuacauccuggagccgguaaaaccaaaagauauuuaccugccauaguucgggaagccauaaaaagagguuugcgcacguuaauauuggccccaacucgcguuguugcugcugaaauggaagaagcucugcguggccuaccaauaagguaucagacuccagcgauacgagcugagcacacagguagggaaauaguagaucuaaugugccaugcgacuuuuacaaugcgucuguuaagcccagugagaguacccaauuauaaucuuauaauaauggaugaggcucauuuuacugauccugcaaguauagcagcuagggguuacauuagcacgagggucgaaaugggagaggcagcgggaauuuuuaugacggcaacacccccuggaucaagggauccauuuccgcaaaguaacgcgccaaucauggaugaagaacgugaaauacccgaacgcagcuggaacucgggucaugaauggguuacggauuucaaagguaagacaguaugguuuguaccaaguauaaaagcggguaaugauaucgcagcaugccuuaggaaaaaugguaagaagguaauacaauuaagucguaaaacauuugauuccgaguauguaaaaacccgcgccaacgauugggauuuuguaguaacuacagauauuucggaaaugggcgcaaacuuuaaagcagaacguguaauugauccacgaagauguaugaaacccguaauucuaacagauggugaggaaaggguuauauuggcaggacccaugccaguaacacacaguagugcagcccaaaggaggggacgaauuggucgcaaucccaaaaaugaaaaugaucaauauaucuacaugggagaaccacuagaaaaugaugaagauugugcucauuggaaggaagcuaaaaugcuucuagauaauauaaauacaccagaagggaucauuccaaguauguuugaaccggaaagggaaaagguagaugcaaucgauggugaauacagacuuagaggagaagcaagaaagacauuuguagaauuaaugagaagaggagaccucccggucuggcuagcguauaagguagcugcagaagguaucaacuaugcagaucguaaauggugcuuugacggaauaaagaauaaucaaauacuagaagaaaauguagaaguugaaauauggacaaaagaaggcgagcguaagaaacuuaagccuagaugguuggaugcacguauauauucagauccacuagcgcuaaaggaguuuaaagaguuugcugccgguaggaaaucauugacauuaaauuuaaucacagagaugggccgucuucccacguuuaugacacaaaaagcucgcaacgcucuggacaacuuagcuguguuacauacggcagaaguaggagggagggcguauaaucaugcuuuaagcgaacuaccagaaacucuagaaacucuucuacuacuaacgcuacuagcuacagugacagguggcauauuuuuguuccuuaugucaggaaaaggaguaggaaaaaugacucuugguaugugcuguauuaucacagcaucuauucuucuaugguacgcucagauucaaccacacuggaucgcagcaaguauaauucucgaauuuuuccuuaucguccuuuugaucccagaaccagaaaagcaaagaacgccccaagauaaccaacuaacauacguaguuauagcaauuuuaacagugguugcggccacaauggcgaaugaaaugggcuucuuagagaaaacgaagaaggauuuaggcuuugguagcaucacaacacaagaaucggaauccaacauccuggauauagaccuacggcccgcaucagccuggacuuuguaugccguugcgacgaccuucauaacacccaugcuacgucauagcauagaaaauucaucugugaaugucagccuuacagccauagcuaaucaggcgacggucuuaaugggguuaggaaaagguuggccacugucaaaaauggauauaggcgugccgcuauuggcuauaggauguuacagccaaguaaauccgauaacacuaacggcggcccuucuacucuuaguugcucauuacgcaauuauugguccaggauuacaggccaaagcaacuagagaagcacagaaaagagcugcagcuggaaucaugaagaauccaaccguugacggaauaacaguuauugacuuagaaccaauuccguacgacccuaaauuugaaaaacaacucgggcaaguuauguuauuaauccucugcgucacgcaaguauuaaugaugcgaacuacuugggcauuaugcgaagcauugacacuagcuaccgguccuauuucaacgcugugggaagguaacccgggucguuuuuggaacacaacaauagcuguuaguauggcaaauauauuuagagguuccuaucucgcuggagcuggacuccuauuuucgauaaugaaaaacacaacuaauacccggcggggcacaggaaacguaggcgaaacucuaggugagaaauggaaaagccggcuuaaugcgcuuggaaagucagaauuucaaaucuacaagaaaaguggaauacaagaaguagacagaacuuuagcuaaggaggggauaaaaagaggagaaacugaucaccacgcgguaaguaggggaagcgcgaaacugagaugguucguagagcggaauaugguaacaccagaaggcaagguaguugaccuaggaugcggacgcggcgguuggaguuauuauugcggcggauugaaaaauguaagagaaguaaaaggucuaacuaaagguggcccuggacacgaagaaccuauacccaugagcacauauggguggaaucuaguccgacuacaaagcggaguagauguauucuuuacaccuccggaaaaaugugacacucuacuaugcgacauaggcgagagcagcccuaauccaaccauagaagcaggaagaacauuacgaguacuuaacuugguggaaaacuggcuuaauaacaauacccaauuuugcauaaaagucuuaaauccuuauaugcccaguguuauagagaaaauggaaacauugcaaagaaaauacgguggcgcucuugugcguaauccauugucucgaaacuccacgcacgaaauguauugggucucaaacgcaacagguaacaucgugucuuccgugaauaugauuagucggauguugauaaauagauuuacaaugaagcacaagaaagcgacauaugaaccagauguagaccucgguaguggaacgcgaaacauugguauugagucagaaauaccaaaccuagacaucauagggaagagaauagaaaagaucaaacaagaacaugagaccucauggcauuaugaccaagaccauccauauaaaacaugggccuaucacggguccuacgaaacaaaacaaacagggagugccucauccaugguaaacgggguagugagauuauuaacaaaacccugggauguaguaccaaugguaacucaaauggcaaugacggacacuaccccauuuggucaacaaagaguuuucaaggagaaaguggacacgagaacacaagaacccaaagaaggaaccaagaaacuuaugaaaauuacagcagaguggcuguggaaggaacuaggaaaagagaaaacuccccguauguguacuagggaagaguucacuagaaaagugcguucgaaugcugcucucggagcaauuuucacggacgaaaauaaauggaaaagugcuagagaagcuguugaagaugguagauucugggaauuaguugaucgagaaaggaaccugcaccucgagggaaaaugugaaacuuguguauauaauaugaugggcaaacgagagaagaaauuaggagaguuugguaaagcaaaggguuccagagccauuugguacauguggcugggggccagguuuuuagaguuugaagcacuaggcuuucuaaaugaggaucauugguuuucucgcggcaacaguuuaucgggagucgagggagagggacuucaucgguuaggcuacauacugagagaaguaggcaagaaagaaggaggagcaauguaugcggacgauacagcaggaugggauacaagaauaacucucgaggaccuuaaaaaugaagaaaugguaacuaaucacaugaaaggcgaacacaagaaacuagcggaagcaauauucaagcuaacguaucaaaauaaaguggugagggugcaaagaccgacgccgcgaggaacgguuauggacaucauuaguagaaaagaucaacgagguucaggucaaguugguaccuacggucucaauacauuuacuaauauggaagcacaauugauucggcaaauggaaggcgaaggaaucuuuaaaaguauacaacauuuaaccgcgacggaagaaauagcaguacaaaauugguuagcucgugugggacgggagcgauuaaguaggauggccauuucaggugaugauuguguuguaaaaccaauugaugaccgauucgcaucugcacucacagcuuuaaaugacauggguaaagucaggaaggauauacaacaaugggaaccuucgagaggauggaacgauuggacucaagugccauucugcucucaucauuuucaugaguuggugaugaaggacgguagaguucuaguagugccguguagaaaucaagaugaacuaauaggacgcgcgagaauaucacaaggugcaggcuggucauugaaggaaacggccugccuuggaaaaagcuacgcgcaaauguggacucucauguauuuccacagacgagaucucagacuagccgcaaaugcgaucuguucagcagucccuucacacuggguaccaaccagcagaaccacaugguccauccaugcaaagcaugaauggaugacgacggaggauauguuagccguauggaaccgaguauggauacaagaaaaucccuggauggaggauaaaacaccaguggaaagcugggaggaagugccguaucuuggaaaaagagaagaucaaugguguggcucucugauaggcuugacaaguagagcuaccugggccaaaaauauucaaacagcaauaaaccaggugcgcagucucaucggcaaugaagaguauacugauuacaugccgagcaugaaaagguuuagacgagaagaagaggaagcgggaguccucugguaa

SEQ ID NO: 22592 - RNA, 9876 nt, Artificial Sequence
  derived and/or modified CDS sequence (opt6) from DENV-2__EU726770__SS-prME
accgcugguguuauaauuauguuaauuccaacagcaauggcauuucacuuaacuacaagaaauggagaaccgcauaugauaguaggucgucaggaaaaaggaaaaucuuuauuauuuaaaacggaagaugguguaaacauguguacguugauggcuauugacuuaggcgaacugugugaagauacaauaacauauaaaugcccauuacuuagacagaacgaaccagaagauauagauuguuggugcaauaguacaucgacauggguaacuuauggcacguguacuacaacaggagaacacagaagagagaaaagaucaguagcauugguaccucaugucggaauggggcuagaaacacguacagaaacauggauguccuccgaaggcgcauggaaacaugugcaaaggauugaaacauggauucuuagacauccaggauuuaccauaauggcggcaauauuagcauauacaaucggcacaacacauuuccaacgagccuuaauauuuauccugcuaacagcaguagcgccuuccaugacaaugcgauguauuggaauaagcaaccgugauuucguugaaggaguuucaggagggagcuggguggacauaguuuuggaacacggcaguuguguaacgacgauggccaaaaauaaaccaacgcuagacuucgaauuaauuaaaacagaagccaaacaaccugcuacuuuacgcaaauacuguauagaagccaaacuaacgaacacuacgacagagagucgcugccccacucagggagaaccgucacuaaaugaagaacaggauaaacgguucauauguaaacauucaaugguugaccggggcuggggcaacgguugcggcuuauucggaaaaggagguaucguuacgugcgcaauguucacuugcaagaaaaacauggaagggaaagucguauuaccagaaaauuuagaauauacuauagugauaacaccgcauucuggcgaagaacacgcgguagguaacgauacagguaaacaugguaaagaaauaaaaaucacuccccaaaguagcauaacggaagcagaauuaacuggauaugggacgguaacaauggaaugcagucccaggaccgggcuggacuuuaaugagaugguuuuacuccaaauggaagacaaagccuggcuaguucaccggcaaugguuuuuagaucuuccacuacccuggcugccuggagcugacacccaagguuccaauuggauacaaaaagaaaccuuaguaacguuuaaaaacccucacgcuaagaaacaagacguagugguacugggaucacaagaaggugcaaugcacacagcuuugaccggagcaacugaaauacaaaugucaucaggaaaucuucucuucaccggacacuuaaaauguagacuucgaauggauaaauuacaauugaaaggcauguccuauucuauguguacuggaaaauucaagauaguaaaagaaauagcagaaacucaacacggaacuauugugauacgaguacaauaugaaggcgauggaagcccauguaagauucccuuugaaauaauggauuuagagaagagacacguccuuggcagacugauuacagugaaccccauugucaccgaaaaagacuccccagugaauauagaagccgaaccgccguuuggagacaguuacauaauaaucggagucgaaccaggacaauuaaaauugaacugguucaagaaaggaaguucaauuggccaaauguucgaaacaacgaugagaggcgcaaagcguauggcuauacucggcgacacagcaugggauuucgggagcuuagggggagucuucacaucaauugguaaagcgcuccaucagguguuuggagccaucuauggagcugcguucagcgggguaaguuggacgaugaaaauccugauaggagucaucauaaccuggauugggaugaacagucgaaguacaagucuaaguguaaguuuaguccuaguaggugucgucaccuuauacuuaggaguaaugguacaagcugauacgggaugcgucguaucguggaaaaacaaagagcuuaaaugcgguagcgggauauucauaacagacaacguacacacguggaccgaacaguacaaauuucaaccggaaucucccagcaaacuggcgagugccauacaaaaagcucacgaggagggaauaugcggaauaagaucugugacuaggcuugagaauuuaauguggaaacaaauaacaccugagcuuaaucauauacuuucagagaaugaaguaaaacuuacaauuaugacgggagauauuaaaggcaucaugcaggcugguaaacgaucuuuaaggccucagccaacggagcugaaauauucguggaagacaugggguaaagcaaaaaugcuaucaacggaaucacacaaucaaacuuuccuuauugacggucccgaaacagcugaauguccgaauacaaaccgggcguggaacucauuagagguagaagauuacgguuucggagucuuuagcaccaauauaugguuaaaacuucgcgagaaacaggauguauucugugacucuaaacuuaugagugcugcaauaaaagauaacagagcuguucaugcagauauggguuacuggauugaaagcgcauuaaaugacacauggaaaauggaaaaagcgucguuuauagagaucaagucgugucauuggccuaaaucacacacacucuggucuaauggaguacuggaauccgaaaugauaauccccaaaaauuucgcaggaccaguaucacaacacaauuacagaccaggguaccacacacaaacggccgguccuuggcacuuaggcaaacucgaaauggacuucgacuucugcgaagguacaacuguaguagugacagaagacugcgggaaccggggacccucauuacgcacaacuaccgccucugguaaacuaauaacagagugguguuguagaagcuguaccuugccaccucuuagguacaggggcgaagauggaugcugguacggaauggaaauacguccuuugaaggagaaggaagaaaauuuagucaauuccuuggucacagccggucacggacaaauagacaacuuuucgcuuggaguguuagggauggcguuauucuuagaggagaugcuucguaccaggguaggcacuaaacacgcaaucuuacucguugccgucagcuuugucacccuuauuacaggcaauauguccuuuagggaccuaggccgaguaaugguaaugguaggagcaacuaugaccgacgacauugggaugggggugacuuaccuugcuuuauuagccgcuuucaaaguacgacccaccuuugcagccggucucuuauuacgcaaauuaacuucgaaagaacuaaugauggcuaccauaggcauagcuuuauuaagccaaucaacaauuccugaaacuaucuuagagcuaacagaugcucucgcauugggaaugaugguguuaaagauugugaggaauauggaaaaauaccaauuagcaguuaccauaauggcaauuagcugcgugccaaacgcaguuauacuacagaacgccuggaaaguaucaugcaccauacuagcagcagugagcguuagcccauuacuucugacaucgagucaacaaaaagcagauuggauaccauuagcucucacaaucaaagggcugaauccgacagcaauauuuuuaacaacuuugucacgaaccagcaagaagagaaguuggccauuaaaugaagcgguaauggcaguuggcaugguaagcauauuggccaguagcuuauugaaaaaugauauaccaaugacaggcccucucgucgcaggagguuuauuaacagucugcuaugugcuaacagguagaucggcugauuuagaguuagaacgggcagcugauguaaaaugggaagaucaggcggaaauaucuggcagcuccccgauucucaguauuacaauaucggaagauggaucaaugagcauuaaaaacgaagaagaagaacauacauugacaauacuuauucgaacgggacuauuagugauaaguggaguuuuuccagucuccauaccgauuacugcggcagcaugguaccuaugggaagucaagaaacaaagagcugguguacuuugggauguuccuaguccuccuccaguaggaaaagcagaacucgaagacggugccuaccgcaucaaacaacgagggauauucggcuacagucagaucggagcggguguauauaaggaaggcacauuccauacuauguggcauguuacgagaggggcaguacuaaugcaucgaggcaaaaggauugaaccuucaugggccgacguaaagaaagaucuaauaucguaugggggagguuggaagcuagaaggagaauggaaagagggggaggaggugcaagugcuggcccuugaacccggcaaaaaucccagagccgugcaaacaaaaccuggacuguuuaaaacaaacacugggacgauaggugcugucucuuuagacuuuagcccuggcaccucugguuccccaauaguagaucggaagggaaaaguaguaggauuguauggaaacggaguagugacaagaagcggagcauauguaagugcgauagcacaaacagagaaaaguauagaagacaauccagaaauagaagacgauauauucaggaagaaaagacuaacgauaauggaccuacacccuggugcaggaaagacuaaaagguaccuaccugcuauagugcgcgaagccauaaaacgaggacuaagaacgcuaauacuugcuccaacgcgagugguugcugccgaaauggaagaagcacuuagagggcucccgauacguuaucaaacgccagcaaucagagcagaacauaccgguagagaaauaguugacuuaaugugucaugcgaccuucacaaugcgcuuacuaagcccgguaagaguuccaaauuacaauuugauaauaauggacgaagcacacuucacagauccagcauccauagcagcacguggauacauuaguaccaggguggaaaugggagaggcagcagguauauucaugacagcaacgccacccgguuccagagacccguucccgcaaaguaacgcgcccauaauggacgaggagagagaaauucccgaaaggucuuggaacucaggacacgaauggguuacggauuuuaaggguaagacgguaugguuuguaccuaguauaaaagcaggaaaugacauugcugcaugucuaaggaaaaacggcaagaaaguaauacaauuaagcaggaagacauucgauucagaauacgugaaaaccagagcgaaugacugggacuuuguaguaacgacugacauaucugagaugggugccaacuucagagccgagagaguaauagauccacgcagauguaugaagcccgucauacuuacagauggcgaggaacguguaauacuagcaggacccaugccaguuacacauuccucagcagcacaacgcagaggucgaaucggaagaaauccgaagaacgagaaugaucaauacauauauaugggugagcccuuggaaaacgaugaagacugcgcacacuggaaagaagcuaaaauguuguuagauaauauaaauacaccugagggcauaauuccaucaauguucgagccagaacgagaaaaaguagacgccauagacggcgaauauaggcugagaggagaagcacguaagacauucgucgaucuuaugagaaggggcgaucuuccaguaugguuggccuauagaguagcagcggaggguauaaauuaugccgauagaagguggugcuucgaugggauuaagaacaaucagaucuuggaggaaaaugucgaaguagaaauauggacgaaagagggcgagaggaagaaacuaaaaccaagguggcuagacgcaagaauuuauagcgauccucuagcauugaaagaauuuaaagaauuugcagcagggcguaaaucucuuacgcuuaaucucauuacugaaauggguagacucccgaccuucaugacacaaaaggcucgugacgccuuggauaaucucgcaguucuccauacagcagagguagguggccgcgcguauaaccaugcucucucugaacuaccagagacccuggaaacucuguuacuuuugacccuccuugcaacaguaacaggagggauauuucuuuucuuaaugagcggaaaaggaauugguaagaugacauugggcauguguuguauuauuacggcaucaauacuauuaugguacgcccaaauacaaccacauuggauugcggcuaguauaauacuugaguucuuucuaauaguguuguugauaccagaacccgaaaaacagaggacaccacaagauaaucaauuaacauauguagugauugcaauacugacggugguagcagcuacaauggcaaacgaaaugggauuucuagaaaagaccaagaaagauuuaggucuaggaagcaucacaacgcaagaaucagaaucgaauauauuagauauagaccuacgaccagcaucagcauggacguuguacgcaguagcgaccacuuucguaacgccgaugcuucggcauucgauugaaaacaguaguguaaacguuucgcuaaccgcaauugcaaaucaagccacugugcuaaugggccuaggaaggggcuggccguuguccaaaauggauauuggcgugccuuuguuggcaaucgggugcuauucucaaguuaacccaauuacacuaaccgcagcucuacuccuucuaguagcacauuaugcaauaauuggaccaggauuacaagcaaaagcaacgagagaggcccagaagcgcacggcagcgggaauaaugaaaaauccgacaguagaugguauaacagugauagaucuugagccgauaccguaugauccuaaguucgaaaaacaacucggccaggugaugcuccuggucuuaugcgucacacaaguacugaugaugagaacaacaugggcgcucugcgaagcauuaacccucgcaacagguccuauaucuacacuaugggaaggaaauccuggacgguucuggaauacaacuauagcaguaaguauggccaacauauucagaggaucauaucuagcaggagcaggguuguuauuuucaauaaugaaaaauacaaccaauaccagaagaggaacagguaauauuggugagacuuuaggugaaaaguggaaaucuagguuaaacgcacugggaaaaagugaauuucaaauauacaagaaaucagguauccaggaagucgauagaacgcuugcaaaagaaggaauaaaaaggggagaaacugaucaucaugcuguaucaagagguuccgcaaaacuucgcugguuuguggaaaggaauaugguaacacccgaaggaaaggugguugauuuaggcugugguagaggcggguggucauauuacuguggggguuuaaagaacguaagagaaguuaagggauuaacaaaagggggaccuggacaugaagaaccgauacccaugagcacauacggguggaaucuuguacgacugcaauccgggguagacguguucuuuacgccuccagagaaaugugauacacuacugugugacauuggagaaucuagcccaaauccgaccaucgaagcuggacgaacguuaagaguacugaaucuagucgaaaacugguuaaacaacaauacucaauuuuguguaaaaguauuaaacccguauaugccaagcgucauagagaaaauggagacacuccagcgaaaauauggaggggcucuaguuagaaacccacuaagcagaaauucaacucaugaaauguacuggguaucaaaugcaaccggaaauauaguaaguagcgugaauaugauaucgcguaugcucauaaauagguuuaccaugaaacauaagaaagcgacauaugaaccggacgucgauuugggcucugggacaagaaauauaggcauugaaaaugagauaccaaacuuggacauuauaggaaaaaggauugagaaaauaaaacaggaacaugagacaucuuggcauuaugaucaagaccaucccuauaaaaccugggcauaccaugguucguacgaaacuaaacaaacuggcagugccaguaguauggugaacggugucguaaaauuacuaacgaaaccuugggauguaguucccauggucacgcaaauggcaaugacagacacuacuccguuuggucaacaaagggucuuuaaagagaaaguggacaccaggacacaagagccaaaagaaggaacuaagaaacugaugaggauaaccgcugaaugguuauggaaggaacuugggaaaaagaaaacaccucgaauguguacccgagaggaauuuacaagaaaaguuagauccaacgcagcgcucggcgcaauauucacugacgaaaauaaauggaagagugccagagaagcuguugaagacucaagauucugggagcuaguugaccgagagcgaaauuugcaucuugaaggcaaaugugaaaccugcguuuauaauaugauggggaaaagggagaagaaauuaggugaauuugggaaagccaagggaagccgcgcgauaugguacauguggcuaggagccagauuucuagaguuugaagcgcuaggauuuuuaaacgaagaccauugguuuucaagagguaauucguuaagcggagucgaaggagagggucuacauaagcuaggcuacauacuuagagacgugaguaagaaagagggagguacaauguacgcagaugauaccgcaggaugggauacacgcauaaccuuagaagauuugaaaaacgaggaaauggucacaaaucauaugaaaggagagcacaagaaacuagcagaagcuaucuuuaaacugaccuaucaaaacaaagugguaaggguucagcggccgacaccaagagggacugucauggacaucauaagcagaaaagaucaaagaggcaguggacaaguugguacauacggacugaauacuuuuacaaauauggaagcucagcuaauaagacaaauggaaggagaaggcaucuuuaaaaguauacaaagacuaacuguuacggaagaaauagcaguacaaaauuggcuagcacgcguuggaagagaaaggcuuucaagaauggccauaagcggagaugauugcguggucaagccuuuagacgaccguuucgcgagugcccuaacugcacugaacgauauggggaaaguaagaaaagacauccagcaaugggaacccaguaggggcuggaacgauuggacccaagucccauuuugcagucaucacuuucaugagcuaguaaugaaagauggacggguauuaguuguaccaugucguaaucaagaugagcuaauuggcagagcaaggauaagucagggugccggcuggucucuuaaggaaacugcaugucuuggaaaaucauacgcacagauguggacccuuauguauuuucaucguagagacuuaagacuugcugcaaacgccaucuguagcgcuguccccagccauuggguaccaacaucacgcacaaccuggagcauacaugcgaagcacgaauggaugacaacugaagauaugcuugcgguauggaaucgcguuuggauacaggaaaauccauggauggaagacaagacaccuguugaaucuugggaagagguaccuuaucuugguaaaagggaagaccaauggugcgguagcuuaauuggccuaacuucacgggcgacaugggcuaagaauauucaaacugcaauuaaccagguacgcagcuuaauaggaaaugaagaauauacagauuacaugccaaguaugaaaagauuccgaaaagaagaggaagaagccggaguucucugguga

SEQ ID NO: 22593 - RNA, 9876 nt, Artificial Sequence
  derived and/or modified CDS sequence (opt6) from DENV-2__EU781135__SS-prME
acugcaggggugauaauuauguuaauaccaacagccauggcuuuucauuuaacuacaagaaauggugaaccacauaugauuguagggagacaagaaaaaggaaaaucucuccuguuuaaaacggaagauggugugaauaugugcacauugauggcaauagaucuaggagaacugugugaagauacgauuacauacaaauguccgcuacuacgccaaaaugaaccagaggauauagacuguugguguaauucaacaucgacauggguaacauaugguacuuguacuaccaccggagaacaccgucgagagaaacgaucgguggcuuuagugccucaugugggaaugggacuugagacaagaacagaaacuuggaugucaagugaaggugcuuggaaacacguucagagaaucgagacuuggauuuugaggcacccagguuucacgaucauggccgcaauccuggcauacaccauuggaacaacacacuuccaaagagcacuuauauuuauuuuacuuacugccguagcgccguccaugacaaugcggugcaucgguauaagcaauagagauuuuguagaagggguuagcgguggaucguggguagauauuguacuagaacaugguucuugcguaacuacaauggccaaaaauaaaccuacucuugacuuugaauuaauaaaaacugaggcaaaacaacccgcaacacuucgaaaauauuguauagaagcaaaauuaacuaauacuacuacagaaucacggugccccacucagggggaaccuucauuaaacgaagaacaagauaaacgcuucauauguaaacauucaaugguagaucgaggaugggguaacggaugugguuuauucggaaaaggaggaauaguaacuugcgcgauguuuaccugcaagaaaaacauggaaggaaaagucguccugcccgaaaaucuagaauauacaauuguaauuacuccucauucaggugaagaacacgcugucggcaaugacacagguaaacacggcaaagaaauuaaaauaacaccacaaucaagcauuacggaggcagaauuaacaggauauggcacuguuacgauggagugcagcccucgaacagguuuagauuuuaacgaaaugguccuauuacaaauggaggauaaagcauggcuuguacauaggcagugguuccuugaccugccguuaccauggcugccaggagcagauacucaagguucaaacuggauccagaaagaaacuuuaguaaccuucaaaaauccacacgccaagaaacaagacguagucguacucggaagccaagaaggagcaaugcacacugcgcuuaccggcgcaacugagauucagaugagcuccggcaaucuccuuuucacagggcacuugaaauguagacuacggauggacaaacugcaacuuaaagguaugucauacagcaugugcacgggaaaauuuaaaauagucaaagaaauugccgaaacacaacaugguacuaucguaauccguguucaguacgagggcgacgguagcccauguaaaauacccuuugaaaucauggacuuagaaaaacgacaugugcugggacgguuaauuacuguaaacccaauuguuacagaaaaagacucacccguaaauauagaggcggaaccaccguuuggagacucguauauaauaauaggcguagaacccggccaauugaaacuaaacugguucaagaaagggucaucaauaggacagauguuugaaacgacgaugcgaggugcaaaaaggauggccauucugggcgacaccgccugggacuuugggaguuugggcgggguauuuacaucaaucgggaaagcacuacaucaggucuuuggagcaauauauggggcugcauucucaggcguuucauggacaaugaaaauccuaauuggcguaauuauaaccuggauuggaaugaacucgcguaguacuuccuuaagugugagcuuaguauuagugggggucguaacauuauauuuaggagugaugguacaagcugauaccggauguguagugagcuggaaaaauaaagagcugaaauguggaagcggaauauuuauuacagauaauguacauacauggacugaacaauacaaauuucaaccagaaaguccuaguaaacucgccucugcaauucaaaaagcccaugaagaagggauuugcggaauccguagcguaaccagacuagaaaaucuuauguggaaacagauaacaccugagcuaaaucacauucuuucggaaaaugagguaaaacuaaccauaaugacgggggauauaaaaggcauaaugcaagcgggaaaaaggucacuacguccacagcccacugaacucaaauacagcuggaaaacgugggguaaagccaaaauguuaaguacagaaucgcauaaccaaacauuuuuaauagaugguccugaaacagccgaaugcccuaacacaaacagagccuggaacucacuugaagucgaggauuacggcuucggaguuuuuaguaccaacauuuggcuaaaacuuagagaaaaacaagaugucuuuugugauucaaaacuuaugagcgccgcaauaaaagacaaucgagcaguucacgcagauauggguuauuggauugaaucugcucuaaacgacacuuggaaaauggaaaaagcguccuuuauagagauaaaaucuugucauuggccaaaaucucacacuuuauggucaaacggagugcucgaaagcgagaugauuauaccgaaaaauuuugcaggaccgguaagccaacauaacuacagaccaggauaccauacacagaccgcagguccuuggcauuuaggcaaauuagaaauggacuuugauuuuugcgagggaacaacaguugucguaaccgaggacugcggcaauagggggccuaguuuacggacuacaacagcuuccgguaaacuuauaacagaauggugcugucgcucuuguacccuaccgccucuacgauauagaggagaggauggauguugguauggaauggagauccgcccccuaaaggagaaggaggagaacuuaguuaauaguuuaguuacagcaggccaugggcagauugauaauuuuucauuaggaguucuagggauggcauuauuucucgaagaaauguuaagaacucgcguggggacuaagcaugccauccugcucguggcagucuccuuuguuacuuugaucacaggaaauaugaguuuucgagaucuagggcgcguaaugguaaugguuggagcaacaaugacggacgacauaggaaugggagucacguaccuagcacuacucgcagcuuuuaagguaagaccaacuuuugcugcaggacugcuauugaggaaacugacaagcaaagaguuaaugauggccacaauagguauagcauuacuaagccagaguacaaucccagaaacaauacuagaacuaacagacgcguuagcuuuagggaugaugguucuuaagauaguaagaaauauggaaaaguaucaacuagcgguuacaauaauggcgauaucuugcgugccaaaugcuguuauacuacaaaaugcuuggaaagucucuugcacaauauuagcugcuguuagugucucccccuuacuauugacaaguagucagcaaaaagcagauuggauaccguuagcacugaccauaaaggggcugaacccaacggcaauauuucuaacaacuuuaucucggacuagcaagaaaagaaguuggccauuaaacgaggcaauuauggcaguaggcaugguaucaauccuagcuagcucucuacuuaaaaaugauaucccuaugaccggcccucuagucgcuggaggccuucugacuguuugcuacguacugacgggaaggagcgcugauuuagagcuagaacgcgcagccgacguaaaaugggaggaccaagcagaaauauccggaucaucaccaauucuaaguauaacaauauccgaggauggaagcaugucaaucaaaaaugaagaagaagaacacacauuaacaauauugauaagaacaggacugcuaguaauaagugguguuuuuccuguauccaucccuauaacugcugccgcuugguacuuaugggaaguuaagaaacaacgagccggagugcuaugggauguucccucucccccaccagugggcaaagcagaauuggaagauggagcauauaggauaaaacaacgcggcauauucggauacucacagaucggagcgggagucuauaaagaaggaacuuuccacacaauguggcacgucacaaggggagcuguauugaugcauagagguaaacgaauugaaccaagcugggcggauguaaagaaagacuuaauuagcuaugguggaggauggaaacucgaaggggaguggaaagaaggggaagaaguucaaguauuggcccuugaaccagguaagaauccaagagcaguccagacaaagcccggauuauuuaaaacaaacaccggcacuauaggggcagucucguuagacuuuucgccagguaccagcgggucaccuauagucgacagaaaaggaaaaguaguaggauuguacgggaacgguguaguaacuagaucaggggcauacgugucugcaaucgcgcaaaccgaaaaaucuauagaagauaacccggaaauagaagaugauaucuuuagaaagaaacgacugaccauuauggauuuacacccuggggccggaaaaacuaaacguuaccuacccgccauuguccgugaagcaauaaaaagaggauuaagaacucuaauucucgccccaacacgcguaguagcagcggagauggaggaggcauuacgagguuuacccauaagauaucaaaccccagcaaucagagcugagcacacuggacgagaaauaguggauuugaugugccacgcaacauuuacuaugcgucuacuguccccuguuagggucccaaauuauaauuugauaauaauggaugaagcacauuucaccgacccagcaucuauugcugcucgcggcuacauuucaacaagagucgaaaugggugaggcagcgggaauuuucaugaccgcuacuccucccgguagccgagauccauucccacagagcaaugcaccaauaauggacgaggagcgagaaauacccgaaaggucauggaacucaggucaugaaugggucacagacuucaaaggcaaaacgguaugguuuguuccaaguaucaaggcuggaaaugauaucgcggcuuguuuacggaaaaauggcaagaaaguaauacaguugagcagaaaaacauuugacagugaauaugugaagacccgagcgaaugauugggacuucguaguuacgacagauaucucagagaugggggcuaauuuucgugcugaacgugugauagacccuagacgauguaugaaaccagucauacucacagauggagaggaaagaguuauacuagccggacccaugcccgugacgcauuccagugcggcucagcguaggggacgaauuggaagaaacccaaagaaugagaaugaucaauauauuuacaugggagagccccuagaaaacgaugaagauugugcccauuggaaagaggcuaaaauguugcuugacaauauaaacacgcccgaaggaauuaucccaucgauguuugagccagaaagagaaaaaguagacgcaauugacggagaauaucgacuaagaggagaagcuaggaaaaccuuuguggauuugaugcgacgaggagaccugccaguauggcucgcauauagaguagcugcagaaggaauuaauuaugcugaucgacgcugguguuuugacgggaucaaaaacaaucaaaucuuagaggaaaacguugaaguagagauauggaccaaggaaggggaacguaagaaauuaaaaccacgauggcuugaugcaagaauauacuccgacccguuggcucuaaaagaguucaaagaguucgcugccgggagaaaaucauuaacgcuaaaucugauuacugaaaugggccguuuacccacuuuuaugacacagaaagcaagagaugcacuagacaacuuggcuguauuacauacggcugaaguuggaggucgagcauauaaccaugcgcuuucugaacuaccagaaaccuuagaaacacuauuauuacucaccuuacuagcuacggugaccggagggauauuucuuuuucuaaugucgggcaaggggauagggaaaaugacauuaggaauguguuguauaauuacugcuagcauucuccucugguaugcacagauacagccucauuggauugcggcuaguauaaucuuggaguuuuucuuaauaguacuuuuaauaccugaaccagagaagcaacguaccccucaagauaaucaacuuacauacgugguaaucgcaaucuuaacugugguagcagcgacuauggcaaaugaaaugggauuccuagagaagaccaagaaagaccuggguuugggaagcauuacaacgcaggaaucagaguccaacauacucgauauagauuuacggcccgcuucagcauggacacuauaugcgguggcuacaaccuucguaacaccgaugcuccgccauuccauagaaaauucgucgguaaaugugaguuuaacugccauagcaaaucaagcuacgguucucaugggcuuagggcguggcuggccauugagcaagauggauauaggagugccacuucuagccaucggauguuauucacaaguaaacccaauuacacucacagcagcucugcuccuucuaguagcucauuaugcgaucauuggaccaggauugcaagcuaaagccacgagagaagcucagaaaagaacugcggcgggcauuaugaaaaauccgaccgucgacgguauaacuguuauagauuuggaaccaauacccuaugacccaaaauucgagaagcaauuaggacagguuaugcugcuaguacugugcgucacucaaguacugaugaugagaacgaccugggcccuaugcgaagcacuaacacuagcaacuggaccaauaaguacucucugggaaggaaacccagggagguucuggaacaccacaauugcaguuaguauggcgaacauauucagaggauccuacuuagccggugcaggauuacuauucucaauuaugaaaaacacaacaaauaccaggcggggaacaggcaauauuggagaaacguugggagaaaaauggaagucgagacuaaaugcacuaggcaaaucagaguuucaaauauauaagaaaaguggaauacaagaggucgaucgaacauuagccaaagaggguauuaaacgaggugaaacugaccaccaugccgugagccgaggcuccgcaaaacuaagaugguuuguugaacgcaacaugguaacgccggaagggaagguuguagaucuuggguguggaagagggggauggucauauuauuguggaggacuaaagaauguucgagaaguuaaaggauuaacuaaaggaggcccaggccaugaagaaccaauucccaugucaacuuacggauggaaccucguucgucuucaauccggagucgauguauucuucacacccccagaaaaaugugacacgcuuuuaugcgauaucggagaaucaaguccaaauccuacgauugaagccggacgaacauuaagaguauuaaaucuaguagagaauuggcuaaauaauaauacacaauuuugcguaaaaguuuuaaauccguacaugccuagugucauugaaaagauggaaacauuacagagaaaauacggaggggcucuagugcguaacccacucucaagaaacuccacccacgaaauguacugggucaguaaugcaaccgguaauauagugucuuccguuaauaugauuucucguaugcuaauuaacagauuuacuaugaaacacaagaaagcaacguaugaaccagacguagacuuaggaagugggacccguaauauagguauugaaaaugaaauaccgaacuuagauaucauuggaaaaagaauagaaaagauuaaacaagaacaugagacuagcuggcacuaugaucaggaucacccuuacaaaacaugggcuuaccaugggaguuacgaaacuaaacagacuggguccgcauccaguauggucaacggaguugucaaacuauuaacgaaaccuugggauguuguaccaaugguaacccaaauggcuaugacagauacaacaccuuucggucagcaacgaguguuuaaggaaaagguagacacuagaacacaggaaccgaaggagggcaccaagaaacuuaugcggauaacagcagaaugguuauggaaggaacuaggcaagaagaaaaccccucgaauguguacaagagaagaguucaccaggaaaguacgcucaaaugcggcacucggcgccauauucacugaugaaaauaaguggaaaagugcaagggaagccguagaagacucaagauuuugggaguuagucgacagggaacgaaauuuacacuuagaaggaaagugugaaaccuguguuuauaauaugaugggaaaaagagagaagaaacugggggaguuugggaaagccaaaggaucaagagcaauaugguacauguggcuaggcgcccgauuuuuggaauuugaagcguuaggauuucucaaugaagaucacugguuuucccgagggaauagcuuaagugguguugaaggugaaggccuucauaaauugggauacauacuuagagacguuuccaagaaagaaggaggggcaauguacgcugaugauacagcaggaugggauacuagaauuacacuugaggaccucaagaaugaggaaaugguaacuaaccacaugaaaggagaacacaagaaacuagccgaggcaauauuuaaacucacuuaucaaaauaaggucguacgcguacaaaggccaacaccaaggggaacaguaauggauaucaucaguagaaaggaucagagaggaucaggucaaguugguaccuaugguuuaaauacauuuacaaacauggaagcacaacuuauacgucaaauggaaggagaaggaaucuucaaaucuauucagagacuuaccgucacugaagagauugcuguucaaaauugguuagcaaggguugggagagaaagauuaucaaggauggcaauauccggggaugauuguguaguaaagccuuuggaugaccgcuuugccagcgcacucacagcguuaaacgauaugggaaaaguacguaaagacauccaacaaugggaaccaucacgaggcuggaaugauuggacccaaguaccuuuuugcucccaucauuuucacgagcuagugaugaaagaugguagaguucuaguugugccaugucguaaucaggaugaacuaaucgggcgugcucgaauuucacaaggugcugguuggucauugaaagagacugcaugccucgguaagucauaugcgcaaauguggacccuaauguacuuucaucgcagagacuuacgauuagccgcgaacgcuauuugcagugccguuccaagucacuggguaccaacaucaagaacaacgugguccauacacgcaaagcaugaguggaugacaaccgaagauaugcuagcaguuuggaauagggucuggauacaagaaaauccuuggauggaggacaaaacgccagucgaauccugggaagaggugccuuacuuaggcaaacgagaagaccaauggugcggauccuuaauaggacuuacauccagggcgacaugggccaaaaauauacagacggcaauaaaucagguucguucacugauagguaaugaagaauacacugauuauaugccaagcaugaagagauuccguaaagaggaggaagaagcaggaguguugugguga

SEQ ID NO: 22594 - RNA, 9876 nt, Artificial Sequence
  derived and/or modified CDS sequence (opt6) from DENV-2__EU687222__SS-prME
acagcuggaguaaucauaaugcugauacccacugcaauggcguuucaccuaacaaccagaaacggcgaaccccacaugauugucggacgacaagagaaagguaaauccuuacuauucaaaacagaggauggcguaaauauguguacauuaauggcaauagacuuaggagaauugugugaagacacaauaacuuacaaauguccccuacuuagacaaaaugaaccggaggauauugacugcugguguaauaguacuuccaccugggugacauaugggacaugcacuacaacaggagagcaucgacgugagaaaagaucaguagcguuaguaccucauguugggaugggucuagaaaccagaacggaaacuuggaugagcagugaaggugcauggaaacauguacagcgaauugaaacauggauucugcgacauccgggguuuacuauuauggcagcaauauuggcauacacaauagggacgacgcacuuucaacgagcuuuaauauuuaucuuauugacagcaguugcaccaaguaugaccaugagauguauaggaauaucgaaucgagacuucguagaaggggucucaggagggaguuggguagauauaguccuugaacauggcaguuguguuacaacaauggccaaaaauaaaccaaccuuagauuucgaacuaauaaaaaccgaagcgaaacaaccagcgacguuaagaaaauacugcauagaagcaaaacuaaccaauacaaccacugaaaguagaugccccacccaaggagaacccuccuuaaaugaagaacaagacaaacgauuuauuugcaaacacaguaugguagauagaggguggggaaauggaugcggucuauuugggaaaggagguauagucaccugugcuauguuuacuugcaagaaaaacauggaagguaaaguagucuuaccagaaaauuuagaauauacgaucguuauuacuccacauaguggugaagaacaugcuguuggcaaugacaccgguaaacaugguaaagaaauaaaaauuacuccgcaaucgucgauuacagaagcggaguuaacaggauauggaacagugacgauggagugcucgccuagaacuggauuagacuucaaugagaugguguugcuacaaauggaagacaaggcuuggcuaguacaucgccaaugguuccuggaccuuccauugccauggcuacccggugcagacacucaagguucuaauuggauccagaaagaaacauugguaacuuuuaaaaacccacaugcaaagaaacaagacguggugguccuugggagucaagaaggagcgaugcauacugcauuaacgggagcaacugagauacaaaugaguagugggaacuuauuguuuacagggcaccuaaaaugucguuuaagaauggauaaauuacaauugaaaggaaugucauacucgaugugcaccggcaaauuuaaaaucgugaaagagaucgcggaaacacaacacgggaccauuguaauaagaguccaguaugaaggggacgguaguccuuguaaaauaccauuugaaaucauggaccuagaaaaacgccauguccuagggagacuaaucacagucaauccaaucgugacggaaaaagacaguccgguuaauauagaagcagaaccaccauucggggacucauacaucauaauugggguagaaccuggacaguuaaaacugaauugguuuaagaaaggguccuccauuggacaaauguuugaaacaacuaugagaggcgcaaaaaggauggccauuuugggagacacagcuugggauuuugggucauugggcggagucuucacuucaauugguaaagccuuacaucaagucuucggagcaaucuacggugcagcuuuuucuggcgucaguuggacgaugaaaauacuaauaggaguuauaauaacauggaucgguaugaacuccaggucgacaucccuauccguaucauuaguuuuaguaggugucguaacacucuaccugggagugaugguacaagcugauucgggaugugugguaucauggaaaaauaaagaauuaaaauguggcucgggaauauucauaacagacaauguccauacauggacagaacaauacaaauuucaaccagagucaccaaguaaacuugcgucagcaauccaaaaagcucacgaagaaggaauaugcggaauaagaucaguuacaaggcucgaaaauuuaauguggaaacaaauaacgccagaacuuaaccauauucugucagaaaaugaaguaaaacucaccauuaugacuggggacauuaaggguauaaugcaggcaggaaaacguucacucagaccucaacccacagagcucaaguauaguuggaaaacuuggggcaaggccaaaauguugucuacagagagccauaaccaaaccuuccucauagaugguccugaaacugcugagugcccuaacaccaaucgugcuuggaacaguuuggaaguugaagauuauggauuuggggucuucaguacaaacauuuggcucaaguuaagggaaaaacaagauguguuuugugauucgaagcuaauguccgcagccauuaaagacaauagagcuguucaugcugauaugggguauuggauagaaagcgcacuaaacgacacuuggaagauggaaaaggcaucauuuauugaaauaaaaaguugccauuggccuaaaagucacacauuauggaguaacggaguuuuggagagugagaugauaauccccaaaaauuuugccgguccaguaucacaacacaauuaucguccagguuaucauacccaaacagccggaccauggcauuuagggaaauuagagauggauuuugauuuuugcgaaggaacuacaguaguaguuacagaagauuguggaaaccgaggcccaucacuuagaacgaccacagcaucggggaaguuaauuacagaaugguguuguagaaguuguacguuaccuccuuuacgauaucgcggagaggacggauguugguaugguauggaaauaagaccacuuaaagaaaaggaagaaaaccucguaaauucguuagugaccgcugggcauggccaaaucgacaauuuuagccucggcguauuagggauggcacucuuccuagaggaaauguuaagaacaagaguaggcacuaaacacgcgauacugcuaguugccgugagcuucguuacacuuauuaccggaaacaugaguuuucgggaucuuggacgagugaugguuauggugggagcaacaaugacagaugacaucggaaugggagugacuuaccuugcacuucuagcagcuuuuaaaguucggccaacuuucgcggcuggucuauuauuacgaaaguuaacgaguaaggaacuaaugauggccacuauagggaucgcacuacucucacaaaguacuauaccggaaacaauacuagaacugacggaugcgcucgcccucggaaugaugguacuuaaaauugucaggaauauggagaaauaucaauuggcaguaacaauaauggcuaucaguuguguacccaacgccgucauacugcaaaacgcuuggaagguaucgugcaccaucuuggcggcagugucgguaucgccauugcuuuuaacauccagucagcaaaaagcagauuggaucccccuugcuuuaacaauuaagggacugaacccaacggccaucuuccuuacgacgcuaucacgaacgagcaagaaacgaaguuggcccuuaaacgaagcgguuauggcaguagggaugguuagcauauuggccucaagccuacuuaaaaaugacauaccaaugacuggaccauuggucgcuggugggcuacuaacaguuugcuacguauuaacaggcaggucugcagauuuagagcuugagagagcagcagacguaaagugggaagaucaagcugaaauuucggguagcucucccauacuuucuauaacaauaucagaagacggauccaugaguauuaaaaacgaagaagaggaacacacacucacaauacuaauucgaacuggccucuuaguaauaucuggcguauucccuguaagcauuccaauaacagcugccgcuugguaccucugggaaguuaagaaacagagagccgguguauuaugggaugugccaaguccaccacccguagguaaagcggaacuggaagauggugccuaccgaauaaaacagagaggaauauuugguuacucacaaauuggagcgggcguauauaaagaaggaacauuccauaccauguggcaugugacacggggagcgguacuaaugcacagaggaaaacgaauugaaccaaguugggcugacgugaagaaagaccugauuucuuauggaggaggauggaaacucgaaggagaauggaaagaaggugaagaaguacaaguacuagcucuugaacccgggaagaacccccgugcagugcaaacuaaaccagguuuauuuaaaacuaacacagguacaaucggagcugugucuuuggauuuuaguccagguaccucggguucaccgauaguagaucgaaaaggcaaagugguuggauuauaugggaauggaguaguuacgagaucuggcgccuauguaagugcgauagcacaaaccgaaaaaucgauagaagauaacccugaaaucgaagacgauauauucagaaagaaacgcuugacaauaauggacuugcauccgggggcgggaaaaacuaaacguuaucuaccggccauugugagagaagcuauaaagagaggguuacgcacucugauuuuagcuccuaccagggucguugcagcagaaauggaggaagcacugcguggacucccaauaagauaccaaaccccagcuauuagggccgagcacaccggacgagaaauaguggaccuaaugugucaugcuacauucaccaugcggcuauuaucuccaguuaggguaccaaacuacaaucuaauuauaauggacgaagcucauuuuacugauccagcaagcaucgcugcgagaggauacauuaguacgagaguagaaaugggcgaagcugcuggcaucuuuaugaccgcuacaccaccaggaaguagagauccauuuccucaaaguaacgcuccuauuauggaugaagaaagagaaaucccugaaagaagcuggaauaguggacacgaauggguaacagacuuuaaaggaaaaaccguuugguucgugccuuccaucaaagcagguaacgauaucgcagcaugucuaaggaaaaacggcaagaagguaauacaacuaucaagaaaaacuuuugauagugaauacguuaaaacaagagcgaacgauugggacuuuguagucacaaccgacauaagcgaaaugggagccaacuuuagggcagaaagagugauugauccccgucgaugcaugaagccuguuauauuaacugacggugaagaaaggguaauacuagcaggaccuaugccaguaacgcacucuucugccgcacaacggagagguaggauaggaagaaauccgaagaaugagaacgaccaguacaucuauaugggagaaccuuuagagaaugaugaggauugcgcacauuggaaagaagcaaagaugcuuuuggauaauaucaauacuccagaagguauaauaccaucaauguucgaaccugaaagagaaaaaguugaugcaauugacggagaauaccguuuaagaggcgaggcaagaaaaacuuuuguggaccuaaugcgcagaggggauuugcccguuugguuagcauacagggucgccgcugaagguauaaacuacgcugauagaaggugguguuuugacggcaucaagaacaaccaaauacuugaagaaaacguugaggucgagaucuggacaaaagagggagaaaggaagaaacuaaaacccagauggcuagaugcgaggauauauucggaucccuuagcuuuaaaggaguuuaaagaauuugcggcaggcagaaagucuuuaacacuuaaucucauuacugaaauggguagacucccuaccuuuaugacgcaaaaagcacgugacgcacucgauaaucuagcaguguugcacacagcugaaguagguggacgugcauauaaccacgcucucucagaacuuccagaaacauuagaaacuuuacugcuacuaacacuccuagcaacagucacugguggaauauucuuauuuuuaaugagugguaaggguauuggaaagaugacucuagggaugugcugcauaaucacagcaucaauauuacuaugguaugcacaaauacaaccucacuggauagcagccucaauuauacucgaauuuuuccuaaucguccuacuuauaccggaaccggaaaaacaaaggaccccucaagauaaucagcugacauacguaguaauugcuauucuaacaguaguagccgcuacuauggcaaaugaaaugggcuucuuagagaaaaccaagaaagauuuagguuuaggaucuauaaccacacaagaaagcgaaucuaauauacuugacaucgauuugcgaccagccagugcauggacucuguacgcaguagcaacgacauucgugacucccaugcuacgacauaguaucgaaaauuccagcguaaacguaagucuuacagcaauagccaaccaggccacagucuugauggggcuuggccgcggcuggcccuugucgaagauggacauaggggucccucuucuagcgauuggguguuacucgcaaguuaauccuauaacauuaacagcugcgcuauuauuacucguagcacauuaugcgaucauaggaccuggguuacaagccaaagcaaccagggaagcacagaaacguacggcagcagggaucaugaaaaauccaacuguugauggaauaacaguuaucgaccuugaaccuauaccguaugacccgaaguuugaaaaacaauuaggacaaguaaugcuauuaguucucugugucacacaagucuuaaugaugcgcacuacaugggcucuuugcgaggcuuuaacauuagcuacagggccuauaucgacccuaugggaagguaacccaggaagguucuggaacacaaccauagcuguaucaauggcuaauaucuuccgaggguccuacuuagcaggggcaggacuccucuuuucgauaaugaaaaacacuacgaacacaagacgaggaacagguaacaucggagaaaccuuaggcgaaaaauggaaaaguagauugaaugcucuaggaaaaagcgaauuucaaauauacaagaaaucaggcauacaagaaguagaccggacucuagcuaaagaagguauuaagcgaggagaaacggaccaucacgcaguuagcagaggaucagcuaagcuacgaugguucguggaacgaaauauggugacaccagaggguaaggucguagacuuggguugcggccgagguggauggucguauuauugcgggggacuaaagaacguaagagagguuaaaggauuaacaaaaggcgggccaggacaugaagaaccaauucccaugucaacuuauggcuggaacuuagugcguuuacaaucagguguagauguauucuuuaccccaccagaaaaaugcgauacacuacuaugugauaucggcgaaucaaguccuaaucccacuauagaagcagggcguacucucagaguauugaacuugguggaaaauugguuaaauaauaauacacaauuuugcaucaagguacuaaauccuuauaugcccagcgugauugagaaaauggaaacacuucaacgcaaguaugggggagcguuaguaagaaaccccuuaucccggaauaguacacaugagauguauuggguuucaaaugcaacugggaacauugucaguucggugaauaugaucagcagaaugcucauaaaccgauuuacaaugaaacauaagaaagcaacauaugaacccgauguagauuuggguagcggaaccagaaauauagguaucgaaaaugaaauacccaauuuagacauaauagggaaacgaauagaaaagauaaaacaagaacacgaaacuucauggcauuacgaucaggaucauccauacaaaacaugggcauaucaugggucauacgagacuaaacaaacuggaagcgcgucuaguaugguaaacggcgucgucaaacuacuaacaaaaccuugggauguggucccaauggugacucaaauggcaaugacugauacuacuccauuugggcagcagaggguuuuuaaggagaagguagacacacggacucaagaacccaaagaaggcacaaagaaauugaugagaauuacagcagagugguuguggaaagagcuaggaaagaagaaaacuccacgaauguguacaagggaggaguucacaagaaagguuagaagcaacgcagcacucggcgcgauauuuacggaugagaacaaauggaaaagcgcuagagaagcuguugaggacagccgauuuugggaauugguugaucgagagcguaaccuucaucucgagggaaaaugugaaacuuguguuuauaauaugauggggaaaagggagaagaaauuaggcgaguucgguaaagcaaaggguagucgugccauaugguauauguggcuaggagcccgauucuuagaauuugaagcccuaggauucuuaaacgaggaucauugguuuagcagaggaaacagucugucuggaguggagggggagggauuacacaaguuaggauacauacugagggacgugagcaagaaagaaggcggagcuauguaugcugaugauacggcuggaugggacacuagaauaacauuagaagaucucaaaaacgaagagaugguaacaaaccauaugaaaggcgaacacaaaaagcuagcggaggcaaucuuuaaacugacauaucaaaacaagguuguuagaguacaaaggccaacaccccgaggaacaguaauggauauaauuuccagaaaagaccaaagaggaagugggcaaguugggacauauggauuaaacacauucacaaacauggaagcgcaacuaauucgacaaauggaaggugaaggaaucuucaagagcauucagaggcuaaccguaaccgaggagauagcgguacagaauugguuggcgagaguaggacgcgaaagguuaagccgaauggcuauuucaggagacgauugcgucgucaagccuuuggacgaccgauucgccagcgcuuuaacagccuugaaugauauggggaagguccgcaaagacauucaacaaugggaacccucacgagguuggaaugauuggacucaggucccauucuguagucaucacuuucacgaauugguaaugaaagacggucgaguauuaguaguaccaugcaggaaccaagaugaguuaauaggaagggcuagaauaucccaaggagcuggcuggucgcuuaaagaaacagcaugcuuggggaagucauacgcgcagauguggacacuaauguauuuucaucgucgagaucuaaggcuggcggcaaaugcaaucugcagcgcugugccuagucauugggugccuacaagcaggacaacauggaguauucaugcaaagcaugaauggaugacuacagaggauaugcuagcgguuuggaaucgaguauggauacaagaaaauccguggauggaggacaaaacuccuguggaaucuugggaagaggucccauaccuaggaaaaagggaagaucaauggugcgguucacuuauaggauuaacuagccgugcgacgugggcuaagaauauacaaacagcaauaaaccagguucguagcuuaauaggaaacgaagaauauacagauuauaugccaagcaugaaaagguuucguaaagaagaagaagaagcuggcguuuugugguaa

SEQ ID NO: 22595 - RNA, 9876 nt, Artificial Sequence
  derived and/or modified CDS sequence (opt6) from DENV-2__EU687223__SS-prME
acggcgggaguuauuauaauguugauaccuacugcaauggcguuucauuuaacaacaaggaauggugaaccgcauaugauagugggacggcaggaaaaaggaaaaucacuucuauuuaaaacugaagacgguguuaauaugugcacauuaauggcuauagauuuaggggaauuaugcgaagauacaauaacauauaaauguccuuuacucagacagaaugaaccggaagauauugacuguuggugcaauagcacuuccacauggguuacuuacggcacgugcacaacuacuggcgaacacaggagggagaaacgauccguugcccuaguaccacaugucgguaugggccuggaaacaagaacggagacuuggaugagcucagagggagccuggaaacacguccaaagaauagaaacauggauauuacggcauccuggcuuuacgauuauggcggcaauauuagcguauacaauaggaaccacgcacuuucagcgggcacucauauucauacugcucacugccguggcgccaucgaugacaaugcgcugcauuggaaucaguaaucgcgauuuuguagagggaguaucugguggaucauggguugauauaguacuagaacacgggucauguguuacaacaauggccaaaaauaaaccaacucuagauuuugaacuuauaaaaacugaagcuaaacagccagcgacauugcggaaauacuguauugaagcuaaacuaacaaauaccaccacagaaucgagaugcccaacacagggagagcccaguuugaaugaagaacaagacaaaagauuuauuugcaaacauagcaugguggauagaggguggggcaauggaugcgggcucuuuggaaaaggagggauaguaacaugcgcaauguucacauguaagaaaaauauggaagguaaaguuguguugccagaaaauuuagaauacacuauaguaaucacgccacauaguggugaggagcaugcaguaggcaacgacacaggcaaacaugggaaagaaaucaaaauaacuccucaaucauccauuacagaggcagagcuuacaggauaugggacgguaaccauggaauguagcccaagaacagguuuggauuuuaaugaaaugguauuacuacagauggaagauaaggcuuggcuaguacaccgucaaugguuuuuagaccuuccauuaccauggcuaccaggggccgacacgcaagggucaaauuggauacaaaaagagacauuagucaccuuuaaaaacccacaugcaaagaaacaagauguuguuguccugggaucucaagaaggugcgaugcauacagcgcuaacuggagcaacugaaauacagaugaguucagguaaccuauuguuuacagggcaucugaaauguagauugaggauggauaaauuacagcuuaaaggaaugucguauagcauguguacagggaaauucaaaauaguaaaagaaauugcugaaacucaacaugguacaauuguaauucgaguacaauacgagggggacggaucgccauguaaaauuccauuugaaaucauggaccuggagaaaagacaugugcuaggacgguugauuacaguaaacccaaucguuacugguaaagacaguccugucaacauugaagcggaaccgccuuuuggggauaguuauauaauuauagguguugaaccaggacaacugaaauuaaauugguuuaagaaagguagcaguauaggacaaauguuugaaacaacaaugagaggagcaaaaaggauggcuauacuaggagacacagcaugggacuuugggagcuuaggaggcguuuucacgaguauugguaaagcccuccaccaagucuuuggagccauuuauggggccgcuuucucuggagugucauggacaaugaaaauucugaucggaguaauaaucacauggaucgguaugaauagccgcaguacaucuuuaucagugagcuuaguuuuaguaggugucgucaccuuauauuugggugugaugguacaggcagacaguggaugcguugucaguuggaaaaauaaagaacugaaaugugggagcgggauauuuauuacagauaauguacacacuuggacagagcaauauaaauuucaaccugaaucaccaucuaaacuagcaagcgcuauucaaaaagcacacgaagaggggauuugugggauacgguccgucacucgccuugaaaaccucauguggaaacagauuacuccggaauuaaaucauauccuauccgagaacgaaguaaaacuaacuauaaugacaggagauauaaaaggaauuaugcaggccgguaaaaggagcuuacgaccucaacccacagaacuaaaauauucuuggaaaacuuggggcaaagcuaaaaugcucagcacugaaucacauaaucagacguuucuaauagauggccccgaaacagcggaauguccaaauacuaaccgugcauggaacuccuuagagguggaggacuacggauuugggguuuucucaacgaauaucugguugaaauugagagaaaaacaggauguauuuugcgauucaaaacuuaugucagcugcgauaaaagacaauagagccguucacgcugauaugggcuauuggauagaaucagcucugaaugauacauggaaaauggaaaaggcuucuuucauugaaauuaaaucaugccauuggccgaaaucacauacauuauggagcaauggugucuuggaaagugaaaugauuauuccuaaaaauuuugcagguccgguaucucaacacaacuauaggccagguuaccacacucaaacagccgggccauggcaucuugggaaacuugagauggacuucgauuuuugcgaaggcacuacgguaguaguuacagaagauugcggaaaucgaggaccgucauugagaacuacuacagcuucugggaaacucaucaccgaauggugcugcagaaguugcaccuuaccaccuuugcgauaccgaggugaggauggaugcugguaugggauggagauuaggccacugaaagagaaagaagagaauuugguaaacucuuugguuacugcgggccacgggcaaauugauaauuucagucuuggaguucuagguauggcacuauuccuagaagagaugcuacgaacaagaguagguacuaaacaugcaauccuccuaguggcggugucuuuugugacacuaauaacaggaaacaugagcuuccgcgauuuaggacgugugaugguaaugguaggugcaaccaugaccgaugacauagguauggguguaacauaucuagcacuucuugcugcuuucaaaguuagaccuacauuugcagccgguuuacuguugaggaaauuaacaucaaaagaauuaaugauggcuacuauagggaucgcucuacuuucccaaaguacuauaccagagaccauauuggaacuaacagaugcucucgcuuuaggaaugaugguucucaaaauugucagaaacauggaaaaauaccaacuagcagugacaauaauggccaucucauguguaccuaaugcgguuauacugcaaaaugcuuggaaaguaaguuguacaauacuugcagcggugucuguuucuccgcuuuuguuaacuucuagccagcaaaaagcugacuggauaccccuagcucugaccaucaaaggauuaaauccaacggcaauauuccugacaacgcuuaguagaacuagcaagaaaagaucauggccacuuaaugaggccgucauggcaguagguaugguuuccauucuugcaagcucucuacugaaaaacgacauacccaugacaggcccuuuaguugcagggggucuucucacaguauguuacguauuaacgggacgcagugcagaucuagaacucgaaagagcggcggaugugaaaugggaagaucaagcagaaauuucugggucgucaccaauauuaagcaucacaauauccgaggacggauccaugucaaucaaaaaugaagaagaggaacacacacuaacaauauuaauacgcacggggcugcugguaauaaguggggcauuuccaguuucaauaccgauuacagcagcugccugguauuuaugggagguuaagaaacaacgcgccggaguacucugggacguccccaguccuccaccggucggaaaagcugaauuagaagauggggcguaucggauaaaacagagaggcauauucggguauagccaaaucggggccggaguuuauaaagaaggaacauuucauacuauguggcacgucacucgaggcgcaguauuaaugcauagaggaaaaagaauugagccaagcugggcagaugucaagaaagaucuaauaucuuacgggggugguuggaaacuagaaggagaauggaaagaaggggaagaaguacaaguccuugcauuagaacccggaaagaauccaagagcuguucaaacuaagccuggccuuuuuaaaacaaauacaggaacaauaggggcaguaucauuagauuucagcccuggcacaaguggaucuccgauuguugaucgcaaaggaaaagugguagguuuauaugguaacggagucguaacucgcucuggagcauacgucucggcgauugcacaaacugaaaagucuauagaagauaacccagaaauugaagaugauauuuuuaggaagaaaagacuuacaauuauggaucuucauccuggcgcagguaaaacaaaaagguaccuaccagcaauaguaagagaggccauaaagagaggauuaagaacgcuuaucuuagcaccaacgagaguaguagcagcagaaauggaggaagcacucagaggccuaccuauuagguaccaaacgccagcaauaagagcagaacauacgggcagagagauaguggauuuaaugugucaugcgacauuuacuaugagauuguuaucuccaguccggguucccaauuacaaccuaauuauuauggaugaggcgcauuuuacggauccagccaguauagcggcacgaggauacauaucuacacgugucgaaaugggagaagcggccgggauauuuaugaccgcgacucccccgggaucuagggaucccuuuccgcaaucuaaugcaccgaucauggacgaagaaagagagauuccugagagaucauggaacuccggucaugaaugggugacagauuucaaaggaaaaaccguuugguuuguaccuucgauuaaagcagguaaugacaucgcugcaugccuucguaagaauggaaagaaaguaauucaacucucaagaaagacauuugacucagaauauguaaaaacgagagccaacgacugggauuuuguaguuacaacagauauaucagagaugggagcaaauuuucgcgccgaaaggguuaucgauccgagaagguguaugaaacccguaauucuaacugauggugaggaaagaguuauauuagcagguccaaugccuguaacacacucgagcgcagcccagcgaagaggccggauuggacgaaaucccaaaaaugaaaaugaucaauacauauauaugggugaaccacuagaaaacgacgaggauugugcccauuggaaagaagcuaaaaugcucuuagauaauauaaacacaccugaaggcauuaucccaucuauguucgagccggagagggagaagguggacgcaaucgauggcgaauaccgucugagaggagaggcaaggaaaacauuuguagaucuaaugagacgaggggauuugccaguuuggcuagcguauagaguggcagcugaggggauuaacuaugcggaccgcagaugguguuucgaugguauuaaaaauaaccagaucuuagaggagaauguagaaguagagauuuggaccaaagaaggugaaaggaagaaauugaaaccucguuggcuggacgcucgcauauauagugauccauuagcguuaaaagaauuuaaagaauuugcagcgggccguaaaucacuaacacugaaccuaauaacugagaugggccgcuugccuacauuuaugacacaaaaggcaagagacgcauuagauaaucuagcaguccuacauacggcagagguaggagggcgagcuuacaaucacgcuuuaagugaauuaccagagacacuugaaacuuuauuauuauugaccuuacuugccaccguuacagggggaauauucuuauuccuaaugucuggcaaagguauaggaaaaaugacccuugggaugugcuguauaauaacugccucaauacugcuaugguaugcucaaauucaaccacacuggauagcggcgaguauaauacuggaguucuuucuaauuguguugcuuaucccggaaccugaaaaacagcgaaccccucaagacaaccaguugacguauguagugauugcaauacuuacgguuguagcagcaacgauggcgaacgaaaugggauucuuagagaaaacaaagaaagaucuuggacugggcaguauuacaacacaagaaucagaaaguaauauuuuagauauagaucuaagacccgcaagcgcuuggacucuuuacgcagucgcaacuacauucgugaccccuaugcucagacacucuauagaaaacucgucagucaaugugagccucacagcaauagcuaaccaagcgacaguguuaaugggcuuaggaagaggcuggcccuuaagcaagauggacaucggaguuccacuacucgcaauugguuguuauucacaaguaaaucccauaacguuaacugcagcucuguugcuccuagucgcacacuaugccauuaucgguccaggcuugcaggcuaaagccacaagggaggcgcagaaacggacagcagccgguauuaugaaaaauccaacaguagauggaauuacagucauugacuuagaaccuauuccuuacgauccuaaauuugaaaaacaacuuggucaggucaugcuguugguacuaugcgucacacagguguugaugaugagaacgacaugggcgcugugugaggcguuaacucuugcgacaggcccaaucaguaccuuaugggagggcaauccuggaagauucuggaacaccacgauagcagugucaauggccaacaucuuuagaggaaguuaucuugcuggugccgguuugcuuuucagcauaaugaaaaauaccacuaauacuagacgaggaacaggcaauauaggagaaaccuuaggcgaaaaauggaagucuagauuaaaugcauuaggaaaaagcgaauuucagauuuauaagaaaagcgggauucaagaaguagauagaacucuugcaaaagaagggauaaaaagaggggagacagaccaccaugcaguuucgcguggaucagccaaauuacgcugguuuguagagcggaacaugguaaccccugagggcaagguuguugaccuugguuguggaagaggagguuggagcuauuacugcgggggucuaaagaauguucgagaagugaaagguuuaacaaaagggggaccuggacacgaagaaccuaucccaaugucgacauacggguggaaucuagugcgccuucaguccggaguggauguauucuuuaccccuccagaaaaaugugacaccuuauuaugugauauaggugaaaguucaccaaauccaacaauagaagccggcagaaccuuacgagugcugaauuuaguagaaaacugguuaaauaauaauacacaauucugcauuaaaguucuaaacccguauaugccuuccguaaucgagaaaauggaaacucugcagcgcaaguaugguggcgcacuuguacguaacccacuaucacgaaauucaacgcaugagauguauugggugucuaacgcaacugguaacauugucucuuccguuaacaugauaucaagaauguuaauuaaccguuucacaaugaagcacaagaaagcuacauacgaaccugauguagaccuuggaucuggaacacggaauaucggcaucgaaaaugaaaucccaaauuuggauauaauaggaaaacgcauagagaaaauaaaacaagaacaugaaacuuccuggcauuacgaucaggaucacccauauaaaacuugggcuuaccauggaagcuaugaaacaaaacaaacaggauccgcauccucaauggugaacggggucgugaaacuauugacaaaaccuugggauguggugccuaugguaacacaaauggcgaugacggauacaacaccauuuggccagcaaagaguauuuaaagagaaagucgauacccgaacgcaagaaccaaaagaaggaaccaagaaacuuaugagaauaaccgcggaguggcuuuggaaagaguuagguaaaaagaaaacuccaagaaugugcacucgagaggaauuuacuagaaaagucagaucaaacgcagcauugggagcaauauuuacagaugaaaauaaauggaaaucugcaagggaagcagucgaggauagcagauucugggaguugguggaucgugagaggaaccuacaucuagaaggaaagugugaaacauguguauauaacaugaugggcaaacgugaaaagaaauuaggagaauuuggaaaagcaaaaggcucucgugcaaucugguacauguggcuuggagcaagauuucuugaauuugaggcuuuaggauuucuaaacgaagaucacugguuuucgagggguaacucacuaucuggugucgagggugaaggccuccacaaauuaggauacauuuuaagagaugugucgaagaaagagggcggugcgauguacgcugaugacacagcaggaugggacacgcgaaucacguuagaagacuugaagaacgaagaaaugguuacuaaucauaugaaaggcgaacacaagaaacuagcggaagcaauuuucaaacuaacuuaccagaauaaaguugugagaguccaacguccuacuccaagaggaacuguuauggacauaauaagucguaaagaccagcgugguucaggacaaguagguacuuauggacuaaauacuuucaccaacauggaagcacaauuaauacggcaaauggaaggcgaaggaauauucaagucgauacaacgauuaaccgucacggaagaaauagccguucaaaacuggcuagcgagagucggaagagaaaggcucucgcgaauggccauuucaggagaugacugcguugugaaaccgcuugaugauagauuugcuucugccuugaccgcucuuaaugauauggggaagguacgaaaggacauucagcaaugggaaccgucaagaggguggaacgauuggacucaggugccauucuguagccaccauuuucacgagcuuguuaugaaagauggaaggguauugguaguaccuugucgaaaccaagacgaguuaauaggucgagcucgaauaucacaaggugcaggauggucacuuaaggaaacagcaugccuggguaaauccuaugcacaaauguggacauugauguacuuccaccgacgugaucuuagauuagccgcaaacgcgauuugcucagccgugccaucacauuggguaccuacuuccagaacaacuuggucgauucaugccaaacacgaauggaugacaacagaggacauguuagcaguauggaauagagucuggauacaagaaaauccauggauggaagauaaaacuccagucgaaucaugggaggaaguuccauacuuagggaaacgugaagaucaauggugcggaucauuaauuggucuuacaucaagggcaaccugggcuaaaaauauacagacggcaaucaaccaaguaaggagucuaaucggaaaugaggaauauacagacuauaugccuucaaugaagcgauuuagaaaggaggaagaggaagcaggaguccuuugguaa

SEQ ID NO: 22596 - RNA, 9876 nt, Artificial Sequence
  derived and/or modified CDS sequence (opt6) from DENV-2__EU687227__SS-prME
acggcugguguuaucaucaugcugauaccuacagcaauggcauuccauuuaacaaccagaaacggagaaccacauaugauaguaggacgucaagaaaaaggaaagagcuugcuauuuaaaacagaagacggagugaauaugugcacacuaauggcaaucgaucuuggugaacucugugaagauaccauaacuuacaaaugcccacuuuugcgucaaaaugaaccagaagacauagacuguugguguaauucaaccagcacuuggguuacauaugguacauguacuacaacgggagaacaucgaagagaaaaacggucaguagcauuaguaccgcacguuggaaugggccuugaaaccaggacagaaacguggaugaguucagaaggcgcauggaaacauguccaaagaauagaaacauggauauuaagacauccaggauucacaauuauggcagcuaucuuagcuuacaccauuggaacuacucacuuccagagggcauuaauauucauucuucuaacagccguagcaccuucaaugacgaugcguuguauagguauaaguaauagggauuucguugaagguguaucaggcgggucauggguagauauaguuuuagaacacggaagcugcguuacaacuauggccaaaaauaagccuacgcuggauuucgaacuuauaaaaacagaagccaagcagccagcaacauuacguaaauauugcauagaagcuaaacucacaaacaccaccacggaaaguagauguccuacgcaaggggaaccaagucuaaacgaagaacaagacaaaagauucauuuguaaacacucaaugguggaccguggcugggggaauggauguggucucuuuggcaaggguggcauuguuaccugcgcuauguucacauguaagaaaaauauggaaggaaagguaguuuuaccagaaaauuuagaauacacuauugucaucacaccucauagcggagaagaacacgcugucggaaaugacacaggaaaacacggcaaagaaauuaaaauaacaccucaaucuucaauuacugaggcagaacucacaggguaugguacgguaacaauggaguguucaccuagaaccgggcuggauuuuaaugaaaugguauuacugcagauggaagacaaagcauggcuuguacacaggcagugguuuuuagauuuaccacuaccgugguuaccaggagcggauacacaaggaaguaacuggauucagaaagaaacacuuguaacauuuaagaacccucaugcaaagaagcaagacgucguaguacugggaucgcaagaaggugccaugcauacagcgcugacuggggcgacggaaauacagaugaguagcggaaauuuacuuuucacuggccacuuaaaaugcagauuacgaauggacaaacuucaauuaaagggcaugucauacucaaugugcacugguaaauuuaaaauaguaaaagaaauagcggaaacccaacacggaacaauaguaauacgcguucaguaugagggggacgguaguccaugcaaaauaccuuuugagauaauggaccuugaaaaacgucauguucucggcaggcuaauaacaguaaauccuaucguaacagaaaaagacaguccugucaauauagaagcagaacccccauuuggagauuccuacauaauaauagguguggaaccuggacaacucaaacuaaauugguucaagaaagguucuucaauaggucaaauguucgaaacgaccaugcguggggccaaacgaauggcaaucuugggugauacugcuugggauuucggaagccuaggaggugucuuuaccagcauuggcaaagcacuucaucaagucuucggugcuauuuacggcgcagcauucucagguguaagcuggacaaugaaaauuuuaauaggugugauaauuaccuggaucgguaugaacucccguaguaccucuuugaguguaucguuagugcuagucggugugguuacuuuauaccuugguguuaugguucaagcugacagugguuguguaguuagcuggaaaaauaaagaacuaaaauguggaaguggcaucuuuauaaccgauaauguacauacguggacugaacaguauaaauuucagccagaauccccgucuaaacuggcgagcgcaauacaaaaagcacaugaagaagguauauguggcauucguucaguuaccagauuagaaaaucugauguggaagcaaauaaccccagagcucaaccauauuuuaucagagaaugagguaaaacuaacaauuaugacaggcgacauuaaaggaauuaugcaagccgguaagcggagucuucgcccccaaccaaccgaacugaaauacucuuggaagacguggggcaaggccaagauguuaucgaccgagucacauaaccaaacauuuuuaaucgacggaccggaaacagcagaauguccaaauacaaauagagcauggaacucccuagaaguagaggauuacggauucgggguauucaguacaaacauaugguuaaaacuccgugagaagcaggauguguucugcgacuccaaguuaaugucagcugccauaaaggacaauagagccgugcaugccgauaugggauauuggauagaaucagcauuaaacgacacauggaaaauggagaaagcgucguucauagaaauaaaaucgugccauuggccaaaaucucacacacuauggagcaacgguguauuagagucagagaugauuauuccaaagaauuucgccggaccggucucgcaacauaauuauagaccuggcuaucacacccaaacugcaggcccguggcaucuaggaaaauuggaaauggacuuugauuuuugcgaagguacgacaguaguaguaaccgaagauuguggaaauaggggacccaguuuaagaacgacaacagcuuccggaaaguuaauaacagagugguguuguagaaguugcacccuaccgcccuugagauacagaggagaagauggauguugguacggaauggagauaagaccguuaaaagaaaaagaagaaaaccuugucaauagcuuagugacugccggacacggacaaauagacaauuuuucauuaggcguccucggaauggcuuuauuucuagaagaaauguuaaggacgaggguagguaccaagcaugcaauacuccugguugccguuucguuugugaccuugauuacgggcaauaugucauucagagacuuaggaagagucauggucaugguaggcgccacaaugaccgaugauaucggcaugggugucacuuauuuagcauuacuagccgcauucaaaguccgacccacguuugccgccggacuacucuugcgaaaacuuaccagcaaggaauugaugauggcaacuaucggaauagcacuucucagucaaucgacuaucccugaaacgauauuggaauuaaccgacgcccucgccuuaggaaugaugguacuaaaaauagucaggaauauggagaaauaucaacucgccguuacgauaauggcaaucaguugcgucccgaaugcagugauacuacaaaaugcauggaaaguaucaugcacuauacuugcggcgguaucagugaguccccuauuacuaacaagcucccaacagaaggcagauuggauuccguuagcccuaacgaucaaagggcuaaauccgacagcuauauuucucaccacacuaucucggacuucaaagaaacgcagcuggcccuuaaaugaggccguaauggcaguuggaauggucaguaucuuagcaaguucuuuauugaagaacgauauaccaaugacaggaccccuaguggcaggaggcuuacugacagugugcuacguacuuacaggacgaucggccgaccuggagcuagaaagagccgcagauguaaagugggaagaucaggcagaaauaucagggaguucuccgauucuaucgauaacaauuagugaagacggaaguaugaguaucaaaaaugaggaagaagaacacaccuuaacaauuuugauaaggacgggacuuuuaguuauaucagguguguucccuguuucuauaccaauaacugcugcagcaugguauuuaugggagguuaagaaacaaagagcugguguauuaugggauguaccgagcccaccgccuguagguaaggcugaacuagaggacggagcauacagaauuaagcaaaggggcauauucggcuacucucaaauaggggccgguguuuacaaagagggaacauuccauacaauguggcauguaacaagaggugcagucuuaaugcauaggggaaaaaggauagaaccgucaugggcagacguaaagaaagauuuaauuucuuaugguggcgguuggaaauuagaaggugaauggaaagaaggagaagaagugcaaguacuugcccuagaaccggguaaaaacccgcgugcuguacagacuaaaccuggauuauuuaaaacgaacacagggacuauuggugcaguaucacuugacuucucaccaggaacaagcggcaguccaauuguagauaggaagggaaaaguaguagggcuauaugguaauggagucgucacaagauccggcgcguacguaagugccauugcgcagacagagaaaagcauugaagauaacccugagauagaagacgauauauuuagaaagaaacgucuaaccauaauggauuugcauccgggcgcugggaaaacgaagcguuauuugccagcaauuguaagagaagcgauaaaacguggauuaaggacucuaaucuuagcccccacccggguaguagcggcagaaauggaagaggcauugcgaggauuaccgauaagguaucaaacacccgcaauaagagcagaacacacgggcagggaaauagucgaccuaaugugccaugcaacauuuacgaugcgacuucuuaguccuguuagggugccuaauuauaaucuaauuauaauggaugaggcgcauuuuacagaccccgcauccaucgccgcacgaggauauauaucaacuagagucgagaugggagaggcagccggcauuuucaugacugcgacgccacccggaagcagggauccuuuuccacaaucaaaugcaccuauaauggaugaagaacgcgaaauaccagagcgaucauggaacucaggacacgagugggucacggacuuuaaagguaaaacgguuugguuugucccaucaaucaaggccggcaaugauaucgcagcuugcuugcgcaaaaaugggaaaaagguaauacagcuuagucggaaaacauucgacagugaauauguaaaaacacgugcuaacgauugggauuuugugguaaccacagauaucagcgaaaugggggcgaauuuccgggcagagcgaguaauagacccacgaaggugcaugaagccaguuauacuaacagacggagaagaaagagucauuuuagcggguccgaugccgguuacgcauagcucggcagcacagagaagaggucgaauuggaagaaauccgaaaaaugaaaacgaucaauauauauacaugggagaaccucuagaaaaugaugaagauugcgcacauuggaaagaagccaaaaugcuccucgacaauaucaauacaccugaaggaauaauaccaucgauguuugagccugaacgugaaaaaguagaugcaaucgauggagaauauagauuacgcggagaagccagaaagaccuuuguagaccugaugagacguggggauuuaccaguguggcuugcauauaggguagcugcagaagggaucaauuacgcggacagaaggugguguuuugauggcauuaaaaacaaucagauacucgaagaaaacgucgaaguggagaucuggacaaaggaaggcgaacggaagaaacuaaagccucgaugguuggaugcaagaauauacagcgauccacuugcgcuuaaagaauuuaaagaguucgcugcgggcagaaaaucucucacauuaaaccucauaacugagaugggaagguuaccgacauuuaugacacaaaaagcuagagacgcuuuagauaaucuugccguucuacauacagcugaggucgguggaagggccuacaaucacgcccuuucagaacuaccagaaacuuuagaaacuuuacuguugcuaacacuuuuagccacagucacuggugguaucuuucucuucuuaaugucaggaaaagguauagguaagaugacucuugguaugugcugcauuauaacagcuucaauauuauuaugguacgcucagauucaaccucacuggauagccgcgucgauaauuuuagaguucuucuuaauuguccuguuaaucccugaaccugaaaaacaaagaacaccacaggauaaucaguuaacauauguuguaaucgccauauuaacuguaguagcagcaacuauggcuaaugagaugggauucuuagagaaaaccaagaaagauuuagggcuaggaagcauaacaacccaagaaagugaaagcaauauauuagauaucgacuuacguccagcaagugcuuggacacuuuacgcaguagcuacgacauuugugacgccaaugcuaaggcacagcauagaaaacucuagcgucaauguaagccuuaccgccauagcuaaucaggcgaccguccucauggguuuagguaggggcuggccuuuaucaaagauggauauaggaguccccuuacuagcaauugggugcuauucccaagucaauccaauuacauugacugcagcauuauuacuccuaguggcacauuaugcaauuauuggaccagggcuucaagcuaaagcgacucgagaagcucaaaaacgaacugcugccggcauaaugaagaacccuacaguagauggaaucacgguuauugaccuagaaccaaucccuuaugauccgaaguuugaaaaacagcugggucaagucaugcuguuaguuuuauguguaacacagguauugaugaugaggacgacuugggcauuaugcgaagcacucacuuuagccacugggccaauuaguacauuaugggaaggaaauccgggacgguucuggaauaccacaaucgccgucagcauggcaaacaucuuuagaggaaguuauuuagcuggagcaggguugcuguuuaguaucaugaagaauacaacuaacacaagaaggggaacaggaaauaucggagaaacccuuggagaaaaguggaaaagcagacuaaaugccuuagguaaaucagaauuucaaauauauaagaagaguggaauccaggagguugaccgaacauuagcuaaagagggcauaaaaaggggagaaacggaccaucacgcuguuagucgugguucagcuaaacuaagaugguuuguagagagaaauauggucaccccagaaggaaaaguuguugauuuaggaugcgguagaggagguuggucauauuauuguggaggucuuaaaaacguucgcgaagugaaaggcuugacaaaagguggaccgggucacgaagaaccuauaccuaugagcacguauggcuggaacuuaguuagguugcaaagcgguguagaugucuucuuuacaccgccagaaaaaugugauacguuacuuugugauauaggagaauccaguccaaauccuacuauugaagcgggacguacacuuagaguacugaaccucguagaaaauuggcuuaacaacaauacucaauuuuguauaaaaguccuuaauccuuauaugccuucaguuauugaaaagauggaaacgcuucagcgcaaauaugguggagcguugguacggaauccauuaucacgaaacucaacacaugaaauguacuggguaucgaacgcuaccggcaauauaguaagcaguguaaacaugauaucccggauguuaauaaaucgauucacgaugaaacauaagaaagcgacguaugagccugacguagauuugggcaguggcacaagaaacauaggcauugaaaaugaaauuccaaacuuggacaucauuggaaagagaauagagaaaauaaaacaagaacacgaaacauccuggcacuaugaccaagaccaucccuacaaaaccugggccuaucauggaaguuacgagacaaagcagacaggauccgcauccucaaugguaaauggcgucguaaaacugcuaacuaaaccuugggauguggucccaaugguaacucagauggcaaugacagauacaacuccauucggucagcaaagaguauuuaaagaaaaaguagauacgaggacgcaagaaccaaaggaaggaacuaagaaacuuaugcguauaacugccgaaugguuauggaaggaguugggaaagaagaaaacucccagaauguguacgagagaagaguucacaaggaaaguaagaucgaaugcagcacucggcgcgauauuuacugaugaaaauaaauggaaaucagcaagggaagcgguagaggacuccagguucugggaauuaguugauagagaaagaaaccuccaucuagaggguaaaugcgaaacguguguguauaauaugaugggaaaaagagagaagaaauuaggagaguucggcaaagccaaaggaucucgagcaauaugguauaugugguuaggagcaagguuucuggaguuugaagcguuaggcuuucugaacgaagaucacugguuuucuagaggaaacucacuaagcggagucgaaggagaaggucuacacaaauuaggguauauuuugcgagacguaagcaagaaagaaggaggagcaauguacgcggaugauacugccgguugggacacaagaauaacuuuagaagaucuuaaaaaugaagaaaugguuaccaaucagaugaaaggugaacauaagaaacuggcagaagcgauuuuuaaacuaacguaucagaauaaaguaguaagaguccagcgacccacgccacgcggaacaguuauggacaucauaaguagaaaggaucaacgaggaagcggccaaguuggaacuuacggauugaauaccuucacaaacauggaggcacaacuaauucgacaaauggaaggugaggggauuuucaaaagcauacagagguuaacaguaacggaagaaauagcagugcaaaacuggcuugcgagagugggcagagaacgacuaucaagaauggcuaucucgggugaugauugcgucguaaagccauuggaugauagguucgcaucggcauugacugcauuaaacgauaugggaaaagucagaaaagauauacaacaaugggaaccaagcaggggauggaacgauuggacacagguuccuuucugcucacaccauuuucacgagcuaguaaugaaagaugggcgagugcuaguaguuccuugcagaaaccaggaugaacuuauaggcagagcacgaauuucacagggagcuggauggucucuuaaagaaacugccugcuuaggaaaaucauaugcccaaauguggacguuaauguacuuccauagacgcgacuuacggcuggcagcaaacgcuauuugcucagcuguuccaucacacugggucccaacuucuagaacaaccuggucgauccacgcgaaacacgaauggaugaccacagaagauaugcuugccguauggaauagaguauggauccaagaaaaucccuggauggaagauaagacacccguugagaguugggaggagguaccauaucucggaaagagagaggaucaaugguguggaucacucauaggucucaccucgagggcuacgugggcgaaaaauauccaaacugccauaaaucaaguacgcucuuuaauugguaaugaagaauacacugauuauaugcccucgaugaaacguuuuagaaaagaagaagaagaagcugggguucuaugguga

SEQ ID NO: 22597 - RNA, 9876 nt, Artificial Sequence
  derived and/or modified CDS sequence (opt6) from DENV-2__EU687228__SS-prME
acagcagggguaauuauuauguugauuccaacugcuauggcauuucacuuaacgacaagaaauggugaaccucauaugauaguuggaaggcaagaaaaaggaaaaagucuauuauuuaaaacugaagauggaguuaacauguguacccugauggcaauugaucugggagaacuuugcgaagauacgauaacauacaaaugcccacuuuuaagacaaaacgaacccgaagauauagauuguuggugcaauuccacuucuacauggguaaccuacgguacauguacuacaacaggcgaacaucguagggagaaaagguccgucgcauuaguuccacaugucgggaugggguuagaaacgcggaccgaaacguggaugucaucggaaggugcuuggaaacacguucaaagaauagaaacauggauucuccgacacccagguuuuaccauaauggcagcaauucuugcuuauaccauaggcaccacgcauuuucaacgagcgcucauuuuuauauuacuaacagcaguagcacccagcaugaccaugcgauguaucggaauaucuaacagagacuuuguagaaggaguaaguggcgguaguuggguagacauaguauuagaacacggaucguguguuacaacuauggccaaaaauaaaccgacucuugacuuugaauuaauaaaaacugaagcaaaacaaccggcaacguuacgaaaauacuguauagaagcaaaacugacaaauacuacgacagaaucccguuguccgacacaaggggaaccaucuuuaaacgaagaacaggacaaacgauucauuuguaaacacagcaugguagaucgaggauggggaaaugguuguggccuguucgguaaaggcggaaucgugacaugugcaauguucacuuguaagaaaaauauggaaggcaaaguuguauuaccagaaaaucuugaauauaccauuguaauaaccccacacucuggagaagaacaugcuguugguaaugauaccgguaaacauggaaaugaaauaaaaauaacaccccagucuaguauaacagaagcagaauuaacuggcuacgguacggucacaauggaauguucuccgcggacgggauuagauuucaaugaaaugguccuauuacagauggaagacaaagcgugguuaguucaccgccagugguuucucgaucuuccacucccguggcugccaggugcagauacucagggauccaacuggauacagaaagaaacguuaguaaccuuuaaaaauccucaugcaaagaaacaagaugucgugguacuaggaucacaggaaggcgcgaugcauacagcauugacuggugcaacugaaauucagaugucgucaggcaauuuauuguuuacuggacaucuaaaguguagauuaagaauggacaaguuacaauuaaaaggcaugagcuacucuauguguacagguaaauuuaaaauuguaaaggaaauagcagagacacaacaugguacgauugucaucagagugcaguaugaaggggacgguucaccuuguaaaauacccuuugaaauaauggaccuugaaaagagacacguauuaggacgccuuauaacagucaauccaaucguuacugaaaaggacagcccaguaaauauugaagcugaaccgccguuuggugacagcuauauuaucauuggcguagaaccaggucaacucaaauuaaacugguucaagaaagguaguagcauaggucaaauguuugaaacaacaaugcguggggcuaaaaggauggccauauuaggagacaccgcaugggacuucggcagccucgguggcguauuuaccucaauagggaaagcgcuucaccagguuuucggugcaauauacggagcugcuuuuucuggagugucuuggacaaugaagauauuaauagguguuauuauuacuuggauaggcaugaauagcagaucuaccagcuugucgguaagccuaguacuugucgguguaguuacacuauacuuaggaguaaugguucaagcagauucagguuguguuguaucauggaaaaauaaagaacuaaaaugugguucuggcauuuucauaacagauaauguacauaccuggacggagcaguauaaauuccagccugagaguccaaguaaguuggccagcgcuauccaaaaagcacaugaggagggcaucuguggcauccggagugucacgagauuagagaaccuuauguggaaacagauuacaccggagcugaaucauauauuaucugaaaaugaagugaaguuaacgauaaugaccggugauauuaaggguauaaugcaagcuggaaaaaggagucuacguccacaaccaaccgaauugaaauacucguggaaaacauggggaaaagcaaaaauguuaagcacagaaagccauaaucaaacauuuuugauagauggaccggaaacagcagaauguccuaacacgaacagagcuuggaacucacuagaaguagaagauuauggauucggcguuuuuagcacaaauauaugguuaaaauuacgugaaaaacaagaugucuuuugcgauucaaaauuaaugagcgcugccauuaaggacaauagagcuguucacgcggauauggguuauuggauagaaagugcauuaaacgacacguggaaaauggaaaaagcuaguuucaucgaaauaaaaagcugccacuggccaaagagucacacauugugguccaauggaguacuagaaucagagaugaucauaccaaagaauuuugcuggcccggugagccagcauaauuaccgaccuggguaccauacccaaacagcagggccauggcacuugggaaaauuagagauggauuuugauuuuugugaaggaaccacagucgucguaaccgaagauuguggaaauagaggaccaucacugaggacuacaacggcauccgggaaacugauuacggaauggugcuguagaucaugcacccucccuccguugcgauaucgaggagaagauggcuguugguaugguauggagaucagaccguuaaaagagaaagaagagaacuuaguaaauucccuuguaacagccggucacgggcaaaucgauaauuuuucuuuaggcguauuaggcauggcuuuguuccuugaagagauguuaagaacucgcguuggaacgaagcacgcuauauugcucgucgcuguuucauuuguuacucucauaacagguaauaugaguuuccgugaccuuggaagaguaauggucaugguaggugcuaccaugacugacgauauuggaaugggagugacauauuuagcgcuccuagccgcauucaagguaagacccacuuuugcugccggauuacuauuaagaaaacuuacaaguaaagaauuaaugauggcgaccauagguauagcguuacugucucaauccacaauaccagagaccauacuggaacuaacggacgcgcuagcucuggguaugaugguuuuaaaaauagugagaaacauggagaaauaucaauuagccguaaccauaauggcaauaucaugcguaccuaaugcuguaauauugcagaaugcuuggaagguauccuguacaaucuuagcugcaguuagcguaagcccauuauuacucacuucaagccaacaaaaagcagacuggauuccacucgcucucaccauaaaaggccuaaacccaacugcuauauuuuuaacuacauugagccguacaagcaaaaagcgaaguuggccguugaaugaggcaguaauggcuguugggaugguaaguauacucgcaucgucucuucugaaaaaugauaucccaaugacaggcccgcuaguagcaggagggcuacucacgguuuguuacguacuaacaggucgaucggcugaccuagaguuggagcgagcagcagauguuaaaugggaggaccaagcagagauauccgguucaaguccgauucuaucaauaacgauaucugaggacggguccaugagcaucaaaaaugaagaagaagaacauacacugaccauauugauccgcacaggccugcuuguuauuuccggaguauuccccguuaguauuccuauuacagcugccgcaugguauuuaugggaagugaagaaacaaagagccgguguacuaugggacgucccgucaccaccgccuguagggaaagcugaauuagaggacggugccuaucgaauaaaacaacgaggcauauucgguuacucucaaaucggcgcaggaguguacaaagaggggacuuuccacacgauguggcacguaaccagaggcgcagucuuaaugcaccgugguaaacggauugaacccuccugggccgaugucaagaaagaucuuauauccuacggcgggggcuggaaguuagaaggagaauggaaagagggagaagaaguacaaguguuagcauuggaaccuggcaaaaaucccagagcuguucaaacuaaacccggcuuauucaagaccaauaccggcacaaucggugcaguuucguuagauuucucuccaggaacuagcggcucucccauagucgaccgcaagggcaaagucgugggauuguacgguaauggaguagucacuagaucgggcgccuacguaucugcgauugcccaaacggagaaaaguaucgaagacaacccagagauagaagacgacauauuucggaagaaaaggcuaacaaucauggaucugcauccuggagcuggaaaaacuaaacgcuaucuuccugcaaucgucagagaagcuauaaaacgugguuuacguacauuaauuuuggcaccuacgcgcgugguagcagcagagauggaagaagcucucagaggguuacccauuagguaucaaaccccagcaauccgugcagagcauacuggucgagagaucgucgauuugaugugccaugcgacauucaccaugagacuuuuaagcccaguacguguaccuaauuacaauuuaauaauaauggacgaagcacacuuuacagaucccgccagcauagcugcuagaggguauauuucaaccagaguagagaugggagaagccgcugggauauuuaugacagcuacaccuccaggcagcagggacccguucccacaaucaaaugcgccgauaauggaugaggaaagggagauaccggaacguucauggaacagcggacaugaauggguuacugauuuuaaagggaagacaguaugguuugugcccucuauuaaggcagguaacgauauugcugcgugccugcguaaaaauggcaagaaagugauucaacuaaguagaaaaacauucgacuccgaguaugugaaaacacgagcaaaugauugggauuuuguuguaacaaccgauauaagugagaugggggcuaauuuccgggcagagagagugauagauccucgacgcuguaugaaaccaguaauccugacagacggcgaagaaaggguaauccuugcugggccuaugccuguaacucauucaagugcagcucagagacguggaagaauaggcaggaacccgaaaaaugaaaacgaucaauauauauauaugggagaaccacucgaaaacgaugaggauugcgcucacuggaaagaggcgaaaauguuacuggacaauauaaauacaccagaaggcauuaucccuagcauguucgaacccgaaagggaaaaagucgaugcuauagacggagaauauagauuacgaggugaagcuagaaaaacauuugucgaucugaugagacgaggggaucuaccaguauggcuagcuuaucgugucgcagcagaaggaauuaauuaugcugaccgccgauggugcuucgacgggauuaaaaacaaucaaauauuagaagaaaauguagagguugaaauauggacgaaagaaggagaaaggaagaaacuaaaaccucgguggcucgaugcaaggauuuacucagaucccuuagcgcuuaaagaauuuaaggaauuugcagcgggacgaaaaucguuaacguugaaucuuauaacagagaugggccgucuacccacauuuaugacucagaaagcgagagaugcucuggacaaucuggcagugcuacauacagcugagguagguggacgggcuuauaaccaugcacuaucagaguuaccagaaacauuggaaacacuucucuuauuaaccuuauuagcaacaguuaccggagguaucuuucucuuuuugaugucgggaaaggggauaggaaagaugacauuaggaaugugcuguauuaucacugcaaguauauuauuaugguaugcacaaauacaaccacauuggauagcagcuucuauaauucuagaauuuuuccuaauaguuuugcuaauaccagagcccgaaaaacaacgaacaccccaagacaaccaacucacauauguggugauugcaauauugacuguaguagcagcaacaauggcuaacgagaugggauuccuagagaaaacaaagaaggaucugggauuggguagcauuacaacgcaagagucugaguccaacauauuagauauugacuugagaccagccagugccuggacuuuauacgcuguagcaacaacuuuugucacuccaauguugagacauagcauagaaaauaguucaguuaauguuucacuaacugcaauugcuaaucaagcaacuguucuaaugggucuaggacgcggguggcccuuaucgaaaauggacauaggggucccguugcuugcaaucgggugcuacucgcaaguaaacccaauuacacucacagcagcacuuuugcuguuaguggcacauuaugcaauaauaggaccaggacuacaagcaaaagccacccgugaagcacaaaagagaacagcugcggggauaaugaaaaaucccaccgucgacgguauaacuguuauagacuuagaaccaauaccuuaugauccaaaauucgagaagcaacuaggucaagugauguuguuaguauugugcguaacacaaguacugaugaugagaacgacuugggccuuaugugaagcguuaacauuagcuacggggccuauaucuacauuaugggaaggaaacccaggacguuucuggaauacaacaauagccguuucaauggcuaauauauuccgaggaucuuaucuagccggugcuggacuuuuauucuccauaaugaaaaauacaacgaauaccaggagagguacugguaauauaggugagacacucggagaaaaguggaagucaagauuaaaugcgcuaggaaagagugaauuucaaauuuacaagaaaucuggaauacaagaaguugaccgaaccuuagcuaaggaaggaauuaagagaggggaaacugaucaccacgcaguuuccagagggucugcaaaacuccggugguuuguagaacguaauaugguuacaccggaaggaaaaguugucgacuuagggugcggccgaggaggauggucauauuauugugguggccuaaagaaugucagagaaguaaaaggccuaacaaaaggugggccaggucacgaagaaccaaucccaaugucaacguauggcuggaaccucgugagacuucagucuggcguagauguauucuuuacuccgccugaaaaaugcgauacauuacugugugauaucggcgaaucgucaccaaaucccacaauugaggcaggaagaacuuugagaguuuuaaaucugguggagaauugguuaaauaauaauacacaauucuguauuaaaguguuaaauccauauaugccuaguguuauagagaaaauggagacacuccaaagaaaguauggaggggcucuggugagaaacccguuaucgagaaauaguacacaugaaauguauugggugagcaaugcgacagggaacaucguaagcaguguaaacaugauuagucgaauguuaaucaauagguucaccaugaaacauaagaaggcgacuuacgagccagauguggauuuagguucuggaacaagaaauaucgggauagaaaaugaaauaccaaaucucgacauaauaggcaagagaauagagaaaauaaaacaagaacacgagacgaguuggcauuaugaccaggaucaucccuacaaaacgugggccuaucacgguucuuaugaaaccaaacaaacuggcagcgcgucaucgaugguaaaugguguaguaaaauuguuaacaaaaccgugggauguaguuccaaugguuacacaaauggccaugaccgauacuaccccguucggccagcaaagaguauuuaaagagaaaguagauacuaggacacaagaaccuaaagaaggaacaaagaaacuaaugcgcauaaccgcagaaugguuauggaaggaacucggcaaaaagaaaacucccagaaugugcacaagagaagaauuuacacggaaagugcgcucaaacgcagcuuuaggagccauuuuuacugaugaaaauaaauggaaaucagcacgagaagcagucgaagauucaagguucugggaguuaguagaucgugagagaaaucuacaccuugagggcaagugugagacuugcguauauaacaugaugggcaaacgagagaagaaacucggugaauuuggaaaggcgaaaggaucacgagccauaugguauaugugguuaggagcacguuucuuggaauuugaagcguugggauuucuaaacgaggaucauugguucaguaggggaaauucccuaagcgguguagaaggagaaggacuccauaaacuaggauauaucuuaagagauguuucuaagaaagaagggggagcuauguacgcagaugacacagccggaugggacacaagaauaaccuuggaagaccugaagaaugaagaaauggucacaaaccauaugaaaggagaacacaagaaacuugccgaggcaauuuuuaaauuaacuuaccagaacaaaguugugaggguucaaagaccuacaccccguggcacaguuauggauauaauuucccgcaaggaucaaagagguagcggacaagucggcacauauggauugaauacauuuaccaacauggaagcccaacugauuagacaaauggaaggugagggaauauuuaaaucaauacagagacuaacagucacugaagaaauagcaguacaaaacuggcuugcuagggucggaagagaaagguuaagucgaauggcaauuucuggugacgauuguguugugaaaccacuagaugaccgcuucgcgucggcacuuacagcacuuaaugacaugggcaaaguaaggaaggauauacaacaaugggaacccaguagggguuggaaugacuggacacaagucccuuuuuguagccaucauuuucaugagcuaguaaugaaagaugguagaguacuugugguuccuuguagaaaucaagacgaauuaaucggccgagccagaauuucacaaggugcaggcuggucauuaaaagagacagcguguuuagggaaaucauaugcucagauguggacgcuuauguauuuccaucgaagagacuugagguuggccgcuaaugccauaugcucggccguuccaucccacuggguuccaacuagcagaacgacguggaguauucaugcuaaacacgaguggaugaccacagaggauauguuggcaguauggaaucgcguauggauacaagaaaaucccuggauggaagacaaaacaccagucgaaucaugggaagaagucccuuauuuaggaaagcgggaagaucaauggugugguagucucauaggucuaacuagccgagcgacuugggccaaaaacauacaaaccgcaauuaaucaagugagaucgcuaauuggcaaugaagaauauacggauuauaugccaagcaugaaaagguuucgaaaagaagaagaggaagccggugugcuaugguaa

SEQ ID NO: 22598 - RNA, 9876 nt, Artificial Sequence
  derived and/or modified CDS sequence (opt6) from DENV-2__EU687230__SS-prME
acggcugguguuaucauaaugcuuauuccgaccgcaauggcuuuucaucuuacgacacgcaauggagaaccacauaugauaguugggcgacaagaaaaagggaaaucccuacuuuucaaaacagaagaugguguaaacaugugcacacuaauggcaauagauuuaggggaauuaugugaagauacaauaacauacaaauguccauugcugcgacaaaaugaaccagaagacauagauugcugguguaauuccacaagcacaugggugacuuaugguacguguacgacgacgggugaacauagaagagaaaaacguucuguggcauuagugccgcauguuggaaugggacuugaaacaagaacggaaacuuggauguccucagaaggagcguggaaacauguucaaagaauagaaaccuggauacuaaggcauccgggguuuaccauuauggcagcaauuuuggccuacacaauagguacaacucauuuucagcgagcauuaauuuuuaucuuauuaacugcuguugcaccaucgaugacuaugcgauguaucggaauuagcaacagagauuucguagaaggaguaucgggugggagcuggguugauauuguacuagaacauggauccugcguuacaacuauggcuaaaaauaaaccgacucuagauuuugaacugauaaaaacagaagcaaaacaaccagcaacacucaggaaauacugcaucgaagcuaaauuaacuaauacgacaacggaaucaagauguccgacccaaggggaaccaucccucaaugaggaacaagauaaacgauucauuuguaaacacaguaugguagaccguggaugggguaauggauguggacuuuuuggaaaaggaggcauuguuacgugugcaauguucacauguaagaaaaacauggagggaaaagucguccucccggaaaaucuggaguauacaauagugaucacuccucacucaggugaagaacaugcgguagguaacgauacaggcaaacaugguaaagaaauuaagauuacaccacaaucuucaauuacugaagccgaguuaacaggauaugguacagugacgauggaguguucgccaagaacaggacuugauuucaacgaaaugguucuauuacaaauggaagacaaagcguggcuaguacacagacaaugguuuuuagacuuaccacuuccauggcuuccaggagcggacacccaagguucgaauuggauacagaaagaaacucuagucacauucaaaaauccacaugccaagaaacaagacgucgucguguuaggaagucaagagggagcgaugcauacagcacuaaccggagcaacugagauacagaugaguaguggaaaucuacuuuucacgggucauuuaaaauguagacuacgaauggauaaacuucaacuuaaaggaaugucguauucaauguguacuggcaaauucaaaauagugaaggaaauagcagaaacccaacauggaacuauuguuauuagaguucaguacgaaggagacggaaguccuuguaaaauaccauuugaaaucauggauuuagaaaaacgccauguacuaggacgucuaauuacagugaacccaaucguuacagaaaaagacucacccguuaacauagaagcugaaccaccuuuuggagacucuuauauaauaauagguguagaaccaggacaacuuaaauugaacugguucaaaaaggggucaucgaucggucaaauguucgagacaacgaugcggggcgcgaagcggauggccauuuuaggggacacagcuugggauuuugggucacucggaggugucuuuacuucgaucgguaaggcccuccaucagguauuuggggcaauuuauggugccgcauucucaggugugucauggacgaugaaaauucuuaucggaguuaucauaacauggauugggaugaauaguagagguaccucauuaagcguuucauuaguacuuguugguguagucacccucuaucuagggguuaugguucaagcugauuccggauguguuguaucauggaaaaauaaagaacuaaaguguggaucagguauauuuauaacggauaaugugcacacauggacugaacaauauaaguuccaaccggaaaguccaaguaaguuagcuagcgcgauacaaaaagcacacgaagaaggaauauguggcaucagaucagugacacgacuugaaaaucucauguggaaacaaauaacucccgagcugaaucauauccugagugagaaugaagugaaacuuacaaucaugacuggugauauuaaaggaaucaugcaagcagguaagagaucacuacgaccgcaaccgacagagcugaaguauuccuggaaaacuuggggcaaggcgaaaauguugucaacggaaagccacaaucaaaccuuccuaauugacgguccugaaacugccgagugcccuaacacgaacagagcauggaacucacuagaaguagaagacuacgguuuugguguauucaguacaaauauuuggcucaaacucagagaaaaacaggauguauuuugugauaguaaauugaugucagccgccauaaaagauaauagggcuguacaugcagacaugggauauuggauagaguccgcguuaaaugacacuuggaagauggaaaaagcaucuuucaucgaaauaaagaguugucauuggccaaaaagucauacccuauggucgaacggaguacuugaaagcgaaaugauaauacccaaaaacuucgcagggccuguaucucaacacaacuacaggccgggauaccacacacaaaccgccggaccuuggcauuuggguaaauuagagauggacuuugacuuuugcgagggaacuacgguugugguuacagaagacuguggcaauagagguccgagucuaagaacuacaacugcgucuggaaaauuaaucacggaaugguguugccgaaguuguacccuaccaccacuaagauauagaggagaagacggaugcugguaugggauggaaauucggccauuaaaggaaaaagaggaaaauuuaguaaauucccucguaaccgcaggucauggccaaauagacaacuuuucacuaggaguucuaggaauggcguuauuccuagaagagaugcuacgaacaagggugggcacgaaacaugcaauucuauuaguagcugugaguuuuguuacacuaauuaccgguaauaugagcuucagagaucugggacgcgugauggugaugguuggugcaacaaugacagacgauaucggcaugggugugacauacuuagcauuacuugccgcauuuaaaguccgacccacuuucgccgcaggccuucucuuaaggaaguuaacuucaaaggaauuaaugauggcuacaauagguauugcauuacuaagccaguccacaauacccgaaacuauccuagagcuuacagaugcacuggcacuggguaugaugguucuuaaaauaguacgcaacauggaaaaauaccaacuagcuguaaccauaauggccauaucaugcguaccaaaugcaguaauuuuacaaaaugccuggaaaguuucaugcacaauauuagcggcuguaucagugucuccacuguuacucacaaguucccaacagaaggcugacuggauacccuuagcccuuacaauuaaaggacucaaccccacggcgauauucuuaacuacccuaucacgaacuagcaaaaagagaucuuggcccuuaaaugaagcagugauggcaguggguaugguaagcauccuagccucgucucuauuaaagaaugacaucccaaugacggggccucuaguggcaggaggauuguuaacaguguguuaugugcuaacuggccgcagcgcggacuuagaauuagagagagcugcugacgugaaaugggaagaucaagcagaaauauccgggucuagcccaauuuuaucaauaacuauaucagaggauggaagcaugaguaucaaaaaugaggaagaagaacauacccuaacaaucuuaauaagaacaggucuauugguaauauccgguguauucccuguguccauucccaucacagcagccgcaugguaccugugggaaguaaagaaacaaagagcugggguccucugggacguuccaucgccaccgccaguagggaaagcagagcuggaggauggagccuacagaaucaaacaaaggggaauuuuuggauauagucaaauuggagcgggaguauacaaagagggaacauuucacaccauguggcauguaacaagaggagcgguacuuaugcacagaggcaaacgaauagagcccagcugggcagacgucaagaaagaccucaucaguuauggaggcggguggaaacucgaaggggaauggaaagaaggagaggaaguacaggucuuagcacuagaaccaggaaagaacccacgagcagugcagaccaaacccggguuguuuaaaacuaauacuggaacaauaggagcagucagccuggauuuuaguccaggaacuucugggucucccauuguagaccguaaaggaaagguagucgggcucuaugguaacggggucgucacaagaucuggcgcauacguaagcgcuauugcacaaacggaaaaaucgauugaagauaauccagaaaucgaagacgauaucuucaggaagaaacgguugacaauaauggacuuacauccaggagcaggaaaaacgaaacgguauuugccggcaauaguaagagaggcuaucaaaagaggguuacgaacacuaauccuagcaccuacaagaguaguggcugcugaaauggaggaggcauuaagaggacuaccaauacgauaccaaaccccggcuauaagggcagaacauacaggaagggaaaucguagaucuuaugugccaugccaccuucacuaugcgacugcuaucaccgguaagaguuccaaauuacaacuugauaaucauggacgaagcacauuucaccgacccugccagcauugcugcucgagguuacauaaguaccagaguagaaaugggagaagcugcgggcauauuuaugacagcaacaccuccuggauccagggacccauucccccaaucgaaugccccaauaauggaugaagaacgugagauuccggaaagaucauggaacucaggccacgaguggguuacugacuucaaaggaaaaacuguaugguucguaccauccaucaaagcaggcaacgacauagcagcaugccuacgaaagaauggcaagaaaguaauacaacucucaagaaaaacguuugauuccgaauaugucaaaacaagagcuaaugacugggacuucguaguaacgacugauauuucggaaaugggggcaaauuuucgcgcagagcgaguuauagaucccagaagauguaugaaacccgucauuuugacugacggggaggaacgugugauacuggcagguccaaugcccguaacacauuccucggccgcucaacgcagaggaagaauagguagaaaccccaaaaaugaaaacgaccaguacauauauaugggggaaccauuagaaaaugaugaagauugugcucacuggaaagaagccaaaaugcuauuagauaauauuaauacaccggaagguaucauaccguccauguuugaaccagaaagagagaaaguggacgcaauagauggugaauaucgauuacgcggugaagcuaggaagacuuuuguagaucuaaugaggaggggagaccuucccgucuggcuugcauaucgcguugcugccgaggguauaaauuaugcugauagaagaugguguuuugacggcauaaagaauaaccaaauucuggaggaaaacguugaagucgagauuuggacaaaggaaggcgaaagaaagaaacuuaaaccacguugguuagacgccagaauauauucagauccguuagcacuuaaagaauuuaaagaguuugccgcagggcggaaaucacuaacacuaaaucuuauuacagaaaugggacgucuuccaacguucaugacacagaaagcacgagaugcauuggauaauuuagccguguugcacacugcagaaguaggggguagggcuuauaaucacgcucugagcgaauuaccagaaacacuggaaacauuauugcugcucacucuacucgcaacgguuacagggggaauuuucuuauuuuuaaugagcgggaaagguauagguaaaaugacguuaggaaugugcuguauaauaacagcuucuauccuauuaugguacgcacagauacaaccucacuggauagcugcuucuauuauacuugaauuuuuccucaucguacuuuuaauuccggaacccgagaaacagcgaaccccucaagacaaucaacuaacauacguaguaauagcaaucuuaaccgucguagccgcaaccauggcaaacgaaaugggauuccuagagaaaaccaagaaagacuugggucuugggaguauuacaacacaggagucagaaagcaauauucucgacaucgaucuacguccagcuagugcguggacccucuaugccguugccacaaccuuuguaacacccauguuacgucacaguauugagaauaguuccguuaaugugucauuaacggcaauugccaaucaagcaacaguacuaaugggcuugggaagggguuggccauugucuaaaauggauauaggagugccccuuuuagcuauagguuguuauagucaaguaaacccgaucacccucacagcggcacugcugcuccuagucgcgcauuacgccaucaucgggccgggacuacaagccaaagcaaccagagaagcgcaaaagcgaacugcagcuggaauaaugaaaaacccaacuguugauggcauuacgguuauagaccuggaaccgaucccguaugauccaaaauucgaaaaacaacuaggccaagugaugcuuuuaguccuguguguaacgcagguauuaaugaugagaacaacuugggcacuaugugaggcucugacacuagcaacaggaccaauaucaacccugugggaaggcaacccagggagguuuuggaauaccacuauagcaguaucuauggcaaauauauuccguggaucguaccuagcuggugcaggacuucucuuuucgaucaugaaaaauacuacuaauacccgacgagggacaggcaauauuggugaaacccuuggagaaaaauggaaaucuagauuaaacgcccuaggcaaaucggaguuucaaauauacaagaaauccggaauacaagaaguagauagaacccuagcaaaagaaggaaucaaaagaggagaaacugaccaucaugccguaaguagagguagugcuaagcuccgaugguuuguggaaagaaacaugguuacccccgaaggaaaaguagucgauuugggauguggaagaggcggauggaguuacuacuguggaggacuaaagaacguaagagaagucaaggguuuaacaaagggaggaccaggacaugaagaaccuaucccaaugagcacauauggguggaaucucguuagauuacaauccggaguagauguauucuuuacuccacccgaaaaaugugauacacuccuaugcgauauaggagagucaagcccgaaucccacaauagaagcggggcggacacuacggguauuaaauuugguugaaaauugguugaauaacaauacccaauucuguauuaaaguacugaacccguauaugccgaguguaauagagaaaauggaaacucuacagcgaaaauacggaggggcgcucgucagaaauccauuaucaagaaauucaacucaugaaauguauuggguuucuaaugcgacagggaauauagugucuuccguuaauaugauuucucgcauguuaauuaaucgguucacuaugaaacauaagaaggcuacauacgaaccggacguagaucuugggucggguaccagaaacauaggcaucgaaaacgaaaucccaaauuuggauauaauaggaaaacggaucgagaaaauaaagcaagaacacgaaacuucauggcauuacgaucaggaccauccuuacaaaacaugggcuuaucaugguucauacgaaacaaaacaaacugguucagcguccucaaugguuaacggagucguuaaacuuuuaacgaaaccuugggauguaguuccaaugguuacucaaauggccaugaccgauacaacuccguucggacagcaacgaguguuuaaagagaagguagacacuaggacacaagagccaaaagaaggaacuaaaaagcuaaugagaauaacagccgaguggcuauggaaagaacuaggcaagaagaaaacaccucgaaugugcacacgugaagaauuuacaagaaaagugcguucaaaugcugcacuaggcgccauauucacagaugaaaauaaauggaagucggcuagggaagcaguagaggacaguagauucugggaacucguagaucgcgaaagaaaucuacauuuggaagguaagugcgaaaccuguguauacaacaugaugggaaagcgagagaagaaacuaggugaguucggaaaagcaaaaggcucacgugcuauaugguauauguggcucggagcucgcuucuuagaguucgaagcucuaggcuucuugaaugaagaucauugguucucuagaggcaauucauuaucagguguagaaggagaaggauuacauaaacucggauauaucuuaagagacguuaguaagaaagaagggggugcuauguaugcagacgauacagcaggaugggacacacgcauuacauuggaggacuugaagaaugaagagaugguuacuaaccauaugaagggcgaacauaaaaagcuagcggaggcaauuuucaaauuaacguaucaaaacaagguaguuagaguccaaaggcccacuccacgcgguacggugauggauauuauaaguagaaaagaccaaaggggcuccggacaagucgguacuuaugggcuaaauacauuuacaaacauggaggcccaacucauccgacagauggaaggugaaggaauauucaaaaguauacaaagacuuacgguaaccgaggagauugcaguacaaaacugguuggcucgcguaggaagagaaagacuaaguaggauggcuauaucaggggaugauuguguuguuaaaccauuagaugaucgcuuugcuucagcacugacagcccuuaacgauaugggaaaaguccgcaaagauauacaacagugggaaccaucaagaggcuggaaugacuggacucaaguucccuuuuguucacaucacuuccacgaacuuguuaugaaagacgggagaguucuuguuguaccuugcaggaaucaagacgagcuaauagguagggcuaggauuucacagggugcggguuggaguuuaaaggaaaccgcguguuuagguaaaagcuacgcccaaauguggacguugauguauuuucaucgacgagauuuaagguuggcagccaacgcgaucugcagugcaguuccaagccauugggucccuacaucaaggacaacauggucgauacaugcaaagcaugaauggaugacuacugaagauaugcuugcaguauggaaucgaguguggauacaagagaacccauggauggaagacaagacuccagucgaaagcugggaagaaguaccguaccuaggaaagagagaagaccagugguguggaucacuaauugguuugaccucucgagcaaccugggcaaagaacauacaaaccgcaauaaaccaaguaaggucauuaaucggaaacgaagaauacacagauuauaugccaucaaugaaacgauucagaaaggaggaagaagaagccggaguacuaugguaa

SEQ ID NO: 22599 - RNA, 9876 nt, Artificial Sequence
  derived and/or modified CDS sequence (opt6) from DENV-2__EU687231__SS-prME
acagcagggguuaucauaaugcuaauuccaacagcaauggcuuuucacuugacaacucguaacggugaaccacauaugauuguuggaagacaagaaaaagggaaaagccugcuauucaaaaccgaagacggaguaaauaugugcacgcuuauggcuaucgaccuaggagaacucugugaagauacuaucacauacaaauguccauuauuaagacaaaaugaaccugaagauauagacugcuggugcaacucaacgucgacauggguuaccuauggaacguguacuacuacgggcgaacaucgaagagaaaaacggucuguugcguuaguuccacacguagguauggguuuagaaaccagaacugaaacauggauguccagugaaggugcauggaaacauguucaacgcauagaaacauggauucuuagacacccaggauuuacaauaauggcagcaauacuagcuuacacuauuggaaccacucauuuccaaagggcauuaaucuucauccuucuuacagcaguagcaccuucaaugacaaugcgcuguauagguauaucaaacagggacuuuguagaagguguuucgggcggaaguuggguagauauagucuuagaacacggaaguuguguaacgacgauggccaaaaauaaaccuacacucgauuuugaacugauaaaaacagaagcgaaacaaccggcgacgcuaagaaaauauugcauagaagccaaauugacgaauacaacuacggaaucaagauguccaacacagggagaaccgucacuuaaugaagaacaggauaaaagguucaucuguaaacacucaauggucgaucguggauggggaaauggguguggucuuuucggcaaagguggaauagugacaugcgcaauguucacuugcaagaaaaauauggaggggaaagugguccuaccugagaaucuggaauauacaaucguaauaacuccacacaguggugaggaacacgcgguagggaaugacacgggaaaacacgguaaagaaaucaaaauaacaccacagaguucaauuacggaagccgaauuaaccggauacggcacggucacaauggaaugcagcccgaggacaggacuggauuuuaaugagaugguuuuauuacaaauggaagauaaagcaugguuaguccacagacagugguuccuagauuuaccuuuaccuugguuaccaggcgccgauacacaaggaucgaauuggauacaaaaagaaacccugguaacauuuaaaaauccacaugcaaagaaacaggacguuguaguuuuggguagccaagagggugcgaugcacacugccuuaacgggugcaaccgaaauucaaaugaguucgggaaacuugcuauuuacuggccaucuuaaaugucgguuacggauggauaaauuacaacugaaaggcaugucuuauuccauguguacgggcaaauuuaaaauuguaaaagagaucgcagaaacucaacacgguacaauaguuauuagagugcaauacgaaggagaugguucaccauguaagaucccauucgaaauaauggaucuggagaaacgacauguacugggacguuuaauaacgguuaauccgauugucacagaaaaagauuccccaguuaacauugaggcagaaccaccguuuggggacucuuauauaauaauugggguugaaccuggacaauuaaaauuaaauugguucaagaaaggaucuagcauaggacaaauguucgaaacgacaaugcgaggagcaaagcgaauggcuauuuuaggggacacagccugggauuucggcucccugggaggugucuuuacaucaauagggaaagcucuccaucaaguuuucggugcaauuuacggagcagccuuuucaggcguaucguggacgaugaaaauucuaauaggaguaauaauaacauggauaggaaugaacucacguucuacaagucucagugugagccuagucuuaguaggaguaguaacauuauaucucggugugauggugcaagccgacagugguugcgucguuuccuggaaaaauaaagaguuaaagugcgguucagguaucuuuauaacagacaaugugcauacauggacagagcaauacaaauuccaaccggaaucaccuaguaaacuagcaucugcaauucaaaaagcucaugaagaaggcauuugcggcauaagaucagucacaagauuagaaaaccuaauguggaagcaaauuacaccagaauugaaucauauauugagugaaaacgaagugaaauuaacaauuaugaccggggauauaaaagguauaaugcaggcuggcaagcgcucacucaggccacaaccgacugaauuaaaguacaguuggaaaacguggggaaaagcuaagaugcuaucaacagaaagucauaaccagacauuccuuauugaugggccggaaacggcugaguguccaaauacuaauagagcauggaacucauuggagguugaggauuaugguuucggcguauucucgacuaauauauggcuaaaauuacgagaaaaacaagacguauucugugacucaaaauuaauguccgcggcgauaaaagacaacagagcaguacaugcggacauggguuauuggauagagagcgcguugaaugacacuuggaaaauggaaaaagcuagcuucauugaaauaaaaucaugucauuggcccaaaagucacacacuauggucaaaugggguacuagaauccgaaaugauaauucccaaaaauuuugccggucccguuagucaacauaauuauagaccuggauaucacacccaaaccgcaggaccuuggcaucuagggaaauuagaaauggacuuugauuucugcgaaggaacgacaguaguagucacagaagacugcgguaauagagguccuucuuugaggacuacuacugcuucagguaagcucauuacagaaugguguugucguuccuguacauuaccaccccugagguaucgaggugaagauggaugcugguacggaauggaaaucagaccacuaaaagaaaaggaagaaaauuuaguuaauagucuuguuacagcugggcacggucaaauagauaauuucagucuagggguacuaggaauggcucuauucuuagaagagaugcuccgaacaagagucggcacaaaacacgcuauacuauugguggcagugaguuuugucacguuaaucaccggaaauauguccuucagagacuuaggaagagucaugguuauggugggugcaacaaugacagacgauauagggauggggguaacuuauuuagcacuccuagcagcuuucaaaguaagaccaaccuucgcggccggucuucuucuaaggaaguuaacaaguaaagagcucaugauggcuacgauuggaauagcacucuugucacaaaguaccauaccugaaacuauucuugaacucacagaugcgcuggcacugggaaugauggucuuaaaaauagugcggaacauggaaaaguaucagcuugcaguuacaauaauggcgauaagcuguguuccaaacgcaguaauacugcaaaaugcauggaaaguaaguuguaccauucuagcagcuguuucuguaucaccucuauuauuaaccaguucccaacaaaaagcugacuggaucccuuuagcguuaacaauaaaaggucugaauccaacugcuaucuuuuugaccacguuaucgaggacuagcaaaaagagaucuuggccccuaaaugaagcaguuauggcaguagggaugguaucuauacuagcaagcucauuacucaaaaaugauauucccaugaccggaccuuuggucgcaggcgggcuauuaacaguauguuacguacucacuggccgcucggcagaccuagaguuagaaagagccgcagauguaaagugggaagaucaagcggaaauaagcgguucuucucccauauuaucgauaacaauaucugaagaugggucgaugucaauaaagaacgaagaagaggaacauacauuaacgauucuuauacgaaccggauuguuagucaucucuggaguauuuccaguuagcauuccuauaacagcagcagcaugguaucuuugggagguaaagaaacaacgagcagggguccuaugggaugucccaucgccuccuccugugggaaaagccgaacuggaagacggggcuuaucggauuaaacaaagaggaauuuuuggcuauucacaaauaggggcaggagucuauaaagaggguacauuucacacgauguggcauguaacccguggugcaguucuaaugcaucguggaaaaagaauagaaccgaguugggccgaugugaagaaagaccuaauuucauacgguggcggauggaaguuggaaggcgaauggaaggaaggugaggaaguacaggucuuagcauuagagcccggcaaaaauccacgugcugugcaaacaaaaccaggacuauuuaaaaccaauacaggcacaaucggagccguuagccuggacuucucacccgggacgucugggucucccauuguggaccgaaagggaaaaguaguaggauuguauggaaaugguguaguaacuagaucaggagcguaugugagugcuauagcacaaacagagaaaucaauagaagauaacccagaaauugaggacgacaucuucagaaagaaaagguuaacaauuauggauuuacacccuggugcaggcaagacuaaacguuaccucccugcaauagugagagaagcaauaaaacgagggcuacgaacgcuaauucucgcaccaacuaggguuguugcugcagagauggaggaagcucuaagaggcuugccgauccgauaccaaacaccagcaauacgcgcugaacacacugggcgugaaauaguagaccuaaugugucacgcaacguuuacaaugagauuacuuucaccugugcgcguaccgaacuauaaucuuauaaucauggacgaggcgcacuucaccgacccagcaaguauagcagcccgcgguuacauaagcacaagaguugaaaugggugaagcagccgguauuuuuaugacggccacaccuccugguucaagagauccauucccccaaagcaacgcgcccaucauggaugaggagagggagauacccgaaaggaguuggaacucaggacaugaguggguaacggacuuuaaaggaaagacgguaugguucguaccuucaaucaaagccggaaaugauauugcagccuguuuaaggaaaaauggcaagaaaguaauacaacuuucucguaaaacauucgacagugaguauguaaaaacaagagcaaaugacugggacuuuguaguaacaacagacauuucugagaugggcgcuaauuuuagagccgaaaggguaauugacccacgucguugcaugaaaccaguaauauuaacugauggcgaagaacggguuauauuggcagguccaaugccuguaacucacaguucugccgcacaacgccgaggacgcauuggacgcaaucccaaaaaugagaacgaccaauacauauauaugggagaaccauuggaaaaugaugaggauugcgcacacuggaaagaagcuaaaauguuguuagacaacaucaauacacccgaagguauuauuccgucuauguuugagcccgaaagagaaaaggucgaugcaauugauggagaauacagacucagaggcgaagcuaggaagaccuuuguggaccucaugaggagaggcgacuuaccgguuuggcuugcguaccgaguagcagcagaaggaaucaacuaugcugaucgccguuggugcuuugaugguauaaagaauaaccaaauucuggaagaaaauguugaaguagagauauggaccaaagaaggagaaagaaagaaacuaaaaccuagauggcuagacgccaggaucuacucagauccguuagcauuaaaagaauuuaaagaguucgcagcaggaagaaaaucacucacccugaaccucaucacugaaaugggaagguuacccacauuuaugacgcaaaaagcuagagacgcauuagauaauuuagccguuuuacauacugcugaaguugguggacgcgcauacaaccaugcucuuucagaacugccggaaacucuugagacauuguugcuacugacucuauuagcuacaguaacagggggaauauuucuguuucucaugagcggaaaagggauaggcaagaugacguuagguaugugcugcauaauaacugcuaguauacuucugugguaugcacaaauucaaccucacuggauagccgccucaaucauauuagaauuuuuccuuauaguauugcuuauaccagagccugagaaacaacgaacgccacaggauaaccaacucacguauguaguaauagcgauccucacuguuguugcugcuacuauggcuaaugagaugggauuucuugagaaaacuaaaaaggacuuaggccugggcagcaucaccacgcaggagucagaauccaacauauuagauauugacuugagaccggcaucugcauggacacuauacgcagucgcgaccacuuuuguaacucccaugcuacgacauucuauugaaaacuccaguguaaaugugagcuuaacggcaauugccaaucaagcuaccguuuuaaugggccuaggaagaggauggccauuaagcaaaauggauauuggagugccucuacuagccauaggauguuacagccaaguaaaucccauaaccuuaacggcggcccucuuacuauugguugcacauuacgcgauaaucgguccaggauuacaagccaaagcaaccagagaagcucaaaagcguacagcggcaggcauaaugaagaauccaacagucgacgguauaaccguaauagaucuggagccaauuccguaugacccaaaauucgaaaagcaacuaggacaagucaugcucuuaguacuaugugucacgcaaguacuuaugaugcggaccacgugggcucuaugcgaggcuuuaacccuagccacggggccaauuucaacccucugggaaggaaauccggguagguuuuggaacacuacaauagcgguuucaauggcaaauauuuucagaggcuccuaccucgcuggagcggggcuucucuuuaguaucaugaagaauacaacuaauacucgaaggggcaccggaaauauaggcgagaccuugggcgaaaaguggaaaucgagacugaaugcucuuggaaaaucugaguuucaaauauauaagaaaucagggauacaagaggucgauagaacacuagcaaaggaaggaauaaaacgaggggaaacugaucaccaugccgucaguaggggaucagcaaaauugaggugguucgucgaacgaaauauggugacaccggaagggaaaguaguggaccuaggcuguggaagaggcggauggaguuacuauugcgguggauuaaagaauguccgagaaguaaaaggacuaacaaaagggggaccaggacaugaggaacccauuccaaugucuaccuacggcuggaaucuaguucgacuacaaucaggcguagauguauucuuuacuccaccagaaaaaugcgacacacuucuuugugauauuggggaauccaguccaaauccaacgaucgaggcagggagaacauugcgagucuuaaacuuaguggaaaacuggcuaaacaauaauacucaauuuuguauuaaaguacucaauccuuauaugcccaguguaauagaaaagauggaaacacugcagagaaaauacggaggugcucuaguucggaauccucuaagucgaaauucaacgcacgagauguacugggugucaaacgccacugguaacauagugucgucaguaaacaugauuucaagaauguugauaaaccguuuuacaaugaagcauaagaaagccacauaugagccagauguagaucuagggaguggaaccagaaacauaggaauagaaaaugaaauaccuaaucuugacaucauuggaaaaagaaucgaaaauaucaaacaagagcaugaaacaucauggcauuaugaccaggaucacccuuauaaaaccugggcuuaccauggaucuuacgaaacgaaacagaccggaucugccucaucuaugguuaauggugucgucaaauuauuaaccaaaccuugggaugugguuccuaugguaacccaaauggcaaugacugacacuacucccuuuggacaacagcgagucuuuaaagagaaagucgauacgcguacacaggaaccaaaagagggaaccaaaaaguuaaugagaauuacagcggaauggcuauggaaggaacuuggcaagaagaaaacaccaagaauguguacacgggaagaguuuacucgaaaaguacgaagcaaugccgcauuaggugcuaucuuuacagaugaaaauaaauggaagucugcaagagaagcuguagaagacucucgauucugggaacucguagauagggagcgcaacuuacauuuagaggguaaaugugagacauguguuuauaauaugaugggaaaaagggagaagaaauuaggcgaauuugguaaagcaaaaggaucgagggcaaucugguauauguggcugggugccagauucuuagaguucgaagcucuuggauuucucaacgaggaucauugguuuucaaggggaaacagccuaagugguguagaaggggagggacuccacaaacucggauacaucuuacgugaugucucaaagaaagaagggggagcuauguacgcugaugauacugcuggaugggacacucgcauuacgcuggaggaucuuaaaaaugaagagaugguaaccaaccacaugaaaggggaacauaagaaacuagcugaggcaauauuuaaacuaacauaccaaaauaaaguaguacggguucaaagacccacaccaagagguacagucauggauauuauuucgagaaaagaucagcguggauccggccaaguugguacauacgguuuaaauacguuuacuaauauggaagcccaauuaauucgacagauggaaggagaaggcauuuucaaaagcauucaaagacugacaguaacggaagagauugcaguucaaaacugguuagcuagggucggaagagaaagacucucaagaauggcuauaucaggcgaugauugcgugguaaaaccccuggacgaccgauucgcuuccgcuuuaacagcauuaaacgauauggggaaaguacgaaaagacauacaacaaugggaacccagcagaggauggaaugauuggacucagguaccauuuugcagucaccauuuccacgaauuggucaugaaagauggcagaguccucguuguucccugccgcaaucaagaugaauuaauaggccgcgcgaggauaucacaaggugcuggaugguccuuaaaagagaccgccuguuuagguaagucauacgcucaaauguggacacuaauguacuuucaucguagagaucuaaggcuugcugcgaacgcuauuuguuccgcaguacccagucauuggguaccaacaucacguacuacaugguccauccacgccaaacaugaauggaugacgaccgaggauaugcuggcaguauggaauaggguguggauacaagaaaacccauggauggaggacaagacaccaguugaaucgugggaagaaguuccuuaucugggaaagcgugaagaucaauggugcgguagccuaauuggucucacuucucgagcaacaugggcgaaaaacauucaaacagcaaucaaccaaguccgaucucuuauagguaaugaggaauacacagacuauaugccuagcaugaaaagguuccgcaaggaggaagaagaagccgguguacuaugguaa

SEQ ID NO: 22600 - RNA, 9876 nt, Artificial Sequence
  derived and/or modified CDS sequence (opt6) from DENV-2__EU687199__SS-prME
acugcuggggucauuauaauguuaauaccaacugcuauggcauuucauuuaacuacacgaaauggugaaccgcacaugauagugggaagacaagaaaaagggaaaagucuucuuuuuaaaaccgaagaugggguaaacauguguacacuaauggcuauagaucuuggagaauugugugaagauacaauuacauauaaauguccauuacuacggcaaaacgaaccugaagacauugacugcugguguaacuccacaaguacguggguaacauauggaacaugcaccacgaccggggaacaucgaagagaaaaacgaucuguagcucuaguuccgcaugucggaaugggucuugaaacaagaacagaaacauggauguccucagaaggugccuggaaacaugugcagagaauagaaacuuggauacuuaggcacccgggguuuacaauaauggcagcaauacuagcauauaccauagguacaacucauuuucagagagcgcuaauuuuuauccuccuaacugcaguagcuccaucuaugacuaugcggugcauaggaauaucaaauagagacuuuguagaagguguaucaggugguucuugggucgauaucguuuuggaacacgguucauguguuacaacaauggcuaaaaacaaaccaacucuagacuucgaacucauaaaaacugaagcaaaacagccggcgacccuacggaaauauugcauagaagcaaaauuaaccaauaccacuacggaaucccguuguccaacacaaggugaaccguccuugaaugaagaacaagauaaaagguuuaucuguaaacacaguaugguagacagggguuggggaaaugguugcggauuauuuggaaaaggugggauagugacaugcgcaauguuuacauguaagaaaaauauggaagggaaaguaguuuuaccggaaaacuuggaguauaccauaguuauaacaccccauucaggggaagaacaugcaguaggcaacgacacaggcaaacacgguaaagaaauuaaaauaacuccgcaaucauccauaaccgaagccgaacuaacugguuaugguacaguuacaauggaauguaguccuaggacgggucuagauuuuaaugaaaugguuuugcuccaaauggaagacaaggcuuggcucguccaccgacaaugguuucuggaccuaccauugccguggcuaccaggcgcagacacgcaaggauccaauuggauacaaaaagaaacacugguuacauuuaaaaauccacaugccaagaaacaagacguaguaguucuggguucccaggaaggagcuaugcacaccgcacugacaggggcuacagaaauucagaugaguaguggaaaucuacuuuuuacaggacaucucaaaugcagacugaggauggauaaacuccaacugaaagguaugucauacaguaugugcacagguaaauucaaaauugugaaagaaauagcagagacccaacacggcacgauaguaauuagaguucaguacgaaggagacggcucuccuuguaaaauaccauucgagaugauggacuuagagaaaagacacguauuaggacguuuaauaacaguaaauccuauaguaaccgaaaaagacucucccgugaauaucgaggcggagccuccauucggagauagcuacauuauaauagguguagagcccggacaacuaaaacugaacugguuuaagaaaggaaguucuauaggucaaauguuugaaacaacgaugcgaggugcuaaaagaauggcgauacuaggcgauacagcaugggacuucggaucauugggaggaguauuuaccagcauuggcaaagcauuacaccaagucuuuggagcuauuuauggagcagcauucaguggggugaguuggaccaugaaaauucuuauaggagucauaauaacuuggauagguaugaauagccggaguacaucgcuaagcgucagccucguucuaguuggcgucguaacacuauaccuaggcguaaugguacaggcagacaccggcugcgucgucucauggaaaaacaaagaacuaaaaugugggagcggaauuuuuauaacagacaacgugcacacauggacggaacaauauaaauuucaacccgaaucaccgucaaaacuagcaagugcgauacaaaaagcacacgaagaaggaauuugugguauaagaagugucacaaggcuugaaaauuuaauguggaaacaaauuacucccgaacuuaaucacauacugagugaaaacgaaguaaaacucacaauuaugaccggggacaucaaagggauaaugcaagcaggcaaacgaucguuacggccacaaccaacugaacucaaauauagcuggaaaacgugggggaaagcgaaaaugcuuucaacggagucacauaaccaaacuuuccucauagaugggccagaaacagcagaaugcccgaauacgaaccgagcauggaacagucuggaaguugaagauuaugguuuuggaguguuuucaaccaacauuugguuaaaacuuagggagaagcaagaugucuucugcgacagcaaauugauguccgcagcaauaaaagacaauagggcggugcaugcagacauggguuauuggauagaaucugcgcuaaaugacacauggaagauggaaaaggcuucuuuuauagagauuaaaaguugccauuggccaaaaagucauacauuaugguccaauggaguucuagagucagaaaugauaauuccuaagaauuuugcgggaccggucucucaacacaacuacagaccaggcuaccacacacagacugcugguccuuggcaccuaggaaaauuagaaauggacuucgacuucugcgagggaacaacagucgucguaacagaagauuguggcaauagagggcccucccuuaggaccacgaccgcaagcggaaaacuaauuacagaaugguguugccgauccuguacuuugccacccuuaagauauagaggagaagaugggugcugguauggcauggaaauaagaccccuaaaggaaaaggaggaaaauuugguuaauucguuaguaacugcggggcacggacaaauagauaauuucuccuuaggaguauugggaauggcccuauuucuggaagagaugcuaagaacucguguggggacaaaacacgccauacuuuuaguugcuguaucauucguuacauugaucacaggaaacaugucuuuucgugauuuagguagagugaugguaauggugggcgcaacaaugacugacgauauagggaugggugugacauauuuagcucuauuagcggcuuuuaaaguccgcccuacauuugccgccggccucuuacugcguaaacuaacaaguaaagaacucaugauggcuacgaucggaauagcacuauuaagccaaucuacaauuccagaaacaauauuagaacugacagaugcacuugcacucggaaugaugguucucaaaaucgugaggaauauggaaaaauaccaacucgcagucacaauuauggccauaagcugugucccaaacgcaguaauauuacagaacgcauggaaaguaaguugcacaauccuagcagcuguaagcgugucaccgcuacuauuaacgucgucacagcaaaaagcagauuggauaccgcuagcacuaacaauuaaagggcuaaauccaacagcuauauuucugaccacucuuucaaggacaagcaagaaacgcaguuggccucuuaaugaagccgucauggcagucggcaugguuaguauccuagcaaguagcuuguugaaaaacgacauuccuaugacaggaccguuaguugcuggcgguuuauugacaguuugcuacguucuuacuggaagaucugcagaccuugaauuagagcgagcagccgacguuaaaugggaagaccaagcugaaaucucagggucaucacccauccuaucuauuacaauuucugaagaugggagcaugucuaucaaaaaugaagaggaagaacauaccuuaacaauccuaauacgaaccggacuuuugguaaucuccggcguuuuuccugugucgauaccaauaacagcagcugcgugguaccucugggaggugaagaaacagcgagccggcguauugugggauguaccuucuccaccucccgugggaaaagcagaacuagaagacggugcguauagaauaaaacaaagggguauuuuuggguauagucaaauuggugcuggugucuauaaggaaggaacauuucauaccauguggcaugucacaaggggugcaguuuuaaugcaucgagggaaaaggaucgaaccgucuugggcugacguaaagaaggacuuaauuucuuaugguggagguuggaagcuggaaggugaauggaaagaaggagaagaaguucaaguuuuagcucuagagccgggcaaaaaucccagagccguccaaacuaagccgggauuauuuaaaacaaacacaggcacuauaggagccguuaguuuagauuucucacccggcacaucaggaaguccaauaguagacagaaaaggcaaaguagugggccuguaugggaacgguguagugacuagaagcggggcauaugucucagcuauugcccaaacggaaaagucuaucgaagauaauccugaaaucgaggaugauauauuucguaagaaaagguuaacuaucauggacuuacacccgggagcagggaaaacaaaaagauaccugccagcuaucgucagagaagccauaaaacgaggacuucgaacauuaauauuagccccaacuaggguuguagcagcagaaauggaggaagccuugcggggucugccaauaagguaucaaacaccggcaauuagggcagaacauaccgguagagaaauaguggauuugaugugccaugcuaccuucacaaugcgucuccuaucaccgguacgcgugccaaauuauaauuuaauaauaauggacgaagcacauuuuacagauccugcaucuauagcggcgcgcgguuacaucaguacaagagucgaaaugggagaagcagcgggaaucuuuaugaccgcaacgccaccugggagccgcgauccguucccccagaguaacgcaccuauaauggaugaagaaagagaaaucccagagcggucuuggaacucuggucaugaauggguuaccgauuuuaaaggcaaaacuguaugguuuguaccaagcauuaaagcaggcaaugauauagcugcaugucuacggaaaaacgggaagaaagucauucaauuaucgagaaaaacguucgacucagaauauguaaaaacacgugccaacgauugggauuuugucgucaccacagauauaagugaaaugggugcuaauuuccgcgcugaaagagucauagauccccguagauguaugaaaccugucauacugaccgauggugaagaacguguaauauuggcaggaccuaugccuguuacgcacucaucggccgcucagcgaagaggucggauaggucgcaaucccaaaaaugaaaacgaccaguacaucuacaugggggaaccccucgaaaaugacgaagacugcgcacacuggaaagaagcgaagaugcucuuggacaacauaaacacuccugaggguaucauuccuagcauguucgaacccgaaagggaaaaaguagaugcaauagacggggaauaccgucucagaggagaggcuaggaaaacuuucguugauuuaaugcgaaggggugauuuacccguaugguuggcuuaccgaguggcagcagaaggcauuaauuacgcagauaggcgaugguguuucgacggaaucaaaaauaaucagauucuagaagaaaauguggaaguugaaaucuggaccaaagaaggggaacggaagaaauuaaaaccacgcugguuagaugcgagaauuuauucugauccccuagcgcuaaaagaauuuaaagaauuugcagcugggagaaaaagucugacauuaaaccuaauuacagaaaugggccgccuaccgacauuuaugacacaaaaagccagagacgcgcuagacaauuuagcgguauuacauacugcagaaguuggagggagagcuuacaaucaugcauuaagugaacucccggagacauuagagacccuuuuguuauuaacacuacuugcaacuguuacgggagguaucuuucuguuucuaaugaguggaaaggguaucggcaaaaugacccucgguaugugcugcauuauuacagcuaguauccuacugugguacgcccagauucaaccacacuggaucgcugccuccauuauucuugaguucuuuuuaauaguccuguugaucccagaacccgaaaagcaacggacaccacaagauaaucagcuuacuuaugugguuauagcgauacuuacuguaguugccgcuaccauggcgaaugaaaugggcuuucuggagaaaaccaagaaagaccucggucugggaucaauaacgacacaagaaagcgaaucaaauauucuugauauugauuugagacccgccagugcauggacguuauaugcugucgccacaacuuucguuacuccuauguuaagacauucaauagagaacucaaguguaaauguaucgcuaacugccauagccaaucaggcaacgguauuaaugggccuugggagagguuggccacuaagcaaaauggauaucggggugccgcuguuagcuauuggauguuauucucaaguaaauccaauuacgcuaaccgccgcccuucugcuacucguugcacauuaugcgauuauugggccaggacuucaagcuaaagcaacacgagaggcucagaaaaggacggcugccgguauuaugaaaaauccuacagucgaugguaucacuguuauugaucuugaaccgauuccuuaugauccuaaauuugagaaacaacugggucagguuaugcucuuaguauuaugcguaacacaaguauuaaugaugcguacaacaugggcuuuaugugaagcauugacucucgcuacagguccaauaaguacuuuaugggagggcaauccaggacgguuuuggaauacuacaauagcuguaucuauggccaauauauuucguggaagcuacuuagcaggagcaggacugcuauucaguauuaugaaaaauacuacaaacacacguagaggcacagguaauauuggagagacauugggcgaaaaauggaaaagcagacuuaacgcgcuugguaaaucagaauuucaaaucuauaagaaaucugggauccaagagguggaccgcacuuuagccaaagaaggaauaaagagaggugagacagaccaccacgcggucucucgagguucagccaaacuucguugguucguugaacguaauauggucacaccugaggguaagguaguagacuuaggauguggacgaggcgguuggaguuacuauugugguggacuaaagaaugugagagaggucaaaggcuuaaccaaagggggaccuggucacgaagaaccaauuccgaugucuaccuacggauggaaucucguacgacuacaaucaggaguagauguuuucuucacgcccccugaaaaaugugauacucuacuaugcgauauaggggaguccaguccaaacccaacuauagaagcaggaaggacacuaagaguauuaaacuuaguagagaauuggcucaacaacaauacacaguucugugugaaaguccuuaacccauacaugccuaguguaauugaaaagauggaaacacuccagcgaaaauacgggggagcucuaguuaggaauccacuuucucgaaacucaacccacgaaauguacugggucagcaacgcaacgggaaacaucguaaguucuguaaauaugauuucucgaauguuaauaaaccgauucacaaugaagcacaagaaagcaacauaugagccagacguagaucuaggaucaggaacuagaaauauagguauagaaaacgaaauaccaaauuuagauauaauugguaaacgaauagagaaaauaaaacaagaacacgaaacgaguuggcauuaugaucaggaucauccguauaagacaugggcauaccacgguucguaugaaaccaaacaaacagguucugcaaguucuaugguuaacgguguuguuaaacuacuaacaaaaccaugggauguaguuccuauggucacacaaauggccaugacugauacaacucccuuuggacaacaaaggguauuuaaagaaaaaguggacacacgaacucaagagccuaaagaaggaacaaagaaacuaaugcgaauaacggcggaaugguuauggaaggagcuagguaagaagaaaaccccaagaaugugcacucgagaagaauuuacgcguaaggugagaagcaaugcggcacuaggugcuauauucacugaugaaaauaaauggaaaagugcccgggaagcuguagaggauucaagauucugggagcuaguugaucgugaacgaaauuuacaucucgaagguaagugugaaacauguguguacaauaugauggguaaacgagaaaagaaacuaggggaguucggcaaggccaaggggucgagagcuauaugguauaugugguuaggcgcgagauuccuggaauuugaagcacugggauuucuaaaugaagaccacugguuuucgcgaggaaacucacugucagguguugaaggagaaggcuuacauaaacuaggauacauccuacgcgacguuagcaagaaagaagggggagcuauguacgcagacgauacagcgggaugggacacacggauaacgcuugaggaucucaaaaaugaagaaaugguaacaaaucacaugaagggagaacacaagaaacuagccgaagcuaucuucaaauuaaccuaucaaaauaaaguagucagaguccaaagacccacuccacguggcaccguaauggacauaauuucgagaaaagaccaaagaggaucggggcagguaggaacuuaugguuuaaacacauuuacaaacauggaagcucaacuuauaagacaaauggaaggggaaggaauauuuaaaucuauccaaagguugacugugaccgaagaaauugcuguccaaaauuggcuagcaagggucggccgggaacgacugaguagaauggccauaaguggagaugauugugucgucaaaccguuagaugauagauuugcuagcgcacuaacugcauuaaacgacauggguaaaguuaggaaagauauucaacagugggaaccaaguagaggauggaaugauuggacacagguaccuuucuguagucaccauuuccacgagcuagugaugaaagacggacgaguauugguuguacccuguagaaaucaagaugaacuaauagggcgcgcacgaauaagucaaggggcggguuggagucugaaagagacggcgugccucggaaaaucguacgcgcaaauguggacauuaauguauuuucaccggagggaccuccgccucgcagccaacgcaaucuguagugccguucccucucauuggguaccgacaaguaggacgaccuggucgauacacgcaaagcaugaauggaugacuacggaagacaugcucgcgguauggaaccgaguuuggauucaggaaaauccauggauggaagacaaaacacccguggaaaguugggaggaaguaccauaucuagguaaaagagaagaccaguggugcggaucauuaauuggcuugacaagucgagcuacaugggccaaaaauauccaaacagcaauaaaucaaguaagaucuuugauaggaaaugaggaauacacugauuacaugcccucuaugaagcgauuuaggaaagaggaagaagaagcgggaguucugugguaa

SEQ ID NO: 22601 - RNA, 9876 nt, Artificial Sequence
  derived and/or modified CDS sequence (opt6) from DENV-2__EU687235__SS-prME
accgcaggagugauaaucauguuaauaccaacggcaauggccuuccacuuaacuacgcgaaauggagaaccacacaugauaguaggaagacaagaaaaaggaaaaucacuacuauuuaaaacagaagaugguguaaacaugugcacgcugauggcuaucgaucuuggagaacuaugcgaagauacuauaacuuauaaauguccucucuuacgacagaaugaaccagaagauaucgauuguugguguaacagcaccaguacaugggucacauacggaaccuguacaacaacaggugaacaucgacgagagaaaagaucaguagcauuaguuccacauguuggcauggguuuagaaacuagaacagaaacauggaugucaucagaaggggcguggaaacacguacaaagaauagaaacuuggauuuuacgucauccagguuuuaccauaauggcagcuauuuuagcguauacaauugguaccacccauuuucaaagagcucuaauauucauacuauuaacugcuguugcaccaucaaugacgaugcgcugcauagggauaagcaacagagauuucguugaaggagucucgggcggaucguggguagauaucguccuagaacacgguaguuguguaacaacaauggcgaaaaauaaaccuacccuugauuuugaacugaucaaaaccgaagcuaaacaaccagcaacauugagaaaauauuguauugaagccaaauuaacgaauacuacuaccgacucgagaugcccaacacaaggcgaacccagccugaacgaagaacaagauaaacguuucauauguaaacacuccaugguagauagaggauggggcaauggaugcggucuuuucggcaaagggggaauaguaacgugugcaauguuuacaugcaagaaaaauauggaaggaaaaguuguauuaccggaaaaucuagaauacacaaucguuaucacaccucauucaggagaggagcaugcugucgggaaugauaccggaaaacauggaaaagaaauuaaaauaacuccucagucuucaauaacugaagcugaacucacaggguacggaacaguuacgauggaauguaguccccgaaccggauuggauuucaacgaaaugguacugcuucaaauggaggacaaagccuggcuuguccauagacaaugguuucuagauuuacccuuaccauggcuaccgggagcagacacgcagggaucaaauuggauacaaaaagaaacguuggucacauuuaaaaacccacacgcaaagaaacaagacgugguuguuuugggaagccaagaaggcgccaugcacacagcauuaaccggggcuacagagauacagaugucaucgggaaaucuauuauuuaccggacaucuuaaaugucgauuaagaauggauaaauugcaauuaaaagggaugucuuauucaauguguacugggaaauucaaaaucguaaaagaaaucgcagaaacgcaacauggaacaauuguaauacggguccaauaugaaggggaugguucaccauguaaaauuccauuugaaauaauggaccuagagaaacgucauguacucggacgguuaauuaccguuaauccaaucgucacggaaaaagacagcccugucaauauagaggcggaaccgccuuuuggggacagcuauauaauaauaggaguugaaccuggacaacuaaaacuaaacugguuuaagaaaggaagcagcauuggccagauguuugaaacaacaaugagaggagcuaaaagaauggcuauuuuaggagacacugcuugggauuucggaucucucgggggaguguucacaucaauagggaaagcgcuucaccaaguuuuuggggcaauauacggagccgcauuuucaggaguauccuggacuaugaaaauccuaauaggugucauaauaacguggauuggaaugaacucuagauccacuucacugaguguuucauuaguucuaguagggguaguaacguuauaccuuggcguaauggugcaagcagauacgggcugcguugucaguuggaaaaacaaagaguugaaauguggaagcgguauuuucauaaccgacaacguucacacauggacagaacaauauaaauuucaaccugaaaguccaagcaaguuagcaagcgcaauacaaaaagcucacgaagaaggcauuuguggcauaagaagcguaacccgacuggaaaaucuuauguggaaacaaauuaccccagaacuaaaccacauucucucagaaaaugaggucaagcuaaccauaaugacaggugauauuaagggaauaaugcaagcuggcaagaggagccuaagaccacaaccuacagaauuaaaauauagcuggaagacuuggggaaaggcaaagaugcugagcacugaaagucauaaccaaacauuccuaaucgauggucccgaaaccgcugaaugucccaauacaaacagagcuuggaacagucucgaaguagaggauuaugguuuuggaguauuuucaacaaacaucugguuaaaacuacgcgagaagcaagacguguucugugauaguaaacuuaugagcgcagcuaucaaagacaauagggcagugcaugcggauaugggauacuggauagaaagugccuuaaaugauacguggaaaauggagaaagcaucguuuaucgagauaaaaagcugccauuggccuaaaagucauacuuuauggaguaauggcguacuggaaagugaaaugauaauucccaaaaauuuugccgggcccgugucacagcauaacuaccgaccuggguaccacacacaaaccgccggaccuuggcauuuaggcaaacucgaaauggauuuugauuucugugagggaacuaccguugucguaacugaagauugugggaaucgaggacccuccuuaagaaccaccacagcuucagggaaauuaauaacggaaugguguugcagaagcugcacauuacccccuuuaagauaucgcggagaagacggguguugguacggcauggaaaucagaccucuaaaagaaaaagaagaaaaucugguaaauucauuggucacagcaggucauggacaaauugauaauuucucguugggaguuuuagguauggcgcuguucuuggaggagaugcuaagaacucguguggggaccaaacacgcaauucuguuagucgcaguaucauuugugacuuuaauuacugguaacaugucauucagggauuugggacgagugaugguaauggugggggcaaccaugacagaugauauagguaugggugucacauacuuagcccuauuagcggccuucaagguuagaccaacguuugcggcugggcuucuguuacguaaacuuacuucuaaggaacucaugauggcuaccauagguauugcauugcugucacaaucaacaauccccgagacaauuuuagaacucacugaugccuuagcacuaggcaugaugguucuuaagauaguucggaauauggaaaaauaucagcuugcaguaacuauuauggcuauuaguugcgucccaaaugcaguaauucugcagaaugcauggaagguguccuguacuauacuggcagcaguguccguaucgccacuuuugcuaacuagcucccaacagaaagcggauuggauaccacucgcauuaacaauuaaaggauuaaacccgaccgcaauauuccugacaacacugaguagaacaucuaagaaacguucuuggccuuuaaacgaagcugucauggcaguaggaaugguuucuauuuuggccucaucacuauuaaagaaugauauaccgaugacgggaccccuaguagccggaggucuacuuaccguuugcuacguuuuaacagguaggagugcagauuuagaacucgaaagagcggcagacguuaaaugggaagaucaagcagagauaucagguaguucuccaauacuaaguauuaccauuucugaagauggaagcaugaguaucaaaaaugaagaagaagaacauaccuuaacaauuuugauaaggaccggacuucucguaauaucaggaguauucccaguuucuauacccaucacugcugcugcaugguauuuaugggaagucaaaaagcaacgagccggcguuuuaugggauguaccuucacccccucucguuggaaaagccgagcuagaggauggagcauacaggauaaagcaacgugguaucuucggauacagucaaaucggcgccggcguauacaaggagggcacguuucacaccauguggcacguaacacguggcgcuguccugaugcacagagguaagcguauugagccuucaugggcagaugucaagaaagauuuaaucucuuacgguggaggguggaaauuagaaggagaauggaaagaaggagaagaaguacagguccuagcguuagaaccaggcaaaaaucccagggcaguccaaaccaaaccaggucucuuuaagaccaacacgggcaccauuggggcaguuaguuuagauuuuucuccaggcaccucgggauccccuauaguagauagaaaaggaaaaguaguaggucuuuacggcaaugggguuguuacacguaguggcgcuuauguaucagccauugcucaaacagagaagucaaucgaagacaauccugagaucgaagaugauauauuuaggaagaaaagacuaacaaucauggaccuccauccaggcgcagguaaaacuaaaagauaucucccagcuauagugagggaagccauaaaacggggucugagaacacucauauuggcaccgacacgaguuguugcugcagaaauggaagaggcgcucagaggacuuccaauccgcuaccaaaccccagcuauucgagcagagcacacaggacgugaaauaguagauuugaugugccacgcgacauucacuaugagacuacuaaguccgguacgcgucccuaauuacaacuugauaauaauggacgaagcacauuuuacagauccagccucaaucgcugcaaggggguauaucucaacuaggguagagaugggugaagcagcugggauuuuuaugaccgcuacuccaccugguucccgugauccauucccgcagucaaaugcacccauaauggacgaagaaagagaaauaccagaaagaucauggaacucuggccaugaauggguuacagauuuuaaaggaaaaacagucugguuuguaccgucaauaaaagcaggaaacgacauagcugccugucuacgcaaaaacggaaagaaggugauacagcuaucccggaagacauucgacuccgaauauguuaaaacacgagcaaaugacugggauuucguagugacgacagauauaucugaaaugggagcaaacuucagagcagaaagaguuauagacccucgaagaugcaugaaaccagucauucuuacugauggggaggaaagagucauacuggccgguccgaugccaguuacacacucgucugcggcacagcgucgagguaggauagggcgaaaucccaaaaaugaaaaugaccaguacauauacaugggagaaccauuggaaaaugacgaagauugugcccacuggaaagaggcaaaaauguuacuggauaauauaaacacacccgaagguauuauaccaucaauguuugaaccugaacgcgaaaaaguggaugcaauagacggagaauauagacuaaggggugaagcgcguaagacguucguagauuuaaugaggcgcggggaccuacccguuuggcuagcguaucgaguggcugcugaaggcauuaauuacgcggauagacgcuggugcuucgauggaauaaagaauaaucagauauuagaagaaaauguugaaguugaaaucuggacuaaagaaggagagaggaagaaauugaaaccgagguggcuagacgcccgaauuuacucagacccauuagcgcuuaaagaguucaaagaguucgcagcaggacggaaaucgcugacucuaaacuuaauaacagaaauggggcgucucccgacauuuaugacucagaaagcacgagaugcccuugacaauuuagcgguuuugcauacugcugaggugggugggagggcuuauaaucacgcucugucagaacuaccggagacacucgaaacucuuuuacuacuaacacuguuagcaacgguuaccggcgguauauuuuuguucuuaaugagcggcaaagggauagguaaaaugacucuugggaugugcuguaucauuacagcuucaauucuauugugguacgcacaaauucaaccacacuggauagcagcauccaucaucuuagaauuuuucuugauaguucucuugauuccagagccagaaaagcaaagaacuccacaggacaaccaacuaacauauguaguaauagcaaucuugacuguugucgcagcaacgauggcgaaugaaaugggcuuuuuggaaaagacaaagaaagauuuaggccuagguaguauuacaacucaggagucagaaucuaacauauuagauauagauuugcgaccagcuucugcauggacacuauacgcgguagcaacuacuuuuguaacgccgauguuaagacauucuauagaaaacucuucgguuaacguaaguuuaacugcaauagcaaaucaagcaacagugcucaugggucuugguagagguuggccacuaucaaagauggauaucggaguacccuuauuagcuauaggcugcuacucccaaguuaacccaauaaccuuaacagcagcacuacuucuuuugguagcacauuacgcaauuaucgguccaggucuucaagcuaaagcuacacgagaagcacaaaagcgcacagcagccggcaucaugaagaaucccacggucgauggaaucacgguuauugaucuagagccaauuccguacgacccaaaguucgaaaaacagcuaggucaagucauguuacuugugcuuugcguaacacaaguacuaaugaugagaacaacgugggcuuuaugugaagcguuaacccuagcgacaggcccaauuaguacguuaugggaaggaaacccgggacgauucuggaauacaacaauagcaguaucuauggccaacauauucaggggcucuuaccuagccggagcggguuuauuauuuaguauaaugaagaauacuaccaauacaagacgcggaacuggaaacaucggugaaacgcuaggagagaaguggaaauccagacuuaacgcacuaggcaagucugaauuucagauuuauaagaagucggggauacaagaaguugacaggacucuagcuaaagagggaauaaaacgaggugaaacagaccaucaugcgguaagcagaggcagugcaaaacuaagaugguuuguagagcgaaauauggucacuccagaaggaaaggugguagaucuagggugcggacgcggaggauggucauauuauuguggaggacuaaagaacguuagggaaguuaaaggcuuaacuaaagguggaccgggccacgaagaaccaauuccuaugucuacguauggauggaaucuuguaagacuacaaagugguguggauguauuuuucaccccacccgaaaaaugugacacccuauuaugcgacauaggagaauccucgccaaaccccacaauagaagcagguagaacacucaggguauugaaccuagucgaaaacuggcuaaauaauaacacucaauuuugugucaagguguugaauccauacaugccaaguguaaucgagaaaauggagacacugcaaagaaaguacggaggggcuuuaguaagaaauccacuauccagaaacucaacccacgagauguauuggguauccaaugcaacagggaacaucguaucaagugugaauaugauaucaaggaugcuaauaaaucgauucacaaugaaacauaagaaagcaaccuaugagcccgauguagaucuggguaguggaaccaggaacauaggaauugaaaacgaaauuccaaauuuagacauaauaggaaagcggauagagaagauaaaacaagaacacgaaacaucguggcacuaugaucaggaccaucccuauaaaaccugggcauaccauggaagcuaugaaacaaaacaaacuggaagugcuuccagcaugguaaauggaguuguuaaguuacuaacaaaaccaugggauguuguaccaauggucacccaaauggcaaugacugauacgacuccuuucggacaacagaggguauucaaagaaaaggucgacacgcgaacacaagaaccuaaagaagggacaaagaaacuaaugaggaucacugcugaaugguuauggaaagaacucgggaaaaagaaaacuccacguaugugcacucgagaagaguucacccgcaaagucagaagcaacgcagcgcuaggagcaauauuuaccgacgagaacaaauggaaaagugcucgggaggcuguagaagacaguagauuuugggaacucguggauagagaacggaauuuacaucuugaaggcaaaugugagacaugugucuacaacaugauggguaagagagagaagaaauuaggagaauuugggaaagcaaagggcucucgagcgauaugguacaugugguuaggagcgcgauuuuuagaauuugaggcuuuaggguucuuaaaugaagaucacugguucucccgugggaacuccuugucuggcguagaaggagagggauuacacaaauugggguauauuuuacgugaugugagcaaaaaggaagggggagcgauguaugccgaugauacagcggggugggacacacgcauuacccuagaagacuugaaaaacgaggaaaugguaacgaaucauaugaaaggagaacauaagaaauuagcugaagcgauuuuuaaauuaacuuaucagaauaagguugugaggguccagagaccuacaccgcgcggcacaguaauggauaucauuucaagaaaagaucaaagaggcagcggucaaguuggcacauacgguuuaaacacauucacuaacauggaggcucaauuaauccggcaaauggaaggcgagggcauauuuaagucuauccaacgguugacuguuacagaagaaauagccguucaaaauuggcuggcaagaguagguagagaaagacuuagucgaauggcgauuaguggugacgauuguguaguaaagccgcuagaugauagguucgcuucggcacuuaccgcuuuaaaugauauggggaaaguaagaaaggacauucagcagugggagccaucaagaggcuggaaugauuggacacaaguacccuucugcucucaccauuuucaugaauuagucaugaaagaugguagaguacuuguaguaccauguagaaaucaggaugaacugaucggcagagcuagaauaucacagggugcugguuggucauuaaaagaaacggcuuguuuagguaaaucauacgcacagauguggacuuuaauguacuuucaucgaagagaucugcgucuagcugcaaaugcgauaugcucggcaguacccucccauuggguucccacaucgcgcacuacauggaguauccaugcuaaacacgaguggaugacaacagaagauaugcuagcaguuuggaacagaguauggauccaggagaauccauggauggaggauaaaacuccuguagaauccugggaagaaguaccauacuuaggcaaaagggaagaccaguggugugggagccucaucggacuaacaucaagagcaaccugggcuaaaaauauucaaacagcaauaaaccaagugagaucuuuaauagguaaugaggaauauacugauuauaugcccucuaugaagcgauuuaggaaagaagaagaggaagccgguguacugugguag

SEQ ID NO: 22602 - RNA, 9876 nt, Artificial Sequence
  derived and/or modified CDS sequence (opt6) from DENV-2__EU687236__SS-prME
acugcugguguuauaauuaugcugauaccaacugcaauggcauuucaccuaacuacucgcaacggagaaccacauaugauagugggaagacaagaaaaagggaaaucuuuacuauuuaaaacagaagauggagugaauauguguacauuaauggcaauagauuugggugaacuaugcgaagauacaauaacauauaaauguccucuauuaaggcaaaacgagcccgaagauauagauuguugguguaauagcacuucgacaugggugacguacgggacguguacaacaacuggugaacauagaagagaaaagagaucaguggcacuuguaccucauguaggaaugggauuggaaacaagaacugaaacauggaugucgucggaaggcgcuuggaaacauguucagcguauagagacauggauucugaggcauccaggauuuacaauuauggcagcaauacuagcuuauacuauagguacgacacacuuucagcgugcacuuauauuuauauuacuuacagcaguagcuccuaguaugacaaugagguguauagguauaucuaaccgagauuuuguugaaggaguauccggaggaucauggguagauauugugcuugagcacgguucuuguguaaccaccauggcuaaaaacaaaccgaccuuagauuuugaauuaauuaaaacagaggcaaaacagccugcaacauugaggaaauauugcauagaagcaaaacucacgaauacuacuacugaauccagguguccaacucaaggcgaacccucuuuaaaugaggaacaagauaaacguuuuaucugcaaacauucaaugguugauagaggaugggguaauggaugcgggcuguuuggaaaaggaggcauaguaacaugcgcaauguucacaugcaagaaaaauauggagggcaaagucguauugcccgaaaauuuagaguauacaauaguuauuacgccacauucgggagaagaacaugcuguagguaacgauacagggaaacacggcaaagaaauaaaaauaaccccacaaaguucaauuacggaggcugaacuaacuggauacggaaccguaacaauggagugcagcccuagaacgggacuggacuuuaaugaaaugguuuuauugcagauggaggauaaggcuuggcuaguacacagacaaugguucuuagaccuaccacugccuugguugccaggggcggauacccaagggaguaacuggauucaaaaagaaacccuaguuacuuucaaaaauccacaugcaaagaaacaagacguaguaguacuagguucacaagaaggagcaaugcacacagcucuuacgggagcaacagagauccaaaugaguucaggaaaucugcuuuuuacaggacauuuaaaaugucgacuuagaauggacaaauugcaguugaaaggaaugagcuauagcaugugcaccggaaaauuuaaaaucgugaaagaaauugccgaaacgcaacacggaacaauuguuauacgaguacaauaugaaggcgauggaagcccgugcaaaauaccauuugaaauaauggaucuugagaaacgccauguucuaggacgauuaaucacugucaacccaauaguaaccgaaaaagauucacccgugaauauagaagcugagccaccuuucggagacuccuauauaauuauuggagucgagcccggacaacuuaaacuaaauugguuuaagaaaggcucgagcauugggcaaauguuugaaaccaccaugagaggcgccaaaagaauggcuauacuaggcgauacugcaugggauuuuggaagucuagguggcguuuuuacgucuauaggaaaggccuuacaccaagucuuuggagcuaucuauggggcagcguuuaguggugucaguuggacgaugaagauacugauaggagucauaauuacuuggauaggaaugaacucaagaucuacaucauuguccgucagucuuguguuaguuggaguaguaacacuguaccuuggagugaugguacaagcagauacuggaugugugguaucuuggaaaaacaaggaacuaaaaugugggagcggcauauuuauaacagauaacguccacacuuggacagaacaauacaaauuucagcccgaaucacccucuaaacuagcuucugcuauccagaaagcccacgaagaagguaucugcgggauucgauccguaacaagacucgaaaaccucauguggaaacaaaucacaccagaacuuaaucauauccuaucagagaacgaaguaaaacugacgauaaugaccggagauauuaagggcauuaugcaagcuggaaaaagaucccucaggccacaaccaacugaacucaaauacaguuggaaaacaugggguaaagcuaagaugcugaguacagagucacacaaucagacauucuugauugaugggccggaaacagcagaaugcccgaacaccaauagggcauggaacucacuugaaguugaggauuacggcuuuggaguauucucgacuaacauaugguuaaaauuaagagagaaacaagacguuuucugugauucaaaguugaugucagcugcgauaaaggauaaucgagcgguucaugcugauauggguuauuggauugaaucagcauugaacgauacguggaaaauggaaaaggccucauucaucgaaauuaaaagcugucauuggccaaaaucgcacacauuauggagcaauggcguacuagaaucugaaaugauuauucccaaaaauuucgcugguccaguaucgcaacacaauuauaggccaggcuaccauacucaaacugcagguccguggcauuuagggaaacuggagauggacuuugacuuuugugaaggcacgacaguuguaguaacugaagacuguggcaacagagguccaucgcuuagaaccacaacggcuagcggaaaguuaauaacggaauggugcuguaggucuuguacuuugccgccacuaagguacagaggcgaggacggauguugguauggaauggaaauaaggccguugaaggagaaagaagaaaaccuuguuaauucgcuuguuacagcgggucaugggcaaauagacaauuucucauuggguguccuuggaauggcacuguuucuugaggaaauguuaagaacaagaguggguacgaagcaugcaauacuccuuguggcugucucauucguaacauugauaacaggcaacaugucguuccgcgauuuggggagagucaugguaauggugggcgcgacuaugacagaugacauaggcaugggagugacauauuuagcuuuacuagcggccuuuaaggugcggccuaccuuugccgcugggcuuuuacuuagaaagcugaccucaaaagaacuuaugauggcuaccaucggaauugcuuuauuaagucagagcacuauuccagaaacuauauuagaauuaacagaugccuuagcacuagguaugaugguguugaagaucguucgcaacauggagaaguaccaauuggcuguaacaaucauggccauaaguugugugccuaaugcuguuauauuacagaaugcuuggaaagucagcugcacuauauuggcagcaguguccguuucaccuuuauuacuaacuucaucacagcaaaaggcagacuggaucccacucgcucucacuauaaaaggccucaacccuacagcgauauuuuuaacaacuuugucaaggacguccaagaaacguaguuggccauuaaacgaagcaguuauggcaguggggauggucucgauucuggcaucuagccuacugaaaaacgacauuccaaugaccggacccuuaguagcaggaggauuauugacggucugcuauguauuaacaggacggagugcagaucuagaacuagaaaaggcugcagacguuaaaugggaagaccaagcagaaauaagcggaucuucuccaauauuaaguauaacaauaagugaagaugggucgaugucaaucaaaaaugaggaagaggaacauacauuaaccauacuaauaagaacagguuugcugguaauaagugggguauuccccguaucuauaccaauaacggcagcagcaugguaucugugggaagugaagaaacaaagagcaggaguguuaugggauguaccaucaccaccuccaguuggaaaggccgaacuagaagauggagccuaucguauuaaacaaagaggaauauucgguuauucacaaaucggugcaggcguauauaaggaaggaacguuucauacgauguggcacguuacuagaggugcgguacugaugcacagaggaaaacguaucgaaccaaguugggcugaugucaagaaagauuuaauaaguuauggcggugguuggaaacuugaaggagaauggaaagaaggugaggaagugcaaguucuggcucuagaaccuggcaaaaauccaagagccguccagacuaagccggggcuguucaaaacaaauacaggaacaauaggcgcaguaucauuagauuuuucaccaggcacaucgggcucuccaauaguagaccguaaaggcaaaguuguuggacuauauggaaacgguguggucacaagaucaggggcauacguaucagcgauagcacagacggaaaagaguaucgaagauaacccggagaucgaagaugacauauuuagaaagaaacgucucacuauaauggauuugcacccaggagcaggcaaaacaaaacguuauuugccggcgauaguuagagaggcaaucaaacgcggguuacguacacugauuuuagcaccuacacgcgucguagcugcugaaauggaagaggcacuaaggggcuugccaauaagguaccaaacuccggcaauuagggcagaacacacaggucgugaaauuguugaucuaaugugccaugccacuuucacaaugcgacuauugucacccguuagaguaccuaauuauaauuuaauuauuauggaugaggcucacuucacagauccagcgaguauugcagcgaggggauauauaaguacacgcguagaaaugggugaagcugcgggaauuuuuaugacggcuacgccaccagguagucgcgaccccuuuccacaaucaaaugcccccauaauggacgaagaaagagagauacccgaaagaagcuggaauagugggcaugaauggguuacagauuucaaagggaagacuguaugguucgugccuucgaucaaagcgggcaaugacauugccgcuugucuccggaaaaauggcaaaaagguaauucaacucucccgaaaaacauucgauuccgaauacguaaaaacgcgagcuaaugacugggauuuuguuguuacuacugauauuucggaaaugggugccaauuucagagccgagagagucauagauccgagacguuguaugaaaccuguaauucuuacagauggugaggaacggguaauuuuagccggcccuaugccuguaacacacagcagugcugcacaacgaaggggucguaucggcaggaacccuaaaaacgaaaacgaccaguauaucuauaugggcgagccacucgaaaaugacgaagacugugcacacuggaaagaggcuaaaauguuauuagauaacauaaacacaccagaagguauuaucccuagcauguucgagcccgaaagagaaaaaguugaugccauugacggggaauaccggcuuagaggagaagcaagaaagacuuucguagaucuaaugagaagaggagauuugccaguuugguuggcauaccgcguagcagcugaaggaauaaacuaugccgaucgacguugguguuuugaugguauaaagaacaaucaaauauuggaagaaaaugucgagguugagauuuggacaaaagagggggaaagaaagaaauuaaaacccagaugguuggacgcacggaucuacagcgauccacucgcuuuaaaagaguuuaaagaauuugcugccggucguaaaucccuaacauuaaaucuaauaacugaaaugggaagacuuccaacauucaugacgcaaaaggcacgcgaugcucucgauaauuuagccguccuccauaccgcagaaguaggagguagagccuacaaccacgcccugagugaacuaccugaaacauuagagaccuuacugcuuuugacacuacuugcaacgguaacaggagguauauuucuguucuuaaugagcgguaaggggauuggaaagaugacacuaggcauguguuguauuauaacugcuagcauacucuuaugguaugcccagauucaaccucacuggauugcugcauccaucauauuggaguucuuuuuaauaguccuuuuaaucccggaaccugaaaaacaacgaacuccacaagacaaucaacucacguacguaguuauagcaauuuuaacugucguagcugcaaccauggcaaacgaaaugggauuuuuagagaaaacuaagaaagauuugggccuaggcucaauuacaacucaggaaucugaaucaaacauacuggacauagaccugcguccagcuuccgcuuggacuuuauacgcaguggccacaacuuucgucacuccaauguuacgucauucgauugaaaauucuucaguaaauguguccuugacagcaauagcuaaucaagcaacagucuugaugggacuugguagaggguggccgcuuucaaaaauggacaucggcguaccacuacucgccauuggauguuauucucagguuaauccaaucaccuuaacagcugcuuuacuucucuuaguugcacacuaugcgauaaucgggccuggacuacaggcgaaggcuaccagagaagcgcaaaaacgcacugcagccgguauuaugaaaaacccuacagucgaugguauaacuguaauugaccucgaaccgauacccuacgacccaaaauuugaaaaacagcucggacaggucaugcuauuaguuuuaugcguuacacaaguacugaugaugaggacaacaugggcuuugugugaagcauuaacucuagccacaggccccauuucgacacuaugggaaggaaauccuggacguuuuuggaacacaacuauagcagugaguauggcaaauaucuuucgagggucauaccuagccggagcaggauuacuuuuuaguaucaugaaaaauacgacuaauacuaggagaggaacugggaauauaggcgaaacacuaggagagaaauggaagaguagguuaaaugcccuugguaaaucagaauuucaaauuuacaaaaagucuggaauacaagaaguggauaggacccuggcgaaggaagggauaaagagaggagaaacggaucaucaugcuguuucgagaggaucugccaaacuacguugguucguagaacguaauauggucacuccugaagguaaaguaguagaccuaggaugugggcgcggagguuggaguuauuauugugguggccucaaaaauguaagagaagucaagggucuuaccaaagggggaccaggacaugaggaaccaauuccuaugucaacauacggcuggaaucuagugagacuacagucaggaguugauguauucuuuacacccccggaaaaaugcgauacguuauuaugugauauuggagaaagcucaccaaauccaacaauagaggccggacgaacgcuccgcguuuuaaauuuaguagagaauugguuaaacaacaauacacaauuuugcgucaaaguucucaacccguauaugccuucuguaauagaaaagauggaaacacuacaaaggaaauaugguggagcauuaguccgaaauccauuaucucgcaacuccacacacgaaauguauugggucagcaaugcaacaggaaacauugugucaucaguuaauaugaucucccgaaugcucaucaaccguuucacaaugaagcauaagaaagcaaccuacgaaccagacguugaucuuggaagcggaacuagaaacauagggauagagaaugaaaucccaaauuuggacauuauaggaaaacguauagaaaagauuaagcaggagcaugaaacaaguuggcacuacgaccaagaucauccauauaaaacaugggccuaucauggcucauacgaaacaaaacaaacagggucagcaaguucaaugguuaauggaguagucaaacuuuugacgaaacccugggacguuguaccaaugguaacucaaauggcaaugaccgauacaacaccauucggacaacaaaggguauucaaagaaaaaguagauacacgcacgcaagagccgaaggaagggacuaagaaauuaaugagaauaaccgcugagugguuauggaaggaguuagguaagaagaagacgccgcguauguguacgcgcgaagaauuuacaaagaagguaagaaguaaugcugcauuaggggcaauauuuacggacgagaacaaauggaaaucggcacgcgaggcaguugaggauaguagauuuugggagcuaguagacagggaaagaaacuuacaucuugaagguaaaugcgagacuuguguauauaauaugauggggaaaagagagaagaaacuuggagaguuugggaaggcuaagggaucaagagcgauaugguauauguggcuaggggccagauucuuagaguuugaagcgcuuggauuucugaaugaagaccacugguucagucgggggaauaguuuaaguggcguagagggcgaaggccugcauaaauuaggcuacauucuacgugacguaucaaagaaggagggaggcgcgauguaugcagaugauaccgccggaugggauacaaggauaacucuagaagaccucaagaaugaagaaaugguuaccaaucacaugaaaggagaacacaagaaauuagccgaggcaaucuuuaaacucacuuaccagaacaaaguaguacgagugcaaaggccaacaccccgaggaaccguaauggacauuaucaguagaaaagaucaacguggaucaggacaagucgggaccuauggauuaaauacguuuaccaacauggaagcacaauugauacgucaaauggaaggagaaggaauuuuuaaaucuauacagcgacuuaccgucaccgaggagauagccgugcaaaauuggcuagcacgaguuggucgcgaaagacuuucucgcauggcgauaaguggggaugacugcguagucaagcccuuagacgaccgauuugcuucugcauugacagcuuuaaaugauaugggcaaaguuaggaaagauauccaacagugggaaccaaguagaggcuggaaugacuggacgcaaguaccuuuuuguucucaccacuuucacgaacuuguaaugaaggacggacgcguccucguaguaccauguagaaaccaagacgaacuuauaggcagagcuagaauuagccaaggagcuggauggaguuuaaaagaaacugcauguuuaggaaaaucauacgcacagauguggacucugauguacuuucacaggcgagauuuacgacucgccgcaaaugcgauauguagugcugugccuagccacuggguacccacaagucgaacaacauggucgauacacgcaaaacacgaauggaugacgacagaagauaugcuagcuguuuggaaucgcguguggauacaagaaaauccuuggauggaagauaaaacuccggucgaaucuugggaagagguucccuaucuggguaaaagagaagaucaaugguguggaucccuaaucggauuaaccucgcgagcaacaugggccaaaaauauccaaacugcaauaaaucaaguuagaucauugauaggaaacgaagaauauacagacuacaugccauccaugaagcgauuuagaaaagaagaggaagaagccgguguacuuugguaa

SEQ ID NO: 22603 - RNA, 9876 nt, Artificial Sequence
  derived and/or modified CDS sequence (opt6) from DENV-2__EU687237__SS-prME
acagcaggagucauaaucaugcugauaccaacugcaauggcuuuccacuuaacaacacggaacggagaaccucauaugauaguuggacgucaagaaaaaggaaaaucucuccucuuuaaaacugaagauggaguaaacauguguacguugauggcaauugaucuaggagaauugugugaagacaccauuacauauaaaugcccauuauuacggcaaaaugaaccugaagacauagauuguugguguaacucgacuucuacaugggugaccuauggaacauguacuacgacuggagaacaucggagagaaaaacgaaguguggcacucguuccucauguuggaaugggauuagaaaccagaacagaaacauggauguccucggaaggugcuuggaaacauguacaacgaaucgaaaccuggauuuuaagacacccuggauuuacgaucauggcagccauauuagcauacacaauaggaacaacgcacuuccaaagagcucugauuuucauccuacuaacagcuguugcuccaucaaugacgaugcguuguauaggaauaucaaacagggauuuuguagaaggaguuuccgguggcucauggguagauauuguacuugaacacggcuccuguguaacaacaauggcgaaaaauaaaccaaccuuagauuuugaauuaauaaaaaccgaagcgaaacaaccggcuacauuaaggaaauauuguauagaagcgaaacucacuaacacuacuacugaaucacgaugcccaacacagggcgagcccucacucaaugaggagcaagauaaaagauuuauaugcaaacacucaaugguugaucgagguuggggaaauggcuguggacuuuucgguaaaggugggauaguaacuugugcuauguucacauguaagaaaaauauggaagguaaagugguacuaccggaaaaccuugaauauacaauagucauaacuccgcauaguggcgaagaacaugccgucggaaaugauacuggcaaacacggaaaggaaauuaaaaucacgccgcagaguucgaucaccgaggcggaguuaacaggauaugguacuguaacaauggaaugcuccccacgaaccgggcuagacuuuaaugagauggugcugcugcaaauggaggacaaagcauggcugguacauagacaaugguuccuggaucuuccacuuccguggcugccuggagcggacacgcaaggcucgaauuggauacagaaagagacuuuagugacuuucaaaaauccacacgcgaagaaacaggauguaguagucuuaggcucacaagaaggggcuaugcauacagcauuaacaggcgcaacugaaauacagaugucaagcggaaaccuauuauuuacuggccauuuaaaauguagguuacgcauggauaaacuucaauuaaaagguaugaguuacucuauguguacugguaaauuuaaaauagugaaggaaaucgccgaaacacagcauggaaccaucgucauaagaguacaauacgagggagaugguagcccaugcaaaauaccauuugagauaauggaucuagaaaaacgacacguauuaggcaggcuuauaacaguaaacccaaucguaacagaaaaggauucgcccgucaauauagaagcugaaccucccuucggagacuccuauauaauaauugggguagaaccaggccaacucaaauuaaauugguucaagaagggcucaaguauuggccaaauguucgagaccacuaugcgaggugcaaagagaauggcuauacuaggagauacagcuugggauuucggaucauugggaggaguauucacaucgauaggcaaggcacuacaucaaguuuucggugcuaucuauggagcugcuuuuucagguguuagcuggacaaugaaaauacuuauaggcgugauaauuacuuggauugggaugaacucuaggagcacaucauuaucagucaguuuaguauuaguaggcguaguaacuuuguaucuagggguuaugguucaagcagacaccggaugcguggugaguuggaaaaacaaggagcucaaaugcgggagugguauuuucauuacggacaacguacauaccuggacagaacaauacaaauuccagccagaauccccaaguaaacuugcgucugccauccaaaaagcacacgaagaaggaauuugugguauuaggaguguaacuagacuugagaauuuaauguggaagcagauuacaccagaauugaaucauauacucagugagaaugaagucaaguuaaccaucaugacuggcgauauuaaagguauuaugcaagcggggaagaggucgcucaggccacaaccaacugaauuaaaauauaguuggaaaacguggggaaaagcuaagaugcugagcaccgaaagccacaaccaaacauuccuaauugauggcccagaaacagcagaauguccaaacacuaaccgugcguggaacucgcuugaaguagaggauuaugguuuuggcguauucuccacaaauauaugguugaaacuucgugaaaaacaagacguuuucugugauagcaaacuuaugucugcugcuauuaaagauaacagagcaguacaugcugauaugggguacuggauagaaagugcauuaaaugauacuuggaaaauggaaaaagcgagcuuuauagagauaaaauccugucacuggccaaagagccacacgcuauggucuaauggaguacuagaaucagagaugauuaucccuaagaacuuugccgguccagucagucagcacaauuaucgaccuggcuaccauacccagacagcagguccguggcaucuaggcaagcuagaaauggacuucgauuuuugcgaaggaacaacaguaguugugacagaagacugcggaaaucgaggaccaucacuuagaacuaccacagcaagugggaaacugauaacagaauggugcugcagaagcuguacgcuaccuccccuaagauacaggggagaggaugguuguugguacggaauggaaaucagaccauugaaggaaaaggaagagaauuuaguaaauaguuuaguuaccgcggggcauggccaaauugauaauuuuucucucggagugcuuggcauggcguuauuuuuagaagagauguuaagaacaaggguagggacaaagcacgcgauauuguuaguagcagugucauucguuacccuaaucacaggaaauaugaguuuuagagaucuuggccgugugaugguuauggucggggcaacaaugacggacgacauuggaaugggaguaacauacuuggcacugcuggccgccuucaaaguuaggccuacguucgcagcagggcuucuuuuaagaaaacucacgucaaaagaacuaaugauggcaacuaucgguauagcacuacugucacaaucuacgauucccgaaaccauacuugaauuaacugacgcacuggcacuaggaaugaugguuuuaaaaauaguaagaaauauggaaaaauaucaacuagccguuacaauaauggcaauaaguugugugccaaaugcaguaauucugcaaaacgcauggaaaguaucuuguacuauuuuggccgcagugagcguuucuccacuacuauuaaccagcucucaacagaaagcagauuggauaccacuggcucuaacaauaaaggguuuaaaccccacagcaauauuccuaacuacauuaaguagaacuagcaagaaaagaucauggccauuaaaugaagcagugauggcugucggaauggugaguauacuagcgucaucacuccuuaaaaacgacauacccaugaccggaccguugguugcagggggauuauuaacuguauguuauguucuaacugguagauccgccgaucuggagcuugaacgugcagcugauguaaaaugggaagaucaggcggaaaucagugguagcuccccaaucuuaaguauaacaauaagugaagacggaucaaugucaauuaagaaugaagaagaagaacacacguuaacuauauuaaucagaacgggauuauuaguaauaucgggcguguuucccguaaguaucccaauuacugccgccgcuugguaucuaugggaaguuaagaaacaacgugccggugucuuaugggaugugccauccccgccaccagucgggaaggcugaauuagaagacggcgcguaucgaaucaaacaacguggaaucuucggauauucccaaaucggcgcaggaguguauaaagaaggcacauuucauacaauguggcauguuacuagaggugcagucuuaaugcaccgaggcaagagaauagagcccucaugggccgacguaaagaaggauuugauuuccuacgggggcggauggaaauuagagggagaauggaaagaaggagaggaaguacaagugcuagcucuugaaccaggcaaaaauccaagggcaguccaaacaaaacccggucuuuucaaaacaaacacugguacuauaggcgcgguuucacucgauuuuucuccagguaccucagguucccccauaguugacagaaaagguaaagucguugggcuauauggaaauggagucgugacuaggagcggagccuaugucucagccauagcccaaaccgaaaaaucuaucgaagacaauccggagaucgaggacgauauauucaggaaaaagcgauuaacuauaauggacuuacacccaggagcuggaaaaacgaagagguacuuaccggcaaucguaagagaggccauaaaacgaggauuaagaacauuaauacucgcuccaacucgcguaguagcugccgaaauggaggaggcacuacgcggcuuacccaucagauaucaaaccccagcaauuagagcugagcauaccggacgcgaaauuguagaccuuaugugccacgcaacuuuuaccaugagacuguuaaguccgguucguguuccuaauuacaaucuaauaauaauggaugaagcacauuuuacugacccagccucaauagcugcgagaggauacauaaguaccaggguugaaaugggagaggcagccgguaucuucaugacagcuacgccaccugggaguagagauccuuuuccacagucaaacgcuccaauuauggacgaagagagagaaauucccgaaagaagcuggaauaguggacacgaaugggucaccgacuucaaaggaaaaacagucugguucguucccuccauaaaagcggguaaugauauagcugcauguuuaaggaaaaauggaaagaaaguuauccaacuuucucgcaaaacuuucgauucugaauaugugaaaacucgugccaaugacugggacuuugucgugacaaccgauauuagugagaugggugcgaauuuuagggcugaaagagucauugauccccgaagaugcaugaagcccguaaucuugacagacggagaggagagaguuauccuugcaggacccaugccuguaacacauagcucagcugcacaacgacgagguagaauugggcgcaaucccaaaaaugagaacgaucaguacauauauaugggggaaccguuggaaaacgacgaagauugugcacauuggaaagaagcgaaaaugcuauuagauaauauuaauacaccagagggaauuaucccaaguauguuugaaccagaaagagaaaaaguagacgcaauugauggugaauacaggcucagaggggaagcucgaaagaccuucgucgaucucaugagaaggggugauuuaccaguuugguuagccuacagagucgcagcggaaggcauaaauuaugcagauagaagauggugcuucgauggaaucaagaacaaccaaauucuagaagaaaauguggaaguugagaucuggacaaaagagggcgaacggaagaaguuaaagccaagauggcuagacgcaaggaucuauucugauccccuugcuuuaaaagaguucaaagaauuugcagcaggaaggaaaucucuaacauuaaaccuaauaacggagauggggagguuaccaacauucaugacacaaaaagcaagagaugcguuggacaaucuagcaguucuucauacagcagaaguugggggcagagcuuacaaccaugcccuaucggaacuuccggaaacuuuagaaacucuccugcucuugacucuccuagcaacuguuacuggaggcauauuuuuauuuuugauguccgguaaaggaauagguaaaaugacauuagguauguguugcauaauuacagcgaguauacuauuaugguaugcucaaauucaaccacauuggauagcagcaucaauuauuuuggaauuuuuccuuauaguauuacuaaucccugagccggagaagcaacguaccccucaagacaaccaacuaacuuauguuguaaucgcaauacugacuguaguugcagcaaccauggcaaaugaaauggguuuccucgagaaaacuaagaaagacuuaggauuaggcaguauaaccacucaagaaagugaaaguaauauucuugauauugacuuacgaccggcuuccgcauggacauuauaugccguugcaacgaccuuugugacuccgauguuaagacauaguauagaaaacucaagcgucaacgucucacuaacugcuaucgcaaaucaagccacaguacuuaugggauugggcagaggguggccuuuaucaaaaauggauauagguguuccccuacucgccauaggauguuauucccaagugaacccuauaacuuugacugcugcuuuauuauuacucguugcucauuacgcaaucauuggaccagguuugcaggccaaggcaacuagggaagcgcagaaacguacagcggcgggaauaaugaaaaacccgacgguagacgguaucaccguaauagauuuagagccuauuccauacgacccuaaauuugaaaagcaauuaggacagguaauguugcuaguauuaugcgucacacagguauuaaugaugaggacuacaugggcguugugugaagcacuaacuuuggcaacagguccaauaucgaccuuaugggaaggaaacccggguagguuuuggaacacaaccauugccguaaguauggcuaauauuuuuagaggcucguaucucgcuggagcagguuuauuguucaguaucaugaagaauacaacaaacacaagaaggggcacuggaaauauaggagagacccuuggcgagaaauggaaaucaagguuaaaugcguugggaaaauccgaauuucaaauuuauaagaaaucaggcauucaggaaguagauagaacccuagcaaaggaagggauuaaaagaggagaaacugaccaucaugccguaucgaggggaucagccaaauuaagaugguucgucgaacgaaauauggucacaccagaggguaaggugguagaucuuggcuguggucgugguggauggucauacuauuguggaggacuaaagaaugugagagagguuaaaggauuaacaaaaggcggaccaggccacgaggaaccgauacccaugagcacguauggcuggaauuuagugagauugcaaucagggguggauguauuuuucaccccuccugagaagugcgacacacuccugugugauauuggcgaauccagcccaaacccaaccaucgaagcaggaagaacuuuaaggguuuuaaaucuaguagaaaauuggcuaaacaacaauacacaauuuugcgugaaaguccuaaaucccuauaugccgucgguaauagagaaaauggagacccugcaaagaaaguauggaggcgccuuagucaggaacccucugucuaggaauagcacacaugaaauguacuggguaucgaaugcuacuggaaauauuguaucaagcguaaacaugaucucaagaaugcuuauuaacagguucacuaugaaacacaagaaagcgacauaugagccagauguagaucuggguuccgguacacgcaacauuggcauugaaaaugaaauaccgaauuuggauaucauugguaaaaggauugagaaaauuaaacaagaacaugaaacgucauggcacuaugaccaagaccaucccuauaaaacuugggcauaucauggcucguaugaaacaaaacagacgggaucagcaucaaguaugguaaauggaguagugaaauuacuuacuaaaccaugggauguggucccgaugguaacgcaaauggcuaugacagauacuaccccauuuggucaacagcgggucuucaaagaaaaagucgauacgcggacacaagagccaaaggaaggaacuaagaaacucaugaggauuacugcagaauggcucuggaaagaacuagguaaaaagaagaccccacgaauguguacacgagaagaauuuaccagaaaagugcgcucgaacgcugcucuuggagcaauuuucacugaugaaaauaaauggaaaucggcuagggaagccguagaagauagcagauucugggaacugguugaccgagaaagaaaucuucaucuggaaggaaaaugugaaacauguguuuauaauaugaugggaaagagagagaagaaauuaggggaauuugguaaggcuaaaggcucacgagcuauuugguacauguggcuaggugcacgauuccuugaguucgaagccuugggguuccuaaaugaagaccacugguuuagccggggaaauaguuugucaggcguugagggagaaggccuacacaaacuugguuauauacucagagauguuaguaagaaagaaggcggugcgauguaugcugaugauaccgcuggaugggacacaagaauuacauuagaggaccugaaaaaugaggaaaugguaacaaaccauaugaaaggugaacauaagaaacuugcagaagccauauucaaacuuacauaccaaaacaagguuguuagggugcaaagaccaacaccacgcggaacagucauggacauuauuagccggaaagaucaacgggguucgggccaaguagguacauauggguuaaacacuuucacgaauauggaagcucagcuaauaaggcaaauggagggagaaggaauauucaaaaguauucagagacuuacuguaacugaagagauagcaguacaaaacugguuagccaggguaggacgugaacgauugaguaggauggcaauaucuggagaugauuguguuguaaaaccuuuggacgaccgauuugcaagugcauuaacagcucucaaugauauggggaagguaagaaaagauauacagcaaugggaaccgucuagaggcuggaacgacuggacacaaguuccuuuuuguucucaucacuuccacgaauuaguaaugaaagacggaagaguacucguagugccauguaggaaccaggacgaguugaucggcagagccagaauaucucaaggcgcaggauggucacuaaaagagacugcgugcuuggggaaaagcuacgcacagauguggaccuuaauguauuuucauagacgggacuuaagauuagcagcaaacgcaaucuguucagcaguuccaucacauuggguaccuacaagucguacaacauggucaauucaugcgaaacaugaauggaugacuaccgaagauaugcuggcugucuggaaccguguguggauacaggaaaaucccuggauggaagacaaaacacccguagaaaguugggaagagguuccauaccucggcaaaagagaagaccaguggugcggaucucuaauaggacugacaagccgggcaacaugggccaaaaauauacaaacggcaauaaaucaagugagaucuuugauagguaacgaagaauauacggauuacaugccuucgaugaaaagguucagaaaagaagaagaggaagcaggaguucuaugguga

SEQ ID NO: 22604 - RNA, 9876 nt, Artificial Sequence
  derived and/or modified CDS sequence (opt6) from DENV-2__EU687238__SS-prME
accgcaggcguaauuauaaugcuaauaccaaccgcuauggcuuuucaucuaacgacgcgcaacggagaaccccauaugauuguggggagacaagaaaaaggaaaaagucuuuuguuuaaaacagaagacgggguuaauauguguaccuuaauggcaauugaucuaggggaacuaugugaagauacaauaacuuauaaauguccguuguuaagacaaaacgaacccgaagauauagauuguuggugcaauucaacaaguacauggguaacauauggaacguguacaaccacaggagaacauaggcgugagaaaagauccguugcccuugugccacacguagguaugggcuuggaaacaagaacggaaacauggaugucaagugaaggagcuuggaaacacguacaacggauagaaacguggauacuaagacaucccggguuuacaaucauggcggccauucuagcauauacuaucggaacuacccauuuccaaagagcacuaaucuuuaucuugcuuacugcaguagcgccuagcaugacaaugcgauguauuggcauaagcaauagagauuuuguagaaggugucucuggcgggucauggguggauaucguacuagaacauggcaguuguguaacaacaauggccaaaaauaaaccuacacuagauuuugaacuuaucaaaaccgaagccaaacaacccgcuacacuucgcaaauauuguauagaagcaaaauuaacuaacacuacaacagaaucaagguguccaacgcaaggggaaccaagccuaaaugaagaacaagacaaacgguucauuuguaaacauaguaugguugaucgcggaugggguaaugguuguggacuuuuuggaaaaggugguauagucacuugugcgauguuuaccugcaagaaaaauauggaggguaaaguugugcuuccagaaaauuuggaauacacaauuguaaucacuccucauucgggcgaagaacacgcaguuggcaaugacaccgggaaacaugggaaagaaauaaaaauuacaccccaaaguucgauaacugaagcagaacucacuggauauggaacaguuacuauggaauguuccccgcgaaccggacuagauuuuaacgaaaugguuuuauugcagauggaagacaaagcauggcugguucacagacaaugguuucucgaucuuccucuaccaugguuaccgggagccgauacucagggaaguaacuggauucaaaaggaaaccuuaguuaccuuuaaaaacccacacgccaaaaagcaagaugucguuguucuugguucccaggaaggcgccaugcauacagcccuaaccggcgcaacagaaauacaaaugucuagcggaaaucugcuuuuuacaggacauuuaaagugcagauugcgaauggauaaguuacaauuaaaaggcaugucauacuccauguguacaggcaaauucaaaauaguaaaagaaauagcggaaacacaacaugggacaauagugauuagagugcaauaugagggagacggaucaccaugcaagauacccuuugaaauuauggauuuagagaaacgacauguauugggucgauuaauaacgguaaacccuaucgucacggaaaaagauucgcccguaaauauugaagcugaaccacccuuuggcgacagcuacauaauuauuggcguugagcccggacaauuaaaacugaacugguuuaagaaaggcucaucaaucgggcaaauguuugaaacgacgaugagaggugcuaaaagaauggcaauucuuggugauacagcaugggauuuuggaucgcuagguggaguuuuuacuucaauaggaaaagcucugcaucaaguguuuggggcaauauauggugcugccuucuccggaguaagcuggacuaugaaaauacuaauagggguuacaauaaccuggauaggcaugaacaguagaagcacuucccuuagcgucagcuuaguucuuguaggaguuguuacucuauaucugggagucaugguucaggcagauacaggauguguagugaguuggaaaaauaaggaguugaaaugugggagugguauuuucauaacagacaauguccacaccuggacagagcaauauaaguuccagccugagucaccaucaaaguuggcgucugcuauccagaaagcccaugaagaagggauauguggaauaaggucuguaacucgauuagaaaacuuaauguggaaacaaauuacccccgaguugaaucauauacuaucagagaacgaaguaaaguugacaauuaugacgggagauauaaaaggcauaaugcaagcgggaaaaagaagccuaaggccucaaccaacugagcuaaaauauaguuggaaaaccuggggcaaagcaaaaauguuaaguacagagucccauaaucagacguuccugaucgaugguccagaaacugcugagugcccaaacacuaauagagcuuggaacucauuggagguagaggacuacggauuugggguauucaguacuaauauuugguugaaauuaagagaaaaacaagauguuuucugugacuccaaacugaugagcgcagcaauaaaggacaaccgugcuguacaugccgauaugggcuauuggauugaaagcgcuuuaaaugauacuuggaaaauggaaaaagcgaguuuuauagaaauuaaaaguugucacuggccgaagucacauacgcucugguccaacgggguucuggaaucugaaaugauaauucccaagaacuuugcgggacccgucucacaacauaacuaccgccccggauaccacacucaaacagccgggccguggcauuugggcaaauuagaaauggacuuugauuucugcgagggaacaacgguaguugucaccgaagacugcgguaauagaggaccaucuuugagaacaaccacagccagcgguaaacuaauaacggaauggugcugcagauccuguacucuuccaccacuaagauaccgaggugaagauggcuguugguacggcauggaaauacgaccauuaaaagaaaaggaggagaaccucguaaauucauugguuacagcuggccauggucagauagauaacuuuagccuaggagugcuaggcauggccuuauuuuuagaagaaauguugaggacgagggucggaacaaaacaugcaauucuuuuaguagcagucagcuucgugacuuuaauaacugguaacauguccuuucgggaucuaggucgagucaugguaaugguaggagcaaccaugacagacgacaucggaaugggagucacuuaucuagcccuucuugcggcguuuaaagugagaccuacauucgcagcuggacuguuacugcgcaaguugacgaguaaggaauuaaugauggcaacuauagguauagcucuauuaagccaaucaacaauucccgaaacaauuuuggaacucacagacgcauuagcucuagggaugauggucuugaaaauaguaagaaauauggagaaauaccaacucgccguaacuauuauggcaauuucaugugucccaaacgcuguaauucuucaaaaugcuuggaaagucucauguaccauccuagcagcgguaucagugagcccguuguuacuuacgagcucucaacagaaagcagacuggauaccccuugcucugaccaucaaaggacuaaauccuacggcgauauuucugacaacucuuucgagaacuagcaagaaaagaucauggccacucaaugaagccgucauggcugucgggauggucucuaucuuagcaaguucucuccucaaaaaugacauaccaaugacggguccccuaguagcuggaggacuucuaacaguaugcuauguuuuaacuggacggagugcugacuuagaauuagaaagagcagccgauguaaagugggaggaccaggcggaaaucucaggaucguccccgauacuuaguauaacaauuagcgaggacggauccauguccaucaaaaacgaagaagaggaacauacauuaaccauuuuaauucgaacgggauuguuagucaucucggguguauuuccugucucaauccccauaacagcagccgcuugguaucuuugggaggucaagaaacaacgagcaggaguacuuugggauguaccaucaccaccacccguugguaaggcugaacuugaggacggagcauauaggauuaaacagcgagguauauucggauauucucaaauuggugcaggaguguacaaagaaggcacauuccauacuauguggcacguuacaagaggggcagugcuaaugcaccggggcaaaagaaucgaaccaucaugggcugauguaaagaaagaucuaauuucauaugguggaggauggaaauuagagggcgaguggaaagagggugaagaaguacaagucuuggcacuagaaccagguaagaaucccagagcaguacaaaccaaacccggauuguuuaaaaccaauacaggcacuauaggcgcaguuagccucgacuucucuccgggaaccaguggaucccccauuguugaucggaagggaaaagucgucggauuauacggaaauggugugguaacucgcucgggugcguaugucagcgccauagcacaaacugaaaaaucgaucgaggacaaucccgaaauugaagaugacauauucagaaagaaaagauugacuaucauggacuuacauccaggcgcgggcaaaacaaaaagauaucucccagcaauagucagagaagcgauaaaaagaggauugcguacuuuaauacuggccccaaccagaguaguugcugcagaaauggaagaagcauuacgaggcuugccuauaagauaucaaacaccagcaauaagagccgaacauacaggccgugaaauaguugaccuaaugugucacgccacguuuacaaugagauuacuuucgccgguucgaguuccaaauuacaaucuuauaauaauggaugaagcacauuuuacagacccagcaucgauagccgcacgaggauauauaucaacuagaguugaaaugggagaagcagccggaauauucaugacugcaaccccgccugggucaagggacccauuuccucaaucuaaugcuccaauuauggacgaggaaagagaaauacccgaaagaagcuggaacaguggacaugaaugggucacagauuucaaggguaaaaccguuugguuuguaccaagcauaaaagcugguaaugauauagcagcgugccucaggaaaaacgguaagaagguaauacagcucagccggaaaacauucgauagugaguauguuaaaacaagggcaaaugacugggauuuuguugucacaacggacauaucagaaaugggugcaaacuuucgcgcggagaggguaaucgacccgcgcagauguaugaaaccugucauucuuaccgauggugaggagcgaguaauacuugcaggcccaaugccgguaacacauucgucagccgcccaacgaagaggaagaauaggaagaaauccaaagaaugagaaugaucaguacauauacaugggcgaaccuuuagaaaaugaugaagacugcgcacauuggaaagaagccaaaauguuguuagauaauauaaacacgccugagggaauaauaccaucaauguucgaaccugaacgagagaaaguggaugcaauagauggugaauacaggcuacgaggugaagcucguaaaacguuuguagaccugaugagaagaggagaccucccgguuuggcuagcauauagagucgcagcagaaggcauuaacuaugcugauagaagauggugcuuugacgguaucaaaaauaaucaaauauuggaagagaauguagaggucgagaucuggacuaaggagggagaacguaagaaauuaaaaccacgauggcuagaugcuaggauauauagugauccuuuagcucugaaagaauuuaaagaguucgcagccggaagaaaaucacuaacacucaacuuaauaacggaaauggguagacuuccuacauuuaugacacaaaaagccagggacgcguuggauaauuuagcaguuuuacauacagcggaagugggaggacgagcauacaaccaugcgcuuagugagcucccagaaaccuuggagacuuuacuauuauuaaccuuacuagcaacagucacaggugggauuuuucuguucuugaugucagggaaagguauagggaagaugacgcuaggaaugugcugcauuauuaccgcaucaaucuuauuaugguaugcacagauacaaccacacuggauagcugcaaguauaauccuugaguucuuuuuaauuguucuccugauaccagaaccagaaaaacaaagaaccccucaggauaaccaacuuaccuauguaguaauagcaauucuaacagucguugcagccaccauggcaaaugagaugggcuuccuagagaaaacuaagaaagaucugggacuuggcucuaucacaacccaagaaagugaaucaaauauucuagauauugauuuacgcccugcaagugcauggacccucuacgcggucgcuacaacuuuuguaaccccuauguuacgccauucuaucgaaaauucaucgguaaaugugagucuuacugcaauagcaaaccaagcuacaguauuaauggggcuaggacguggguggccauugucuaagauggacauaggcgucccauugcuagcgauagguugcuacagccaaguaaacccaauaacacugacggcagcgcuguuacuacuuguugcccacuacgcuauaauagguccugguuuacaggccaaagcaacaagagaggcucagaaaagaacugcagcuggaaucaugaaaaauccuacuguugaugggauuacagugaucgaccuagagccaauaccauaugauccuaaauucgagaaacaacucggucaaguuauguugcucguucuuuguguuacacaagugcugaugaugcggacaacaugggcauuaugugaagcgcuaacgcuugcaaccgggccaauuucaacguugugggaagguaauccagggagauuuuggaacacaacuauugcggugucaauggcaaacauauucaggggaagcuaucucgccggggcuggacuguuauucucaauuaugaagaacaccaccaacacuagacgcggcacaggaaauauuggugaaacccuaggugagaaguggaaaucgcgauuaaaugcuuuaggaaagucggaguuccaaauauacaaaaagucuggaauacaagaaguugaccggacgcuugccaaggaaggaauuaaacguggggaaacggaccaccacgcaguuaguagagguucagcaaaacucaggugguucguugaaaggaauaugguaacuccagaaggcaagguugucgacuugggcuguggaagaggaggcuggaguuacuauuguggaggcuuaaagaaugugagagaaguaaagggacuuaccaaggguggcccuggucaugaagaaccaauaccaaugagcacguacggguggaaucuuguuagguuacaguccggaguagauguauucuucacacccccugaaaaaugugauacguuauuaugcgacauaggggagaguagucccaauccaacaauagaagccggaaggacacuaagggucuuaaaucuugucgagaauuggcuuaauaacaauacccaauucugcgucaagguacuaaauccauacaugccauccguuauagaaaagauggaaacauuacagagaaaguauggcggcgccuugguuagaaauccgcuuagcagaaacucaacacaugaaauguauuggguuucuaaugcgacaggaaauauaguaaguaguguuaauaugaucuccagaaugcugauaaaccgcuucacaaugaaacacaagaaagcgaccuaugaaccugaugucgaccuggggucugguacccgaaauaucggaauagagaacgaaaucccaaaucucgauauuauaggaaaaagaauagaaaagauuaaacaagagcacgaaacaaguuggcacuaugaccaagaccacccauacaaaacaugggcguaccacggaaguuacgagacaaaacaaacggggucagccucuucaaugguaaacggaguagugaaauuguuaacuaaacccugggaugucguucccaugguuacccagauggcuaugaccgauacaacuccauuuggucaacagcguguauuuaaggaaaaaguggacacucgaacacaagaaccaaaggaaggaaccaagaaauugaugagaauaacugccgaaugguuauggaaagaacucggcaagaagaaaacaccacguaugugcacaagagaagaguucaccaggaaggugcguucuaacgcagcacuaggagcaauuuuuacugacgaaaauaaguggaagucagcuagagaggcaguggaggauucacgauucugggaguuaguagaucgagaaaggaaccuacaucucgaagguaagugcgaaacuuguguauauaacaugaugggcaaaagagagaagaaauuaggggaguucggaaaagcaaaaggcuccagagcaauuugguauauguggcuaggagcaagauuccuagaguucgaggcccuggguuuucuaaaugaggaucacugguucucucgaggaaauucccuaucgggcguggagggcgaaggauuacauaaguuggguuauauuuugcgagauguuucaaagaaagagggcggcgcuauguaugcggacgauacggccgggugggacaccagaauaacacuugaagaccucaaaaaugaagaaaugguuaccaaucacaugaaaggcgaacacaagaaacuggcagaggccauauucaaacugacauaucaaaauaaaguuguuagaguacaacguccaacaccuagggggacuguaauggacauaaucuccagaaaggaucaacgaggaucaggccaagucggcacauacggacuuaacacauucacaaauauggaagcacaauugauuagacagauggagggcgaggguauauucaaaaguauccaaagauuaacaguaaccgaggagauagcaguccaaaauugguuggcuaggguagggcgagaacgauugucccgcauggcuauuucaggggaugacugcguaguaaaaccguuagaugaucguuuugcuucugcauuaacagcacugaaugauaugggcaaaguaagaaaagauauacagcaaugggaaccgagccgugguuggaaugauuggacccagguaccauuuuguucucaccacuuccaugagcuaguuaugaaggacggccguguccuaguagugccaugucggaaucaagaugaguuaaucgguagggcacgaauaucccaaggagcaggauggucuuuaaaggaaacugcaugucuuggaaaaaguuacgcgcagauguggacauuaauguauuuucaccgaagagaucuacggcuugcagcaaaugcaauuuguagugcaguaccaagucauuggguuccaacaagucgaacaacguggaguauucaugcaaaacacgaauggaugaccaccgaagacauguuagcaguauggaacaggguauggauacaagaaaacccuuggauggaagacaagaccccaguggaaaguugggaagaaguccccuaccuggguaaacgugaagaccaauggugugguagucuaauaggauuaacuucucgggcaacaugggcgaaaaauauacaaaccgcuauaaaucaaguacgcucauugauaggaaaugaagaguauacagacuacaugccaucaaugaaacguuuccgaaaggaagaagaagaagcggggguauuaugguaa

SEQ ID NO: 22605 - RNA, 9876 nt, Artificial Sequence
  derived and/or modified CDS sequence (opt6) from DENV-2__EU687240__SS-prME
acuguuggaguaauaauaauguugaucccaacagccauggcuuuucaccuaacuacuagaaacggagaaccucauaugauaguaggaagacaagaaaagggcaagucacugcuuuucaaaacagaggauggagucaacauguguacacuuauggcuauugacuuaggggaacuaugugaagauacgauaacauauaaguguccuuuauuaagacaaaaugaaccagaagauauugacugcuggugcaauucaacaucgacguggguaacauaugguacuuguacuacaacuggagaacauagaagagagaaacgaagcgucgcauuggugccacauguaggaaugggacucgaaacaaggacugaaacuuggaugucuagcgaaggagcauggaaacacgugcaaagaauugaaacuuggauuuugagacauccaggauuuaccaucauggcagccauucuggcuuauacuauagguacuacacauuuccaacgugcauuaauuuuuauauuacugacggccguagcaccauccaugacaaugcgauguauuggaaucaguaaucgugacuucguggagggugucucaggugguucuuggguugacauuguacuagagcaugguuccuguguaacuaccauggcaaaaaacaagccaacacuagauuuugaacuaauaaaaacugaagcaaaacagcccgcuacuuuacgcaaauacugcauagaggcgaaauuaacaaauacaacuacggaaagucguugcccaacucaaggagagccuagucucaaugaggaacaagacaagcgauuuauaugcaagcauucuaugguagauagagguugggggaaugguugcggucuauucggaaaaggggggauuguaacaugcgcaauguucacaugcaagaaaaacauggaggggaaaguuguguugcccgaaaaccuagaauacacaauaguuauaacuccgcauaguggagaggaacacgcaguaggcaaugauacggggaaacaugggaaagaaauuaaaauaacaccccaaucgaguauaacggaagcggagcuaaccggcuacggaacagucacaauggaguguuccccuagaacaggacuagauuuuaacgagaugguucuacuccaaauggaggauaaagccuggcuugugcacagacaaugguuucuagaucuaccacuaccuuggcuuccaggagcagauacacaagguuccaauuggauacaaaaggagacccuagugacauuuaagaauccacaugcaaaaaaacaggacgucguaguauuaggaagucaagaaggagcuaugcauacagcgcuuaccggggcuacggagauacaaauguccagugguaauuuacuguucacuggucaccucaaaugucgccuaaggauggauaagcuucaauuaaaggggaugagcuacucgauguguacaggcaaguuuaagauaguaaaagaaaucgcggaaacccaacaugggacuauagucaucaggguccaauaugaaggcgacggcucuccauguaagaucccuuucgaaaucauggaccuagaaaaaagacacguauuaggucgacuaauaacgguaaacccuauaguaacggaaaaagauaguccgguuaacaucgaggcggagcccccuuuuggggacagcuacaucauuauaggaguagaaccaggacagcucaaguuaaauugguuuaaaaaagggucgucgauuggacaaauguucgaaacaacaaugagaggagccaagcgcauggcuauacuaggugacacggcgugggauuucgggaguuugggaggggucuuuacgucgauagguaaagcacuacaucagguauuuggcgcuaucuauggggcagcuuuuucaggggugaguuggaccaugaagauacuuauuggaguuauaauuacuuggauagguaugaauucaaggucaacaucuuuaucaguaagccuuguacuuguaggaguagugacgcucuauuuagguguaauggugcaagcagauagugguugcguaguuucuuggaaaaauaaagaauuaaagugcggauccgguauauuuauaacugacaacguacauaccuggacagaacaguauaaauuccaacccgaaaguccgagcaaauuagccagugcgauacaaaaagcccaugaggaagguauaugcgggaucagauccgucacacguuuagaaaaucuuauguggaaacagauuacuccagaauuaaaucauauucuaagugagaacgaagcaaaauugacuauuaugacaggugauaucaaaggaaucaugcaagcaggaaaaagaucauugcgcccccaaccaacagaauuaaaauauagcuggaaaacguggggaaaggcgaaaaugcucuccacugaaagucacaaccaaacguuucuaaucgauggacccgaaaccgcagagugucccaauaccaauagagccuggaacucgcuggagguugaagauuacggguucggaguauuuucaacuaauaucuggcucaaacuacgugaaaaacaggacguuuucugcgacucaaagcucaugucagcggcaauaaaagacaauagagccguacacgcugauauggguuauuggauagagagcgcccuuaacgauacauggaaaauggaaaaagcuucuuuuauagaaauaaaaucuugucauuggccuaaaucucauacauuauggucuaacggcgugcuagaaucugaaaugauaaucccaaaaaacuuugcaggcccaguuagucaacacaacuaccgaccgggcuaccacacacagaccgcgggaccuuggcacuuggggaaauuagaaauggacuucgauuucugcgaaggaacgacaguaguaguaacagaggauuguggaaacagaggacccagucuuagaacuacaacagcuucugguaaacuuaucaccgaauggugcugucgaaguugcacacuaccuccacuacguuacagaggugaagacggcugcugguacggaauggaaaucagaccauuaaaagaaaaggaagaaaauuuagucaauagucucguaacggcaggacauggccaaauugacaauuucucacuagguguacugggaauggcacuuuuccucgaggaaaugcuccguacgcguguaggcacuaagcacgcaauacuuuuaguugcagucucauucgugacuuugauaaccgggaauaugucguuuagggaucuagguagagucauggugaugguaggagcaacaaugacagaugauauaggcauggguguaacauauuuagcuuuacuugcagcauuuaaaguacgccccacguuugcugccggacugcuacucagaaaguuaacauccaaggaguuaaugauggcgacaauuggaaucgcucuauuaagucaaaguacaauaccugaaacgauucucgaauuaacagaugcacuagcacuaggaaugaugguacugaagaucguaaggaauauggaaaaauaccaauuagcaguaacuauaauggcaauaaguuguguacccaaugcaguaauacuacagaacgcguggaaaguuaguugcacuauucucgcagcaguuuccguuuccccccuguuauugaccuccagucagcaaaaggcggacuggauaccucuugcgcugacgauuaaaggccuuaacccaacagcaauuuucuugacaacacuaucgcgaacuagcaaaaagcgaagcuggcccuuaaacgaagcaguaauggcaguugggaugguaaguauuuuagcuucaaguuugcucaaaaaugauaucccaaugaccggaccuuuagucgcaggcggccuauuaaccguuugcuacgucuugacugguagaucggcagacuuggaacuugaaagagcagccgacgucaaaugggaagaccaagcggaaauaucaggaucaucuccaauacuaagcauaacaaucucggaagaugguaguaugaguauaaaaaaugaagaagaagaacauacgcuuacaauuuuaauaagaaccggauuauuaguaauaagcgguguguuuccaguaucgauuccaauaacagcugcagcuugguauuuaugggaagucaaaaagcaacgagccggaguacuaugggauguucccagcccccccccuguaggaaaagcagaauuagaggacggcgccuaucguauuaaacagcgaggcauuuucggauauucccaaaucggugcaggcguauauaaagaagguacuuuucauacgauguggcauguuacacgaggcgccguucugaugcaccggggaaaaaggauugaaccuucuugggcggacguuaaaaaggaucuuauaucauaugggggcggauggaaauuagaaggagaauggaaggagggcgaagaagugcaaguacuagcacuagagccggggaaaaauccucgggcaguacaaaccaagccgggucucuuuaaaacaaauaccgguacaauaggagcuguuaguuuagauuucuccccuggaacuucgggaucgccuauaguagauaggaaaggaaaaguaguaggccucuacgguaauggagugguuacgagaucaggagccuauguauccgcaauagcgcaaacggaaaaauccauagaagacaauccugagaucgaagacgauauauuuagaaagaaacgacugacaaucauggauuuacauccuggcgcugggaaaaccaaacgcuauuuaccagcaauaguuagagaagcaauuaagagagggcugagaacauugauccuagcaccuacaagagucguggcagcagaaauggaagaagcguuacgcggacuaccgauaagauaucagacucccgccauaagggcagaacauacuggaagagagauaguagaccucaugugccaugcaacuuucacuaugcgauuauugucaccagugcguguuccuaacuauaaccuaauuauuauggaugaagcacauuuuacggacccagcaucuauagcugcucgcggauacauaucgacaagaguggaaaugggcgaggccgccgguauauucaugacggcaacccccccaggaaguagagauccuuuuccucagucaaaugcaccuauuauggaugaagaaagggaaaucccugaacgaucauggaauucaggacaugaaugggucaccgauuucaagggcaaaacggugugguuuguuccuuccaucaaggcugguaaugauaucgcagcuugucuucgaaaaaacggcaagaagguuauacaauuaucaagaaaaacuuucgauagugaguacguaaagacucgggcgaacgauugggauuuuguuguaacuacggauauaucggaaaugggugcaaacuuucgugcagaacgagugauagauccgagaagaugcaugaaacccguaauauuaacugauggagaagaacgaguuauauuagcaggaccaaugccagucacccacaguagugcagcacagcggagaggacgaauaggacgaaauccaaaaaacgaaaacgaucaauauaucuauaugggggagccuuuggaaaaugaugaggauugugcgcauuggaaggaagccaagauguuauuagauaacauaaauaccccagaagguauaauuccuuccauguuugagccagaaagagaaaaaguagaugcaauagacggggaauauaggcuacgcggcgaagcacgcaaaacauuuguugaucuuaugaggcgcggagaucuaccaguauggcuggcuuaucgcguagccgcagaagggaucaacuaugcagaccguagaugguguuuugaugguauuaagaacaaucaaauacuagaggaaaacguagaaguugaaauauggacgaaagaaggcgaacgcaagaaacuaaagccaagguggcucgacgcacguauauauagcgacccacuagcuuugaaggaauuuaaagaauucgcagcagggaggaagucccuaacguugaaucuaauuacugaaaugggaagacuaccuacauucaugacacaaaaagccagagacgcacuagauaauuuagcaguucuacacacggccgaaguagggggaagagcuuacaaccaugcgcuuuccgaauuaccugaaacgcuagagacacuauuacuacuaacacuacuugccacaguuaccggagguaucuuccuguuccuuaugagugguaagggaauagguaaaaugacgcuaggaaugugcuguauaauuacagcgucuauauuacuaugguacgcucaaauacagccacauuggauagcugcgaguauuauacuagaguucuuccuuauaguauuacucaucccugagccggaaaaacaaaggacuccucaagacaaccaauuaacguauguggucaucgcuauucuuacuguaguagccgcaacaauggccaaugaaauggguuuuuuggaaaagaccaaaaaagacuuaggcuuaggcaguaucacuacucaagaaagcgaaagcaacauacuagacaucgauuugcguccagcauccgcauggacucuguaugcgguagcuacaacauuugucacuccaauguugagacauagcauagaaaauaguucaguaaacguuagcuuaacagccauagcaaaccaggcaacgguucucaugggcuuagggagaggauggccacuuucuaaaauggacauugguguaccgcuccucgccauuggcugcuauucgcaaguuaacccgaucacucuaacagccgcguuauuauuacuaguagcccauuacgcuauuauaggaccgggccuucaggcgaaagcuacaagagaggcucagaagagaacagcagcaggcauuaugaagaaccccacaguagauggaaucacagucauugaccucgaacccaucccauacgacccuaaauuugaaaaacaacuuggucagguaaugcuacuuguacuauguguuacgcaagucuuaaugaugagaaccacuugggcacucugcgaagcuuuaacauuagcaacugggccgauauccacauugugggaagggaaucccggcagauuuuggaacaccacuauugccguaucuauggcaaacauauuccgaggauccuauuuggcaggagccggucuucuauucucaauuaugaagaacacgacuaauaccaggcgcgguacgggaaacauaggugaaacuuugggagaaaaauggaaaucuagguuaaaugcacuaggaaagucugaauuccaaauauacaagaaaucaggcauucaagagguugaccggacuuuagcaaaagaagguauuaaacgcggagagaccgaccaccaugccguuagccgcgguucugcuaaacugagaugguuuguagaacgcaauaugguaacccccgaagguaaagugguagauuuagggugugguagagguggguggucauauuauuguggcggauuaaaaaacguaagagaagucaaaggacuaacgaaagguggcccugggcaugaagaacccauuccaaugucuaccuaugguuggaacuuaguucgccuacaaucagguguagauguauuuuucacuccuccugaaaaaugcgauacacugcuaugugauauaggugaaaguucuccuaauccaacuauugaggccgggcguacacuuaggguacugaaccucguugaaaauuggcuaaauaauaauacccaguucuguauaaaaguucuuaacccauauaugccgaguguaauagaaaagauggaaacacuacaacgaaaauauggaggagcccugguaaggaauccuuugagcagaaauucaacacaugagauguauugggugucuaaugcgacggguaauauagucucuagcgucaauaugaucaguagaaugcucauuaacagguucacaaugaaacacaaaaaagcgacuuaugaaccagacguagauuuaggaucgggaaccagaaacaucgguauagaaaacgaaauaccaaaucucgacauuaucgggaagagaauagaaaagauaaagcaagaacacgagaccucauggcauuacgaucaagaucacccauacaagacaugggcauaucacgggagcuaugagacaaaacaaaccgguagugcaucaucuaugguuaauggcguugugaaacuccuaacgaaaccaugggauguugucccgaugguuacccaaauggcaaugacagauacaacaccguucggacaacagagggucuuuaaagaaaaaguggacacgagaacgcaagaaccuaaggagggcacaaagaaauugaugagaauaacagccgagugguuauggaaggaguuaggcaaaaaaaagacgccgaggauguguacaagagaggaauucacaagaaaaguucgcagcaacgcugcacuaggagcuaucuuuaccgacgagaauaaguggaaaagcgcacgugaggcuguugaagauagccgauuuugggaauuaguagaucgcgaaaggaaucuucacuuagaagggaaaugugaaacaugcgucuauaauaugauggguaaacgugaaaaaaaauugggugaguucggcaaagcuaagggaagccgagcgauaugguacauguggcuuggagcccguuuucuagaauuugaagccuugggcuuccuaaaugaagaccauugguuuucgcgagguaacucgcuaagcgguguagaaggggagggguuacauaagcuugguuauaucuuacgggaugugucaaagaaagaagggggggcuauguacgcagacgauacagcugggugggauacuagaauuacauuagaagaccuuaagaacgaagaaaugguuacaaaucauaugaagggugaacauaaaaagcuugcggaagcgaucuuuaaguuaaccuaccagaacaaagucgugcgagugcaaagaccaacaccgcgugguaccguaauggauaucauaaguagaaaagaccaaagaggcagcggucaaguaggaacauacggucuaaacaccuucacaaauauggaagcccaauuaauucggcaaauggaaggggaaggaauuuuuaagaguauacaaagguugaccgugaccgaagaaauagcugugcagaauugguuagcucgaguaggccgcgaacgacuuucgagaauggcaauaucuggcgacgacuguguugugaaaccacuagacgaucgauuugcaucggcacucacagcacuuaaugauauggggaaaguaaggaaagauauccaacaaugggaaccaagucgaggguggaaugauuggacgcaggucccauuuugcucucaucauuuucacgaauugguaaugaaagauggacgcgucuuaguugucccaugucggaaccaggaugaacugauaggccgugcaagaaucucccaaggcgcgggauggagcuuaaaggaaaccgcuuguuuaggaaagucauacgcacaaauguggacacucauguacuuucaucgaagagacuuaagacuagcugcgaacgcuauauguagcgccguaccuucacacuggguaccaacaucuaggacaacauggucaauucaugccaagcacgaguggaugacuacagaagacaugcuugcaguauggaaucguguauggauacaagaaaauccuuggauggaggauaagacaccuguugaaucuugggaagaaguuccauauuuaggaaaaagagaagaccaauggugcggaagccuaauaggacugacaucuagggcgacaugggccaaaaacauacaaacagcaauuaaccaaguuaggucuuuaauugguaacgaggaauacaccgauuauaugccaucaaugaaaagauuccgcaaagaagaggaagaagcgggaguauuaugguaa

SEQ ID NO: 22606 - RNA, 9876 nt, Artificial Sequence
  derived and/or modified CDS sequence (opt6) from DENV-2__EU687241__SS-prME
acagcgggaguuauaauuaugcucauuccaacagcaauggcauuucaccucacaacucgaaauggggaaccacacaugaucgugggcagacaggaaaaagguaaaagucuuuuguuuaaaacggaagauggaguaaauaugugcacauuaauggcaauagacuuaggagagcuuugcgaagauacaauaacuuacaaauguccacuauuacgacaaaaugaaccagaggauaucgauugcugguguaauagcacaagcacauggguuacauauggaacaugcacaacaacaggugaacacagacgggaaaaacgaucaguagcauuaguuccacacguagggaugggauuggaaacgagaaccgaaacauggauguccucagagggagcguggaaacacguacaaagaaucgaaacguggauuuuacgacaucccggguuuacuauaauggcagcgauauuagcauacucaauagggacuacacauuuucaaagggcacuaauuuuuauacuacugacagcaguagcuccaagcaugacuaugcggugcauuggaaucucuaaucgagacuuuguagaaggcguaagcggcggcaguuggguagacauaguucucgagcacggaaguugcguuacuacaauggcgaaaaacaaaccuacuuuggacuuugaacugacaaaaacggaagcuaaacaaccugccacauuaagaaaauacuguaucgaggcuaaacucaccaacacgacaacagaaucaagaugcccaacccaaggagaacccucuuugaacgaagaacaggacaaaagguucauuuguaaacacucuaugguggaccgaggaugggggaauggaugcggauuguucggaaaaggaggaauaguaaccugugccauguuuacauguaagaaaaauauggaaggaaaagugguguuaccagaaaaccuugaguacacaaucgugauaacaccacauagcggugaagaacacgccgugggcaacgauacaggcaaacacgguaaagaaaucaaaauaacaccacaguccaguauaacugaggcagaacuaacaggauauggaacaguaacuauggaauguaguccaagaacgggccuggauuucaacgaaaugguauuacugcaaauggaggacaaagcauggcuaguacaucgucagugguuccuggaucucccccucccauggcucccaggugccgauacacaaggaucaaauuggauucagaaagaaacauuaguaacauucaaaaacccacaugccaagaaacaggacguagugguucuuggcucgcaagagggagcaaugcauacagcuuuaacaggugcaaccgaaauacaaaugucaagcggaaaucuuuuauucacaggacaucuaaaauguagacuaaggauggauaagcuacaauugaagggcaugaguuauucuaugugcacaggcaaguuuaagauaguuaaagaaauugcggaaacccaacacgggacuauugucauacgaguucaauaugagggggacggaucuccauguaagaucccuuuugaaaucauggaucucgagaagcgccauguccuuggacgucuaauaaccguaaauccaauaguaacggaaaaagauucuccugucaauauagaagccgaaccaccuuucggugacucguacauaaucauaggaguugagccaggucaacuaaagcugaacugguucaagaaaggcucaucaauuggacaaauguucgaaacgaccaugagaggcgcuaaaagaauggcaauucuuggcgacacagcuugggauuucggaagccucggcggaguuuuuacaucaaucggaaaggcuuuacaccaaguuuucggggcuauuuauggagcagcguuuuccgguguaucuuggacuaugaagauucuuauugguguaauaauuacauggauaggaaugaacuccaggagcaccagcuuaucaguaagucuuguauuaguugguguaguaacuuuauaucucggaguuaugguucaagcugauacaggcuguguggugaguuggaaaaauaaggaacuuaaguguggaucagguauauuuaucacggauaauguccacacuuggaccgaacaauauaaauuccaacccgaaaguccguccaaacuggcgagugccauacagaaagcgcacgaagaaggaaucugcgggauucgcuccgugacuagguuagagaauuuaauguggaaacaaauuacgcccgagcugaaccacauacugucagagaaugagguaaagcuaacgauaaugaccggagauauaaagggcauuaugcaggcuggaaaacguucucuacguccucagccgacugaacuuaaauauaguuggaagacaugggggaaagcaaagauguugagcacugaaagccacaaucaaaccuucuuaauagauggacccgaaacagcagaaugccccaauacuaacagggccuggaacucacuugaaguggaagauuacgguuuugguguauucucaaccaauaucugguuaaaauugagagaaaagcaggauguauuuugugauucgaaauuaaugagcgcagcaaucaaagacaauagagcaguacaugcugauaugggguacuggauagaauccgcccuaaacgauacauggaaaauggaaaaggcaucuuuuaucgaaauuaaaucaugucacuggccuaaaucacacacuuuguggucuaauggaguacuagagagugaaaugauuauacccaagaacuuugcaggaccagugucacagcauaauuaccggccaggcuaccauacucagacugcaggcccguggcaucuaggcaaacuggagauggauuucgauuucugcgaggguacaacuguugugguaacggaagauugcggcaaucgcgggcccucucucaggacaacgacagccagcggaaaacugauaacagaaugguguugucgcaguuguacucucccaccucuacgcuauagaggagaagaugguuguugguacggaauggaaauccgaccucucaaagagaaagaagagaauuuaguuaacuccuuaguuaccgccggucauggacaaauagauaauuuuagcuuaggaguuuuagggauggcauuauuuuuggaagagaugcuuagaacacggguaggcaccaaacaugccauauuacuugucgcaguuagcuuuguuacacucauaacaggaaauaugucuuuuagggaccugggacgcgugaugguaaugguaggagcaacaaugaccgacgauauagggaugggcgucaccuauuuagcauuguuagcugcuuucaaaguuagacccaccuuugcagccgguuugcuccuaaggaaauuaacaaguaaagaauuaaugauggcaacaaucggaauagcacuuuuaucucagagcacaauuccagaaaccauauuagaguuaaccgacgcacuugcauuaggcaugaugguguugaagauugucagaacaauggaaaaauaccagcuagcggucacaauaauggcgauaagcugcguaccuaaugcaguuauuuugcaaaaugcauggaaaguaucauguacgauccuagcggcggucucaguaaguccccuacuguuaacaagcucacaacaaaaggcagacuggauaccacuugcauugacaauuaaaggucugaaccccacagcuaucuuuuugacaacguuaucucguacaucuaagaaacgaaguuggccacucaaugaagccgucauggcugucgguauggugaguauccuggcuuccagccucuuaaagaacgauauuccaaugacggguccguuaguagcaggcggauuguugacggugugcuacguacugacuggacgaucagcagauuuagaauuagaaagagcugcagaugucaagugggaagaccaggcagaaauuaguggcucauccccaauucugaguauaacaauaucagaagacgggagcaugucgauaaagaaugaagaggaagaacauacauuaacaauacuuauacguacuggcuuguuggugauuucuggaguauucccaguaaguauuccaauuacugcagcugccugguaccucugggaagucaagaaacaacgugcaggaguucuaugggauguaccuucuccaccucccguagggaaagccgaauuggaagauggggcauauaggauaaaacaacgaggaauuuuuggauacagccagauaggagcaggaguauauaaagagggaacauuccacacaauguggcaugugacuagaggggcgguuuuaaugcaccgggguaaaagaauagaaccgucaugggcagauguuaagaaagacuuaauaucauacggaggagguuggaagcuagaaggagaauggaaagaaggggaggaaguucagguauuggcuuuagaaccgggcaaaaauccgagagccguccaaacaaaaccaggauuauuuaaaacuaacacaggcacaauaggagcaguuagcuuggauuucagccccggaacaucuggcucgccuaucgucgaucggaaaggaaaaguggucggauuauacggcaauggaguaguaacaagaucgggugcuuacguuucggcaauugcacaaacagagaaaagcauagaagacaauccagaaaucgaggaugacaucuucagaaagaaaagauuaacuaucauggaucugcauccaggagcaggcaaaacaaagcgauacuuaccggcaaucguacgcgaagccaucaaacgcgggcuacgaacccuaauacuugcgccuacccguguaguagcugcggaaauggaggaagcacuuagaggauuaccaauucgauaucaaaccccugcaauucgagcagaacauacugggagggaaauaguugaccucaugugucaugcaacauuuacuaugcggcuacuuucaccuguuagaguuccuaacuacaaucugauuauaauggacgaggcccauuucacugauccugccucuauugcggcaagaggauauauaaguacacggguugaaaugggugaggcugccggcauauucaugaccgccaccccgccagggucuagagacccauuuccucaaaguaacgcaccuauaauggacgaagaaagagaaaucccagaacguucguggaacagcggacaugagugggugacggacuuuaagggaaaaaccguaugguucgugccuucaaucaaagcaggaaaugacauagcagccuguuugaggaaaaauggcaaaaagguaauucaacuaucucgcaagacauucgauagugaguaugucaaaaccagggcgaacgacugggacuuugugguuaccacggacaucucugaaaugggggcgaacuuuagagcugaacguguaauugauccacggaggugcaugaaacccgucauauuaacugauggagaggaacguguaauacuugcaggaccuaugcccguaacacacaguucggcagcucaaaggcgagguagaauaggucgcaaucccaaaaaugagaaugaucaauacauauauaugggugagccacuagagaacgacgaagacugugcacacuggaaagaggcgaaaaugcugcuggacaacauaaauacgccugaaggaauuauccccucaauguuugaaccggaaagagagaaaguagaugcgauugauggagaauauagacuccgaggagaagcccguaagacguucguugaucucaugcgaaggggcgaccuuccagucuggcucgcguacagaguagcagcagaggguauaaacuaugcagauaggagauggugcuuugacgguauuaaaaacaaccaaaucuuagaggaaaauguagagguagagaucuggacaaaagagggugaaagaaagaaauuaaaaccuagaugguuggacgcaagaaucuauagugacccacuagcgcuaaaagaauuuaaagaauuugcagcuggacguaaaagucuuacucucaaccuaaucacagaaaugggacgacuaccuacguucaugacccaaaaagcccgagaugcucucgauaaccuagccguccuacauacugcagaaguuggcggacgagcauauaaccaugcccuguccgaacugccggaaacacuggaaacauuauuacuucucacacuucuugcaacugugacgggcggcaucuuuuuauuucuaaugucggguaaaggaauaggaaaaaugaccuugggcaugugcugcauaauuaccgccucaauauuacugugguaugcacaaauacaaccacauuggauagccgcuucaauaaucuuggaguucuuuuuaaucguacuacucauaccagaaccagaaaaacaaagaacaccacaagacaaucaauugacguauguagugauagcaauauuaaccguuguugcugcaacgauggcaaaugaaaugggcuuuuuggagaaaaccaagaaagaucuggggcuuggcucaauaacuacgcaggaaucagaaucuaacauauuggauaucgaccuucggccggcaagugcguggacguuauacgcaguagccacaacauucguuacgccaaugcuaagacacaguauugaaaauuccucaguaaaugucucacuaacggcuauagcuaaccaagccaccguacucaugggcuuaggucgugguuggccauuaaguaaaauggauauaggagugccauugcuagcaauuggauguuacucacaaguaaauccuauaacuuuaaccgcagcacuauuauuauuaguagcgcacuacgcgauuauaggaccugguuuacaagcaaaagcuacgagagaagcucaaaaacgaacugccgcaggaaucaugaaaaauccuaccguagauggaauuacagucauugaucuagaaccaauaccuuaugacccgaaauucgaaaaacagcuagggcaagugauguugcucguacuuugugucacccaaguucucaugaugagaacuacaugggccuuaugugaagcacuuacucuagcaacugggccuaucagcacucugugggaaggcaauccaggaagauucuggaacacaacaaucgccguauccauggcaaauauuuuucgaggaaguuauuuagcuggagcaggacuacuauucucuauaaugaagaacacuacuaacacuaggcggggcacugguaacauuggggaaacccugggugaaaaauggaagucgcgacuaaacgcacuagguaaaagugaauuucaaauauauaaaaagagcgguauucaggagguagauagaacauuagcgaaggaaggcauaaaaaggggugaaacagaucaccaugcagucucaaggggcucugcuaaauuaagaugguucguggagcgaaacauggugacuccagagggaaaaguaguagaccuaggauguggcagagguggcuggucuuauuauugcggcggacuaaagaauguucgagagguuaaaggacucacaaagggaggcccaggccaugaagaaccuauacccaugucuacauacgguuggaauuugguaagacugcaaagcggcguagacguguucuuuacaccaccagaaaaaugcgacacuuuauuaugugacauaggagaaucaucuccaaauccaacuauagaagccgggagaacauuaagaguguuaaacuuaguagaaaauuggcuaaacaacaacacccaauuuuguguaaagguuuuaaauccuuauaugccuaguguaauagaaaagauggaaacuuuacagcggaaauacgguggggcccuagugagaaacccgcucucacgaaauaguacacacgagauguacugggucucaaacgcgaccgguaauauaguaucuagcguaaacaugauuagucgaauguuaauaaauagauuuacaaugaaacauaagaaagcgacguaugagccagauguggaucuaggaucuggcacaagaaauauaggcaucgagaacgagauaccgaaucuugacaucauagggaagcguauugagaaaauuaaacaagaacaugaaacaucauggcacuacgaucaagaucacccauauaagacgugggcguaucacggaucuuaugaaaccaaacaaacuggaagugcauccucaauggugaauggaguagugaaauuacugaccaaaccuugggauguagugccgaugguaacacaaauggcuaugacagacacuacuccguucggacaacaacggguauuuaaagaaaaaguagacacacgaacccaagagccaaaagaagguaccaagaaauuaaugagaauaacagcugagugguuauggaaagaacucgguaaaaagaaaacaccacgaauguguacaagagaggaauuuaccagaaaaguaagaucaaaugcagcacugggagccauuuuuacagaugagaauaaauggaaaagugcuagagaggccguggaagauucacgauucugggagcuaguugaucgugaacgcaaucuccacuuggaaggaaaaugcgagacuuguguguacaacaugaugggaaaacgugagaagaaauuaggggaguuugggaaggcuaaggguuccagagcuauaugguacaugugguugggagcacgguuccuagaauuugaggcuuuaggcuuccuaaaugaagaccacugguucagucgugggaacaguuuaucaggaguugaaggggagggauuacauaaacucggauauauauuacgggaugucucaaagaaagaagguggugcuauguaugcggaugauacagcuggaugggauacacgcauaacacuggaagaucugaaaaacgaagaaaugguaacgaaucauaugaaaggagaacauaagaaacuugccgaagcaauauucaaauugacauaccaaaacaaaguaguacgagugcaaaggccuacgccaagagguacuguaauggauauuauuagcagaaaagaccaaagagguagcggucaggucguaacuuauggucucaauaccuuuaccaauauggaagcucaauugauacgucagauggaaggcgaaggaauauucaaguccauccaaagauuaacaguaacagaagagauagcgguccagaauuggcucgccagagucggacgcgaaagguuaagccguauggcuauaaguggagaugacugugucguaaagccacuagaugacagguucgcgagcgcucucacugcauuaaacgauauggggaaagugagaaaagacauacagcaaugggaaccuagucgaggauggaaugacuggacucaaguacccuuuugcucgcaucauuuucaugaauugguuaugaaagauggucggguacucguaguacccugucguaaucaagaugaauuaauaggccgagcacguauaucucagggagcaggauggagccugaaagaaacagccugucuagguaagucuuaugcgcagauguggacuuuaauguacuuucacagaagagauuuaaggcuagccgcuaaugcgauauguagugcgguucccucccacuggguuccuacaaguagaacaaccuggagcauccaugcuaaacacgaauggaugacaacagaagauauguuagcuguuuggaacagaguguggauacaagagaaccccuggauggaagacaaaacuccgguugagaguugggaagaagugccuuauuuaggaaaaagagaagaccaguggugugggucguuaaucggacuaacaucaagagcuacuugggcaaagaauauacaaaccgcuauaaaucaagugcgaucccuuauuggaaaugaagaauacacugauuauaugcccaguaugaaaagguuccgcaaagaagaggaagaggccgguguguugugguga

SEQ ID NO: 22607 - RNA, 9876 nt, Artificial Sequence
  derived and/or modified CDS sequence (opt6) from DENV-2__EU687242__SS-prME
acugcaggggugauaaucaugcuaauuccaacugcuauggcuuuccaucuuacaacaagaaauggggaaccacauaugauuguagggcggcaagaaaaagguaaaucucuuuuauuuaaaacugaagaugguguaaauauguguacccugauggcuauagaucuuggugaacuaugugaagauaccauaacauacaaauguccucuccuaagacaaaaugaaccagaagacauugauuguugguguaacucaacaucaacuugggugaccuacggaacuugcacaacaacuggugaacacagaagagaaaaacggucugucgcuuugguuccccaugucggaaugggccuagaaacucggaccgaaacauggaugaguucggaaggugcauggaaacacgugcaaagaaucgaaacauggauacuucggcauccugguuucacaauaauggcagcuauccuagcauacacuauaggaacuacacacuuucaaagagcacucauauuuauauuguuaacagcaguagcacccucaaugacuaugagauguaucggcauuagcaaccgugacuuuguugaagguguaucggguggaucuuggguggacaucguacuagaacaugggucauguguuacuacaauggcgaaaaauaaaccuacucuagauuuugaacuuaucaaaaccgaagcaaaacaaccagcaacguuacguaaauauugcauagaagcaaaauuaacaaauaccacgacugagucgagauguccgacacaaggagaaccaucgcuaaaugaagaacaagauaaacgcuuuauauguaaacauucgaugguugaccgcggauggggaaaugggugcggccuuuucgguaaaggcggaaucgugacaugugccauguucacguguaagaaaaacauggaaggcaaaguagucuugccugagaaucuugaauacacaauugucaucacgccacauucuggagaagaacaugcaguaggaaaugauacggguaaacacggcaaagaaauaaaaauaacaccacaaaguagcauuaccgaagcggaacuaacaggauacggaacaguaacgauggaaugcagcccuagaacaggauuagauuucaacgagaugguucuacugcaaauggaagacaaagcguggcucgugcauaggcaaugguuucuagacuugccacuaccguggcuaccaggugccgacacacaaggaaguaacuggauccagaaagaaacauuaguaacauucaaaaacccucaugccaagaaacaagacguagugguauuaggaucucaggaaggcgccaugcauacagcguuaacaggagcaaccgagauacaaaugucaucuggaaaucucuuauucacaggccaucuaaaaugccgccuaagaauggacaaauuacaacuaaaaggaaugucauauaguauguguacuggaaaauucaaaaucguuaaagaaauagcagaaacccaacaugggacuauaguuaucagggugcaauaugagggggaugguucaccuugcaaaauuccauuugagauaauggacuuagagaaaagacacgucuuaggcagacuaaucacagugaauccuauuguuacggagaaagacagucccguaaauauagaagcagaacccccauucggcgacucauacauuaucauuggaguagaaccuggacaacucaaacugaacugguucaaaaagggaaguagcaucggacaaauguuugaaacaacuaugagaggagcuaaacgcauggcuauauugggagacaccgcuugggacuucgguucauuaggcgguguguucaccagcauaggaaaagcauuacaccaaguguuuggcgcuauauauggcgcagcuuuuaguggcgucaguuggacgaugaaaaucuugauuggcguaauaauaaccuggauaggaaugaacucucgaucaacguccuuaaguguaagccuaguuuuaguagguguugucacguuguaccuaggaguaaugguacaagcagauacaggauguguagucucauggaaaaauaaagaauuaaaguguggaagcggaaucuucauaacagacaauguucacacguggacugaacaauacaaauuccagcccgaaucuccgucaaaguuagcauccgcuauccaaaaggcacaugaagaaggcauuugcggaaucagaucugucacaagguuagaaaaucuuauguggaaacagauuacuccagaauuaaaucauauacugagugaaaacgagguuaaauuaacuauuaugacgggagauauaagaggaaucaugcaggcgggaaagagaagccuccgaccucaaccuaccgaacuuaaguauucauggaagacuuggggcaaagccaaaauguuaagcacagaaucccacaaucagacauuucuuaucgacgguccagagacugcagaauguccaaauacuaauagagccuggaacucacucgaaguugaagacuaugguuuuggaguauuuuccacaaacauuuggcuaaaauuacgagaaaagcaagacguauucugcgauucuaaauugaugucagcagcuaucaaagacaaccgggcaguccaugcagauaugggauauuggauugaaagugcacugaaugauaccuggaagauggaaaaagcaucauuuaucgaaauaaaaucuugcuacuggccgaagagucauacuuuauggucaaauggaguucuagaaagcgaaaugauuauccccaaaaauuuugcagggccaguaagucagcauaauuacagaccugguuaccauacucaaacugcggguccauggcacuugggcaaauuagaaauggauuuugacuuuugugaaggaacaacuguuguuguaacagaagacugcgguaacagaggaccaagucugagaacaacuaccgccaguggaaaacuaaucacagagugguguugucgaucaugcacuuuaccuccguuacgauauagaggugaagauggaugcugguacggaauggaaauucguccguuaaaagaaaaagaagagaaucucguaaauucauuagugacugcuggucauggccaaauugauaacuuuucguuggguguccuaggaauggcucuauuuuuggaagaaaugcuacgaacgcgugucgguacaaaacaugcuauucuguuaguagccguuuccuuugugacccuuauuacaggaaauaugaguuuucgugaucucggcagagucaugguuauggugggugcaacaaugacugaugauaucgguaugggcguaacauaccuugcacuuuuagcugcuuuuaaaguaagaccgaccuucgcagcaggacuucuccucaggaaauuaacuucuaaagaacucaugauggcgacgaucggcauagcuuuacuaagccaguccacuauacccgaaacaauccuagaauuaacagaugcguuggcucucggaaugaugguauuaaaaaucgucagaaacauggaaaaauaccaacuggccguaacaauuauggcgauaaguugugugccgaaugcaguaauacugcaaaacgcauggaagguuucguguacaauuuuagcugccguauccguaucuccacuucuauuaacaaguagccaacaaaaagccgauuggaucccgcuagcccuaacaauaaaaggacuaaauccuacugcgauauuuuuaacaacuuugucccgcacgucuaagaaaagaucauggccgcuuaacgaggcgguuauggcugugggcauggucucaauuuuggcauccuccuuguugaaaaaugacauuccuaugacuggaccccuaguugcuggaggacugcuuacaguaugcuauguacucacgggacguucagcagaucuagaacuugaacgugcugcagauguaaagugggaagaucaggcagaaauaagcggaaguucgccaauucucaguauuacuauuuccgaagauggaucaaugaguaucaaaaaugaagaagaagaacauacuuugacgauucucauucgcacuggucuauuaguuauaaguggaguuuuuccuguuucaauaccaauuaccgccgcugcuugguacuuaugggaaguaaagaaacaaagagcgggaguauuaugggacguucccuccccgccaccaguugggaaagcugaacucgaagauggugcguauagaauaaaacaaagagguauauucggauauagccagauaggugcaggaguauacaaagaaggaacguuucauacaauguggcaugugacaagaggcgcaguccugaugcaucgcgggaaaagaauugaaccgaguugggccgaugucaagaaagaucuaauuucguaugguggcggauggaaacuagaaggugaauggaaagagggagaagaaguucaaguucuugcgcuggaaccagguaaaaaucccagagcgguccagaccaagccuggacuauuuaaaaccaauacaggaacaaucggagcaguuucauuagauuuuucaccugggacaucugggucaccaauuguagauagaaaagguaaagugguagguuuguaugggaauggagucguaacgcggagcggugcauauguuagugcaauagcacaaacagaaaaaucuaucgaagauaacccugaaaucgaagaugauaucuucaggaagaaacgauuaacuauaauggauuuacacccuggagcuggaaagacgaagagauaccuaccugcaauaguacgagaggcaauuaagcgagggcugagaacccuuauccucgccccaacacgugucguagcagcagagauggaagaagcgcucagaggacuuccgauuagauaucaaacgccagcaauuagagcagaacacaccgggagggaaauuguugaucuaaugugccaugcuacguucacaaugagauuacuaagcccaguacggguaccuaacuacaauuuaauaauaauggacgaagcacacuuuacggauccggcaucaauagcagccagagguuauaucucgacuagaguugaaaugggugaagcagcagguauauucaugacggcuacgccaccuggaucucgagacccauucccucaguccaacgccccaauaauggaugaagaaagagagauaccugaacgcaguuggaacucuggacacgaauggguuacagauuucaaaggaaaaacggugugguucguuccuagcauuaaagccggaaaugauauagcugcaugcuuaagaaagaaugguaaaaaggucauacaacucucaagaaagacguuugauucggaauauguaaaaacucgagcaaacgacugggauuuugucgugacuaccgacauaucagaaaugggcgcgaauuuccgugcagagcgcguaauagacccccgucgauguaugaaaccugucauauuaacugacggugaggaacgaguuauacuagcuggcccaaugccggugacgcacagcuccgcugcacaaagaagaggccguauuggcagaaaucccaaaaaugaaaaugaucaauacaucuauaugggagaaccucuggagaaugacgaagauugugcucacuggaaggaggcaaaaauguuacuugauaacaucaacacaccagagggcauuauucccagcauguuugaacccgaacgagaaaaaguugaugcaauagauggugaauaccgacuacgaggugaagcacggaaaacuuuuguugauuuaaugaggagaggugauuuaccggucugguuggccuaucgaguagccgcagaggguauaaauuacgcagauagaagaugguguuucgaugguaucaaaaauaaccaaauacuggaagaaaacgucgaaguugaaaucuggacuaaagaaggcgaaaggaagaaacuuaaaccuagaugguuagaugcuagaauauauagugauccucuugcuuuaaaagaauuuaaagaauuugccgcagggagaaaaaguuuaaccuugaaucucaucacagaaaugggcaggcuaccaacguuuaugacucaaaaggcacgagaugcccucgauaacuuagcuguucuccauacugccgaaguggguggacgagcuuauaaucaugcacuaaaugaacucccagagacucuugaaacuuuauuauuauuaacacuucucgcaaccgucacuggaggaauauuccuguucuugaugucagguaaagguauaggaaagaugacucuuggcauguguuguauaauaacagcuucaauuuugcucugguaugcacagauccaaccacacuggauagcagcgaguauaauucuggaauuuuucuugauaguucuacuaauaccagaaccugaaaagcagagaacaccucaagauaaucaguuaacuuauguaguuauagcuauccucacaguaguagccgccacgauggcaaaugaaaugggauuuuuggaaaagacuaagaaagauuuaggauuaggaucaaucacaacgcaagaaagugagaguaauauuuuagauauagaucugcgaccugcauccgccuggacauuauaugcaguggcgacuacuuucguaacaccaauguuacgacauucuaucgaaaacucuaguguuaauguaucacuuacugcaauugccaaccaagcuacuguguuaaugggucugggaagaggauggcccuuauccaaaauggauauaggaguuccacuguuagcaauuggauguuacagucaaguaaauccuauaacguuaacagcagcacuuuuacucuugguugcccauuaugcgauuauaggucccgguuugcaggcuaaagccacacgugaggcucagaaaagaacagcugcaggaauuaugaagaauccuaccguggacgguauuacugucauugaccuagaaccaauucccuaugacccuaaguuugaaaaacagcucggucaagucauguuacuuguacuguguguaacccaagugcuaaugaugcguacaacaugggcuuuaugcgaagcacuaacacucgcgacgggaccaauaaguacccuuugggaagguaauccaggacgauuuuggaauaccaccauagcaguaucaauggccaauauuuuucgcgguucuuaucuagcaggggcuggucuguuauucuccauuaugaaaaacacaacuaauacacgucguggcacagguaauaucggggaaacuuugggugagaaauggaaaucaagacucaaugcacuugggaagagugaguuccagaucuauaaaaagaguggcauccaagaaguggaucguacccucgcaaaggaagggauuaaacguggggagacggaucaccaugcugugagucgaggaucugcuaagcugcggugguuuguagaacggaauauggucacgcccgaaggaaaaguaguagacuuggggugcggccgcggagguuggucauauuacugcgggggucucaaaaauguaagagaagucaaagguuugacuaaaggggguccaggccacgaggagccaauaccuaugucaacauauggguggaauuuaguucgccuacagucgggugucgaugucuucuuuacuccaccagagaagugcgauacuuugcucugugacauuggggagaguagccccaacccaacaaucgaagcaggaagaacguuaagaguuuugaaccugguagagaauugguuaaacaauaacacacaauuuuguguaaaaguccucaauccauauaugccgucuguaaucgagaaaauggaaacguuacaaagaaaauacggaggagcccuaguaagaaauccacuaucuagaaauucgacucaugagauguauuggguaucgaacgcaacaggcaauauuguaucuagcguuaacaugauaucaaggaugcuuauaaaucgauucacgaugaaacacaaaaaggcuacauacgagcccgacguagaccucggaucaggaaccagaaacaucggaaucgaaaaugaaauucccaauuuggacaucaucgggaaaagaaucgagaaaauaaaacaagaacaugaaacaucauggcacuaugaucaagaucacccauacaaaacgugggcguaucacggaucguacgaaaccaagcaaacgggcucagcuagcaguaugguuaaugguguaguuaaacucuuaaccaaaccaugggaugugguuccaaugguuacccaaauggcgaugacggacacaacgcccuucggacaacagagaguuuucaaagaaaaaguagacacuaggacgcaagaaccaaaagaggggacuaagaaauuaaugcgaauaacugcugaauggcuuuggaaagaauuggggaagaagaaaacgccaagaauguguacacgugaagaguucacacgaaaagucaggaguaaugcggcauuaggagcaauauuuacugaugagaauaaauggaagucggcaagggaagcaguagaggacaguagguuuugggagcuaguggacagagagagaaaccuacauuuagagggcaaaugcgagacaugcgucuacaacaugauggguaaaagagagaagaaacuuggagaauuugguaaagccaaagguucuagagccauuugguauauguggcuuggagcucgcuuucucgaguuugaggcuuuaggauuuuuaaacgaagaccauugguuuucuagaggaaauucucuaaguggagucgaaggugaaggccuucauaaauuaggauauauacuaagagauguuagcaagaaagaagguggugcuauguacgcagaugauacagcgggaugggacacuagaauuacguuagaggaucucaaaaacgaggagauggucaccaaccauaugaaaggagaacauaaaaaguuagcggaagcgaucuuuaaauuaacguaucaaaacaaggucgugaggguacagaggcccacccccagaggaacaguaauggauaucaucucgcggaaagaccagaggggcagcggacagguugguacuuacggauuaaacacuuucacuaauauggaagcgcaacuaauccgccaaauggaaggugaaggcaucuuuaaauccauacaacguuugacaguaacugaagaaauugcaguacagaacugguuagccaggguagggagggaacgucuaagcagaauggccauaaguggugacgacuguguaguaaaaccacuggacgacagauucgcaagcgcccugacagcacuaaaugauaugggaaaaguuaggaaggauauucaacagugggaaccaagccgcggguggaaugacuggacccaaguccccuucugcucacaccacuuccacgaauuaguaaugaaggaugguaggguacuuguugucccaugucgaaaccaggaugaauugauugguagggcucguauaagccaaggcgccggguggucucuuaaagaaacggcgugcuugggcaagucuuacgcucaaauguggacguuaauguauuuccaccggcgcgaucuaagacucgcugcaaaugcuauuugcucggcaguaccaagucacugggugccaacuucgcggacaacguggucaauucacgcaaaacaugaauggaugaccacagaagauauguuggcaguauggaaucgaguauggauucaggaaaaccccuggauggaagacaaaacaccgguugaaagcugggaagagguaccguacuuggguaaaagagaagaccaauggugcggaucgcuuauaggauuaaccucuagagcgaccugggccaaaaauauacaaacugcgauuaaucaagucaggagccugauaggcaacgaggaauacacugauuauaugccuuccaugaaaagauuuagaaaggaagaagaagaagcggguguauuaugguga

SEQ ID NO: 22608 - RNA, 9876 nt, Artificial Sequence
  derived and/or modified CDS sequence (opt6) from DENV-2__EU687243__SS-prME
acugcaggaguaauaauaauguuaauaccaacggcgauggcauuucacuugacaaccagaaacggugaaccgcacaugauagucgguagacaggaaaaagguaaauccuugcuauuuaaaacugaagauggaguaaacauguguacucuaauggcaauagauuuaggagaauugugugaagacaccauaacuuacaaaugcccucugcuacgacaaaacgaaccagaagauauugauuguugguguaauucaacaaguacaugggugacauaugguacuugcacgacuaccggugaacaccgaagagaaaaacgcagcgucgcucuugugccucauguagguaugggacuugaaacccgaacagaaacauggaugaguucugaaggcgcguggaaacacguucagcguauagagacauggauacugagacauccuggauuuacuauaauggcggcaauauuggcuuacacuauaggcaccacacauuuucaaagagcucugauuuucauauuauugacggcaguugcuccaucuaugacaaugagauguauugguauaucgaaccgagauuuuguagaaggcgucucuggaggcucuuggguagauaucguacuggaacaugguuccugcgucacuaccauggcgaaaaacaaacccacauuagacuucgagcuaaucaaaaccgaggcaaaacagccggcaacucuacggaaauacuguauagaggcgaaacugacuaacacaacaacugaguccagauguccaacccaaggugaaccuucccuuaaugaagaacaagauaaaagauuuauauguaaacacucaaugguagaucgcgguugggguaaugguuguggucucuuuggaaaaggaggaauagucacaugugcaauguucaccuguaagaaaaacauggaaggaaaaguaguucuccccgagaauuuagaauacaccauaguaauaacuccucacaguggagaagaacacgcuguugguaaugauacggguaaacauggcaaagagauaaaaauuacaccgcaauccuccauaacagaggcggaacucacaggcuacggaacaguaacaauggaauguaguccucgaaccggccuagauuucaaugaaauggucuugcugcagauggaagauaaagcauggcuaguacacagacaaugguuuuuagacuuaccacuaccuuggcuuccuggugccgauacgcaaggaucaaauuggauacaaaaagaaacauuaguaacauuuaaaaauccacacgcuaagaaacaagauguagugguacugggcagucaagagggggcuaugcacacugcuuuaacaggagccacagagauacagaugaguucagguaacuuauuauuuacuggacacuuaaaaugccgccuuaggauggauaaacuacaacuaaaagguaugucauacucgaugugcacagggaaauucaaaauagugaaagaaauugcugaaacacagcaugguacgauaguaauccggguacaauaugaaggggaugguucuccaugcaaaauaccauuugagauuauggauuuagagaaaagacauguguuaggaagacuaaucacagucaaccccauagugacugaaaaagacucgccuguaaauauagaggcagaacccccauucggggacagcuacauuauaauaggaguggaaccggggcagcugaaauuaaauugguucaagaaaggaaguaguauaggucaaauguuugaaacuacaaugaggggugcgaaacggauggcaauccucggugacacagcuugggacuuugggucguuagguggaguauuuacuuccaucggaaaggcacuacaccaaguauuuggagcgauauauggagcugcauuuagcggaguaucuuggacuaugaaaauucuuauaggugugauuauaacauggauaggaaugaauagucgaucaaccucacuauccguaucucuuguauuaguaggugucguuacucucuauuugggugucaugguacaggcagauacagguugcguugucaguuggaagaauaaggaauuaaaauguggaagugguauauucauaaccgacaacguucacacauggaccgagcaauacaaauuccaacccgaaucaccgucaaaauuagcuuccgcuauacaaaaagcacacgaggaaggcauuuguggaauuagaucagucacgagauuagaaaacuugauguggaaacagauaacaccugaguuaaaucauauacucucagaaaaugagguuaaguuaacaauuaugacaggcgacauaagaggaauaaugcaagcuggaaaaaggucgcuacguccccaaccuaccgaauugaaguauucauggaaaacaugggguaaagcgaagauguuaucuacugagucacacaaucagacauuucuaaucgaugguccagaaacugccgagugcccuaauaccaaccgagccuggaauagucuugaaguugaagacuauggauuugguguauuuucaacuaauauaugguuaaaauuaagagagaaacaagacguauuuugugacucuaaauuaaugagcgcagcuauaaaagauaaccgggcuguacaugcagauaugggcuacuggaucgaaucugcccuaaaugauacuuggaagauggaaaaagcgucauucauugaaauuaagaguugucauuggccgaaaucacacacccuauggucaaaugguguucuagaaagugaaaugauuauaccaaagaacuuugccgggccgguuagucaacacaauuauaggccagguuaccacacgcaaacugcaggaccauggcauuuagguaaauuggaaauggauuuugacuuuugcgaaggaacaaccguaguaguuacagaggauugugggaaucgaggcccaagccucaggacaacaacagcaagcggaaaauuaaucacagaaugguguugcagaaguuguacauuacccccacuucgauacagaggagaggacgguugcugguaugggauggaaaucagaccuuuaaaagaaaaagaggaaaaucuaguaaacaguuuagucacagcgggacacggucaaaucgacaauuuuucccuuggaguuuuagggauggccuuauuuuuggaagagaugcugagaacacguguagggaccaaacaugcgauauuguugguggcagugucauuuguaacacucauuacagggaauaugucauuuagggaucuaggaagagucauggugauggugggagcaacuaugacugaugacauugguaugggagucacauaccuugcgcucuuagcggcuuuuaaggucaggccaaccuuugcagcaggcuuguuacugcgaaaacuuaccucaaaggaauuaaugauggcaacaauagguaucgcacuuuuaagucaauccacaauaccagaaacuauacuugaacuaacagaugcauuagcacucggaaugaugguuuuaaaaauaguuagaaacauggaaaaauaucagcuagcuguaacuauaauggcuauaagcuguguccccaacgcagugaucuuacagaaugcauggaaagucaguuguacgauucuagcugccguaagcguuucuccccuucuacuaacaucuucucaacaaaaagcugauuggaucccacuagcgcuaaccauaaaaggauugaauccuacugcuauuuuccucacuacauuaucuagaacuagcaagaaacguucauggccgcuuaaugaggcaguaauggcgguaggaauggugagcauucuggccucuucacugcuuaaaaaugacauuccgaugacuggaccgcucguagcaggagguuuauuaacaguauguuacgugcuaacagguagaucagcggaccuagaauuagagagagcagcagauguuaagugggaagaccaggcagaaauauccggaagcucaccaauauugagcaucacaauaucagaagacgggaguaugucaaucaaaaaugaagaggaggagcauacguuaacaauuuuaauccguaccgguuuacugguuauuuccggaguauuccccguuuccauaccaauaacagcggcagcaugguauuugugggaggucaagaaacaacgagcuggagugcuaugggaugugccaaguccuccaccuguaggaaaagccgaauuggaagauggggcauauagaauaaagcagagagguaucuuuggauauagucagauuggcgccgguguguauaaagaaggaacauuucauacaauguggcacguaacaagaggugcaguauuaaugcaccgugguaagcgaauugagccgucuugggcugaugucaagaaagauuuaaucaguuaugguggaggauggaaauuagaaggcgaguggaaagaaggagaagaaguacaaguccuggcacuggaaccgggcaaaaacccaagggcuguucaaacuaaaccaggauuauuuaaaacgaauacgggcacaauaggggcuguuuccuuagacuucaguccagggacgucgggaucaccaauuguagaccgaaaaggcaaaguaguaggccuguacggaaacgguguaguuacacgaagcggagcauaugucagugccaucgcacagacggaaaaaucaauagaagauaaccccgaaauagaagaugauauuuuuaggaagaaacgucuaacuauaauggacuuacauccaggagcagguaaaacgaaacgauaucucccagcaauagugcgugaagcuauaaaaagaggguuacgaacacucauuuuagcgcccacucgcguggucgcggccgaaauggaagaggcacucagaggacuaccgauacgauaccagacuccugcaauuagagcggagcauacagggcgcgaaaucguagaccuaaugugccaugcuacauuuacaaugcgacuacucaguccuguacgcguacccaauuacaaccuuaucaucauggaugaagcacacuucacggaucccgcaagcauagcugcuagggguuauauaucaacaagaguagagaugggagaagcugccgguaucuuuaugacagcuacaccuccaggcucacgagauccuuuuccccaaaguaaugcgccaaucauggaugaagaaagggaaauaccugaaagaucguggaacucaggucacgaaugggucacugauuucaaagggaaaacaguaugguuuguacccaguaucaaggcgggaaaugacauagcagcuugccuaaggaaaaaugguaaaaagguaauacagcucagccguaagaccuuugauucagaguacgugaaaacaagagcuaaugauugggauuucguaguaacgacagacauuuccgaaaugggagcuaauuucagagcugaaagaguuauagauccaaggcggugcaugaagccaguuauacuuaccgacggagaggaaagagugauccucgcaggccccaugccagucacacauucaagugcagcgcaaaggcguggucggauaggacgaaauccuaaaaaugaaaaugaccaauauauuuacaugggagaaccucuagaaaacgaugaagauugugcccacuggaaagaagcaaaaauguuauuggacaauauaaauacccccgagggcauaauaccaaguauguucgaaccagaaagagaaaaaguugaugcuaucgauggugaauauagacuaagaggcgaagcgcguaaaacauuuguugauuuaaugagacgaggagauuuaccaguaugguuagcguaccgggucgcagcagaggggauuaauuaugcagauagacguugguguuucgacgggaucaaaaauaaucaaauacuugaagaaaauguagaaguggaaauuuggacuaaagagggagaacgaaagaaacuaaaaccaagaugguuagacgcuagaauuuacagugauccacuagccuuaaaagaauuuaaagaguucgccgccggccgaaaaucauuaacacuuaacuuaauaaccgagauggguaggcuaccgacuuuuaugacgcagaaagcuagggacgcacuugauaauuuagcaguacuucauacagcagaagucggaggcagagcauauaaucaugcucuuaaugaguugccugaaacacuggaaacgcuacucuuauuaacucuucuugcuacggugacuggcgguauauucuuauuccuaaugucaggaaagggaauaggaaagaugacucuuggaauguguugcauaaucacggcaucgauuuuacucugguaugcacaaauccaaccacauuggauagcugcgucgauuauacuugaauuuuuccuaauaguucuacugauaccagagccagagaaacaacgaaccccacaagauaaucaauugacauauguggucauagcaauuuuaaccguugucgcagcaacaauggcaaaugaaaugggguuucuagagaaaacuaagaaagaucuaggcuuagguagcauaacaacacaagaaagugaaagcaacauacuugacauagauuuacgaccugccucugcauggacauuauacgccguggcgacuaccuucgucacgccaauguuaagacauagcauagaaaacaguucagugaacguaagucuaaccgcaauugcaaaucaagcgacggucuuaaugggccuuggaagaggauggccccuaagcaaaauggacauaggaguaccgcuacuagcaauagguuguuauucacagguaaaucccauuacauuaacagcugcauuacucuuacuuguggcucauuacgcaauaauagguccaggguugcaggccaaagcuacucgugaagcccaaaaacgcacagcagcggguauuaugaaaaaccccacaguagaugggauaaccguaaucgacuuagaaccgauuccauaugacccaaaauuugaaaaacaacucggucaggugaugcucuuaguucuguguguuacacagguucucaugaugagaacaacgugggcccuaugcgaagcauuaacacuagcaaccggacccauaucaacucucugggaagguaacccuggucgauuuuggaauacuaccauagcugucaguauggcuaacauuuucagagguucguauuuagccggugcaggacuauuauuuucaauuaugaaaaauacaacuaacacgagaagaggcaccggaaacauaggagaaacacuuggcgagaaauggaagucuaggcuuaaugcacucggaaaaucugaguuccaaauauacaagaaauccggaauacaagaaguagacagaacucuggcaaaagaagggauaaaacggggagaaaccgaccaucaugcggucucgaggggcagugccaaauuacgcugguucguugaacgcaauaugguuaccccagaaggaaaaguaguggauuuaggaugcggacgaggcggauggucauacuacugcgguggucuuaaaaacguaagggaagucaaaggcuuaacgaaagggggacccggacaugaggaaccaauacccaugaguaccuacggguggaaucuagugcguuuacaaagcgggguugacgucuuuuucacaccaccugaaaaaugcgauacccuguuaugugacauaggagagucuucuccuaacccaacaauagaagcuggucggaccuuacgcguauuaaaccucguugagaauuggcuaaauaauaacacccaauucuguguaaaaguucuuaauccguauaugccuagugugauagagaaaauggagacacuacaacgaaaguauggaggagcuuuagucaggaauccguuaagucguaauuccacccaugagauguacuggguaucaaacgcgacuggcaacaucgucucuagugugaacaugauuucuagaauguugauaaaucgcuuuacgaugaaacacaaaaaggcaacuuaugaaccagauguagauuuaggauccgguacgcguaauauagguaucgaaaacgagauuccgaaucuggauauuaucggaaaaagaauugaaaagaucaagcaagaacacgaaacaucuuggcauuacgaucaagaucaccccuauaaaacaugggcuuaucaugguaguuaugagacaaaacaaacgggaucagcaucgaguaugguaaacggagugguuaaauuacucacaaagcccugggacguaguuccuauggugacacagauggcuaugacugacaccacaccguuuggucaacaacgaguguuuaaagagaaaguagauacccguacucaagaaccaaaagaagguaccaagaaacugaugagaauaacagcugaaugguuauggaaggaacuggggaagaagaaaacuccaagaauguguacccgggaggaguuuacccgcaaaguuagauccaacgcugcucuuggggcuauuuucacagaugagaauaaauggaaaagcgcgcgagaagcuguggaggacucacgauuuugggagcuuguugacagagaaaggaauuuacaucuagaagguaagugcgaaacauguguauauaauaugaugggaaaaagagagaagaaauuaggugaauuugggaaagcgaaagggucacgugcaauuugguacaugugguuaggugcacgcuuucuugaauuugaagcgcuaggauucuuaaacgaggaccauugguuuucccggggaaacagccuaaguggcguagaaggagagggucugcacaaauuaggauacauccuacgggacguuaguaagaaagaaggaggagcaauguaugccgaugauacugcuggcugggacacuagaauuacacuagaagaucucaaaaacgaagagauggugacaaaucacaugaagggcgaacauaagaaacuagcggaagccauuuuuaaacuuaccuaccagaacaaagugguuagaguacagcgaccaacacccagaggcacaguaauggacauaauaucucgaaaagaccaacgugggucuggccaagugggcaccuauggauuaaauaccuucacgaacauggaagcucaacucauacgucaaauggaaggcgaagguauauucaaaucuauacaaagacucacaguuacugaagaaauugccgugcagaauuggcuugcacgggucggacgagagcgccuaucuaggauggcuauaucaggugaugauugcgucguaaagccacuagaugauagauuugcuuccgcucuuacagcacucaaugauauggggaagguaagaaaagauauacaacagugggaaccuucuaggggauggaaugauuggacucaaguuccuuucuguagucaucacuuccaugaacuuguuaugaaagaugggagaguacuuguagucccauguaggaaucaagaugaauuaauugguagagcaagaaucagccaaggagcuggguggucucuaaaagaaacugcuugucucggcaagucauacgcucaaauguggacucuaauguacuuucaucgcagagaccuuagauuagcagcaaaugcgauauguagugcagucccaagucauuggguuccuacgucaagaacaacauggucaauucaugcaaaacaugaguggaugacaacagaagauaugcuagcaguguggaaccgcgucuggauccaagagaauccguggauggaagauaagacgccaguugaaaguugggaagagguuccuuacuugggaaagagagaagaccaauggugugguucacuaauuggauuaacgucccgggcaacaugggcuaagaacauacaaacagcgauaaaucagguucgaucguuaaucggaaacgaggaauauacagauuauaugccgagcaugaagcgauuuagaaaagaagaagaagaagcagggguccuaugguaa

SEQ ID NO: 22609 - RNA, 9876 nt, Artificial Sequence
  derived and/or modified CDS sequence (opt6) from DENV-2__EU687245__SS-prME
acugcaggagugauaauuaugcuuauuccaacagcgauggccuuccacuuaacuacaagaaacggugaaccacauaugauuguugguagacaagaaaaaggaaaaagucuacuauuuaaaaccgaagauggcguuaauaugugcacccuuauggcgauagaucuaggggaauugugugaagacacuauaaccuauaaaugcccacuacuccggcaaaacgaaccagaggauauagauugcuggugcaacucaacaucgacuugggugacguauggcacauguacaacaacuggugaacaccgcagagagaaaagaucaguagcacuuguuccucaugucgguaugggacuagaaacacguaccgaaacguggaugucaucagaaggugccuggaaacauguacaaagaauagaaacauggauucuucgucauccuggcuuuacuauuauggcugcuauauuagcuuacacuauaggcacgacgcacuuccaaagggcguuaauauucauauugcucaccgcagucgcacccucaaugacaaugcgaugcauaggcauaucaaauagagauuucguggaagguguuagcggugguucguggguggauauaguguuagagcacggcagcugcgucacaacgauggcuaaaaauaaacccacacucgacuuugaauuaauuaaaacugaagcaaaacagccggcaacucuaagaaaauauugcauagaagcuaaacuaacaaauacaacaacagagucacgcugcccaacacaaggagaaccuagcuugaacgaagaacaagauaaacguuuuaucuguaaacacucaauggucgauagaggaugggggaauggaugcggacuauucgggaaaggaggaauugucacuugugcaauguucacaugcaagaaaaauauggaagguaaaguuguccuccccgagaaccucgaauauacgaucgucauaacaccacacucgggagaggaacaugcggucggcaaugacacagguaaacaugguaaagaaauaaaaauuacgccacaaucuucaauaacugaagcugaauuaacugguuaugggacaguaacaauggaauguucacccaggaccggauuagauuuuaacgaaaugguauuauuacaaauggaggauaaagcaugguuaguccauagacagugguuuuuagaccuuccacuaccgugguuacccggagcugauacgcagggaucaaacuggauacaaaaagaaacacucguaacauucaaaaauccccaugcuaagaaacaagauguaguuguucucgguucacaggaaggugcgaugcacacagcacucacaggagcuaccgaaauacaaaugaguagcggaaauuuauuguucacaggucauuuaaaauguagacuccgaauggacaaauuacaacuuaaagggaugagcuauucgaugugcacuggcaaauuuaaaauaguuaaagaaauagcagagacacaacauggaacaauaguaauucgcguacaauacgaaggugacggaucuccaugcaaaauaccguucgaaaucauggacuuagagaaaagacacguauuaggucgauugaucacugucaacccaauaguaacugaaaaagacagcccugucaacauagaagccgaaccacccuuuggggacaguuauaucauuauaggagucgaacccggccaacuaaaacuaaauugguucaagaaagguaguaguauuggacaaauguuugaaacaacaaugcgaggcgcuaagaggauggccauacuaggagauacagcaugggacuuugggucccuaggugguguuuucacaucaaucgggaaagcauugcaucaagucuucggagcgauauacggagcagcauuuagcggcgugaguuggacuaugaaaauauuaauaggaguuauaauaacguggauagggaugaauaguaggucaacuucauuaucgguuucauuaguuuuaguagguguuguaacacuguacuuagggguaaugguacaagcggacacaggaugugugguaucuuggaaaaauaaagaacugaaaugcggaaguggcauauucauaacagauaacguacacacauggacagaacaguauaaauuccaaccagaaagcccuucaaaauuagcaucagcgauccaaaaagcucaugaagaaggaauuugugguaucaggagcgucacaagguuagaaaaucuuauguggaagcagauaacaccagaacucaaucauauauuaucagaaaacgaagucaaguuaacuaucaugacuggugauaucaaggggauuaugcaggccggaaagcgaucguuaagaccucaaccaacugaauuaaaauauuccuggaaaacaugggguaaagcaaaaaugcucagcacugaaagucauaaccaaaccuuccuaauagauggucccgaaacagcugaaugccccaacaccaaucgggcguggaacucccuagagguagaagauuauggauuugggguauuuucaacuaauauauggcuuaaacuucgugaaaaacaggauguauuuugcgacucaaaauugaugucagcagcaauuaaggauaauagggcaguccaugcagauaugggauauuggauugaauccgcguuaaaugacacauggaaaauggaaaaggcuucuuuuauagaaaucaagucaugucacuggccgaaaucacacacgcuauggucuaacgguguuuuagaaucggaaaugauuauacccaaaaacuucgcuggaccuguaucucaacauaauuaucguccagguuaccacacccaaacugccggaccuuggcaucuaggcaaacucgaaauggauuuugauuuuugugaagguaccaccguuguuguaacugaagauugcgggaacaggggucccucacuaagaaccacgacggcgagcggcaagcuaauaacagaauggugcugccguucguguacucuuccuccacuacgguauagaggggaggacggcugcugguaugguauggaaauacgcccauuaaaagagaaggaggagaaucuagucaacucccuuguuacugcaggccauggccaaauugauaauuuuucacuugguguucuagggauggcauuauuucuagaggaaaugcuacgcacaagagucgguacuaaacacgcuauacugcuaguugcgguaaguuuuguaacuuugauaaccggaaauaugagcuuuagagaucuugguagaguaauggugauggugggcgcaacaaugacggaugauauaggaauggguguaacauaucuagccuugcucgccgcuuucaaaguaaggccuacguuugcugcuggacuacuucuucgaaaguuaacgucaaaggagcuaaugauggcgacaauaggaauugcuuuauuaucucagucaacgauaccagaaaccaucuuggaacuaaccgaugcccuugcuuuagggaugaugguccucaaaauaguucgaaauauggagaaauaucagcuagcgguaacaauuauggcaauuuccuguguaccaaacgcagucauuuuacaaaacgcauggaagguaagcuguaccauccuagccgcagucuccgugagcccucuauuacuuaccuccagccaacagaaagccgauuggauuccgcuagcgcugacaauuaaaggcuugaauccuacagcaauauuucuaacaacauuaaguaggacgagcaagaaaagaucauggccauuaaacgaggcugucauggccguuggaaugguuaguauucuugcaaguagucuguugaagaaugauaucccuaugaccggaccacucguugcaggaggcuugcuaacuguuuguuaugucuuaaccgggcguucggcagaucuugaacuagagagagcugcagauguaaaaugggaggaccaagcagagauaucaggcagcucaccgauacuaagcauaacgauaucagaggauggaucaaugucaaucaaaaaugaggaagaagaacauacgcucacuauacugauucgaaccggucuucugguuauaaguggugucuucccuguaaguaucccgaucacugcagccgcgugguaccuuugggaaguuaagaaacaaagagcuggaguccuaugggacguuccgaguccaccucccguuggaaaggcagaacuagaagauggagcauaucguaucaaacaaagaggaauauuuggguacucccaaauuggagcaggaguguacaaagaagguacauuucauacuauguggcacgugacaagaggagcgguacucaugcaucgcggaaaaagaauagaaccaucuugggccgauguuaagaaagaccuuaucagcuauggaggcggguggaaauuggagggagaguggaaggaaggagaagagguacaaguacuggcgcuagaaccugguaaaaauccucgagccguucaaacaaaaccaggauuauuuaagacuaacacagguacuauuggcgccgucucauuagauuuuucaccagguacgucgggaucgccuauaguagauagaaaagguaaaguaguaggcuuguauggcaaugggguuguaacuagaaguggugcguauguuagcgcaaucgcccaaacggaaaagucaauagaagacaacccugagaucgaggacgacauuuucaggaagaaaagauuaacgaucauggauuuacacccgggagcggguaagacaaaaagauaucuucccgcaauaguuagggaagcgauaaagagaggccuucggacauuaauauuggcuccaacucguguaguagcugccgaaauggaagaggcuuuacgaggauuaccuauucgcuaucaaacuccugcuaucagagcugaacacaccggacgagaaaucgucgaucuaaugugucacgcaacguuuacaaugagacuacuuagcccugucagaguaccaaacuauaaucucauuaucauggaugaagcacauuuuacagauccagcgucaauagcggcccgcggcuacauaucaacgagaguagagaugggugaagccgcaggaaucuuuaugacagcgacaccuccggguucgagagacccauuuccucaaucaaacgcccccaucauggacgaagaacgagaaauuccugaacguucuuggaacucaggccaugaauggguaacggauuuuaaaggaaaaacggucugguuuguaccuagcauuaaggcugggaaugauaucgcagcaugucucaggaaaaaugggaagaaaguaauacaacucagcagaaagacauuugauuccgaauacguaaagacaagagcaaaugacugggacuuuguugugacaacggacauaucagaaaugggagcgaauuuuagagcagaacgaguaaucgacccaagacgauguaugaaaccagucauacuaacugacggagaagaacgcguuauacuggcuggaccgaugcccguaacgcacagcagugccgcucagcgaagaggaagaauugggcgaaauccuaaaaacgaaaacgaccaauacaucuacaugggggaaccacuagaaaaugacgaagacugugcgcauuggaaagaggcgaaaauguuacuugauaauauuaauacuccagaaggcauuaucccaucuauguucgaaccugaaagagaaaaagucgacgcgauugacggcgaauacagacugagaggugaagcaagaaagacauuuguggaucuuaugcgucguggagaccucccgguguggcuagccuauagaguagccgccgaaggaaucaacuaugcugacagacgguggugcuuugauggcauaaagaauaaucaaauccuagaggaaaauguagaggucgaaauuuggaccaaggagggagaacggaagaaacuaaaaccccguuggcucgaugcuagaauauauucagacccuuuagcacuaaaggaauuuaaagaauuugcagcgggaaggaagucacuuacauuaaaucugauuacagagauggguagacugccgacauucaugacccaaaaggcucgcgaugcucucgacaaucuugcgguauuacauacugcagaaguuggcggcagagccuacaaucaugcauuaaaugaauuacccgaaacgcuagaaacauuauuauuauuaacacuucuggcgacuguaacuggugggauauuucuauuucucaugucagguaaaggaauaggaaaaaugacucucggcaugugcuguauuaucacagcaagcauauuauugugguaugcacagauacaaccucauuggauagccgcaucaauuauauuagaguucuuucuaauaguacuacugauuccugaaccagaaaaacaacgaacaccacaggauaaucaauuaacuuauguuguuauagcaauuuuaacaguuguagcagcuacgauggcaaaugaaaugggauuuuuggaaaagaccaagaaagaucuugguuuaggaaguauaacaacacaggaaagugaaaguaauauccuggauauugaucuacgcccugcuagcgcuuggacacuauacgcgguggcaacuaccuuuguaacgccaaugcugaggcauucaauagaaaauucgucagucaauguauccuuaacagcuaucgcgaaucaggcgacaguguuaaugggacuaggccggggauggccgcuauccaaaauggauaucggaguaccacuauuagcaauagguuguuacucucaaguuaaucccaucacuuuaaccgcagcucuacuacugcuaguggcucacuaugcuauaaucggcccuggacugcaagcgaaagcuacuagagaagcgcaaaaacgaacugcggcaggaauaaugaaaaaucccacugucgacggaaucacagucauugauuuggaaccaaucccguacgaucccaaauuugaaaaacaacuuggucagguaaugcucuuaguucuuugcgugacacaaguguugaugaugcgaacaacaugggcucuaugugaagcauuaacccuugcgacgggaccaauaagcacuuugugggaaggcaauccugggagauuuuggaauacuaccauagcuguuucgauggcuaauauauuccgagguucauaccuggcuggugccggacuauuauuuagcauaaugaagaauacuacaaacgcucgucgcgggacuggcaacauaggugaaacucuuggagaaaaauggaaaaguaggcuaaacgcauuagggaaaucggaguuucagauauauaaaaagucaggaauacaagaaguagacagaacgcuggcaaaggaagguauaaaaaggggugaaaccgaucaccaugcaguaucgagaggaucggccaagcuccguugguuugucgaacggaauaugguaacaccggaagggaagguaguagaccuagguugcggucguggaggguggagcuauuauuguggaggccucaagaaugugcgugagguaaagggauugacaaaggguggaccgggacacgaagaaccaauaccaaugagcacauacgguuggaacuuaguaagacuacaauccggaguagauguauucuucacgccacccgaaaaaugcgauacacuacuuugugacauaggagaaaguucuccuaauccuacgauagaagcaggacgaacgcugagggucuugaaucuuguugagaauugguugaauaauaauacccaguuuugcguaaaagucuuaaauccuuacaugccgucugugauugagaaaauggaaacucuacaaagaaaauauggaggcgccuuagugcgaaaucccuuaagccguaacagcacccacgagauguacuggguuuccaaugcuacagggaacauagugucaagcguaaauaugauuucgcguaugcuaauaaaucgauucacaaugaagcauaagaaagcgacuuaugagccggacguagauuuagguucuggaaccagaaacauaggaaucgaaaaugaaauaccaaaucuagauauaaucggaaaacgaaucgagaaaauaaaacaagaacaugaaacgagcuggcauuaugaccaagaccauccuuacaagacaugggcguaccauggaagcuaugaaacaaaacaaacggguagugcaucuuccaugguuaaugggguaguaaaguuacugacuaaaccaugggauguaguaccaauggugacccaaauggcuaugacagacacaacgccauuuggccaacaacgcguauuuaaagaaaaagucgacacucgaacgcaagagccgaaagaagguacuaagaaauugaugcgaauaacugccgaauggcuguggaaagagcucgggaaaaagaaaaccccgagaaugugcacccgagaggaauuuacgcgaaaagugcggucuaacgccgcacucggcgcgauauuuacggacgagaacaaauggaaaucugcacgagaagcuguagaagauucuagguucugggagcuagucgaucgagagcgcaaccuacaucuugaggggaaaugugagacauguguauacaauaugaugggaaagagggagaagaaauugggggaguucggcaaagcgaaagguucaagagcaauaugguacauguggcuaggugcaagauuuuuagaauuugaagcacucggcuuccugaaugaggaccauugguucaguagaggcaauucgcuuuccgggguagaaggcgaaggauuacauaaacuagguuacauucuucgagauguuucaaagaaagaaggaggagcaauguacgccgacgauacagccggcugggauacuagaauaaccuuagaagaucuaaagaacgaagaaaugguaacaaaucauaugaaaggagaacauaagaaauuagcagaagcaauuuuuaagcugaccuaucagaacaaaguaguucggguacaaagaccgacgagcagaggaaccguuauggauaucauaagucguaaagaucaaagggguuccgggcaaguaggaacuuacgggcuaaauacauucacaaauauggaggcacaauuaauacgucaaauggaaggagaaggaauauucaaaaguauucagagacuaacuguaacagaggaaauugccguacaaaauuggcucgcacguguaggcagagagcgucuuaguaggauggcgauuuccggugaugauuguguaguaaaaccucuugacgauagauuugcaagcgcuuuaacagcuuuaaaugauaugggcaaagugcgaaaggacauacaacaaugggagccaucuaggggauggaaugacuggacccaggugccauuuuguucacaucauuuccaugaauuaguaaugaaggacggacgugucuuaguagugccuugccggaaucaagaugaacuaauuggaagggcuaggauuucacagggggcgggcuggaguuuaaaggaaacagccugccuuggaaaaucguacgcucaaauguggacucucauguauuuccauagacgagauuuaagauuggcggcgaacgccauaugcuccgccguccccucacauugggugcccacuucucgcacaaccugguccauucacgccaaacaugaauggaugacgacugaagauauguuagcugucuggaauaggguauggauucaagaaaauccuuggauggaagacaaaaccccuguagagaguugggaagaaguacccuacuuagguaagagagaagaucaauggugcgggucacuaauaggauuaaccucucgagcuacuugggcuaaaaauauucaaacagcgguaaaucagguaaggucuuugauagguaacgaagaauacacugacuauaugccaucuaugaaacgguucagaaaagaagaagaagaagcaggaguccuuugguaa

SEQ ID NO: 22610 - RNA, 9873 nt, Artificial Sequence
  derived and/or modified CDS sequence (opt6) from DENV-2__HQ541798__SS-prME
acagcaggcaugauauuuaugcuaaucccaacuguaauggccuuccaccugacuaccaggaacggagaaccacauaugauuguaaguagacaagaaaaagggaaauccuuacucuuuaaaacaggagauggugugaauaugugcacgcuaauggcgauggaucuuggggaacuaugugaagacacaauaacauacaaauguccccuccuuagacaaaacgaaccggaggacauugauuguugguguaauaguacgagcacgugggucacauacgggacguguaccacaacaggagagcaccgacgcgaaaaaagaucaguugccuuagucccgcauguugguauggggcuugaaacacguacggaaacuuggauguccucagagggggcuuggaagcacgcgcaaaggauugaaacguggauauugagacacccagguuucacuaucauggcagcaaucuuagcuuacacuauuggaacaacucauuuccagcgagcucuuauauucauacuacuaacagcaguugcuccgucaaugacaaugagguguauagguauuaguaauagagauuuuguagagggaguauccggugguaguuggguagauaucguauuggagcacggaucauguguuacuacaauggcaaagaauaaaccuacucucgauuuugaauuaauaaagaccgaggccaaacaaucugcaacauugagaaaauauuguauagaagcuaaauuaacuaauacuacuacggaaaguagauguccuacacagggagaacccucuuuaaacgaagagcaagacaaaagguucguuuguaaacacucgauggucgaucgcgguugggggaauggauguggguuguuuggcaaaggcggaaucguaacaugugcuauguucaccugcaaaaaagauaugaaaggggaagucguacaaccggaaaauuuagaauauacuauuguuauuacgccacacucuggcgaggaacaugcaguagguaacgacaccgguaagcaugguaaagaaauaaaaauaacuccucagucgucaaucacugaagcagagcuaacgggguauggcacuguaacaauggaauguucuccgcgaacaggccuagacuucaacgaaauggucuuauugcaaauggaaaauaaagcuugguugguccaucgacaaugguuuuuggaucuaccguuaccaugguuaccaggggccgauacacagggaucuaauuggauccaaaaggagacauuaguaacauuuaagaacccucacgcuaagaaacaagacguugucguuuuaggaagccaggaaggcgcaaugcauacagcucuaaccggcgcaaccgaaauacagaugucuucaggaaauuugcuauuuacuggacauuugaaaugcagauuaaggauggauaaacuacaauuaaaaggcaugaguuacucaauguguaccgggaaauucaaaguaguuaaagagauagcagagacacaacacggaacuauaguaauucggguccaauaugaaggagaugggucuccuuguaaaauaccguuugaaauuauggaccuagagaaacgucacguacuaggaagacuaaucacaguaaauccaauaguuacggaaaaagauucaccaguaaauauugaggcugaaccacccuuuggagacuccuacauaaucauuggaguggagccaggacagcuaaaauuaaacugguuuaagaaaggcucaucaauugggcaaauguuggagacuacuaugaggggagccaaacgaauggcgauacuuggagauacagccugggauuuugguagccuaggaggaguauuuacuucaauuggaaaagcauuacaucaaguguucggugcuaucuauggggcagcuuuuucaggaguuucauggacaaugaaaauuuuaauagguguuaucauaacauggauaggaaugaauagccgaaguacaucacuaucuguuuccuuagugcuaguaggaguuguaacccucuacuugggagucaugguccaggcagacucuggcuguguagucucguggaagaacaaagaguugaagugcggcucaggcaucuucauuacggauaacguccauacauggacggaacaauauaaauuccagccagaaucgccgaguaaauuggcgucagcaauacaaaaggcucaugaagaggggaucugcgguauacgaucggucacaagacuggagaacuuaauguggaaacagaucacuccagaacuaaaccauauacugucagaaaacgaaguaaaauugaccauuaugacuggugacauaaaaggaauaaugcaagcaggaaaacgaucguuaagaccgcagccgacugaacuaaaauacucuuggaaaacauggggaaaagcuaaaaugcuaucaacagaaucacauaaccaaaccuuucuaauagacgguccagaaacagcagaaugcccaaauacgaauagagccuggaauucacuagaagucgaagacuacggguuugguguauuuacaaccaauauaugguuaaagcuacgugagaaacaagacguguuuugcgauucaaagcugaugagugcggcuauuaaagacaacagagcuguacacgcggacaugggauauuggauagaaagugccuuaaacgauacauggaagauagagaaagcgagcuuuauagaagugaaaaguugucacuggccuaaaccucacacauuauggucaaaugaaguauuagaguccgaaaugaucauuccaaaaaauuuugcagguccaguaagccaacauaacuaucguccagguuaucauacacaaacggcuggcccauggcaucuggguaaacuggaaauggacuuugacuucugcgagggcacaacuguuguaguaacggaggauugugggaauaggggcccuucauuaagaacaacgacagccucagguaaacugauuacagaauggugcugucggucauguacucuaccgccacuaagauaucgcggagaggacggcuguugguauggcauggagauuagacccuugaaagaaaaagaagaaaacuuagucaauucccuagugacagcggggcauggucaaauugacaauuucagucuaggugucuuaggaauggcacucuuuuuagaggaaauguuaaggacuaggguagggacgaaacaugccauucuacuggucgcgguaagcuucguaacuuuaauaaccgguaauaugucguuuagagaucuaggccgcguaauggugaugguuggagcaaccaugacggaugauauuggaaugggaguaacguacuuggcgcuccucgcugcguuuaaaguaagaccgacauuugcggcgggcuuauuacuaagaaagcuaacaucgaaagaguuaaugaugacaacaauugggauaguacuccucucccaaucaacuauuccugagacaauuuuggaacuuaccgacgcucuagcccuggguaugaugguauuaaaaaugguaagaaagauggaaaaauaucaguuagcuguaacaauaauggcgauccucugcgucccaaacgcgguuauacuacagaaugcuuggaaggugucgugcacaauauuagcaguuguaaguguuucaccccuuuuccugacgucuucacaacaaaaagcagauuggauaccacuugcccucaccauaaaaggauuaaacccuaccgcuauauuuuugacuacucuauccagaacaaacaagaaacgaucguggccucucaaugaagcuauaauggcaguuggcaugguuaguauauuagcgaguucauuacucaaaaaugauauucccaugacugggccauuaguggcagguggacuauugaccgugugcuacgucuuaacgggaagauccgcagaccuagagcuagaacgcgcggcugacguuaaaugggaggaccaagcagaaauuuccgggagcaguccaauucuuuccaucaccauuagcgaagacggaaguaugaguaucaaaaaugaagaggaagaacaaaccuugacuaucuuaauaagaacaggucuacuugucauaucaggucuguuccccguaucacuaccuauaacggccgcugcaugguaucuaugggaagucaagaaacaaagagcaggaguccuuugggaugucccgucaccuccucccguagggaaagcagaacuagaagacggagcauaucgaauaaagcagaaaggaauacugggcuacucucaaauuggggccgguguuuauaaagaggguacauuucacaccauguggcacguuacaagaggagcaguucugaugcacaaagguaagagaauugaaccaaguugggccgacguuaaaaaagaccuuauauccuauggcggaggauggaaauuagaaggagaauggaaagaaggagaagaaguccagguacuagcacuugagccuggaaagaauccuagagccguccaaacuaaaccagggcucuuuaagaccaacgcaggaacuauuggagcaguaagucuggauuucucuccuggaacuucuggcucaccgauaauagauaaaaaaggaaaaguagugggcuuauauggcaacggaguaguaacucgaucgggcgcuuauguuagugcaauagcacaaacagaaaaaaguauagaagauaauccagaaauugaagaugacauauuccgaaaaaggaaauuaacuauuauggaucuucaccccggagcaggaaaaacaaaaagauaucugccugccaucguucgagaagcuauaaaaagaggccuacgaacguuaauacucgcacccacaagggucguugcagcagaaauggaggaagccuuacgagguuuaccaauucgauaucaaacacccgcaauucgagcugaacacaccggaagggagauaguagacuuaaugugccaugcgaccuucacuaugcgucuacuaagcccagugcgagucccaaauuauaauuugauaaucauggaugaagcacauuuuacggaucccgcuucaauagccgcacgugguuacauuucaacacgaguugaaaugggugaggccgcuggaauauuuaugaccgcuaccccuccaggcagcagggauccauuuccccaaucgaacgcucccauaauggacgaggaaagagaaauccccgaaagaucauggucaaguggacaugaguggguaacagauuuuaaaggaaagacaguaugguucguaccgaguauuaaagcggguaacgacauugcagcaugccugagaaaaaaugggaaaaaaguaauucaauuaucucgaaaaacauuugacucggaguacguaaaaacucgaacaaaugauugggauuuuguaguuacaacggacaucagcgaaaugggagcuaacuuuaaagcagaacgcgucaucgaccccagacguugcaugaaaccaguaaucuugacagacggagaagagagggucauacuugcgggcccaaugccaguaacacacaguagcgcagcucaaagacgggguagaauaggucguaauccaaaaaacgagaaugaucaauacauauacaugggagagccgcuugaaaaugaugaggauugugcacauuggaaagaggcaaaaaugcuacuggauaauaucaacacaccugagggcauuauacccucaauguucgagccugaaagagagaaaguugaugcaauagacggcgaauaucggcuccgaggugaagcgcgaaaaacguucguagaccucaugagaaggggcgaccuaccaguuuggcuugcauauagaguagccgcugaagggauuaacuacgcugaucgacguugguguuuugauggaauaaaaaauaaucaaauacuugaagaaaauguagaaguugaaauauggacuaaagaaggcgaacguaaaaagcucaagccuagaugguuggaugccagaauauauucagauccuuuagcucugaaagaauuuaaagaauuugcagcgggcagaaaaucauuaacgcucucccuuaucaccgagaugggccggcuuccgaccuucaugacacaaaaggcccgagaugcacuagauaaucuagcgguauuacauacggcagaggcuggagguagagccuauaaucacgccuuaagcgaacuacccgaaacgcuagaaacccuucuguuacuaacacucuuggcgaccguuacaggagguauuuuccuguuuuugaugucaggcagagguauagguaaaaugacacucgguaugugcuguauuaucacugcaaguaucuuacuaugguacgcccaaauccaaccgcauuggauugcagcaaguauaauucuagaguucuucuugaucguuuuacuaauaccagaacccgaaaaacagcgaacuccacaggauaaucagcuaaccuacguaguaaucgcuauacuaacuguaguagcagcgacaauggcaaaugagaugggguuuuuagaaaaaaccaaaaaagaucuaggacuugguucgauaacaacacaacaacccgaaucuaacauauuagauauagaccuccgaccagccagugcuuggacacuauacgcuguagcuacaacauucguaacgccaaugcuucgccacaguauagaaaacucaagcguaaaugugagucuuaccgcuauagcuaaucaggcaacgguauuaauggguuuaggcaaagguuggccucuaucuaaaauggacauaggcguuccacuguuggcaauaggaugcuauucacaaguaaauccuauuacauugacagcagcacucuuucuauuaguggcacauuacgcuauuauaggaccagguuuacaagcaaaagccaccagggaggcucagaaaagagcugcugcgggaauaaugaaaaacccaacaguagauggaauaacagugauagauuuggacccgauaccuuaugauccuaaauucgaaaaacaguuaggacaagugaugcuucucguauuaugcgucacacaggucuuaaugaugaggacgacuugggccuuaugugaggcucugacccuagccaccggcccgauaucaacacuaugggaagggaacccuggcagauuuuggaauacgacaauagcggucucuauggcuaacauauuccgaggaaguuauuuggcaggagcaggucuucuuuuuucuauuaugaaaaauaccacaaacacucgucgcggaacgggaaacauaggcgaaacguuaggcgaaaaguggaaauccagacuuaaugcacuuggaaagagugaauuucaaauuuauaaaaaaucgggaauucaagaaguggauaggacuuuagcgaaagaaggcauaaaacggggugagacugaucaucacgcugugucacgagguuccgcgaaauugaggugguuuguggagagaaauauggucacaccugaagguaaagucguugaucugggauguggaagaggaggauggagcuauuacuguggaggccuaaaaaacguccgcgagguaaaaggcuugacgaagggagggcccggacacgaagaacccaucccgaugaguacauaugguuggaaucuagucagacuacaaagugguguugauguuuuuuuuaccccaccagagaagugcgauacccuacuaugcgauauuggugaaagcaguccgaacccgacaguagaagcugguaggacgcuccgaguucuaaauuuggucgaaaauuggcuaaacaauaauacccaauucuguauuaaaguacucaauccauacaugccuuccgucauugagaagauggaagcacuccagaggaaauacggaggagcguuagucagaaauccccuaagucgaaauucaacacaugaaauguacuggguuucgaaugcgucuggaaauauuguuagcucugucaauaugauaagucguaugcucauaaauagauucacuaugaggcauaaaaaagcgacuuaugagccggauguagacuuagguucugguacaagaaauauaggcauagagucugagauacccaauuuagacaucauugguaaaagaauaaaaaucaaacaagaacaugaaaccuccuggcauuacgaccaggaccauccguacaaaacgugggcuuaccacgguucguacgaaacaaaacaaacuggaagcgcaaguaguaugguaaacggcguaguuagacuacugacaaagcccugggaugucgugccgaugguuacccaaauggcaaugacagauacgacgccuuuugggcaacagcgaguuuucaaagaaaaaguagauaccagaacacaagaaccaaaggaagguacuaagaaacuaaugaaaauuacagccgaaugguuauggaaagaauuggguaaaaaaaagaccccacggaugugcacgcgagaagaauucacucguaaaguaagaaguaacgcugcguuaggagcaauuuucacagaugaaaauaaauggaaaagugcaagggaagcaguugaggauagcagauucugggaauuaguggauaaggagagaaauuuacauuuagaaggaaaaugcgaaacuuguguuuauaauaugauggguaaaagagaaaagaagcuaggggaguucgguaaagcaaaagguucgcgagcuaucugguauaugugguuaggugcgcgcuuccuugaauucgaagcucuagguuuccuaaacgaagaucacugguuuagucgggagaacaguuugaguggugucgaaggagagggucuccauaaauuaggauauauauuaagagacguuucuaaaaaggaaggcggggcgauguacgccgacgacacagcaggcugggacacuagaaucacauuagaagacuuaaaaaaugaagaaaugguaacaaaucacauggagggagagcacaaaaaauuagccgaagcgauuuucaaauugaccuaccaaaauaaaguagugagaguucaacgacccacucccagaggaaccguuauggacauaauuagucggcgugaucaacgaggaucugggcaaguggggacuuacggauuaaauacuuucacaaauauggaagcucaauuaauacggcagauggaaggcgaaggcguauuuaaaucaauucaacaccuaacugucacagaagaaauugccguucagaauugguuagcuaggguuggacgugagagacucucacgaauggcaauuucaggagaugauuguguuguaaaaccauuggaugauagauuugcaucagcauuaacugcacuuaaugacauggggaaaguccguaaagauauacaacaaugggaaccuucgagagguuggaaugauuggacucagguaccauuuugcucacaucauuuccaugagcuuauuaugaaggaugguaggguauuggucguaccuuguagaaaucaagacgaguugauugggcgcgcaaggauaucacaaggagcugguugguccuuaagagaaacagcuugucuuggcaaaucuuaugcgcaaauguggucucuaauguauuuccaccgaagagaucuuagauuagccgccaacgcgaucuguucggcuguaccuucacauugggucccaacuagccguacuaccuggagcauacacgccaaacaugaguggaugacugcugaggauaugcuaaccgucuggaacagagucuggauacaagaaaauccguggauggaagacaaaacuccuguugaaagcugggaagaaaucccuuacuugggcaagcgggaagaccaguggugcgggagcuuaauuggccuuacuucacgugcaacuugggcaaaaaauauacaaaccgcaauaaaucaaguaagauccuugaucggcaacgaagaauacacagacuacaugcccagcaugaaacgauuucgaagagaagaggaagaagcaggcguacuaugguaa

SEQ ID NO: 22611 - RNA, 9876 nt, Artificial Sequence
  derived and/or modified CDS sequence (opt6) from DENV-2__JF730053__SS-prME
acagcugggaugauaauuaugcuuauuccgacuguaauggcauuccauuuaacaacacgaaacggagaaccgcauaugauaguauccagacaagaaaaaggcaaaaguuuguuauucaaaacgggagacggaguaaacauguguacguugauggcuauggacuugggcgaauuaugugaagauacaauuacuuauaaauguccacuguugcgucaaaacgaaccagaagacauagauuguuggugcaauucuacaucaacauggguaaccuaugguacaugcacuacaacaggagaacauagaagagagaaaagaucuguagcgcucguaccgcauguuggaaugggucuugaaacacguacagaaacuuggaugucuucugaaggugcguggaaacacgcacaaagaaucgaaacauggauauuacgacacccaggguucaccauuauggcagcuaucuuggcauacacuauuggaaccacccacuuccagagagcauuaauauucauuuugcuaacugcagucgcaccuucuaugacuaugcgguguauagggauaucuaacagagauuuugucgaagggguaagcggaggauccuggguagauauaguacuggaacaugguaguugcgucacaacuauggccaaaaacaaaccuacucuagauuuugaauuaauaaaaacagaggccaaacaaagugcuacccuacgaaaauauugcauugaagccaaauuaaccaauacaacuacugaauccagaugcccaacacaaggugaaccaucacucaaugaagaacaggacaaaagauuugucugcaaacacagcaugguugacagaggcuggggaaauggauguggccuguuugguaaaggagggauuguuacuugcgcgauguuuacuugcaagaaaaacaugaaaggaaagguuguccaaccugagaauuuggaguacaccauaguaauaacaccacacucgggcgaggagcacgcuguaggaaaugacacuggcaaacauggaaaagaaauuaaaaucacgccucaguccucuauaacugaagcagaacuaacuggguauggaacuguaacuauggagugcaguccaaggacaggauuagauuuuaaugagaugguguuacuucaaauggaaaauaaggcuuggcucguacauagacagugguuccuugauuugccacuaccaugguugccuggugccgauacucagggauccaauuggauccaaaaggaaacauuaguaacguuuaaaaacccacacgcuaagaaacaggacguuguaguucuuggcucucaagaaggagcuaugcauaccgcacuaacgggggcuacggaaauucaaaugucaagcgguaacuuauuauuuacagggcacuuaaaguguagguuaagaauggauaaauuacaacuaaaaggaauguccuauucaaugugcacggguaaauucaaagugguuaaggagauugccgagacacagcacgguacaauuguaaucagaguucaauacgaaggugaugguaguccgugcaagaucccauucgaaaucauggaccuagagaaaagacacguuuuagguagauugaucacaguaaacccaaucguaacggaaaaagauucuccagugaauauagaagcggagccaccguucggugauucuuacauaauaauuggagucgaaccuggccagcuaaaguuaaacugguucaagaaggguucaucgauuggacaaauguuggagacgaccaugaggggagccaaacggauggcuauauugggugauacugcaugggauuucgguucacuagggggcguauucacgagcauaggaaaagcacugcaucaaguauucggugcaauuuauggggcagcauuuagcggcgucucuuggacaaugaaaauuuuaaucggaguuauaauaacuuggauagggaugaauagucgaucuaccuccuugucagucagcuuagucuuaguugggguaguaacccuauauuugggugucauggugcaagcggauucggguuguguuguaaguuggaagaauaaagaacucaaaugcggaucagguauauuuauuacggauaauguucauacuuggacagaacaauauaaauuccagccagaaucuccuagcaaacuagcaagcgcuauucaaaaggcucaugaagaagguauaugugguaucagaucaguaacccguuuagaaaacuuaauguggaaacagauaacuccagaauuaaaucauauuuuaagugaaaaugaagucaaacuaaccauuaugacaggugauauuaaagggauaaugcaagccgggaagagauccuuaaggccacagccaacggagcuuaaguauaguuggaaaacaugggggaaagcaaaaaugcuaucgacagaaucccauaaccaaacauuccuaauugacgggcccgaaacggcugaaugucccaauacuaaucgagcauggaacaguuuagaaguugaggauuacggauuugguguauuuacgacaaacaucuggcucaaacuacgagaaaaacaagacguguucugugacagcaaacuuaugucugcggcuaucaaggauaacagagcaguccacgccgacauggguuauuggaucgaaucggcauuaaaugacacauggaaaauugaaaaagcgagcuuuauagaaguaaaaucaugucauuggccaaagucucauacuuuguggaguaaugaaguccuugaaagugaaaugauaauacccaaaaauuucgcagguccgguuucccaacacaacuacagaccgggguaucauacgcagacggcagggcccuggcaucuugguaaauuggaaauggacuuugauuuuugugaagguacgacaguuguagucaccgaagauugugguaauagaggacccagcuugcggaccacaacugcguccggcaaacugauaacugaaugguguuguagaucauguacauugccaccauugcgauaucgaggcgaggacggcuguugguacgguauggaaauccgaccacugaaggagaaagaagaaaacuuaguuaauucccuuguuacagcuggucacggccaaauagauaauuucucguuaggugugcuaggaauggcuuuauuuuuggaagaaaugcuacggacgcguguggguacaaaacacgccauacuucucguagcgguaaguuuuguaacuuuaauaacuggcaacaugucauuccgagauuugggaagaguaaugguuaugguaggugcuacaaugacagaugacauugggaugggaguaacauaccuggcacuauuagcagcuuuuaaaguccgcccaacauuugccgcaggucuacuccuucgaaaacuuacuagcaaagagcugaugaugacgacuauagguauaguguuauugucacaaaguacgauaccagaaacgauacuugaguuaacagacgcucuugcucuugggaugaugguucucaaaaugguacguaaaauggagaaauaccaacucgcugugacaaucauggcaauucuuugcguacccaacgcuguaauacugcagaaugccuggaaaguaaguugcacaauccuggcgguuguaucggugucgccucuuuuccugacaagcucccaacagaaagcagauuggauaccguuggcucugacuauaaaaggcuuaaacccaacugcuauauuucugacaacgcuuagcagaaccaauaaaaagagaucuuggccauuaaaugaagcaauuauggcaguaggcaugguguccauuuuagcgaguucacuucuuaaaaacgauauaccaaugacugguccucuagucgcggguggguuacuuacagucugcuaugugcuuacagggcgaagugcagaccuagaauuagaaagagcagccgauguaaaaugggaagaucaagcugagauaucaggcagcaguccgauucugaguauaacaauauccgaggauggaagcaugaguauuaaaaacgaagaagaagaacaaacacuuacaauauuaauaaggacggguuuauuaguaauaucaggacucuucccaguaagucuuccaauuaccgcggcggcaugguaccuaugggaaguuaagaaacagcgagcgggcguuuuaugggacguaccuucaccucccccaguaggaaaagcugaacuugaggauggcgcauaccgaauaaaacaaaaaggaauacuaggauacucacagaucggagcggguguauacaaagaggguacauuucacaccauguggcacguaacaagaggagccguauuaaugcauaaaggaaaaagaauagaacccaguugggccgacgucaagaaagauuugauuaguuaugggggagguuggaaacucgaaggugaauggaaagaaggagaagaagugcaaguuuuagcucuugaaccuggcaagaauccacgcgcaguucaaacgaagccaggcuuguuuaaaacaaacgcggguacaauaggcgcaguaagccuagauuuuucaccuggcacaucagggucccccaucauagauaagaaagguaagguagucgguuuauaugguaaugguguaguuacacggagcggcgcuuauguaucagccauugcucagaccgagaaaaguaucgaagauaaucccgaaaucgaagaugauauuuuuaggaaaagaaaauuaacgauaauggacuugcacccaggagccggaaaaacaaaacguuaucuaccugcaauaguaagggaagcaaucaaaagaggucuaaggacacuaauucuugcaccuacaagggucguagcggcugagauggaagaggcacuucgaggacucccaauccguuaucagacuccggcgauccgagcagaacacacaggccgcgaaauugucgaucuaaugugucaugcgacauuuacuaugagacuuuuaagcccugugagaguaccaaauuauaaucuaauuauaauggacgaagcacauuuuacagauccagcaucuaucgcggcccgaggguacauuucaacacgcgucgaaaugggagaagccgcuggaauauucaugacggcaacgccuccaggcuccagggaucccuuuccccaaucgaaugcaccgauaauggacgaggaacgugaaauaccagaaagaucuugguccagugggcaugaguggguaaccgauuucaagggcaaaacaguuugguuuguuccuaguauaaaagccgggaaugauauagccgcaugccuacgcaaaaauggaaagaagguaauucaauuaucacgaaaaacauucgacagcgaauacgugaaaacacgaacuaacgacugggacuucgucguaacuacugacaucucggaaaugggagccaacuuuaaggcagagcgaguaauagacccccggagauguaugaaaccaguaauacucacugacggagaggaaagaguaauucuagcagguccaaugcccgucacucauagcagcgcugcacaaagacgaggacggauuggacgaaaucccaaaaaugaaaaugaucaauauauauacaugggggaaccgcuggaaaacgacgaggauugugcccauuggaaagaggccaaaaugcuacuggacaauauaaauacaccugaagggauaauacccaguauguucgagccggaaagagaaaaagucgacgccauagacggagaguaccgacuacgaggggaggcuagaaaaaccuuuguggaccuuaugagaagaggcgaucuuccaguauggcuagcuuacagaguggcagcugagggcaucaacuaugcggacaggcguuggugcuuugaugguauuaaaaacaaucagauauuggaggaaaauguggagguagaaauuuggacgaaagagggugagaggaagaaacuaaaaccucgaugguuagaugcuagaauauacagugacccuuuagcgcuaaaagaauuuaaagaauuugcggcgggcagaaaaagucugacccuaaguuuaauaaccgaaaugggucgauugccuacauucaugacgcaaaaagcgagagaugcauuagauaauuuagcaguucuacauacagcagaagcggguggacgagccuauaaccaugccuuaucugagcuaccagaaacauuagaaacgcuauuacuacuaacgcuacuugcaacaguaacuggugguauauuccuguuucucauguccggucgugguauaggcaaaaugacauuaggcaugugcuguauuauaacagcaucaauacuuuuaugguaugcccaaauucaaccccacuggauugccgcaaguaucauauuagaguucuuuuuaaucgugcuacucauuccagaaccagagaaacaacggacuccucaggauaaccaguuaacauacgucguaauagcuauauuaacaguaguugcagcgacuauggcaaaugagaugggauuucuagagaaaacuaaaaaggaucuuggacuaggaaguaucacgacucagcaaccggagaguaauauacucgauauugaccugcgcccggcuuccgcuuggacacuguaugcaguggcgacgacguuuguuacgccaaugcuccggcauaguauagaaaauuccucgguaaauguaucuuugacugcgauagcgaaccaagcaacuguauuaaugggauuaggaaagggcuggccgcuaucgaaaauggacauaggugucccucuuuuggcaauugguuguuauagucaagugaauccaauaacacucacagccgcacuauuuuuguuaguugcacacuaugcuauaauuggaccuggucuacaagcaaaagcgacuagagaagcacaaaaacgugcugccgcagguauaaugaaaaauccaacagucgauggaauaacaguuauagaccuagaucccauuccuuaugacccgaaguuugaaaaacaacuaggacaaguaauguuacuuguuuuauguguuacacagguacuaaugaugagaacuacaugggcucucugugaagcgcugacacuggccacagggccgaucucgacacucugggaagggaacccgggucgauucuggaacacuacaauagcagucuccauggccaauauauuccgggguucauaccucgcgggugcuggccuccucuuuagcauaaugaaaaauacaacgaacacgcgacggggaacuggaaauauaggagaaacguugggagaaaaauggaaaaguagauugaaugcucuaggaaagucugaauuucaaaucuacaagaaaucugguauccaagagguggaccguacacuagcaaaagagggaauaaaacgaggagagacagaucaccacgcgguaagccguggaucagcuaaacuacggugguucguagaacguaacaugguaacacccgaagggaagguuguagauuuagguugcggaagaggcggauggaguuauuacugcggaggucuuaaaaaugugagagagguaaaaggauuaacaaaaggugguccaggacaugaagaaccaauaccuaugucaaccuacggauggaauuuaguacgucuucaaagcgguguagauguguucuucacaccuccagaaaagugcgacaccuuauugugugauauaggagaaaguuccccgaauccuacuguugaagccgguagaacacuccgaguucugaauuugguagagaacuggcugaacaauaacacacaauucuguauaaaagucuuaaauccuuauaugcccuccguaauugagaaaauggaagccuuacaacgaaaguacggcggcgcccuaguacgaaauccacuuucaaggaauagcacccaugagauguacugggucaguaaugccucaggcaauauuguuucaucaguuaauaugaucagccgcaugcugauaaacagauuuacuaugcgacacaagaaagcaacuuaugagccggauguagauuuaggaucugggacaagaaacauaggcauagaaucagagauaccuaaccuggauauaauaggcaaaagaauugagaagauuaaacaagaacacgaaacaagcuggcacuacgaucaagaucacccuuauaaaacaugggcguaucaugguucauacgagacuaaacagaccggcucagcuucgucuauggucaacggcguaguuagguugcucaccaaaccuugggacguaguaccaauggugacacaaauggccaugaccgacaccaccccauucggccaacagcgcguauucaaagaaaagguagauacgcgaacccaagaaccuaaagaagggacuaagaaauuaaugaagauuaccgcugaaugguuauggaaagaacuggggaagaaaaagacaccaagaaugugcacgagagaggaauuuacuagaaagguucgauccaaugcugcucucggagccauauuuacagacgaaaauaaauggaagagugcgagggaagcuguugaagacucgcguuucugggaauuaguugauaaagaacgaaauuuacacuuggaagguaaaugugaaacauguguuuauaacaugaugggaaaaagagagaagaaauuaggggaguucgguaaagcaaaagggucucgagcuauaugguauauguggcuaggagcgcgauuucucgaguucgaggcguugggcuuuuuaaacgaggaccauugguuuagccgugaaaacucauuaucgggcguugaaggcgagggauugcauaaacuuggauacauucuucgcgauguaaguaagaaagaaggcggugccauguacgcagaugauaccgcugguugggacacacgaauuacucuagaagaccuuaaaaaugaagagauggucaccaaucauauggagggcgagcauaagaaauuagcggaggccaucuucaaauuaacuuaucaaaauaaaguaguucgaguccaaagacccacuccgagggguacaguuauggacauuauaucucgcagagaucaaagaggaaguggccaagugggaacuuaugguuuaaauacauuuacuaauauggaagcgcaauuaauccggcaaauggagggagaaggcguauuuaaaucaauacaacaucuuacuguaacugaagaaauugcuguacaaaacuggcuagccagaguaggccgagaaagauuaucacgaauggcgauaaguggggaugauuguguugugaagccauuagaugaccgauuugcgucagccuuaacugcuuuaaaugauauggguaaagucaggaaagacauccaacagugggaacccagcagaggauggaaugauuggacccaaguuccauucugcagccaccacuuccaugagcucauaaugaaagacggaagaguacuugucguaccuugcagaaaucaagaugaacuaauaggacgcgccaggauuagucagggagccgguuggucauuaagagagacagcuugcuuaggaaaaucauaugcgcaaauguggaguuuaauguauuuucacaggagggaccuuaggcuugcggcuaacgcgauauguucagcgguaccaagccauuggguaccaacaagccgaacuacauggaguauccaugcaaaacacgaauggaugaccgcugaagauaugcuuacaguauggaaccgaguauggauccaagaaaauccauggauggaagauaaaacaccuguagaaucuugggaagaaauuccuuaccuggguaaaagagaagaucaaugguguggcucacucaucggauuaacuucaagagcuacgugggcgaaaaacauucaaacggcaauaaaucagguuagaagccuaauugggaacgaggaguauacugauuacaugccaaguaugaaacgcuuuaggcgagaggaggaagaggcaggaguucuaugguaa

SEQ ID NO: 22612 - RNA, 9876 nt, Artificial Sequence
  derived and/or modified CDS sequence (opt6) from DENV-2__EU529706__SS-prME
accgccggagucaucauaauguuaauacccacggcaauggcuuuucaucuaacaacacgaaauggagagccgcauaugauuguaggaaggcaagaaaaaggaaagucauuacuauuuaagacggaggaugguguaaauauguguacgcuuauggccaucgaucuaggggaacuuugcgaggauacgauuacauauaaauguccauuacuuagacaaaacgaaccagaggauauugacugcuggugcaauucgacaagcacuugggugacguacggcaccuguacuacuacaggggaacaccgucgagaaaaaagaucaguagcccuaguaccccauguugguaugggauuagaaacaaggacggaaacuuggauguccucagaaggggcguggaaacacguacaaagaauagagacuuggauauuaagacauccaggauuuacaauaauggcagcuauacuagccuauacgauugguacaacacauuuccagagggcuuuaaucuuuauucuacuuacagcuguggcacccucgaugacaaugagaugcauuggaauaagcaaucgagauuuuguagagggggucagcgguggaucauggguugacauaguacuugaacacgguuccugugugacgacaauggcaaaaaauaaacccacguuagauuuugagcugaucaagaccgaagcaaaacaaccugccacauuacggaaauacugcaucgaagcaaaauuaacgaauacaacuacagaaagccguugcccaacccagggugaaccgagcuuaaaugaagaacaagacaaaagauuuauuugcaaacacucaaugguugaucgaggaugggguaacggauguggcuuauuugggaaaggcggcauuguuacgugcgcaauguucaccugcaagaaaaacauggaagggaaaguaguacaaccggaaaaucuggaguacacaauuguaauuacaccacacaguggugaagagcaugcgguuggaaaugacacuggcaaacacggaaaagaaaucaagaucacaccgcaauccucaauuacggaggcagaauuaacgggauacggaacagucacaauggaaugcucacccagaacaggcuuagacuucaacgaaaugguucuauuacaaauggaagauaaggcaugguugguucaucgacaaugguuuuuagauuuaccacugcccuggcuaccaggcgcggacacucaagggagcaacuggauacagaaagagacauuaguaacauuuaaaaauccacaugcaaaaaaacaagaugugguaguucugggaucacaagaaggagcaaugcacacagcacuaacaggagcaacagaaauacagaugucgagcgguaaucucuuauuuacuggacaucugaaaugcagauuacgcauggacaaauuacaguuaaaaggcaugaguuauuccaugugcacagggaaguucaaaaucgucaaagagauagcugagacucaacacggcacgauagugauccgaguacaguacgaaggagauggcucuccauguaaaauccccuucgagauuauggaucuagaaaaacgucauguucuaggcagguuaauaacaguuaacccaaucguuacugaaaaggauucuccuguaaacauagaagccgagccaccguucggugacaguuacauaauaauaggcguagaaccuggacaacuuaaauugaacugguucaagaaagggaguucaauaggucagauguuugaaacaacaaugcgaggagcuaaacgaauggcaauuuugggcgauacagcgugggauuuuggcucuuugggugggguuuucaccucuauagggaaagccuugcaccaaguauuuggcgcaaucuacggagcagcuuuuucaggugugucguggacaaugaaaauauugaucgggguuauaaucacauggaucgguaugaauagcagaucgaccucacucucaguguccuuagugcucgucgguguaguaacacuauauuuaggaguaaugguucaagcggauaccggauguguaguaucuuggaagaauaaagaacuaaaaugcgguuccggaauauucauaacugauaaugugcauaccuggacagaacaauacaaauuccagcccgaaagcccaucgaaauuggccucggcuauccaaaaagcgcacgaggaggguauaugugguauucgaucaguaaccagacuagagaaccuaauguggaaacaaaucacuccggaauuaaaccauauuuuaucugaaaacgagguuaaacuaacuaucaugacaggagauauaaaaggaauaaugcaggccgguaaaaggucacuuaggccacaaccuacggaauugaaauacagcuggaagacauggggaaaagcuaaaaugcucuccacggaaucgcacaaccaaacuuuccuaauagaugguccagagacagccgagugcccaaacacaaacagggccuggaauucauuagaaguugaggauuacgguuuuggagucuuuucaacuaauauauggcuaaaacuucgugaaaaacaagauguauucugcgacaguaaguuaaugagcgcagccauaaaagauaaucgagcuguccacgcagacaugggauacuggaucgaaucugccuugaaugacacguggaaaauggaaaaggcaaguuucaucgaaauaaaaucaugucauuggccaaaaagucacacauuauggucgaacggaguccuagaaagugaaaugauaauuccaaagaauuucgcagguccgguuucccaacauaacuaucgacccggguaucauacacagacugcgggcccguggcaucuugggaaauuagaaauggacuuugacuuaugcgaagggacaacaguuguaguaacggaagauugcgguaaccgggggccaagccuucgcacaacaacggcaaguggcaaacucauuaccgaauggugcuguagaagcugcacauuaccgccauuacgauauagaggcgaagacggauguugguauggaauggaaauuagaccauuaaaagaaaaagaagaaaacuuaguaaauucacuaguaacagccggucauggacaaauagauaacuucagucuaggcguacucggcauggccuuauuuuuagaagaaaugcugcgaacaaggauugguacgaaacacgcaauucuauugguugccgugagcuuuguaacguuaauuacaggcaauaugucauuucgggauuuaggucguguaaugguaaugguuggggcaaccaugacggaugauauagguauggguguaacauaccuugcauuacuugcggcuuucaaagugaggccaacauuugcggcaggacucuuacuacguaaacugacaucaaaagaacugaugauggcaacaauugguauagcacuauuaucccaaucuacgauaccagaaacaauuuuggaguuaacggacgcacuagcauuaggaaugaugguauugaaaauaguaagaaauauggagaaauaucaacuagcuguaacuaucauggcaauaaguugcguaccuaacgcagugauacugcaaaacgccuggaaaguaagcugcacgauacuagcugcgguaucaguaucuccgcuccugcuaacaucaucccagcaaaaagcugacuggauaccgcuggcccuaacaauaaaaggcuugaacccaacugcaauauuucuuacaacgcuaucuagaacaucaaaaaaaagaaguuggccucuuaaugaagcagucauggcgguuggaauggugagcauucuagcaagcaguuuacuuaaaaaugacauaccaaugaccggaccacuagucgcuggaggccuuuugacagucugcuacguacugacuggacgcagcgccgacuuagaauuagaaagagcugccgauguuaagugggaggaccaagcagagauaucaggcucaucgccgauucucucuauuacuauuucagaagauggaagcaugucaauaaagaaugaagaggaagaacacacgcucacuauuuuaauaagaacagggcuguugguaauaucaggugucuucccugucucgauccccaucaccgcagccgcaugguaccuaugggaaguaaaaaaacagagagcugguguguugugggaugucccgucgccuccgccaguagguaaagccgaacuagaggacggagcauauagaauuaaacaacggggcauauuuggcuacagucaaauuggugccggggucuacaaggaaggaacauuucauacgauguggcacguaacacgaggagcugugcucaugcauagagguaaacgaaucgagccgucuugggcagaugugaaaaaagacuuaauaucauacggaggaggguggaaacuugaaggagaauggaaggagggggaagaaguccaaguucuagcuuuagaacccggaaagaacccgcgggcuguucagaccaaaccaggauuauuuaagacaaauaccgguacuaucggcgcuguaagucuugauuucaguccuggcaccagugggaguccgauuguagacaggaaaggaaaggucguaggacucuacggaaacgguguaguuaccaggaguggagcuuaugucagugcaauagcacagacagaaaaaaguauagaagauaauccagaaauugaagaugauauuuuucgaaaaaagcgauuaacaauaauggaccuccacccuggugcaggaaaaacaaaaagguauuugccagcgauuguuagagaagcaauuaaaagaggucuaaggaccuuaauauuagcuccgacccgaguuguagcagcagaaauggaagaagcguugcgaggacuuccuauaagauaucagaccccggcgauaagggcagaacauacaggacgagagauuguagauuuaaugugccacgcgacauucacuaugagguuacucagcccuguaagaguaccgaauuacaaccugauaauaauggacgaagcacacuuuacggaccccgcaucuauugccgcgagaggauauauuagcacuagaguggaaaugggagaagccgccggaauauucaugacagcgacgccuccggggucucgugauccauucccacaaucgaacgcuccaauaauggaugaagagcgagagauccccgaacgaaguuggaauagcggucacgaaugggucacagauuuuaaagguaaaacaguaugguucguaccaucgauaaaagcaggaaaugacauagcagccugccuaagaaaaaacggaaagaaaguuauacaacucucucggaaaacauucgacagugaguacguuaagacuagagccaaugacugggacuuugucguaacuacugauauaucugaaaugggagcaaacuuccgugccgagagggucauagauccgcgcagauguaugaaacccguaauucuaacagauggagaagaaagggugauauuagcgggccccaugcccgucacucacucaagcgcugcacaaagacgugguagaauaggaagaaauccaaaaaacgaaaaugaucaauauaucuauaugggcgaaccuuuagaaaaugaugaagauugcgcucauuggaaggaggcuaaaaugcuauuagauaacauaaauacacccgaaggaaucauccccagcauguuugaaccggaaagagaaaaaguagacgccauugauggagaauauagacuaagaggugaggccaggaaaacguuuguugaucuuaugagaaggggcgauuugccaguaugguuggcauauaggguugcagcagagggaauaaauuaugcggaucguagaugguguuucgacggaauaaaaaacaaucaaaucuuagaagagaacguugaaguugaaaucuggacuaaagaaggcgaaagaaaaaaauugaaaccaagguggcuagaugcccgaaucuacucagauccgcuugcguugaaagaauucaaggaauuugcagcaggacgcaaaucauuaacacuaaaucugauuacugaaaugggcaggcuuccuacguuuaugacucaaaaagcacgugaugcauuggacaaucuggccguucugcauacugcggaaguuggaggccgagccuauaaucacgcacuaagugaacuuccagagacgcucgaaacguuauuacuacuuacacuuuuagccacgguuacuggagguaucuuccuuuuucuaaugucuggaaaagggaucggaaaaaugacacuaggaaugugcugcauaauaacagcgucaauucuuuuaugguacgcacaaauacagccccacuggaucgcagcaucaauuaucuuggaauuuuuucuaauuguauuacugauacccgaaccagaaaaacagcgaacgccacaagauaaccagcugaccuaugugguaauagcaauuuuaacaguagucgcggcuaccauggccaacgaaaugggauuuuuagaaaaaacuaagaaagaccuuggcuuaggcucaaucacgacucaagaauccgaaucuaacauauuggauauagauuugagaccugcgucugcguggacgcuuuacgcaguugcaacaacguuuguuacaccuauguugagacauuccauugagaauagcucugucaaugucucucuuacugccauugcaaaucaggcaacggugcuuaugggccuaggaagaggauggccauuaucuaaaauggacauaggaguaccacuguuagccauagguuguuauucgcagguaaauccaauuacccuaacugcugcacugcucuuacuaguugcucauuacgcuauaaucgguccaggacuacaggccaaggcaacaagagaggcacaaaaaaggaccgcugcgggcauaaugaaaaacccuacaguggacggaauaacuguuauugauuuagaaccuauaccauaugaccccaaauucgaaaaacaacuagggcaaguaauguuacuaguauugugcgugacacaaguauuaaugaugcggacaacuugggcacugugcgaagcauuaacucuugccacuggucccauaucgacacugugggaaggaaacccaggucgguuuuggaauacgacuauugcgguguccauggccaacauauucagaggaucauaccuagcgggcgcuggcuuauuguuuucaauaaugaaaaauacgacaaacacaagacgaggaacgggcaauauaggggaaacucuuggagagaaauggaaaagccggcuuaaugcucuuggaaagucugaguuccaaauauauaaaaaauccggaauacaagaagucgacagaacucuagcaaaagaagguauaaaacgaggcgaaacugaccaucaugcgguaaguagagggucugcgaaguuaagaugguucguugaaagaaauaugguaacaccagaagguaaaguaguagaucugggaugcgggagaggaggauggucguacuauuguggggggcuaaaaaauguaagggagguaaaaggauuaaccaagggcgguccaggucacgaagaaccuauucccaugaguaccuauggcuggaacuuggucaggcuucaaucagggguggaugucuuuuucacgccaccagaaaagugugauacuuugcuuugcgauauuggggaaagcucgccuaauccgacuguagaggcagguagaacgcuaagaguccuuaauuugguggaaaacuggcuaaacaauaauacccaauuuugugucaaagucuuaaauccguauaugccgucagucaucgaaaagauggaagcacuacaaaggaaguacgggggagcacuaguaaggaauccccugucacgaaacucaacacaugagauguacuggguguccaacgcgaccgggaauaucguuucaucgguaaauaugauaagcagaaugcuaauaaaucgauuuaccaugaagcauaagaaggcgaccuacgaacccgacguagauuuggguuccggaaccagaaauauuggaaucgaguccgaaauucccaaucuugauauuauagguaaacgaaucgagaaaauaaaacaggagcaugagacgagcuggcacuacgaucaagaccacccuuauaaaacgugggcuuaccauggcucguaugaaacgaaacagacuggaucggcgaguucuauggugaacgggguagucaaacuucucacaaaaccaugggauguaguaccuauggugacucaaauggcaaugacugauacaacuccauucggucaacaaagaguguucaaagaaaaagucgauacuagaacccaagagccaaaagaaggaaccaagaaacucaugaggaucacugcagaaugguuauggaaagagcuuggccgaaagaaaacucccagaauguguacaagagaagaguucacaaggaaagucaggucaaaugcugcacugggugcaaucuuuaccgaugaaaacaaauggaaauccgcgagagaagcgguugaggauucaagguuuugggagcuuguugauagagaacggaacuuacauuuggaaggcaagugcgaaacuuguguauacaacaugaugggcaaacgagaaaagaaacuuggugaguuuggaaaagcaaaaggcagucgcgcaauuugguauaugugguuaggcgcaagguuucuagaauuugaagcguugggcuuuuuaaacgaagaucacugguuuucccgagguaauuccuuauccggagucgaaggagagggcuuacauaaacuagguuacauacuaagggauguaaguaaaaaagaagggggggcuauguaugcggacgacacggcaggaugggauacgcgaauaacucuagaagacuuaaaaaacgaagaaaugguuacaaaucauaugaaaggagaacauaaaaaauuagcagaagcuauuuucaaacugacauaccagaauaaaguuguacggguacaaagaccuacaccacgcggaacggugauggacaucaucagcaggaaagaccaaagaggcucaggccaaguugggacuuauggauuaaacaccuuuacaaauauggaagcucaauuaauacgacaaauggaaggugaggguauauuuaaaaguauucaacgacugacgguaaccgaggaaauagccguacaaaacugguuggccagaguagggcgagaaagauuaucaagaauggccauuaguggcgaugacuguguuguaaaaccucuagaugaccgauuugcaagugcuuuaacugcgcugaaugauauggguaaaguaagaaaagacauacaacaaugggagccaagcaggggcuggaaugacuggacucaaguucccuucuguucacaccauuuucaugaacuagucaugaaagacggccgaguauuggucgugccauguagaaaucaggaugaguuaauagguagagcgagaauaucucaaggagcaggcuggucgcuaaaagagacagccugucuuggaaagucuuacgcacaaauguggacguuaauguauuuucauagacgugauuuacgacuugccgcaaaugcaauauguucugcggucccaucgcacugggugccaacaucacgaacaacuuggaguauccaugcgaaacaugaauggaugacaacagaggauauguuggcaguuuggaaucgcguuuggauacaagaaaacccauggauggaagauaaaacaccaguggagaguugggaagaagugccguaucucgggaaaagggaagaucaauggugcgguucccuuauaggacuaacgaguagagcaacaugggcuaaaaauauacaaaccgcaauaaaucaaguuagaucacuuauaggaaacgaggaauauacggacuauaugccaucaaugaagagguucagaaaagaagaggaggaagcagguguuuuaugguaa

SEQ ID NO: 22613 - RNA, 9876 nt, Artificial Sequence
  derived and/or modified CDS sequence (opt6) from DENV-2__EU482720__SS-prME
accgcgggugugauuauuauguuaauuccaacagcaauggcauuucacuuaacuacacguaacggagaaccccauaugauagucggaagacaagaaaaagggaaaucacuacuuuuuaaaacagaagacggaguuaacauguguacacuaauggcaauagauuuaggugaauuaugugaagauaccauaacauacaaauguccauuauugcgucaaaaugaaccugaagauauagauugcugguguaacagcacauccacuugggugacauacggaacuuguacuacaaccggagaacacagacgagagaaaagaucgguagcgcuuguaccacacguugggauggggcuagaaacucgaacugaaacuuggaugucaagugaaggugcguggaaacauguacaaaggauugaaacguggauauuacgucauccugguuucacuacaauggcagcaauucucgccuauaccauugguacgacccacuuucaaagggccuuaauauucauauuauuaacagcgguagcaccaagcaugacuaugagaugcauagguauaaguaacagggacuucguagaaggaguaagugggggauccuggguggacauaguucuagaacacggaagcugcgugacgacuauggccaaaaauaaaccuacacuagauuuugaacugauaaaaacagaagcgaaacaaccagcgacucuuagaaaauacugcauagaagcaaaacugacaaacacuacaacagaaagccgauguccuacgcagggugaaccuucacuuaacgaagaacaagacaaacgauucauauguaaacauaguauggucgauagagguuggggcaauggauguggacucuuuggcaaaggaggaaucguaacaugugcaauguuuacaugcaagaaaaacauggaaggaaaagucguuuugcccgagaacuuggaauacacaauuguaauaacuccccauucgggugaagaacacgccgugggaaacgauaccgguaaacauggaaaagaaaucaaaauuacaccucaaucuucgauuaccgaagcugaauugacaggcuaugguacuguaacgauggaaugcucgccccgaacgggacuugauuucaaugaaaugguucuucuccagauggaagauaaagccuggcugguucaucgacagugguuucuagauuugccgcuccccuggcuaccuggggcugacacccaagguucuaauuggauacaaaaagaaacucuaguaacauucaaaaacccucaugcgaagaaacaggauguagugguucucggaagucaagaaggggcaaugcauacagcguuaacaggcgcuaccgagauucaaaugucaagugguaacuuacuguucaccggacaucuaaaaugcagacuuagaauggauaagcugcaacuaaaagguaugaguuauaguaugugcacuggaaaauuuaagauaguuaaagagauugcagaaacucagcacggcacuauaguuauccgaguacaauaugaaggagauggaucuccgugcaaaaucccauuugagauaauggaucuagaaaaacggcacguauuaggaaggcuaaucacagucaauccaauagcaacggaaaaagauucaccaguuaacauugaagccgaaccuccauuuggagacagcuauauaauuaucgguguagagccaggccaguuaaaauuaaacugguuuaagaaagggucgucaauuggucaaauguuugaaacuacaaugagaggagcuaaaagaauggccauacucggugacacugccugggauuuuggaucgcuuggaggggucuucacaaguauagguaaggcccuacaucagguauucggagccauauauggugcugcuuuuagcggaguauccuggaccaugaagauuuuaaucgguguaauuauuacuuggauaggaaugaauagucgcuccacaucgcuaucagugagccugguauuagucgguauuguuacucuuuacuuaggcguaauggugcaagcagauacaggaugcgucguaucauggaaaaauaaagaacuuaagugcggcucagggauauuuauuacugacaauguucauaccuggacugaacaauauaaauuucaaccagagucucccucaaaguuagcaagugcaauucagaaggcucaugaggaaggcauuugcggaauuagaucaguaacaagacuagaaaaucuaauguggaaacaaauuacacccgaacugaaucacaucuugucggaaaaugagguuaaauuaacaauaaugacaggcgacauaaagggaauuaugcaagcgggaaaaagaagucuacgaccacagccgacagaauugaaauacaguuggaaaacgugggguaaagccaaaauguugucuacagaaucucauaaccaaacuuuucuaaucgacggaccugaaacugcggagugcccuaacacuaauagagcuuggaacucacuagaaguagaggacuacggauucggaguauuuucuaccaauauuuggcugaaauuaagagaaaaacaagauguguuuugugacaguaaauuaaugucagcagcuauaaaagauaauagagcuguucacgcggauaugggauauuggauugaauccgcgcucaacgauaccuggaagauggaaaaggcgagcuucauugaaaucaagucaugucacuggccgaagucucauacuuuaugguccaaugguguacuagaaagcgaaaugauaauaccgaaaaacuucgcuggaccuguaagucaacauaauuacagaccuggauaucauacgcaaacugccggaccauggcauuuaggaaagcuagagauggauuucgacuuuugcgaaggaacuaccguggugguuacugaagacugugguaacagaggcccuagucuaagaacgacgacagcgucugguaaguugauuacggaguggugcugccgcucauguaccuugccaccguuaagguauaggggcgaagauggcuguugguacggcauggagauuagaccgcucaaagagaaagaggaaaaccugguaaauagcuuagucaccgcugggcauggucaaauagacaauuucagccuaggaguauuaggaauggccuuauucuuagaagaaauguugagaacuagagugggcacaaaacaugcaauuuuacugguggcugugaguuuuguaacccugauuacuggaaauaugucauucagggaucuaggcagaguaaugguaauggugggagcuacuaugaccgaugauauuggcaugggaguaaccuauuuagcucuuuuagccgcauucaagguucgaccaaccuuugcugcaggccugcuacuacguaaacucacaaguaaagaauugaugauggcuaccauuggaauagcauuguugucucaauccacgaucccggaaacgauacuugagcuaacugacgcccuagcgcuuggaaugaugguacuaaaaauuguacguaauauggaaaaauaucaacuugccguaacaaucauggcaauaucgugcguuccgaaugccguaauacuacaaaacgcauggaaaguaucauguacaauccuagcagcgguuaguguaucuccauuauuacuaacaucuucacagcaaaaagcugauuggauuccgcuagcgcuaacuauaaaggggcuaaacccaacggcuauauuucuuacaaccuuaucccguacaucgaagaaaagaucuuggccacuaaaugaagccguaauggcaguaggcaugguuucaauucucgccucgucguuacuuaaaaaugacauaccaaugaccgggccacugguagcgggaggcuuacucacgguauguuacguuuugacaggaaggagugcagaucuagagcuagagaaagcagcugacgugaagugggaagaccaagcagaaauaagcggcucaucacccauccugaguaucacuauaagcgaagaugguagcaugaguaucaaaaaugaagaagaagaacauacacucacgaucuugauacggacugguuugcucguaauauccgguguuuuuccaguaucaauuccaauaacagcggcagcgugguaucucugggaagugaagaaacaacgagcugggguucuaugggauguacccagcccacccccggucgggaaagcagaacuagaagauggcgccuaucgaauuaaacaaagaggaaucuuuggauacagucaaauaggggcaggaguuuauaaagaggguacauuccacacuauguggcaugucacaaggggcgcgguuuugaugcauagggggaaacggauagagccuaguugggcagaugugaagaaagacuugauaagcuauggaggcggauggaagcuagaaggcgaauggaaagaaggagaagaaguacaagugcuggcacuagaaccagggaagaacccacgugcuguacaaacaaaaccggguuuauuuaaaacuaauacaggaaccaucggagcagucucgcucgauuucucaccaggaacaagcggaucacccauuguagacaggaaaggaaaaguugugggucuauacgguaauggaguugucacuagaucaggugcguacguuagugcaauagcacaaacagagaaaucaaucgaagacaaucccgaaauagaagacgauauuuuucggaagaagcguuuaacgauaauggaccuccacccaggagcaggaaaaacaaaaagauauuugccggcaaucguccgggaggcaauaaaaagaggauuacgaacauuaauauuagcaccaacccguguaguugcugcagaaauggaggaggcuuuaagaggauuaccgauacguuaucagaccccggcaauuagagcugaacacacugguagagaaauaguagacuugaugugucaugccacauuuacaaugagacuacucaguccagugagaguaccuaauuauaacuugauaauaauggacgaagcccauuuuacagauccugcuucaaucgcagcucggggauacauaucaacacgaguggaaaugggagaggcagcuggaaucuucaugacagcgacaccuccaggaucacgcgauccauuuccacaaucuaacgccccaauaauggaugaagagagagagauacccgaacgaucauggaacucaggacacgaaugggugacagacuucaaggggaagacaguaugguuuguaccaucaauuaaggcaggcaaugauauugcugcuugcuugaggaaaaaugguaagaaaguaauacagcugucgaggaaaacauucgacucugaauaugugaagacacgugcaaacgauugggauuucguaguuacaacugacauaagugagaugggagcaaauuuuagagccgaacgaguaauagacccuagacgaugcaugaaaccaguaauauugacagauggagaagaaagagucauacuggcaggaccaaugccaguuacccacuccagugcugcucaaagacgaggcagaauugguagaaacccuaagaacgaaaaugaucaauauauauauaugggugaaccacuagagaacgaugaagauugcgcucacuggaaagaagcaaagaugcuauuagauaacaucaauaccccagagggaauaauccccaguauguuugaaccugaaagagaaaaaguagacgcaaucgauggugaguaucgacuuaggggagaggcgcguaaaacauuuguggaccuaaugagacgaggggaucuaccaguaugguuggcguaccguguagcagccgaggggauuaauuaugcagaccgccguugguguuuugaugguaucaaaaauaaucagauacuagaagagaacguugaaguagaaaucuggacaaaagaaggcgaaagaaagaaauuaaaaccgcgauggcuagaugcaagaacauauagugacccacuugcacugaaagaauuuaaagaauuugcagcagggcgaaaaaguuuaacacuaaaucuaauaacagagaugggacgcuugcccacuuucaugacucaaaaagcucgggaugcguuggauaauuuagcuguauuacauacggcagaaguaggggguagggcuuacaaccaugcgcuaagcgaauugccagaaacucuagagacauugcuacucuuaacacuuuuagcgaccgucacuggaggcauauucuuauuucugaugucaggaaaagguauaggcaaaaugacauuggguaugugcugcaucauuaccgcaucgauucuguuaugguaugcacaaauucaaccacauuggauugccgcuucgauaauccuggaguucuuucugauuguauuguuaaucccagagccugagaaacaacggacaccacaagauaaccaauugacauaugugguuauagcaauuuuaacaguuguggcggcaacaauggcaaacgaaaugggguuccuagaaaagaccaagaaagaccuaggucuaggaucaauaaccacccaagaaucugaaagcaauauacuagauauagaucuaaggccagcauccgcauggacacuuuacgcaguagccacaacguuugugacaccuauguuaagacacucaauagagaacuccucgguuaauguaucauuaacugcgaucgcgaaccaagcgacaguacuaaugggccuaggaagagguuggccccuaucuaagauggacaucggaguuccucuacuagcaauugguugcuacucacagguaaauccuauaacauuaacggcugcucucuuauuguuaguagcgcacuaugccauaauaggucccggacuacaggcuaaagcaacuagagaagcucagaaaagaacagcagccggaauaaugaaaaauccaaccguagacggcauaacuguuauagaccuggaaccgauucccuaugacccuaaguucgaaaaacaauuaggacaagucauguugcuaguacucugcguaacacagguauuaaugaugaggacaacaugggcacucugugaggcacugacuuuagcuacuggcccaauaucaacauuaugggaagggaacccuggccgcuucuggaauacaacgauagccgucucaauggcaaauauuuucagaggcagcuacuuagcaggcgccggcuuauuauucaguauaaugaaaaauacaaccaauacaagacgagguaccggcaauauuggagaaacucuuggggaaaaguggaaaagccgauugaaugcacuagguaaaucggaauuucaaauauacaagaagagugggauacaagagguagauagaacguuagcaaaagaagguauuaaacgaggggagacagaccaccacgcagucagcaggggaagugcuaaacuaagaugguucguugaaaggaauauggugacacccgaagggaagguaguggaucugggaugcggccgaggaggguggucauacuacugugggggccuaaagaauguacgagagguaaaaggcuuaaccaagggaggcccaggacaugaagaacccauaccaaugucaaccuauggcuggaacuugguaagguuacaaagcgguguugauguguucuuuacgccgccagaaaaaugugauacguuauugugugauauuggugaaucaucaccgaacccaacaaucgaagcgggcagaacccucagaguacuaaauuuggucgaaaauuggcugaauaauaauacacaauuuugcguuaaaguccugaacccuuacaugccaaguguaauugagaaaauggagacuuuacaacguaaauaugguggugcgcuagucagaaauccuuuaucaagaaacucaacacacgaaauguauuggguaaguaacgcgacagguaacauuguuucaucaguaaacaugauaucaagaaugcuaauaaacagauucacuaugaagcauaagaaagcuacauacgaaccagauguagauuuaggcucaggaacucggaauauaggaauagaaaaugaaauuccaaaccuagauauaauuggaaagagaauugagaaaauaaaacaggaacaugaaacuucauggcauuaugaccaagaucacccauacaagacaugggcuuaccacgguaguuacgaaacgaagcaaacuggcagugcuucaaguaugguaaaugguguugugaaguuacuaacaaaaccgugggacguuguucccaugguaacgcaaauggccaugacugacacgaccccguucggccaacaaagaguauucaaagagaaagucgauaccaggacucaagaaccaaaagaagggacgaaaaaguuaaugcguauuaccgcggaaugguuauggaaagaguuaggcaagaagaaaacccccagaauguguacaagagaagaguucacgagaaaaguucgcaguaacgcugcgcuaggugcgauauuuacggaugaaaauaaguggaaaagugcuagagaagcagucgaagacagucgauucugggaauugguugaucgagaaagaaauuuacauuuggaaggaaaaugugagaccugcguauacaauaugauggguaaaagggagaagaaacuuggagaguucgguaaagcaaaaggcucaagggcuauuugguacauguggcuuggugcgcgauuuuuagaguucgaagcacuaggcuuuuugaaugaggaucauugguucucccgaggaaauucuuugagcgggguagaaggagaaggccuccacaaauuaggauauauacuaagagauguuuccaagaaggaagggggcgcgauguaugcagacgacacugccggaugggauacacguauuacccucgaggaucucaaaaacgaagaaaugguaaccaaccauaugaaaggagagcauaagaaacuugcagaggccaucuuuaaauugaccuaucaaaauaaagucgucaggguacaaaggccuacgccaaggggaacagugauggacauuaucagcagaaaggaccaaagaggaagcggacaaguugggacguaugggcuaaauacguucacgaauauggaggcacagcuuauccggcagauggaaggggaggggauuuucaaaagcauacaaagauuaacaguuaccgaagagauagccguucaaaauugguuagccagagugggccgggaacgacuaaguagaauggcuauaaguggugaugacuguguaguuaaaccauuagacgauagauucgccucagccuuaacugcccuaaaugauaugggaaaaguaagaaaggauauucaacaaugggaacccucaagaggauggaaugauuggacacagguaccuuuuugcagccaucauuuucacgagcuagucaugaaggacggaaggauguuaguuguucccuguagaaaccaggaugaauugauaggcagagcgcguauuagucaaggugcugguuggagcuuaaaagaaaccgccugccuugguaagucguaugcucaaauguggacccuaauguacuuccauagaagagaucuaagacuggccgcuaaugccauaugcucugccgugccaucacauuggguucccacaucucgaaccacauggaguauacaugcaaaacaugaauggaugacuacagaggauaugcucgcaguguggaauagggucuggauccaggaaaacccuuggauggaagauaaaacacccguagaaucaugggaagaagucccauaucuggguaagagggaggaccaauggugcgguuccuugauuggauugacuucccgagccacaugggcuaaaaacauacaaacagccauuaaucaaguucgaucccuaauugguaaugaggaguacacggauuauaugccgaguaugaagcguuuuaggaaagaagaggaggaagcaggagucuuaugguaa

SEQ ID NO: 22614 - RNA, 9876 nt, Artificial Sequence
  derived and/or modified CDS sequence (opt6) from DENV-2__EU482721__SS-prME
acagcugguguaaucauaaugcuaaucccaacagcaauggcauuucauuuaacaacgagaaacggagaaccacauaugauuguaggcagacaagaaaaaggaaaaagccuacuauuuaaaacugaagacggugugaauauguguacuuugauggcaauagaccuaggagaauuaugcgaagacacuauaacguacaaaugcccucuguugagacaaaaugaaccugaagauauagacugcugguguaacucgacuucaacauggguaacguaugguacguguacuacaacaggagaacacagaagagaaaaacgcucaguagcucuuguuccccauguggguaugggauuagaaacucgaacggaaacauggaugucaagcgagggagcuuggaaacacguacaacggauagagacuuggauccucagacacccagguuuuacgacaauggcagcgauccuugcuuauacuauuggaacaacucacuuucaaagagcauuaauauuuauacugcuaacagcaguagcaccaagcaugacuaugcggugcaucggcauuaguaaucgagauuucguugaggguguaagugguggcagcugggucgauaucguacucgaacacggauccugcguaacaaccauggccaaaaauaaaccgacuuuagauuucgaacuaauuaaaacggaggcaaaacaacccgcaacacugcgcaaauauuguauagaagcaaaacuuacuaacaccaccacagagucccguugcccaacacaaggagaaccuaguuugaaugaagaacaagacaaaagauucaucuguaaacauucuaugguagauaggggguggggaaacggaugcgguuuauuuggaaaaggagggauuguaacaugugcgauguucacguguaagaaaaacauggaaggaaaaguaguacaaccugaaaaccuggaauacacaaucguuauaacgccccauagcggagaagaacaugcuguugggaacgauacagguaaacaugggaaagagauaaaaauaacaccacaaucgucuaucaccgaagcggaauuaacgggguauggaacgguaacaauggaauguucaccaagaacaggguuagauuucaaugaaaugguucugcuacaaauggaagauaaggcauggcuaguucaucgacaaugguuucuugaucuuccgcuaccguggcuccccggcgcagauacacaagguagcaauuggauacagaaagaaacucuuguuacuuucaaaaacccacaugccaagaaacaggauguagugguucuuggaucacaagaaggggcaaugcauaccgcacuuacgggugcuacggaaauacaaauguccucgggaaauuuauuauuuacuggucauuuaaaauguagacuuagaauggacaaacuacaauuaaaagguaugucauacucgauguguacuggcaaauuuaagauaguaaaagaaaucgcugaaacacagcacggaacuaucguaauuagaguccaauaugaaggcgacgggaguccaugcaaaauccccuucgagaucauggauuuagagaaaagacauguacucggucguuuaauaacagugaacccuauaguuacggagaaagacucuccuguaaacauagaagcagaaccucccuucggcgauuccuauauuauuauaggcgucgagccuggucagcucaaauuaaacugguuuaagaaaggcaguucuauuggucaaauguucgaaaccacaaugcgcggggcuaaacggauggcuauacuaggcgacaccgcuugggauuuugggucauugggcggagucuuuacgucaauuggaaaggcauuacaccaggucuucggagcuauuuauggagcagcguucagugggguaagcuggacuaugaaaauauugauaggugugauaauaacauggauugguaugaauagcagaaguacgagccuuucaguuucccuaguauugguuggaaucguaacacuauaucuuggagucaugguucaagcugauacagguuguguaguaucauggaagaacaaagaauugaaaugugggaguggcauuuuuauuacagauaacguacacaccuggacagaacaauauaaauuucaaccagaauccccaaguaaauuagcuagugcuauucagaaagcacaugaagaaggaauauguggcauuaggucaguaaccaggcuugaaaauuugauguggaaacaaauaacaccugaacuuaaucauauucugucagaaaacgaaguuaaauugacaauaaugaccggggauauuaagggaauaaugcaggcgggcaaaaggucucuucgaccccagccuacugaauuaaaauauucuuggaaaacaugggggaaggcaaaaaugcuaagcacugagucccacaaucaaaccuuccucauugauggucccgaaacugcagaguguccaaauacaaaccgagcauggaacucauuagaaguugaagauuacggguucgguguauucagcacaaauaucugguuaaaguugagggaaaaacaagauguauuuugcgacucaaaacucaugucagcugcaaucaaagacaaucgugcgguucacgcggacaugggcuacuggauagaaucugcguuaaaugauacguggaaaauggaaaaagcaucauuuaucgagaucaagaguugucacuggccaaaaucucacacauuauggagcaacgguguccuagaaucagaaaugauuauucccaagaacuucgcaggucccguaagucaacauaacuacaggcccgguuaucauacacaaacugccgggccuuggcaccucgguaaauuagagauggauuucgauuucugugagggaacaacaguggucgucaccgaggauugcgguaaucgagguccgagccuucgaaccacaacugcgucugguaagcuaauaacagaauggugcugucguuccugcacauugccaccuuugcgauacaggggcgaagacggcugcugguauggaauggagauaagaccucuaaaggagaaggaagaaaauuuggugaacucauuagucacagcuggucaugggcaaauagauaauuuuuccuuggggguguuaggaauggcauuguuccucgaggaaauguuaagaaccagaaucgguacaaaacaugccauacucuuaguggcgguaaguuucgucacacucauaacugguaacaugaguuuuagggaucugggaagggucaugguaauggugggcgcuaccaugacggaugauaucggaaugggaguaacguaccuagcauuauuagcugccuuuaaagucagaccgacuuuugccgccggucuacuucuccguaaguuaacaucuaaggaacugaugauggcaacaauagggauagcgcuauuaucacaaucuaccauucccgagacuaucuuagaacuaacagaugcccuugccuuaggcaugaugguucuaaaaauaguaagaaacauggaaaaauaccaacuggcuguuacaauaauggcgauuucgugugugcccaaugcaguaauauuacaaaaugcguggaaagucucuugcaccauacuagcagcaguuucugugagcccucuauuacuuaccucaucucaacaaaaagcagacuggauaccuuuagcauugacaauuaaaggccugaaccccaccgccauauuucuaaccacuuuaucccgaacgucaaagaaaagauccuggccuuuaaaugaagccaucauggcaguagguauggugagcauauuagcaagcagucugcuuaaaaacgauauuccuaugaccgggccauugguggcaggaggucuauuaacaguaugcuacguauuaacagggaggucugcagaucuggaauuagaacgagcugcggacguaaaaugggaagaucaagccgaaauuucugggaguaguccgauauugucaauuacuauaucagaggaugggaguaugucgaucaaaaacgaggaggaagaacacacucuaacaauacuuauacguaccggacuauuaguaauaagcggcguguuucccguaagcaucccaauuacggcagcugcuugguaccugugggaagucaagaaacaacgagcagggguauuaugggaugucccgucaccaccaccagucgguaaagcagaauuagaagacggagcuuauagaauaaaacagagaggcauuuuuggauauucccaaauaggcgcagggguauauaaagagggaacauuucauacuauguggcacguaacacgcggagcgguucuaaugcaucgagggaaaagaauugaaccgagcugggcagacgucaagaaagaccuaauaucauacggcggcgguuggaaacuagaaggcgaauggaaagagggugaagagguacaaguauuagcucucgagcccgggaaaaauccuagggcaguacaaacuaaaccgggauuguucaaaacaaauacuggaacgauaggugcugugucacuugauuucucgccgggaacaucaggcucgccaauaguagauaggaaaggaaaagugguaggauuauacggaaacggugugguuacacgcucuggggccuacguaucagcaaucgcacaaacugaaaagaguauagaagauaacccagaaauugaagacgacauauuuaggaagaaaagguuaacgauaauggauuuacacccgggagccggaaaaacuaaacgcuaccuaccggcuauaguaagagaagcaauaaaaagaggauuaagaacuuugaucuuagccccgacgcgcguaguugcagcugaaauggaggaggcauuaaggggauugccuauucgauaucaaacgccagcgauuagggccgagcauaccggcagggagaucguugaucugaugugccacgcaacuuucaccaugcgguuguuaucaccagucaggguacccaacuacaaccuuauuauuauggaugaggcucauuucacagauccagccucaauugcggcucgcggcuauauuucaacacguguugagaugggagaggcugcuggaauauuuaugaccgcaaccccaccgggaaguagggauccuuucccccaauccaacgcaccaauuauggaugaagaaagagagauaccugaaaggucauggaauagugggcacgaauggguaacggacuucaaaggcaaaacagugugguuuguaccgagcaucaaagcugggaacgacauagcggcaugccuuaggaaaaacgguaagaaagugauacaauuaucaagaaaaacguucgauuccgaauaugucaaaacucgcgcgaaugacugggauuucguagugacaacagacauaagugaaaugggcgcaaauuuucgggcagaacgaguuauagaccccagacgaugcaugaaaccggucauacuaacagacggcgaggaaaggguuaucuuggcagggccaaugccagugacccauucaucagccgcacagcgucgggggagaaucgguagaaaucccaaaaaugaaaacgaucaauauauauauaugggagaaccauuggaaaacgacgaagacugcgcucauuggaaggaagccaagauguuacuugauaacauuaacacgccagagggaauaauuccaaguauguuugaaccggaaagggaaaaaguugacgcaauagauggggaguaccggcugcgaggcgaagcaagaaaaacuuucgucgacuuaaugagaagaggugacuuacccgucugguuggcauauagaguagcagcggaagguauaaacuaugcggauagaagaugguguuuugauggaaucaagaacaaucaaauacuagaggaaaacguugagguagaaauuuggacaaaggagggagaaagaaagaaacuuaaaccuagauggcuugacgcgcguauuuacucagacccgcucgcucuaaaagaguucaaggaauuugcagcuggucguaaaagucuaacacuuaaccuaauaacggaaaugggaaggcuaccaacauucaugacccaaaaggcacgagacgcccuagacaaccuugcgguuuugcacacggcagaagcugggggucgagcuuauaaccacgcuuuguccgagcuaccugaaaccuuagaaacacuguuauuauuaacauuacuagcuacaguaacuggcgguauuuuucuauuccugaugucaggaaaagggauagguaaaaugacgcucggaauguguugcauaauaacagcaaguauuuuacugugguaugcucaaauacagccgcacuggauagccgcaucgauuauauuagaguucuuuuuaauaguacuucuaauaccugagccggaaaaacagagaacaccacaagacaaccaauugaccuaugucgugauagcgauacucacuguaguagcagcaacaauggcgaaugaaaugggauucuuagagaaaacaaagaaagauuuagguuuaggcagcauaaccacgcaagaaucagaauccaauauauuagauauagauuuacgaccagcaagugcauggacccuauaugcuguagcaaccacuuuuguaacuccgaugcuaaggcauaguaucgaaaauuccucaguuaauguuagccuuacagcaauugcgaaccaagccacaguacuaaugggacuagggaaaggauggcccuugaguaaaauggacauagguguucccuugcuggcuauagguugcuauagucaaguaaauccaauuacgcuaacggcugcucuauuacugcuagucgcacacuaugcaaucauagguccuggacuacaagcuaaagcaaccagggaggcacagaaacgugcagcggcgggaauaaugaaaaacccuacgguagaugggauaacaguuauagacuuagaaccuauacccuaugauccaaaauucgaaaagcaacugggacagguaauguuacuuaucuuaugcguaacacaaguucuaaugaugagaacgacuugggcauuaugugaagcccugacacuagcaacugggccgauaucgacuuuaugggaagguaauccugggcgauuuuggaacacuacuauagcugugucuauggcuaauauauuucggggaaguuaucuagcgggcgcuggacuauuauuuucgauaaugaaaaauacaacgaauacaagacgcggcacgggcaacauaggugaaacacugggagagaaauggaaaaguaggcuuaacgccuuaggcaagagugaauuucaaauauacaagaaaucagguauacaagaaguugacagaaccuuggcaaaggaaggaaucaaaagaggagaaacugaucaccaugcgguaucucgaggaucagcuaaacuaagaugguuuguggagcgaaauaugguaacgccagaggggaaggucguagauuuaggauguggaaggggaggguggucauacuacuguggaggacucaaaaacguuagggaaguaaaaggccuaaccaagggcgguccaggucaugaagaaccgauaccaaugagcacauauggauggaaucuagugcggcuccaaagugguguagauguauucuuuacuccgccggaaaaaugugauacguugcuuugugacauaggagaaagcagcccuaauccuacuauagaagcaggcagaacacuaagaguccuuaaucuaguagaaaacuggcuuaauaauaauacccaauuuugcauaaaaguauuaaaucccuauaugccaucuguaauagagaaaauggaagcucuccagcgaaaauaugguggggcacuuguaagaaauccacucaguagaaauucaacacacgaaauguacuggguuuccaaugcaaccggaaauauugugucaagcguuaacaugaucuccagaaugcuuauuaauagguuuaccaugaaacauaagaaagcgacauaugagccggauguagaucuuggaucuggaacucgaaauauaggaauagaaucagaaauaccaaaucuagauauuauuggaaaacggaucgaaaagaucaagcaagaacaugaaacgagcuggcauuacgaccaagaccauccauauaaaacaugggcuuaucauggaucauaugagaccaaacaaacgggaagugcauccucaauggugaacgggguuguaagauuauugacaaagcccugggacguuguaccuaugguuacccagauggcuaugaccgacacaaccccuuucgggcaacagaggguauuuaaagaaaagguugacacaagaacacaagaacccaaagaaggaacaaagaaacuaaugaaaauaacagcugaaugguuauggaaagagcuaggaaagaagaaaacgccaagaaugugcacccgagaagaguucacaaggaaaguaagaaguaacgcagcucuuggugcgauauucacagaugagaauaaauggaagucagcucgagaagcagucgaagacggacgguuuugggaacugguugauagggaaaggaauuuacaccuagaagguaaaugcgaaacuuguguuuacaauaugauggguaaacgagagaagaaacugggagaauuugggaaagcuaaaggaagcagggcaauaugguacauguggcuaggcgcgagauuuuuagaguucgaagcguuaggauuuuuaaaugaagaccauugguuuucgcgagguaacucauuaucuggcgucgagggcgaaggauuacauaggcuaggauacauccuuagagacgugucaaagaaagagggaggcgccauguaugcggaugacacggcaggaugggauacuagaauuacauuagaggaucuuaaaaaugaagagaugguuacgaaccacaugaaaggcgaacacaaaaaguuggcagaggcaaucuuuaaauuaaccuaucagaauaagguuguaaggguacaaagaccgacaccaaggggaacuguaauggacauuauaucacgcaaagaucagagagggaguggucaggucggaacguauggauuaaauacauucacgaauauggaggcgcaguuaauuaggcagauggaaggagaagguauuuucaaaucgauacaacguuugaccguuacugaggagauagcagugcagaauugguuagcgagaguaggaagagaacggcuuucacguauggcaauaaguggugaugauuguguuguuaaaccuuuagaugauagauuugcaagugcuuugaccgcacuaaaugauaugggaaaagugcgaaaggacauucagcaaugggaaccaagccgugguuggaaugauuggacacaggugcccuuuugcucgcaucacuuucacgaacugguaaugaaggauggaagaauguuaguaguuccuugccgaaaccaagaugaauuaaucggcagagcucgaauaagccaaggcgcagggugguccuuaaaggaaacagcuugcuugggaaaaagcuaugcacaaauguggaccuuaauguauuuucauagacgugaucuucguuuagccgcaaaugcaaucuguucagcggucccgucccacuggguuccaacaagcagaacaaccugguccauucaugcaaagcaugaauggaugacgacagaagauauguuggcaguauggaauagaguauggauacaagagaaccccuggauggaagauaaaacaccggucgaauccugggaggaaguuccauaucuuggaaagagagaggaccaauggugcggcaguuuaauuggacuuacaucacgggcgacaugggcaaagaauauacaaaccgcaauaaaccaaguaagaucucuuauagguaaugaagaauauacggauuauaugccguccaugaaaagauucagaaaagaagaagaagaggccgggguucuuugguga

SEQ ID NO: 22615 - RNA, 9876 nt, Artificial Sequence
  derived and/or modified CDS sequence (opt6) from DENV-2__EU482722__SS-prME
acagcggguguaaucaucaugcuuauaccaacagcaauggcauuucaccugacgacacguaauggagaaccucacaugauuguugguagacaagaaaaaggaaaaucccuguuauuuaaaacggaggacgguguaaauauguguacacuaauggccauagacuuaggugagcuaugugaagauacaauaacauacaaauguccacuccugagacaaaaugaaccugaggauauagauugcugguguaauaguaccucaacgugggugacguauggaaccuguacgacaaccggagagcaucguagagagaaaaggaguguggcacucguaccacacguaggaaugggacuagagacgcgaacggaaacauggaugaguucagaaggugcuuggaaacauguacagagaauagaaacuuggauuuuacggcacccuggauucaccauaauggcagcaauacucgcauauacuauagguacaacccauuuccagagagcacuaauauuuauucuauuaacagcaguggcgccuaguaugaccaugaggugcauagggauaucaaaucgagacuucguagaagguguuagugguggaagcuggguggauauaguuuuagagcaugguuccugugugacgacaauggcgaaaaauaaaccaacacucgacuucgaacuaauaaaaacagaagcuaaacaaccagcuaccuuaagaaaauacuguauugaagcaaaacugacaaacaccacaacagaaucuaggugcccuacacaaggugaaccuagucuuaaugaagaacaggacaaaagauuuauauguaaacauucaaugguggaucgaggaugggguaacgguugcggucucuuugguaaaggugguauuguuacaugcgcaauguucaccuguaagaaaaauauggaagguaaagugguucuaccggaaaauuuagaauauacaauaguuaucacaccucauucgggagaagaacaugcaguggggaacgacacugguaaacacgguaaagaaaucaaaauuacgccgcaaagcucaauuacagaggcagaauugacugguuauggaacaguuacaauggaguguucuccucgcacuggacucgauuucaaugaaaugguucuucuacaaauggaagauaaagcaugguuaguucacaggcaaugguuucuugacuugccacucccauggcucccaggagccgauacacagggaucaaauuggauacaaaaagagacccugguuacauuuaaaaauccgcaugcaaagaaacaggacguugugguacuagggucucaggaaggcgcgaugcauacggccuuaacuggagcaaccgagauacagaugagcucagggaaucuacuauuuacuggucauuugaaaugccgauuaagaauggauaaacuacaguugaaaggaaugucuuacaguauguguacuggaaaauucaaaauaguaaaagaaauagcugaaacgcaacacggaaccauuguaauucgaguacaguaugagggagauggaagcccaugcaaaauccccuuugaaauaauggauuuagagaaaagacauguuuuaggacgauugauuaccguaaacccaauuguaacagaaaaagauucaccggugaacauugaagcugaaccgccauuuggagauuccuacaucauuauaggaguggaacccggccaacucaaacuuaauugguucaagaaagguaguucaauaggacaaauguuugaaacaacuaugcguggugcuaaaaggauggcaauauuaggcgacacugcuugggauuuugguucacuaggaggagucuuuacguccauaggcaaggcuuuacaucaagucuucggugcaauuuauggagcagcuuucagcgggguaaguuggacaaugaaaauccuaauugguguuauaauuaccuggauaggcaugaacagcaggucaaccucacuuucugucucauuaguacuuguagggguagucacauuauaucuaggagucaugguacaagcagauucaggaugugugguuaguuggaaaaacaaagaacugaaaugcggcucaggaauauuuauaacagacaacgugcauacauggacagaacaauauaaauuucaaccggaauccccgucuaaauuggccucagcaauacagaaagcacacgaggagggcauuuguggaauaaggucuguaacuaggcuggaaaauuugauguggaaacagaucaccccggaauugaaccacauucuaagugaaaacgaaguuaaguugaccauaaugacuggcgacauaaaaggcauaaugcaggcggguaaaagaucauuaagaccacaaccgacagaacucaaauacaguuggaaaacauggggaaaagccaaaauguuaucaacagaaagucauaaccaaaccuuucucauugacgggccagagacagcggaaugcccaaacacgaacagagccuggaacucuuuagaaguugaagauuacggauuugguguauuuucuacaaacaucuggcuuaaacuaagggaaaaacaagauguauuuugugacucgaaacucaugagcgccgcaauaaaagauaaccgcgcgguccacgcagauauggguuauuggauagagucggcucuaaacgacacguggaagauggagaaagcgucauuuauagagauaaaaaguugucauuggccgaaaagccauacuuuauggagcaauggagugcuggaaucugaaaugaucauacccaaaaauuuugccggacccguuucgcaacauaauuaccguccagguuaccacacgcaaacagcagggccuuggcaucucgguaaacuggaaauggacuucgauuucugcgaaggcacaaccguugugguaacagaagauugcggaaaccgagggccaagucucagaacgacuacugcuaguggaaaacucauaacagaguggugcugucgaucauguacauugccaccacuaagauaucgcggggaggaugguuguugguaugggauggagauucgcccccuaaaagaaaaagaggaaaacuugguaaacucguuaguuacugcuggacauggccagaucgacaauuucucuuuagguguucuaggcauggcauuguuuuuagaggaaaugcuacgaaccagaguagguaccaaacacgccaucuuauugguugcugucaguuuugugacauuaauuacggguaauaugucuuuucgagauuuagggcgaguaaugguuaugguaggugcgacuaugacggacgacaucggaaugggcguaaccuaccuagccuugcuagcagcauuuaagguaagacccacauucgcugcugggcuguuacuaagaaagcugaccuccaaagaguuaaugauggcaacaauuggaauagcuuuacuuagucagucuacgauuccggaaacaauauuggaguuaacagacgcacuagcucuagggaugaugguuuuaaagauaguacgaaauauggaaaaauaccaauuggcaguuacaauuauggcaaucaguuguguaccgaaugcaguaauccuucaaaacgcauggaaagugucauguaccauacuagcagcaguauccguaagcccacuacuccuaacaucuucacaacaaaaagcagacuggauaccgcuagcccuaacgauaaaaggacuaaauccuaccgcuaucuucuuaacaacacuaagucgaacgagcaagaaaagaucuuggccucucaaugaggcggucauggcagucggaaugguuaguauauuagcgaguucuuuacucaaaaaugauauaccaaugacagggccauuaguagcaggaggauuguuaacuguguguuauguauuaacaggucguucugccgaccuggaauuagagagaguagcagacguaaagugggaggaucaagcugaaauuagcgggaguucgccaauauuaagcauaacuauaagcgaggauggcucaauguccaucaaaaacgaagaggaagaacacacauuaacaauauuaauuagaacugggcugcuugucauuagcgggguauuuccuguuagcauacccauuacggcugcagcaugguaucuuugggaagugaaaaagcagcgcgcaggcguguuaugggaugucccgaguccaccuccaguaggaaaagcagaacuagaagacggcgcguacaggauaaaacaaagaggaaucuucggauauucacaaaucggagcagggguauauaaagaagggaccuuucauaccauguggcacgucacaagaggugcaguuuugaugcaccgugguaaacguauagaaccuuccugggcugaugugaaaaaggaucuaauaaguuacggcgguggcuggaagcuagaaggugaauggaaggaaggggaagaagugcaaguucuggcuuuggagccgggcaaaaacccgcgugcaguucaaacaaaaccagggcuuuuuaaaacuaauacaggcacaauaggagcgguuucacuggacuucucuccggggacgucaggaagucccaucgucgacagaaaggguaagguuguaggacuauacggaaacggugucgucacgagaucaggggcauauguaucugcuauagcacaaaccgaaaaauccauagaagauaacccagagauagaagaugauauuuuuagaaagaaaagguugaccauaauggaucuccacccaggugcggguaaaacaaagcgauaccuaccagcaaucguaagagaagcuauaaaacgaggucugaggacccucauucuagcuccgacgcguguaguugcugccgagauggaagaggcauuaagaggccucccuauuagauaucaaacuccagcuauaagagcagagcauacaggacgagaaauaguagaucuuaugugccaugcaacauucacgaugcguuuauuauccccuguacggguuccaaacuacaacuuaauaauaauggaugaagcacauuuuacagacccagcuucaauugccgcucgaggcuacauauccacccgaguagagaugggugaagcggcagggauauucaugacugcaacacccccaggcucacgcgacccguucccacaaucuaaugcacccauuauggacgaagaacgugaaauaccagaaagaaguuggaacucuggacacgaaugggugacagacuuuaaaggcaaaacugucugguuugucccaagcaucaaggcugggaaugacauagcugcaugcuugagaaagaacgggaagaaaguaauucaacucagccgaaaaacguucgacucagaauaugugaagacucgagcaaaugacugggauuuuguuguuacuaccgauauaagcgaaaugggugcuaauuucagagcugaaaggguaauagauccgcgucguugcaugaaaccgguaauacuaacagauggugaagaacguguaauauuagcuggaccaaugccuguaacacauucuucggcugcccaaaggagaggucgcauuggcagaaaccccaaaaacgagaacgaucaauauauuuacaugggggaaccacuagaaaaugacgaagauugugcgcauuggaaagaggcgaaaaugcuauuagauaauauaaauacgcccgaagguauuaucccuucaauguuugaaccugagcgugaaaaaguggacgcaauugauggggaguaucguuuaagaggagaagccagaaagaccuuugucgaccuaaugcguagaggugauuugccgguaugguuagcauauagaguggcagccgaagggauuaacuacgccgaucggagaugguguuuugaugguaucaaaaacaaucagauacuagaagaaaauguugagguugagauauggacaaaggagggcgagaggaagaaacuuaaaccaagaugguuagaugcccgaauauacucugacccacuagcuuuaaaagaauuuaaagaguucgcggcaggaagaaaaacccuuaccuugaauuuaauuacagaaauggguagauuaccaacauuuaugacccagaaggcaagagaugcauuagacaaucuagcaguauugcauacagcugagguaggagguagagccuacaaucacgccuuaucggaacuaccagagacucuagagacguuauugcucuuaacccuauuggccacuguuacgggaggaauauuuuuguuccuaaugucagguaaagguaucggaaagaugacgcuggggauguguuguauuauaacagcaucuauacuguuaugguaugcacaaauucaaccacacuggaucgcugcguccaucauucuugaguucuuucuuauuguccuuuuaauacccgagccugaaaaacaacgcacgccucaagauaaccaacuaacauacgucguaauagcuauauuaacgguugucgcggcuacaauggcgaaugaaaugggauucuuggagaaaaccaagaaagauuuagguuuagggucgauuacuacacaagagagugaaucgaacauacuggauauagaucugcgacccgcaagcgcguggacccuguacgcgguagccaccacauucgucacaccuauguuacgucauagcaucgaaaauucaucagucaacgucagccugaccgcaaucgcgaaccaggcuaccguccuuaugggccuaggcaggggguggccacuuucgaaaauggauauuggaguaccacuuuuagcgauaggguguuauagucaaguuaaucccauuacauuaacagccgcgcuucuacuauuggucgcccacuacgcuauuauugggcccggacuacaagcaaaagcaacuagagaagcacaaaaacgaacagcagcugggauaaugaaaaaccccacuguagacgguaucacaguuauugacuuagagccgauuccauacgauccuaaauucgagaaacaauugggucaaguaaugcuccuaguacuaugcguaacacagguguuaaugaugaggacaacuugggcauugugugaagcgcucacacuggcuacgggaccaauaucaacacucugggaaggaaacccuggacguuuuuggaauaccacuaucgcagucucaauggcaaauauauuuaggggauccuaccuagcaggggcuggucuuuuguucucuauuaugaaaaauacuacaaauaccagaagaggaacuggaaauaucggagaaacacuaggagagaaguggaaaagcagauuaaacgcguuaggaaaaucggaauuucaaauauacaagaaaagugguauucaggagguagaccguacguuagccaaagaaggaauaaaaagaggugaaacggaccaucacgcaguaaguaggggcucagcuaaauuacgcugguuuguggaaagaaauaugguaacgccugaggguaaaguuguagauuuggguugcggacgaggugguuggucauacuacugugggggauugaaaaaugugcgcgagguaaaaggauugacgaaaggaggcccaggucacgaggaaccuauaccgaugaguacguacgguuggaaccugguaagacuccagucugguguugauguguucuuuacucccccggaaaaaugcgauacauuacuaugugauaucggugaauccaguccgaaccccacgauagaagcgggaaggacgcucagaguacuaaaucugguugaaaacuggcuaaauaacaauacacaguuuugugucaagguccucaauccuuacaugccaucaguaauagagaaaauggaaacccuucaacguaaguacgguggggcccuaguuagaaauccacuaucgcguaacucaacacacgaaauguacuggguuucaaacgcaaccggaaauauaguaaguucaguaaacaugauaagucggauguuaauuaaucguuuuaccaugaagcauaagaaagcuacuuaugagccugaugucgaucuaggaagcggaacucgaaauauaggaauugaaaaugaaauucccaauuuagauaucauaggaaaacguauagagaagauuaaacaagaacacgaaacaagcuggcacuaugaccaagaccauccguacaaaacaugggcauaucacgguaguuaugaaaccaaacaaacuggaucagcgagcagcauggugaauggugugguaaaauuacuaacaaaaccuugggacgugauaccaaugguaacacagauggccaugacagacacaacgcccuucggccaacaaagaguauucaaagaaaaaguagacacccgcacacaagagccaaaggaaggaacgaagaaauuaaugagaauaacugcagaaugguuauggaaagaacuggggaaaaagaaaacaccaagaaugugcacgagagaggaauuuaccagaaaaguuagaucaaaugcggcacugggggcgaucuuuacagaugaaaacaaauggaaaucagcgcgcgaggcagucgaagacagucgauuuugggagcuaguagauagggaacguaaucugcaccuggaggguaaaugcgaaacaugcguauauaauaugauggguaagcgggagaagaaacuaggagaguucggaaaggcuaaggggagccgggcaauaugguauaugugguuaggugcacgauuucucgaauuugaagcacuaggcuuucuaaaugaagaucauugguuuagucgugguaacucauuguccggcguggaaggagagggauuacauaaguuaggauauaucuuaagagacgugagcaagaaagaagggggagcgauguaugcugaugauacagcaggaugggauacaaggauuaccuuggaagaccuuaaaaaugaagagauggucacgaaucauaugaaaggagaacacaagaaacuugcggaagccauuuucaaauuaacauaucaaaauaaagugguacgaguacaaagacccaccccgagaggaacaguaauggauaucauuagucgaaaagaccaacgaggaagcggucaaguuggcacauacggacuaaauacauucacaaauauggaagcacaacugauuaggcaaauggaaggagaaggcauuuucaaaaguauucagcgacucacaguuaccgaagagauagcuguacaaaauugguuagcgcgaguugguagagaaagauugucuaggauggcuauaucaggagaugacuguguggucaaaccucuagaugaucguuuugcuuccgcauugacagcacugaaugauauggggaaaguacgcaaggacauucaacaaugggaaccuuccagaggauggaacgacuggacgcaagugccauuuugcagucaucauuuucaugagcuaguaaugaaagacggacgaguguuaguugugccgugcaggaaucaagacgaacuaauaggccgagcccguauaagucaaggggcagguuggucguugaaggaaacagcguguuuaggaaaaucuuaugcccaaauguggacacuaauguauuuucaucgaagagaucuaagacucgcagccaacgcuauuugcagugcuguaccgucccacuggguuccuaccucacguaccacguggaguauucaugcgaaacacgaauggaugacuacugaggacaugcuggcaguguggaaucgaguauggauccaagaaaauccuuggauggaagauaaaacuccggucgaguccugggaagaaguaccauacuuaggaaagcgagaggaucaguggugcggaucucuaauaggcuugacuucgcgagcuacuugggcgaaaaauauccagaccgcaauaaaucaaguaaggagucucauaggaaacgaagaauauacggacuauaugccaaguaugaaaagguuuagaaaggaagaagaagaggcagggguucugugguaa

SEQ ID NO: 22616 - RNA, 9876 nt, Artificial Sequence
  derived and/or modified CDS sequence (opt6) from DENV-2__EU482723__SS-prME
acugcggguguaaucauuaugcugauaccaacagcgauggcauuccauuuaacuacaaggaacggagaaccucauaugauaguuggacgccaagaaaaaggaaaaagucuccuauuuaaaacugaagacggaguaaauaugugcacauuaauggcuauagaucuaggagaauuaugugaagauacaaucacauauaaauguccacuacucagacaaaaugaaccggaagauauagauuguugguguaacaguacaucuacgugggugacauauggaacauguacaacuacuggugaacaucgccgagaaaaacggucuguggcauuaguuccucacguaggcaugggacuagaaacaaggacagaaacuuggaugagcucugaaagagcauggaaacauguacaaagaauugaaaccuggauauugagacauccaggauuuacaauaauggcagcuauauuagcauacaccauaggaaccacacauuuucaaagagcauugaucuuuauauuacucacagcaguagcuccuucaaugacuaugagguguauaggaaucaguaauagagacuuuguagaaggagugucugguggaucauggguggacauuguacuagaacaugguucuugcguaacuacuauggccaaaaacaaaccgacccuugauuuugaauuaauaaaaaccgaggcuaaacaaccugcuacucuaagaaaauacugcauugaagcuaaauuaacuaauacgaccacagagagccgcuguccaacccaaggagagccaucacuaaacgaagaacaagauaaaagauuuauaugcaaacauucaaugguugauagaggauggggaaacgguuguggcuuauucgguaaaggagguauagucacaugugcaauguuuacauguaagaaaaauauggagggaaaagucguuuuaccggaaaaccuggaauauacaauuguuauuacgccgcacucaggcgaggaacaugcgguaggaaacgauacugguaaacaugggaaagaaauuaaaauaacuccucaaaguucaaucacagaggcggaauuaacagguuaugggaccguaacgauggaaugcagcccccgaacaggacuagacuuuaacgaaaugguccucuuacaaauggaggauaaagccugguuaguccaccgucagugguuucuagaucucccccucccaugguuacccggcgccgauacucaggguucaaauuggauucagaaagaaacacucgugacauuuaaaaauccacaugccaagaaacaagacguagucguauuaggaagccaagaaggggcaaugcacaccgcacuaacuggcgccacugagauacaaaugagcagcggcaauuuauuauuuacgggacauuuaaaauguaggcucagaauggauaaauuacaacugaaagggaugucguacucuaugugcacagguaaauuuaaaaucgugaaagagauagccgaaacccaacacggcacgauaguuauccggguacaauacgaaggagacggcucgcccugcaaaauaccuuuugaaauuauggaucuagagaaaaggcauguacucgguagauugaucacagucaauccaauuguaacagaaaaggauagcccaguaaacauagaagcagagccuccauuuggugauucguacauaauaauagggguugaaccaggccaacuaaaauugaauugguuuaagaaaggaucgaguauaggacagauguuugaaacgacaaugagaggagccaaaagaauggcuauacuuggugauacugcuugggacuuugggucucuaggaggcgucuucacaucaauagguaaagcauugcaccaaguguuuggagcgauauauggugccgcauucaguggagugucguggacaaugaaaauucuaaucgguguaauuauaacauggauaggaaugaauagucggucaacuucucuuaguguaagucuaguauuagugggaguaguaacguuguauuuaggcgugaugguacaggcugauaguggaugcguagucucauggaagaauaaagaauuaaaauguggaaguggaauauuuauuacugauaacguccacaccuggaccgagcaauauaaguuccaaccagaaucaccaaguaaauuagcaucugcaauccaaaaagcccaugaagaagguauaugcggcauccgaucaguaacaagacuugaaaaucucauguggaaacaaauuacuccggaauuaaaucacauucucuccgaaaacgaaguaaaauuaacuaucaugacgggcgauaucaaaggcauaaugcaagcaggaaaaagaucacuaagaccccaaccuacugaacuaaaguacucauggaaaaccugggguaaggcuaaaauguuaaguacagagagccauaaucaaacuuuccuuauugacggucccgaaacggcagaauguccaaacacgaaccgagcauggaacucauuagagguagaggauuacggcuucggaguguucaguacgaacauaugguuaaaacugagggaaaaacaggacguauuuugugauuccaaauuaaugagcgcagcaauaaaagacaauagagcaguucacgcagacauggguuauuggauagaauccgcgcuaaaugauaccuggaaaauggaaaaagcauccuucauugaaauaaagagcugccauuggcccaaaucccacacucuauggagcaauggugugcuugagucugagaugauaauaccgaaaaauuuugcggguccggucagucaacauaauuaccgacccgguuaucacacucaaacugcuggaccauggcauuuaggcaaacuggaaauggauuuugauuucugcgaggggacuaccguuguaguuacugaagauugcgguaaccgaggaccaucucuuaggacuaccacugcuuccggcaagcuaauuaccgaaugguguuguagaucuugcacucuaccaccauuacgauacaggggagaggauggguguugguauggaauggaaauuagaccacuaaaagaaaaagaggaaaauuuaguaaacucacuuguaacagcgggacacgggcagauagauaauuucagccuaggcguccuaggaauggcgcucuuucuugaagagauguugcguacgcgaguagguacaaaacaugccauacuauuagucgcaguaucauucguaacacugaucaccgggaauaugucauuucgugauuuaggucggguaauggucaugguuggagcaacuaugacugacgauauaggaauggggguaaccuaucuugcacuauuagcugcauuuaaaguaagaccaacauuugcagcuggauuacuucucagaaaacuuaccuccaaggaacuuaugauggccaccaucggcaucgcacuguuaagucaaucaacuaucccugaaaccauuuuagaacugacagaugcauuggcgcuuggcaugauggugcucaagauaguucguaauauggaaaaauaccaacucgccgucacaauuauggcaauaaguuguguucccaacgcagugauccuacagaaugcuuggaaagucucuuguacuaucuuagcggccguuucagucaguccacuauugcuaaccaguagccagcaaaaggcggauuggauacccuuagcuuuaacgauuaaaggucuuaacccgaccgcgauuuuccuaacuacacuaagcagaacaucaaagaaaagaaguuggccuuuaaaugaagccguaauggccguagguauggugucgauccuugcuuccucacuacuaaagaaugacauuccuaugacugguccuuuaguagccggcggacuuuuaacgguauguuaugugcucacgggacgaagugcagaucuugaauuagagagggcugcagacguaaaaugggaagaucaggcagagauaucagguucuaguccaauauuaucgauaacaaucucagaagacggaaguaugaguauuaaaaacgaagaagaagaacauaccuuaacuauccugaucaggacuggucuccugguuauaucuggaguauuuccaguaaguauaccgaucacagcugcagccugguacuuaugggaagucaagaaacaacgugcaggaguucucugggacgugccuaguccacccccaguaggaaaagcagaguuggaagauggagcauaccguauuaaacaacgagguauauuuggguacucacagauuggugcaggaguauauaaagaaggcaccuuucacacaauguggcaugucacucgaggagcuguauuaaugcaucgagggaaaaggauugagccauccugggcugauguuaaaaaggauuugauuucuuacggcgggggcuggaaauuagaaggagaguggaaagagggagaggagguacaaguacuagcucuugaacccgggaagaacccaagagcaguucaaacaaagcccgguuuauuuaagaccaauacggggacaaucggagcaguuucucuugauuucuccccgggaacuuccgguucaccaauaguggaucgcaagggaaaaguaguaggacuuuacggaaacggaguagugacuagaucaggagcguacguuagcgccaucgcucaaacagaaaaaucaauagaagauaauccagagauagaggaugauaucuucaggaagaaacgcuuaacaauaauggaucuccauccaggugcagggaaaacuaaacgcuaccugccagcaauuguacgagaagcaauaaaacguggacuaagaacacuaauacuagcuccaacucgugucguagcagcugagauggaggaagcacuucgcggucuaccaauaagauaccaaacaccagcaauuagggcggagcauacaggaagggaaauaguagaccugaugugccacgcuacuuucacgaugcgauugcuuuccccaguacgggugccuaacuauaaucuaauuauaauggaugaggcucauuucacagauccagcuagcauagcagcacgcgguuauauuucgacucgaguugaaaugggugaagcugccggaauauuuaugaccgccacaccucccgguucccgagauccuuuuccacaaagcaaugcaccaauaauggacgaagaaagagaaauuccagaaaggucguggaacucuggucaugaauggguaacagauuuuaaaggaaaaacuguuugguucguaccaagcauuaaagcaggaaaugauaucgcggcaugccuacgaaagaacgggaagaaaguaauucaacuaucuagaaaaacauuugauagcgaauauguaaaaacaagagccaaugacugggauuuuguagucacuacugauauaagugaaaugggggccaauuucagagcagaacgcguuauagauccaaggcggugcaugaagccugugauuuugacagacggagaagaaagagugauacuugcaggcccuaugccaguuacgcacaguagugcagcacaaagaaggggaagaauuggaagaaaucccaaaaacgaaaacgaucaauauauuuauaugggagaaccacuagagaacgaugaagauugcgcacacuggaaagaagcgaaaaugcuacuagacaauauaaauacuccugaggguaucaucccuucgauguuugaaccggagagagagaaaguagacgcaauugauggagaguaucgacuucgaggugaagcgcguaaaacuuuuguagaucuaaugagaagaggagauuuaccgguaugguuagccuacagaguugcugcagaggguauuaacuacgcugauagaagaugguguuucgacggaaucaaaaauaaccaaaucuuggaagaaaacguugaagucgagauauggaccaaagaaggugaacgaaagaaauuaaaaccgcgaugguuagaugcuagaaucuauagcgauccacuugcacugaaagaauuuaaagaguuugcugcaggccgcaaaucauugacauuaaacuugauaacggagaugggucgacugccaacuuucaugacucagaaagccagagacgcacuugacaacuuggcaguuuuacacaccgcagaggugggaggccgcgccuauaaucaugcacucucugagcugccugagaccuuggagacuuugcuacugcuaacguugcuagcuacaguaacugguggcauuuucuuauuucuuaugagcggaaaaggcauuggaaagaugacuuuagggaugugcuguauaaucacagcuucaauauuauuaugguacgcucaaauccaaccgcacuggauugcagcaaguaucauacuggaguucuuucuaauaguuuugcuaaucccagaacccgaaaagcagaggacuccccaagacaaucaauuaacuuacgugguaauagccauccuuacgguuguugcagcuacaauggcuaacgaaaugggauuuuuagaaaagaccaagaaagaucucgggcugggaaguauaaccacucaagaaucugagagcaauauacuggauauagaccuucgcccagcgagugcauggacccuguaugcuguagcuacaacuuucguaaccccgauguugcgucauucaauagaaaauagcaguguuaaugucagcuuaacagccauagcuaaccaagcaacgguguuaaugggauuagguagaggauggccacucaguaaaauggacauaggaguaccgcuccuugcuauagguuguuacucacaggugaauccuauuacgcugacggcggcucucuuauuacuuguugcacauuacgcaauuauagggccaggacuacaagcuaaggcaacacgcgaggcacagaaaaggacggcggcgggcauaaugaagaacccaacgguugaugguauuacuguaauagaccucgaaccuauuccuuacgacccaaaauucgaaaaacaacuuggacaaguuaugcuacuugugcuaugcgugacccaaguacugaugaugagaacuacaugggcuuuaugcgaagcccugacguuggcaacggguccaauaucaacacucugggaaggaaaccccggccgauuuuggaauacuacaauugccguaucaauggcuaauauuuuucgagguucguaccuagcuggagcaggauuacucuucucaauaaugaaaaauacaacaaauaccagacgcgguaccggaaauaugggggaaacccuaggcgaaaaauggaagucucgcuuaaaugcacuugggaaaagcgaauuucaaauuuacaagaaaaguggaauacaggaaguugacaggaccuuagcaaaagaagggauaaaacggggagaaacugaucaucaugcugugucgcguggauccgccaaacugaggugguuuguggagaggaacauggucacgccggagggcaagguuguugauuuggggugcggucguggagguuggucauauuauugcggaggccucaaaaaugucagagaagugaaggggcuaacuaagggaggcccaggacaugaggaaccaauacccaugucaacuuauggauggaacuuaguacgguuacaaucuggaguugacguguuuuucacuccuccggaaaaaugcgacacacuacucugugauauaggugagaguucgccaaauccgacaauagaagcuggacguacacuacgaguccuaaaucuuguagagaauugguuaaauaauaacacacaauucugcauaaaaguguugaacccguacaugccuagugucauagagaaaauggagacucuccaacgcaaguauggcggagcucuuguucgaaauccacuuagcagaaauuccacucacgaaauguacuggguaagcaaugccacagggaauauuguauccucaguuaauaugaucucucguaugcuaaucaacagguuuacgaugaaacauaagaaagcaacuuacgaaccugauguagaccuaggcuccgggacaagaaauauugguauagaaaacgaaauacccaauuuagauauaauuggcaaacgaauugagaaaauaaaacaagaacaugaaacaaguuggcauuaugaccaggaccauccuuacaaaacaugggcauaucaugggucguacgaaacaaaacaaacaggguccgcaaguucaauggucaaugggguaguaaaacuauuaacgaagccaugggacgugguaccaaugguaacucaaauggcaaugacagacacaacaccauucggacaacaacgaguuuuuaaagaaaaaguagacacuaggacucaggagccuaaagagggcacuaaaaagcugaugagaauaacggcugaaugguuauggaaagaacuagguaagaagaaaacaccacguaugugcacccgagaagaguuuacccguaaaguuagguccaacgcggcgcugggagcaauuuucacggacgaaaauaaauggaaaagcgcaagagaggccguagaagauucaagguuuugggaguuaguugacagagaacguaauuuacauuuggaaggcaaaugugaaacguguguguauaauaugauggggaaacgagagaagaaauuaggagaguucggcaaagcuaaggggaguagagcaauaugguacaugugguugggcgcaagauuuuuagaguucgaagcauuagguuuucugaaugaagaucacugguucucgcgcggaaauucacuguccggcgucgagggugagggacuacacaaguuagguuacauuuugagagauguaagcaagaaagaagggggugcuauguacgcagacgauacggcagggugggacacgcggauaacgcuagaagaucuuaaaaaugaagaaauggucacuaaucacaugaaaggggagcacaagaaacuagcugaggccaucuuuaaacuaacguaucaaaauaaaguggugaggguucagagaccgacaccgaggggaacuguaauggacauuauauccagaaaagaucaacgaggaucuggucaaguaggaaccuauggauugaauacauucaccaauauggaagcacaacuuauacgacagauggaaggagaagguauuuuuaaaagcauacaacgacuaaccguaacugaagagauagcgguucagaauuggcucgcuagagugggaagagaacgccuaucgcgaauggccauuagcggcgaugauugcgugguaaaaccucuagaugaucgauuugcaucagcauuaaccgcucuuaacgauaugggcaaggucagaaaagacauacaacaaugggagccuagcagaggcuggaaugauuggacacaagucccuuuuugcagucaucacuuucaugaacugguaaugaaagacggucguguauuagugguaccgugccgcaaucaggacgaacuaauaggaagggcaagaaucucccaaggagcuggguggucauugaaggagacggccugucuaggcaaaucauaugcacaaauguggacuuuaauguauuuucaucgacgcgauuuacguuuggcagcuaacgcuauuugcagcgccgucccaagucauuggguacccaccaguagaacgacuuggaguauacacgcuaagcacgaauggaugaccacggaagacaugcucgccguguggaaucgaguauggauucaagagaauccauggauggaagacaaaaccccaguagaaaguugggaggaagucccuuaucucgggaagagggaagaucaauggugugggucuuuaaucggauuaacaaguagggcaacgugggcuaaaaauauccaaacagcaaucaaccaaguucguuccuuaauuggcaacgaagaauacacugacuacaugccaucaaugaaaagauuccgaaaagaagaagaggaagcuggcguuuuaugguag

SEQ ID NO: 22617 - RNA, 9876 nt, Artificial Sequence
  derived and/or modified CDS sequence (opt6) from DENV-2__EU482724__SS-prME
acggccggagugauuauaaugcuaauacccacugcaauggcuuuucaucuuacuacuaggaauggcgagccacacaugauaguaggaagacaagaaaaaggcaaaagucuauuauucaaaacugaagacggcgugaacauguguacccuaauggcaauagacuuaggugaauuaugcgaagacaccauaaccuauaaguguccacuauuacgacaaaacgagccagaagauaucgauuguuggugcaauaguacaucaacauggguuaccuauggaacaugcacaacaacaggagaacacaggagagagaaaagaucugucgcacuuguuccccauguggguauggggcuagagacacggacggaaacauggaugucaucagagggggccuggaaacacguacaaagaauugagacauggauucuucggcacccaggauuuacaaucauggccgcgaucuuggccuacacaauuggcacgacacauuuccaaagagcucuaaucuuuauuuuauuaacggccguugcuccaagcaugacaaugcgguguaucgggauuucuaauagggauuuuguagaaggugugaguggagguucauggguugauauagucuuagagcauggaucauguguuaccacaauggcgaaaaacaagccaacucuugauuuugaacuuauuaaaacggaggcaaaacaaccugcaacacuaagaaaauauuguaucgaggcaaaauuaacaaauacgacuacugagagucgaugccccacccaaggggagcccagcuuaaaugaggaacaagacaagagguucauaugcaagcauaguaugguagaucgagguugggggaaugggugcggacuguuuggaaaaggcgguauagugacuugugcaauguucacgugcaagaagaauauggagggcaaggucguguuacccgaaaaucucgaguacacaauuguuauaacaccucauagcggagaagaacacgcaguaggcaaugauacugggaaacacggaaaagaaaucaaaauaacuccccaaagcucuauaacagaggcggaauuaacaggauaugggacaguaacgauggaaugcuccccaagaacaggguuagauuuuaacgaaaugguauuauuacaaauggaagauaaagccugguugguacaucgacaaugguuuuuagaucuaccguuaccguggcuacccggagcagauacacaaggcucaaauuggauucagaaggagaccuugguaacguuuaaaaauccccaugcuaaaaagcaggacguaguuguucuagguucacaggaaggagcaaugcauacagccuuaacaggggccaccgagauacaaaugaguucuggcaaucugcuauuuacaggacaccuaaaguguagauuaaggauggacaaacugcaguuaaaaggcaugucauacagcaugugcacaggcaaguuuaaaauagucaaagagauagccgaaacacaacacggaaccaucguaauucgaguacaguacgaaggagacggaagucccuguaaaauaccguucgaaauuauggacuuagaaaaaagacauguccuagggagauuaauuacgguaaaucccauuguaacggaaaaagauucaccaguuaauauugaagcagagccaccuuuuggagauuccuacaucaucauaggaguagaaccaggacaacuuaaacucaauugguuuaaaaaaggaucaaguauaggacaaauguucgaaacaacuaugcgaggagcgaagagaauggcgauacuaggugauaccgcaugggacuuuggaagucuaggaggaguauuuacuucaaucggaaaagcauuacaucagguauuuggugcgaucuauggugcagcuuuuagcggaguaaguuggacaaugaaaaucuuaauagggguaauaauaacuuggauaggaaugaacucacgcucuacaagcuugucuguaucguugguauuaguuggagucguuacccuauaccuagguguaaugguacaagcggauacuggcugcguggugagcuggaaaaauaaggaacuaaagugugggucagguauuuuuauuacugauaaugugcacacauggacggagcaauacaaguuccaaccagagagcccaucaaagcuagcaagcgcaauucagaaagcgcacgaggaagggaucugcggaauacgauccguaacucgcuuagaaaauuuaauguggaagcaaauaacuccugaacuaaaccacauauuaucugaaaaugaagugaagcuaacaauaaugacuggugauaucaaagguauaaugcaagcugguaagcguucauuacgaccacaacccacugaauugaaauacucauggaagacuuggggcaaagcuaagauguugucaacugaaucacacaaccaaacguucuuaauugauggaccagagacagcugaauguccaaacaccuccagagccuggaauucacuagaaguggaggauuacggauucggcgucuuuagcacuaauauuuggcuaaaacugcgugaaaaacaggauguuuucugugauucgaagcugaugagcgcagcgauaaaagacaacagggcaguacacgcggacaugggauauuggauagaaucagcucuuaaugacaccuggaaaauggagaaagcgucauuuaucgaaauaaaaaguugucauuggccuaaaagucauacguuguggaguaacggaguauuggaaucagaaaugauaauaccuaaaaauuuugcaggccccgugagucagcauaacuacaggccuggcuaccacacucaaaccgcaggaccguggcaccuaggaaaacucgaaauggacuuugauuucugcgaagggacuacgguaguaguaacagaagauugcgguaaccgggggccuucacuacgaacaacaacagcuaguggaaaauugauaacugaaugguguuguaggucaugcacauuaccaccgcuucgguaccgcggagaggauggguguugguacgguauggaaauucgaccacuaaaagaaaaagaagagaaccuagugaauucguuaguaacagcugggcaugggcaaaucgacaauuuuagcuugggcgucuuaggcauggcgcucuuucuagaagaaaugcuaagaacacguguuggaacuaaacaugcgauauugcuaguggcuguuaguuucguaacacucauuacugguaauaugucuuuucgagacuuaggaagaguuauggugaugguuggcgcaacgaugacugacgauauuggaaugggaguaacauauuuggcuuuacucgcagcauucaaagugcgaccaacuuuugcagcggggcuccucuuaaggaaacugacuaguaaagaacugaugauggcaacaauaggaaucgcguuacucagucaaagcacuauaccagaaacgauccuugaacuaacugaugcucucgcauuagggaugauggugcucaaaauaguuagaaauauggaaaaauaucagcuagcgguuaccauaauggcuaucaguugugugccaaaugcaguuaucuuacaaaacgccuggaagguaucuugcacaauccucgcagcgguaucggugucaccauuacuuuuaacuucaagucaacagaaagcugauuggauuccccuggcucucacaauuaagggcuuaaacccuaccgcuauauuucuuacaacauuaucacggacaucaaagaagagaucuuggccacuaaaugaagcgguaauggcgguuggcaugguauccauacuggcguccagccuucuaaaaaacgauauaccuaugaccggcccacuugucgcugguggauuacuuaccgucugcuauguacucacgggaagaagugcagaucuagagcuugaacgcgcugcagauguaaaaugggaagaucaagcagaaauaagcggaaguucacccauucuaaguauaacuauaagugaagacggaucgaugaguauaaaaaacgaagaagaagagcacaccuugacgauauuaauccguacaggacuguuagugauaucugguguauuuccaguguccauuccaauaacagcugcagcaugguaucuuugggagguuaaaaaacagcgcgcggguguucuuugggacguaccuucacccccgccugucgguaaagcggaauuagaagauggagcauauagaaucaaacaaagaggaauauuuggcuacucacaaauaggcgccgguguguauaaggaaggaacguuucauaccauguggcacguaacaagaggagcaguacuuaugcaucgggggaaacguaucgaaccgucuugggcagaugugaaaaaagauuugauaaguuauggagguggauggaagcucgaaggagaauggaaagaaggugaggagguccaaguguuggcccuagaaccgggaaaaaauccacgugcaguccaaacaaagcccggucuauucaagacaaauacuggaacuaucggugcugugucauuagauuuuaguccaggaacauccggaaguccuauuguagauagaaagggaaaggucguuggcuuauacggcaacggggucguaaccagaucgggugcauacguuucugcuauagcgcaaacggaaaaaucgauagaagacaauccugaaauagaagacgauauauuucgaaagaagagacuuacgauaauggauuuacacccaggugccggaaagacgaaaagguaccuucccgcaauugugagggaagcaauuaagaggggacuucggacgcuuauacuugcccccacuagaguaguugcagcagaaauggaggaagcccugaggggcuugcccauaagauaccaaacuccagcaauaagagcggaacauaccggacgagaaaucguagacuugaugugucaugcaacguucacaaugagguuacuuucaccaguaagagucccaaauuacaaucuaauaauaauggacgaagcucauuuuacagaucccgcaaguauagcagcaagaggauauauaucaacacguguggaaaugggggaagcagcuggaauauuuaugaccgcaacuccaccgggcagucgugacccauuuccucagucaaacgcaccuauaauggacgaagaacgagaaaucccagagcguucauggaauucaggccaugaauggguuacggauuucaaaggaaaaacgguaugguucguucccaguauuaaagcggggaaugauauagcggcuugucuacggaaaaaugggaaaaaagugauucaacuuucccgaaagacguucgauuccgaguauguaaaaacccgcgcaaaugacugggacuuuguggucacaacugacauaucugaaaugggugccaauuuuagagcggagcgagucauagauccccgccguugcaugaaaccaguaauuuugacggauggagaggaacgagugauauuagcuggaccuaugccaguuacccauaguagugcagcgcaaagacgaggacgcauagggagaaauccuaaaaacgaaaaugaucaauacauuuacaugggagaaccccucgaaaaugaugaagauugugcacacuggaaagaggcgaaaauguuauuagacaauauuaacacgccggagggaauaauaccuagcauguucgagccugaacgagagaaaguggaugccauagauggggaguaucgauuacgaggggaagcaagaaaaacuuucguugacuugaugcguaggggagaccuaccuguguggcuagcuuauagaguagcugcagagggcauaaacuaugcagauagacguugguguuuugauggaauaaaaaauaaucaaauucuugaagaaaacguagaaguagagauuuggacaaaagaaggcgaacgaaaaaaauuaaaacccagauggcuugaugcacgaaucuauucagauccucuagcacucaaagaauuuaaggaauuugccgcugggcgaaagagccugacucucaacuugauuacagaaauggggcgauuaccaacuuucaugacccaaaaagcgagggaugcacuggacaacuuggcaguucuucacacugcagaaguuggugggcgugcauacaaucaugcguuaucagaacuaccugaaacacuggaaacccuuuuauuacugacauuauuagcaacuguaacgggcggaauauuuuuauuccuaaugucaggaaaaggaauugguaagaugacauugggcaugugcugcauaauaacagccuccauccucuugugguacgcccaaauacaaccucauuggauagcagcuaguauuauacuagaauucuuucuaauagucuuauuaauaccugagcccgaaaaacaaagaacgccacaagacaaccaauuaacguaugugguaauagcaauucuuacggugguugcagcgacuauggcaaacgaaaugggauuuuuagaaaaaaccaaaaaggaccuaggauuaggaucaauuacaacucaggaaucagaaaguaacauuuuagacauugaccuucgaccagcgucugcauggacuuuauaugcaguagcgacuaccuuuguaacaccaauguuacgacauucuauugaaaauagcagcguuaacgucagucuaacugccauagcaaaccaagcaacaguauugaugggauuagguaggggauggccacuaaguaaaauggauauuggugugccucuuuuagcuauaggaugcuauucacaagucaaccccaucacucuaaccgccgcuuuacuauuauuaguagcgcauuaugccauuauagggccgggauuacaagcuaaagccacuagagaggcccagaaacguacugcugcggggaucaugaaaaacccaacuguagacgguauuacagugauugaucuagaacccauucccuaugauccaaaguucgaaaagcaauuggggcaagucaugcuacucguacuaugcgucacgcaaguacugaugaugaggacaacuugggcccuuugugaagcgcugacucuagcaacuggcccaauuagcacuuugugggagggaaauccggggcgcuuuuggaauacgacuauagcugucucuauggcuaauauauuccguggaaguuaucuugcaggagcagggcuauuauuuuccauaaugaagaauacaacgaacacgcggcgaggaacgggaaacauuggagaaacguuaggagaaaaauggaaaaguagacuaaaugcgcuggguaagucagaauuccaaauuuauaaaaaaagugguauccaagaaguagacagaacauuggcaaaagaggguauuaagcgaggagagacagaucaccacgcagucucacgggguucagcaaaauuacgcugguuuguugaaaggaauauggugacuccugaggggaagguggucgaucuagggugugggagaggaggauggaguuacuacuguggcggauuaaagaauguucgggaaguuaaaggccuuacaaaaggagggccaggucacgaagaaccgaucccgaugucuaccuacggauggaaccuaguccggcuucaaucagggguagauguguuuuucacaccuccggaaaaaugugacacacuuuugugcgacauaggugaaucgucucccaaccccacaauugaagcaggaaggacuuugcgaguacugaauuuaguggagaauuggcugaauaacaauacucaauucugcguuaaaguacuaaauccauauaugccgucaguaauagagaagauggagacauugcagcggaaauacgggggggcguugguacguaacccccuaaguagaaauucgacucaugagauguacugggucucaaacgccacagggaauauugucagcagugucaauaugaucucaagaauguuaauaaacagguucacuaugaaacauaaaaaagccacauacgaaccagauguagacuuaggaagcggaacaagaaauauaggaauugagaaugagauacccaauuuggacauuaucggaaaaaggauagaaaaaauaaaacaagagcacgaaacaucauggcauuaugaucaagaucauccauacaaaacaugggcauaucacggcaguuaugagaccaaacaaacuggaagugcaucaaguauggugaaugguguggugaaauuauuaacgaaaccgugggauguagugccuaugguuacucaaauggcaaugaccgauacuacccccuucggacagcagcgggucuuuaaagagaaaguagacacccgaacccaagaaccuaaagaaggcaccaaaaaacuaaugcggauaacggccgaaugguuguggaaggaacuagguaaaaaaaaaacaccacgcaugugcacaagagaagaguuuacuagaaaaguaagaaguaacgcagcguugggagccauuuucacggaugaaaacaaauggaaaagugcuagagaagcaguggaagacucacguuucugggaguuaguugaccgugaaagaaaucuacacuuagaaggaaaaugcgagaccugcguuuacaacaugaugggcaagagagagaagaaacucggggaguucgguaaagccaaagguucgagggcaaucugguauaugugguuaggugcucguuuucuggaauuugaggcacuaggcuuccuaaacgaagaucauugguucucaagagguaauucgcucaguggaguugaaggagaaggccuucauaaacugggauauauacuaagggaugugucaaaaaaagaagggggagcaauguacgcugaugacacagcaggaugggacacacggaucacguuggaagauuuaaaaaacgaagagauggugacaaaccauaugaaaggugaacacaaaaaguuagcagaagcgauauucaaauuaacuuaccagaauaaaguaguaagaguucaaagaccaaccccaagaggcacaguaauggauauaauaucacguaaagaccaaagggguucagggcagguaggaacauauggauuaaacacguuuacaaauauggaagcacagcuaauacgacaaauggaaggcgaaggaauuuuuaaaaguauacagagauugacagugaccgaagaaauagcuguacagaacugguuagcgagaguuggucgcgaacgucuaaguagaauggcaauaaguggggaugacugcguaguaaaaccucuagacgauagauucgcgagcgcacuaacugcacugaaugacaugggaaaaguacggaaagacauccaacaaugggaacccaguagaggauggaaugacuggacgcaaguuccuuuuugcagucaccauuuccaugaacuaguaaugaaagauggccgaguacuaguaguaccgugucgcaaccaagaugaacuaauaggcagagcgcguauaucacagggagcgggguggagucuaaaagaaaccgcaugucuuggaaaaagcuaugcucaaauguggacucuaauguacuuucauaggagagaucuaaggcuugcagcuaacgcuauauguucugcagucccgucccauuggguaccgacaucacgaacuacauggaguauacaugcgaaacacgaauggaugacgacggaagacauguuagcuguguggaaccggguauggauacaagaaaaucccuggauggaagauaaaacaccgguagagucuugggaagaagugccuuauuuaggcaaaagagaggaucagugguguggaagucuaaucggccuaacuucaagggcaacgugggcuaagaacauccaaacugcgauuaaccaaguuagaucucuaauuggcaaugaggaauacacagacuacaugccaucgaugaagagauuccgaaaagaagaggaagaagcggguguccuaugguga

SEQ ID NO: 22618 - RNA, 9876 nt, Artificial Sequence
  derived and/or modified CDS sequence (opt6) from DENV-2__EU482725__SS-prME
acugcugguguuaucauaaugcucaucccuacagcaauggcauuccauuuaaccacucgcaauggcgaaccccacaugauuguaggacgucaagaaaagggaaagucgcugcuuuucaaaacagaagauggcgucaacauguguacucucauggcuauugaucucggggaacuuugcgaggauacgaucacuuauaagugcccacuacugagacagaacgaacccgaggauauugacuguuggugcaacucaacaucgacauggguuacuuacggaacgugcacuacaacuggugagcaccgccgugaaaaaagaucuguggcuuugguaccucauguggggaugggcuuagaaacaaggacugaaacauggaugucuagugaaggagccuggaaacauguccaacgaauugaaacguggauacugaggcaccccggauucacaauaauggcggcuauuuuagcauauacgauagggacaacucauuuccaaagagcacuaauuuucauacucuuaaccgccguugcuccaagcaugaccaugagaugcauaggcauuagcaacagagauuuuguagaggguguuucaggagggucuuggguugauaucguauuggaacacggaagcugugugaccaccauggcaaaaaacaaaccaacauuagauuucgagcugauuaaaacagaagcuaaacaaccggcuacacucagaaaauauuguauugaagccaaacucacaaauacaacaacagaaucaagauguccaacacaaggggaaccaucauuaaaugaagagcaagauaaacguuucauuuguaagcacaguaugguggauagaggauggggaaaugguugcggauuauuuggaaagggaggaauaguuacuugugcgauguuuacuuguaaaaaaaacauggaaggaaaaguaguacucccagaaaacuuggaguacacaauaguuauaacuccacacaguggcgaggaacaugcugugggaaaugauacagggaagcacggcaaagagauaaaaauaacaccucaaucuaguauaacggaagccgaacuaaccgguuauggaacaguuacgauggaaugcucaccacgaacgggauuagauuucaaugagauggugcugcuucaaauggaggacaaggccugguuaguccacagacaaugguuuuuagacuugccucuaccuugguuacccggugcagacacucagggcucuaacuggauucaaaaagaaacucuugugacuuuuaaaaauccacacgcaaagaaacaagauguuguuguccuaggaucacaagagggagcuaugcauacagcauugacaggagcaacugaaauacaaaugucgucuggaaacuuauuguuuacggggcaccuaaaauguagacugagaauggauaaacuucaauuaaaaggaaugaguuauaguauguguacugguaaguuuaagauaguaaaagagauagcagaaacgcaacacggaacaauuguaauaagaguccaauaugaaggagauggcucuccaugcaaaauccccuuugaaauaauggaucuagaaaaaaggcauguauugggaagacugauuacgguaaacccuauaguuacagagaaagacucucccguaaacauugaagcugaacccccauucggcgacaguuauauuauaaucggaguagagccaggccaauuaaaauugaauugguucaagaagggaucaucaauuggacaaauguuugaaacaacgaugaggggugcaaagaggauggcaauacugggugauacagccugggacuucggaagucuaggagguguuuuuacuucuauaggcaaagcauuacaccaaguauuuggugccauauacggagcagcauuuaguggcguuucauggacaaugaaaauacuuauuggaguuauaauuacguggaucgguaugaacucuagaagcacuuccuuaagcguaucuuugguacuuguagggguaguaacguuauacuuaggaguuauggugcaagcagacacaggaugcgugguauccuggaaaaauaaagaacucaaaugcgggagugguaucuuuauaacagauaauguacauacauggacagaacaauauaaauuccaaccagagagcccuaguaaauuagcaucggccauucaaaaagcucaugaagaggguauaugcggaauacgaaguguuacaagauuagaaaaccuuauguggaagcaaauaacuccggaacuuaaucacauacucagugagaacgaagucaaacugacuauaaugacaggagauauaaaagguaucaugcaagccgggaaaagaaguuuacgaccccaacccaccgaacuuaaauacuccuggaaaacgugggguaaagcaaagaugcuaaguacggagucacauaaccaaacuuuuuuaaucgauggaccagagacagcagaauguccuaauacuaaccgugcuuggaacucauuggaagucgaagacuacggauuuggcguauuuagcacaaauauuugguuaaagcucagggaaaaacaggacguauucugugauagcaaauuaauguccgcugcuauaaaggauaacagagcgguccacgcggacauggguuacuggauagaaucggcauuaaacgacaccuggaaaauggaaaaagccucauuuaucgagauuaaaucaugccauuggccaaagagucauacccuauggucaaauggcguacucgaaucagaaaugauaaucccuaagaauuuugcgggaccaguaucacaacauaauuacagacccgguuaucauacucaaacugccggcccuuggcaucuagguaaacuugaaauggauuucgacuucugugaaggaacuacaguuguggucacagaagacuguggaaaccggggcccgucguuacguaccacgaccgcaagcggaaaacucauuaccgaguggugcuguagaucauguacacuuccaccacuaagauauagaggggaggauggcuguugguaugggauggaaauccgccccuuaaaagaaaaagaagaaaauuuggugaauucgcuaguaacagccggucauggacaaauugacaauuuuaguuuaggaguuuugggaauggcacuauuuuuggaagaaauguuaaggacucgaguaggaacaaaacaugcaauacuacuuguugccguuuccuucguaacacuaauuacaggaaacaugaguuuccgagaucucggucgaguuaugguaaugguaggagcuacgaugacugaugacauugguaugggagucacauauuuagcacuucuugcagcuuuuaaaguucgaccaacguucgcugcaggauuacuguuacguaagcuaaccucaaaggagcuaaugauggcuacaauaggaaucgcauuacuuagccaaucaacaauuccagaaacuauauuagaauuaacugaugcguuggcauuaggcaugaugguauugaaaauagugaggaacauggagaaguaccagcucgcaguaaccaucauggcuauaagcuguguaccuaacgcgguaauccugcagaacgcuuggaagguuucaugcaccaucuuagcggcugucagcguuaguccgcuacuguugacgucuucacaacaaaaagccgauuggauaccguuagcacugaccauaaaaggacuaaauccgacagcuauauuuuuaacaaccuugagucgcaccucgaaaaaaaggagcuggccuuuaaacgaagcuguaauggcaguagggauggugaguauucuagcuagcucccucuugaaaaacgauauaccuaugacgggaccuuugguugccggaggguuacuuacaguuuguuacguucugacagguagaagcgcagaccuugaauuagaacgggcagcagacgucaaaugggaagaucaagcugaaauaucuggaaguaguccaauacucucgauuacuauaucagaagauggaaguauguccaucaagaacgaagaagaagagcauacucuaaccauuuugauacggacuggauuguuggugauaucagggguauuuccugugucaauaccaauaaccgcggcagcuugguaucucugggaggucagaaaacaacgagcugguguauuaugggaugucccuucaccaccgccagucgggaaagccgaauuggaggacggugccuaucggauaaagcaacgugguauauuuggcuauucccagauuggagcuggaguauauaaggaagggaccuuucauacaauguggcacgucacuagaggcgcaguucugaugcacagagggaaaagaauugaaccuucaugggcggauguuaagaaagaccuaauaucuuacgggggagguuggaaacuagaaggagaauggaaagaaggagaagaaguacaaguucuagcauuggagcccggaaagaauccgagagccguacaaacuaagccuggauuguuuaaaacuaacaccggaaccaucggcgcuguaucgcuugauuuuagucccggaacaucugguaguccuauugucgauagaaaagggaaaguuguaggccuauacggaaacgguguaguaacgaggucgggcgccuaugugagugcaauugcgcaaacagaaaaaucaaucgaagauaauccggaaauugaggacgauauauuuagaaaaaagagacucacuauaauggaccugcacccgggcgcugguaaaacaaagagauacuuaccagcaauugugcgugaggcaauaaaaagaggcuuacgaacgcucauauuggcuccuacacgagugguugcggccgaaauggaagaggcccuacgaggccucccuauacguuaucaaacgccugcuauaagggccgagcacaccgggagggaaauaguagauuuaaugugucaugcaacauuuacgaugcgccucuugagcccaguaagaguuccgaacuacaacuugauuauuauggacgaagcacacuuuacugauccggccaguauagcggccagggguuauauaaguacucgagucgagaugggcgaagcugccgggauuuuuaugacugcaacaccgccagguaguagggacccuuucccacaaucaaacgcgccgauuauggacgaagaacgggaaauuccggagagaaguuggaauucaggacaugaguggguaacagacuuuaaaggaaaaacggugugguuuguuccaucuauuaaggcaggaaacgauaucgcugcuuguuugaggaagaauggaaaaaaagugauacaacugucuagaaaaacuuuugacagugaauauguaaaaacucgugcgaacgacugggacuucguggucacuacagauaucuccgagaugggggcuaauuuucgugcggagaggguuauagacccgagaagauguaugaaaccagucauucugacagacggagaagagagggugauccuugcggguccaaugccagugacgcauucgucagcggcucaaagaagaggacgaauaggacgaaaucccaaaaacgaaaacgaucaauauauauauaugggcgaacccuuagaaaaugaugaggauugcgcccauuggaaagaagcaaaaaugcucuuagauaacauaaauacgccagaaggaauaauuccuucuauguuugaaccggaacgagagaagguggacgcaauugacggagaguacagauuacguggagaagcaagaaaaacauuugucgacuuaaugagaagaggcgacuugccagucugguuagcguacaggguggcugcugaaggaauaaauuaugcagaccgacgaugguguuucgauggaauaaagaacaaucaaauauuagaggaaaauguugaagucgagaucuggacaaaagaaggggagaggaagaaacuaaaaccuagaugguuagaugcucgaauauacucggauccuuuggcccuuaaagaauucaaggaguuugccgcuggucgcaaaaguuugacacuaaaccugauaacugaaauggggcgauuaccuacauuuaugacccaaaaggccagggaugcauuggacaacuuagcgguacugcauacagcggaaguaggagguagggcuuacaaucaugcacuaucggaacuucccgaaaccuuagaaacguugcuuuuguuaacucuauuagcuaccgucacuggaggaauauuuuuauuucuuaugucaggaaaggguaucggaaaaaugacguuagggauguguugcauaaucacggccucaauauuauuaugguaugcgcaaauacaaccacacuggauugcagcuucaauaauauuggaguuuuuucuuauaguccuauugauccccgagccggaaaagcaacguacaccacaagacaaucaauuaacauacguggugauugcaauacuaacaguaguggccgccacgauggccaacgaaauggguuuccucgagaaaacuaaaaaagauuuaggguuaggguccauaacuacgcaagaaagugagaguaauauacuugacauagaucuccgccccgcaagcgcauggacucuauacgcaguggcuaccacguuugucacaccaauguuacgacauucaauugaaaacaguucaguaaacguaucgcuaacagcgauagcaaaccaggcuaccguauuaaugggauuggguagaggauggccguuaucuaaaauggacaucggagucccacuuuuggcuauaggauguuacucgcaagugaacccuauaacacuuacagcagcacuauuauuacuuguagcccacuaugcgauaauagguccgggucuucaagcaaaggcaacacgagaggcucaaaaaaggaccgcagcagguauaaugaagaauccaaccguugauggaauuaccgugauagaccuagaaccuaucccauacgaucccaaauucgaaaagcaauuaggccaaguaaugcuauuaguccuauguguuacucaaguccuaaugaugcgaacgacuugggccuugugugaagcacuaacacuagcaacuggaccgauaucuaccuuaugggaaggaaauccuggaagguucuggaauacuacuauagccguaagcauggcaaauauauuucgcgggucauaucuugccggagcuggauugcuauuuucgaucaugaaaaacacuaccaauacgagacgcgguacuggaaauauaggggagacacuaggugagaaguggaaaucacaacuuaaugcgcuuggcaagagugaauuccagaucuauaaaaagagcgggauccaagaaguggacagaacguuggccaaagaaggaauaaaaagaggcgagaccgaucaucaugcuguaagcagaggcuccgcaaaacucagaugguucguagaaagaaauauggucacacccgaagguaaaguaguagaucuagguugcggaaggggaggauggagcuauuacugugggggccuaaaaaacguacgagaagugaaaggauuaacuaaaggcggaccaggccaugaagaacccauaccgaugagcaccuacggauggaauuuaguucggcuacaaagugggguagacgucuuuuuuacuccucccgaaaaaugcgauacccuucuaugcgacauaggagaaucuaguccaaauccaacuaucgaagcuggaagaacccuaagaguacugaaucuaguagagaacuggcuaaacaauaacacgcaauuuugcgugaaaguauuaaacccauacaugccaucaguaauagaaaaaauggaaaccuuacaaagaaaauaugggggagcacuaguacguaauccauuaagcagaaacagcacacaugaaauguauuggguuucaaacgcaacaggaaacauaguaucguccgugaacaugauuucccgaaugcuuaucaacagauucacaaugaaacacaaaaaggcaaccuaugaaccagauguagaccucgguucaggcacacgaaauauuggaauagaaaaugaaauaccaaauuuagauauaauaggaaaaaggauagaaaaaaucaaacaagagcaugaaaccucauggcauuaugaccaggaccacccuuauaaaaccugggccuaucacgggagcuaugaaacaaagcaaaccggcucggcaucguccaugguaaauggaguaguaaaauuacuuacaaaaccaugggaugucgucccaaugguaacucaaauggccaugacagacacgacaccauucggacaacagagaguauucaaggaaaaagucgacacacgaacccaagaacccaaagaaggaacgaaaaagcuuaugaggaucacggcugaguggcuauggaaagaauuaggaaagaagaagacuccacgaauguguacacgugaggaauuuacucggaaagucagguccaaugcagcuuugggagcuauauuuaccgaugaaaauaaauggaagagugcgagagaagcgguugaggauucccgauuuugggaauuagucgaucgcgagcgaaaccuacaccuugaagguaagugugaaacuugcguguacaacaugaugggaaaacgugagaaaaaguuaggagaauuuggaaaagcuaaagggaguagagccauaugguauauguggcuaggagcuagauucuuagaguuugaggcccuuggcuuccuuaaugaagaccauugguuuagcagggguaauagucuauccggaguagaaggggaaggucuacauaaguuggguuauauuuugcgagaugugaguaaaaaagagggaggggcgauguacgcggacgacacugccggaugggauacccgcauaacauuagaggacuuaaaaaacgaggagauggugacaaaccauaugaaaggggagcauaaaaaauuagcggaagcuauuuucaaauuaacauaccaaaauaaaguuguaagaguccaaaggccuacaccucguggcacaguuauggacauuauuucaagaaaagaucaaagaggaaguggacaaguuggaacauauggucuuaacacuuuuacuaauauggaagcacaauuaauucgucaaauggagggggaaggaauauuuaaaucaauucaaagacucacaguaaccgaggaaaucgcaguccaaaauugguuggcccggguagggcgagaaagauuaucccgcauggcuauuaguggcgacgauugcguagugaagcccuuggaugaucgguucgcaucugcguuaaccgcacuaaacgauaugggcaaaguacguaaagacauacaacaaugggagcccagucgaggauggaaugauuggacacaaguuccauuuuguucacaucauuuccaugagcuaguaaugaaagacgguagggucuuaguuguaccaugucgaaaucaagacgaauugauagguagagcacgaauuucccagggugcaggauggagccuaaaagaaaccgcguguuuagguaaaagcuaugcacaaauguggacauuaauguauuuucauaggagagaccuacgacucgccgcuaaugcgauauguagugcaguaccaagucauuggguaccgacuucaagaacaacuuggagcauucacgcuaagcacgaguggaugacuacagaagauaugcuugcuguauggaauagaguauggauacaagaaaauccauggauggaggacaaaacuccgguugaaaguugggaggaaguuccauacuuagguaaacgagaagaucaauggugugguaguuugaucggauugacaaguagagccacaugggcaaaaaauauacaaacagccauuaaccaaguaagaucacuuauagguaaugaagaauauacugacuacaugccgaguaugaagcgguuuaggaaggaggaagaggaagcuggcguauuaugguaa

SEQ ID NO: 22619 - RNA, 9876 nt, Artificial Sequence
  derived and/or modified CDS sequence (opt6) from DENV-2__EU482726__SS-prME
acagcugguguaauuguaauguuaaucccuacggucauggcguuccaccucacaacaaggaacggagaaccacauaugauaguagggcgccaagaaaaaggaaaaucacuacucuuuaaaacagaagauggcgugaacaugugcacacuuauggcuauugaccucggugaacuuugcgaagauacuauuacauauaaauguccguuauugcgacaaaacgaaccugaagacauagacuguuggugcaauucaacaaguacguggguuacauacggaacuuguacaacaacaggggaacauaggagggaaaaacggucuguagcacuuguaccgcacguaggaaugggacucgaaacacgcacagaaacuuggaugucaucggaaggugcuuggaaacacguacaacguaucgaaacauggauuuuacgacaccccgguuucacaauaauggcagcaauacuugcuuauacaauagguacaacucacuuccagcgugcacucauauucauacuucuuacggcaguagcuccaucaaugacaaugcgcugcauagguauuucaaaucgugacuucgucgaaggaguaaguggagggagcugggucgacauaguuuuagaacauggaucuugcgugacuacgauggcgaaaaacaaaccaacucucgacuuugaguugaucaaaacugaggcuaagcaaccugcaacccugcggaaauacugcauagaagcgaaauuaacaaacaccacuacagaaucuagauguccaacgcaaggcgagccgucauuaaaugaagaacaagauaaacgcuucauaugcaaacauaguaugguagaccgaggguggggaaacggaugcggacuauucgguaaaggcggcauuguaaccugcgcaauguuuacuugcaagaagaauauggagggaaaaauaguucaaccugagaacuuggaauauacaauaguaauuacuccgcauucaggugaagaacaugcagucggaaacgauacagguaaacauggcaaggaaauuaaaauuacaccacaaagcucuacuaccgaagcagaacucacaggauauggaacugucacgauggaguguucaccacgaacaggucuagacuucaacgaaaugguacugcuccagauggaagauaaagcaugguuggugcacagacaaugguuucuagaccugccauuaccuuggcuacccggagcggauacgcaaggaucuaacuggauucagaaagagacuuuagucacuuucaaaaacccacaugcgaaaaagcaagacguggucgugcuagggucacaggaaggcgcaaugcauacagcguuaacaggagcaacagaaauacagaugagcuccggaaacuuacuauuuacugggcauuugaaaugcagauuacgcauggacaaacuacaguuaaaaggaauguccuacaguaugugcauuggaaaauuuaagauaguaaaggaaauagccgaaacgcagcacgggacgauaguaauccguguacaguaugagggugauggguccccuuguaagauuccuuucgaaauaacagaucuagagaagaggcacgucuugggaaggcugauaaccguaaaucccauuguaacagagaaggaugccccagucaauauugaggcagagccucccuuuggugacucguauaucaucguaggaguggaaccaggacaauuaaaauugaauugguucaagaaagggaguucaaucggucagauguuugaaacaacaaugagaggagccaaaagaauggcgauuuuaggggauacagccugggauuuugguagccugggagguguauuuacuagcauagguaaagcucugcaucagguauucggcgcaauauauggggcagcauuuucaggagugaguuggacgaugaagaucuuaauagguguuauaauuaccuggauaggaaugaacaguagaaguaccaguuuaucaguaagccuaguucuagucggaguaguaacucuauauuuaggcgcugugguccaggccgauaguggcugcgugguaaguuggaaaaacaaagaacucaaauguggcucaggaaucuuuauaacagacaacguucacaccuggacagagcaauacaaguuucaaccggaaucaccuagcaaauuggcuagcgcaauacaaaaagcacaugaagaggguauaugugggauaagaucaguaacccguuuggaaaauuugauguggaagcaaauaacaccggaguuaaaccauauucucucagaaaacgaagugaaguuaaccauaaugacaggugauauaaaaggcauaaugcaagcagguaaaagaucacucagaccacaaccaacggaacucaaguacaguuggaaaaccuggggaaaggccaaaaugcuuaguaccgaaagccacaaucaaacauuucucauugacggaccagaaacugcggaguguccaaauacuaauagggcuuggaacucgcucgagguagaagacuacgguuuuggcgucuuuacgaccaacauauggcuuaaacuaagggaaaaacaagauguuuucugugauagcaaauuaaugagugcagcgauuaaggauaauagagcaguucaugcggauaugggauauuggauagaaucugcauuaaacgauacauggaaaauggaaaaggcaaguuucauagaggugaaaucaugucacuggcccaaaagucauacucuuuggucuaacggaguauuagagagcgaaaugauaauucccaagaauuucgccggacccgugagccagcacaauuacagaccaggguaccauacacagacagcaggccccuggcaccucggaaaauuagaaauggacuuugacuucugugaagguacaacaguaguggugacagaagacugugguaaucguggaccuaguuuacgaacaacaacggcaucugguaaguugaucacagaaugguguuguaggagcugcacacuuccuccguugagauauagaggagaggaugguugcugguaugggauggaaauacgaccccuuaaagagaaagaagaaaacuuaguaaacagucuuguaacugccggacauggacagauugauaauuuuagcuuaggaguacucggaauggccuuauuccuugaagagauguuacgaaccagagugggaacuaaacaugcaacauuacuuguagcauuaucauuugugacacuaauaacaggaaacauguccuuucgcgaucuaggucgagucaugguaauggugggcgcaaccaugacagacgauauaggaaugggcgucacauauuuagccuuguuagcugcuuucaaaguaagaccaaccuucgcagcgggacuauugcuucgaaagcuaacaucuaaagaacuaaugauggcaacaauagguauagcauuauuaucucagucaacacugcccgaaacgauuuuggaacugacagaugcccuagcucucggaaugaugguccucaaaauugugagaaacauggaaaaauaucaacuugcggugacgauaauggcgauuagcugcguaccgaacgcaguuauucuacaaaaugcuuggaaaguaucuuguacaauacuagcagcuguuuccguaucgccccuucuguugacuucaucccaacagaaagcggacuggauaccgcucgcccuuacaauaaaaggucucaauccaacggcuauauuccuaacgaccuuaucccgaacauccaaaaagagaagcuggccauugaacgaagcuauuauggcagucgguauggucaguauacuagcaagcucuuuacuuaaaaacgacauaccuaugacagggccucuaguagcugguggacuccucaccguguguuacgucuugacgggaaggucagcagauuuagaacuugaacgugcagcagacgucaagugggaagaucaggcagagauaucaggaucgagcccaauucucaguaucacuauaucugaagauggcucuaugucaauuaagaaugaagaagaagaacagacacuuacuauuuuaauacguacagggcuguugguaauaucaggcguauucccgguauccauuccaauaacggcggcggcuugguaccuaugggagguaaagaaacaacgugcggggguacuaugggaugucccaagcccuccaccagugggaaaagccgaauuagaggacggugcauacaggauuaaacagagagggauacuugguuauucccagaucggagcaggagucuacaaagagggaacauuucauacaauguggcaugugacgagaggagcugucuuaaugcauagggguaaaagaaucgaaccaagcugggcagaugucaagaaagaucuaaucucuuauggugguggguggaaacuugagggggaauggaaagagggggaagaagugcaagugcuagcucuagaaccuggcaaaaauccgagagcaguacaaacaaaaccaggaauauuuaaaacuaacacuggaacaauaggagcaguuucauuggacuuuucgccagggacuucaggcucuccaauaguagauagaaaaggcaaaguuguaggauuguaugguaauggagugguaacaaggaguggagcauauguaucagcaauagcucagacggaaaaauccauugaagacaauccugaaauagaagacgacauuuucaggaaaaagagacugacaauaauggacuuacacccaggugcaggaaaaacuaaacgguaccuuccagcgauaguacgagaagccauuaagaggggccucagaacauuaauacuugcacccacacgcguggucgcugccgaaauggaagaagcgcuaagaggucuuccuauuagauaccagaccccugcgauaagagcugagcacaccgguagagaaauuguagauuuaaugugccaugcgacguucacaaugcgauuacucuccccaguuagagugccaaauuauaaccucauaauaauggaugaagcacauuuuacugauccugcgaguauagcggcacggggauauauaucuacacguguagaaaugggagaagcagcagggauuuuuaugacugccacuccuccugguuccagagauccauuuccucaaucgaacgcgccaauuauggaugaagaaagagaaauccccgagagaucauggaacuccgggcaugaauggguuacagauuucaaagggaaaacaguaugguucguuccuaguauuaaagcagguaaugauaucgcagccugucuaaggaaaaaugggaagaaaguuauucaacugagcagaaaaacguucgacucagaauauguaaaaacuagagcaaacgauugggauuuuguaguaacaacugauauauccgaaaugggggcaaauuuucgugccgaacgaguaauugaucccagaaggugcaugaaaccaguuauuuugacugauggagaagaacgaguaauccuugcgggaccuaugccgguaacucauuccucugcagcacaaaggagaggacgaauuggacgaaauccuaagaaugaaaacgaucaguauauauacaugggggaaccauuagagaacgacgaagacugugcacacuggaaagaagcuaaaaugcuucuagacaauauuaauacuccggaaggaauuauaccaucaauguuugaaccugaacgugaaaaaguagacgcuauugauggugaguacagauuacgaggugaggcccgaaaaacauucguugacuuaaugcguagaggagauuugccugugugguuagcauacagagucgcugcagagggaauuaauuaugcagacagaagauggugcuucgacggaaucaaaaacaaucaaauauuagaagaaaauguugaggucgaaauuuggacuaaagaaggagagcgaaagaaacuaaaaccccguuggcuagaugcacguaucuauagugacccauuagcacuuaaagaauuuaaggaauuugcggcagggagaaagucuuuaacauuaaauuugauuacugaaauggggagacucccaacuuuuaugacacaaaaagcacgcgacgcauuagacaaccuggcaguucuacacacggcugaaguuggcggucgggcauauaaucacgcucuuucugaacuuccagaaacgcuagaaacauuacuauuacuaacgcuauuagcaacuguuacaggaggaaucuuccuauuuuugaugucaggaaaagguauaggcaaaaugacgcugggcauguguugcauaauuacugcaagcauucucuugugguacgcgcaaauucaaccccacuggauagcugcaucuaucauucuagaguucuuccuaauugucuuacucauuccugaacccgagaaacagagaacaccacaggacaaucaacuuacuuauguaguaauagcuauauuaacugucgucgcagcuacgauggccaaugaaaugggcuuuuuggagaaaacuaagaaagacuuaggauuaggcaguauuaccacacaagagagugagucgaauauuuuagacauugaucugcgaccagcaucggcauggacacucuaugcaguggcgacaacuuucguaacccccaugcuuagacacagcaucgagaauaguaguguuaauguuucacucaccgcaaucgcuaaucaggcaacugucuuaaugggacuaggccguggauggccguugucuaaaauggacaucgguguaccauuacuugcuauaggcuguuacucgcaagugaauccaauaacauuaaccgcagcacuucuccuauuaguggcucauuaugcgauaauugggccaggguugcaggccaaagcuacacgugaggcgcagaaaagaacagcagcggguauaaugaaaaacccaacaguggacggaauuacaguaauagacuuagagccuauacccuaugacccgaaauuugaaaaacaacuuggccaagugaugcuacugguauugugcgucacacaaguauuaaugaugcgaacaacaugggcacuaugcgaggcuuugacuuuagccaccgggccaaucucaacauugugggaaggaaacccgggacgauucuggaacacaaccauugccguuucuauggcuaacauauucagaggaucauacuuagcaggggcuggucuccuauucucaauaaugaaaaacaccacaaacacacggcgaggaaccgggaacauaggagagacauuaggugaaaaauggaagucuagacuaaaugcauuaggaaagagugaauuucaaauuuauaagaaaucaggaauacaggaaguagaucgaacacucgcaaaagaggguaucaaaagaggagagacagaccaucaugcuguuuccaggggcucagccaaacuccgcugguuuguugaaagaaacauggucacgccugagggaaaaguaguugaccuggguugcggccgggguggcuggucauauuauugcgguggacuaaagaauguuagagagguuaaaggguuaaccaaggguggucccgggcaugaggaacccauucccaugucaacauacggauggaaccucguacgauuacaaagcgggguggauguuuucuuuaccccaccggaaaaaugugauaccuuacugugcgacauaggagaaaguaguccuaacccaaccauagaagcuggaagaacacuacgcguacuaaaucugguggaaaauugguuaaauaauaacacgcaauuuuguauaaaaguacuaaaucccuauaugccaucaguaauugagaaaauggaaacuuuacaaagaaaauaugguggcgcauuaguucgaaauccuuuguccagaaauucaacacaugagauguacuggguaucaaaugccacugguaauauagugaguucuguuaauaugauaucaagaaugcuaauuaauagauuuacuaugaaacauaagaaggcaacuuaugaacccgauguagaucugggaagugggacccguaacauaggaauagaaucagaaaucccaaaucuagauauaauaggaaaaagaauagagaaaauuaaacaggagcaugagacaaguuggcauuacgaucaagaucacccauacaaaacaugggcauaucacgguucuuacgagaccaagcaaacugguucggcaaguucaauggugaacggcguuguaaaacuauuaacaaaaccaugggacgugguaccgauggucacacaaauggcaaugacagacaccacaccauuuggacaacagaggguauucaaagagaagguugacacuagaacacaggagcccaaagaagguaccaagaaacugaugcgaauaacagcugaaugguuauggaaagaacuuggcaagaagaaaacaccgcguaugugcacacgugaagaguucacuaggaaaguucgaucgaaugcugcauugggggcaaucuucacagaugagaauaaguggaaaagcgcacgagaggcaguggaagauaguagauucugggaacucgucgaccgggaaaggaaccuacacuuggaaggaaaaugcgagacauguguauacaauaugaugggaaaaagggagaagaaacuaggagaguucggaaaagcuaaaggcaguagagcuauuugguauauguggcuuggugcuagguuucuugaguucgaagcgcugggauuuuugaaugaagaucauugguuuucuagagguaacucacugucggggguugaaggagaaggguuacauaggcugggcuauauauuaagagaaguagguaagaaagaagggggugcaauguaugcagacgacacggcagggugggacacaagaaucacacuggaagauuugaaaaacgaggaaauggugacuaaucauaugaaaggagagcauaaaaaguuggcagaagcaauuuuuaaauuaacguaucaaaauaaagucguucgaguacaaagaccuacgcccagaggcacuguuauggauauaauuuccaggaaggaucaaagaggcucaggucaagucggaaccuauggguuaaacacauucacuaauauggaagcccaauuaauaaggcaaauggaaggagaagguaucuuuaaaucaauacagcaucugacugcaacagaggagaucgcuguacaaaauuggcuagcaaggguagguagagagagauuaaguagaauggcaauuucuggcgaugauuguguuguaaagcccaucgaugauagguuugcaucagcauuaacagccuuaaaugauauggguaaaguacgcaaggauauucaacaaugggagcccaguagaggcuggaacgacuggacucaaguaccauucugcucacaccauuuucacgaacucgugaugaaagacgggaggguccuaguaguuccaugccgaaaccaagaugaacuuauaggcagggcaagaauuucgcagggugcgggguggagucuaaaagaaacggcuugccuaggcaaauccuaugcucaaauguggacuuuaauguauuuccaucgaagggauuuacgauuagcugcgaaugcaauauguucagcugugccaagucacuggguaccuacuagcagaacuacgugguccauacaugcgaagcaugaauggaugacaacagaagacaugcuugccguauggaacagaguguggauacaagaaaacccuuggauggaagauaaaacaccugucgagucaugggaagaaguucccuaucuagguaaacgggaagaucaauggugcggcucacuaaucgggcuaacaagucgcgcaacgugggcuaagaauauucagacggccauuaaucaaguacgaucauugauugggaaugaagaauacacugauuauaugccaucaaugaaacgguuccgacgggaagaagaagaagcaggcgucuuaugguaa

SEQ ID NO: 22620 - RNA, 9876 nt, Artificial Sequence
  derived and/or modified CDS sequence (opt6) from DENV-2__EU482727__SS-prME
acagcugguguaauuaucaugcucauaccaacggcgauggcauuccaucugacuacaagaaauggagaaccacauaugauuguuggacgucaagaaaaaggaaaaagucuccuauuuaaaaccgaagaugguguuaacauguguacuuuaauggcuauugaucucggagaacucugugaagauaccauaacauauaaaugcccuuuauugagacaaaacgaaccagaagauauagacugcugguguaauaguacgucgaccuggguuacguauggaaccugcacuacaacuggugaacauaggcgcgagaaaagaucuguagcccuaguaccucauguagguaugggucuagaaacaaggacagaaaccuggaugaguucggaaggugcuuggaaacaugugcaaaggauagaaacauggauacuuagacauccuggauuuacgaucauggcugcgauacuagccuauacaaucgggacuacacauuuccagagagcauugaucuucauucucuuaacggccguggcuccgucaaugacuaugcgguguauaggaauuuccaauagggauuuuguagagggcguuucaggagguuccuggguugauaucguguuagaacaugguuccuguguuacgacuauggcgaaaaauaaaccgacucuagacuucgaacugauaaaaacugaggccaaacaaccagcaacccuaagaaaauacuguaucgaagcaaaauuaacaaacacaaccacagaaucaagguguccaacccagggcgagccaucauuaaaugaagaacaagauaaaagauucaucugcaaacacucaaugguagauagaggauggggcaauggaugcggucucuuuggaaaaggagguauaguaacgugugcaauguucacauguaagaagaacauggaaggaaaagucguauuaccggaaaaccuagaauauacgauagugauaacaccucacuccggugaggaacacgccgucggcaaugauacaggaaaacauggaaaagaaauuaaaauuacuccgcaaucaucaauaacagaagcagaacucacagguuacgggacagucacaauggaauguucaccaaggacagguuuagauuucaacgaaaugguuuuguugcaaauggaagauaaagcaugguugguucaucgccaaugguuccuagauuuaccucuuccgugguuaccgggcgccgauacacagggaucaaacuggauccaaaaagaaacccuagucacauucaaaaauccgcacgcgaagaaacaggacgugguaguucuagggucacaagaaggugcaaugcacaccgcguugacaggagcgacugaaauucaaaugucgagcgguaaccuacuauuuacuggacauuuaaaaugccgacuacguauggauaaacuacaauuaaaaggaaugucauauucaauguguacggggaaauuuaaaauagucaaagagauagcggaaacacaacaugggacgaucguuaucagaguacaauaugagggugaugggucaccgugcaaaauaccauucgagauaauggauuuggagaaacgacacguacucggaagguuaauuacugugaauccuaucguaaccgaaaaagauucaccagucaacauagaagcagagccaccuuucggcgauucauauaucauaauaggggucgagccaggccaauuaaaacuaaauugguucaagaaaggcucgaguauagggcaaauguuugaaacaacaaugagaggagcaaaacgaauggcaauauuaggugacacagccugggacuuuggaucgcugggaggaguuuucacaucaaucgguaaagcacuccaccaaguguuuggggcaauauauggugcagcuuuuagcggcguaucguggacaaugaaaauauuaauaggaguaaucauaaccuggaucgguaugaacucgcgaaguacaucacuaucagucagccuaguucucguaggaguuguaacacuauaccuaggagugaugguucaggcggauagugguuguguaguuuccuggaaaaauaaagaguuaaaaugcggcaguggaauuuuuauaaccgacaauguucacacauggacggaacaauauaaauuucagccugaaagucccaguaaacucgcaucagcaauucagaaagcgcaugaagaaggaauauguggcauaagauccguaacuagacuugaaaaucuaauguggaaacaaaucacaccugaacucaaccauauucuaucagaaaaugaagucaaacuaacuauaaugacuggagauaucaaaggaauuaugcaagcugguaaaagaucauuaagaccccaaccgaccgaguuaaaauauagcuggaaaaccuggggaaaagcaaaaaugcugaguacggaaucacacaaccaaacuuucuuaauagauggaccagagacugcagaaugcccaaacacuaauagggcuuggaacucccuagaggucgaggacuaugguuucggcguuuuuaguacaaauauuuggcuaaaauuacgagaaaaacaagaugucuucugcgauuccaaauugauguccgcagcgauaaaggauaaucgcgcaguacaugcagacauggguuacuggaucgaaucagcgcuaaacgauaccuggaaaauggaaaaggccuccuucauugaagugaagucaugccauuggccaaaaucucauacacuauggucgaauggcguucucgaaagcgaaaugauaauuccgaaaaacuuugcagggcccguaucccaacacaauuaucggccuggauaucauacacaaacugcggguccuuggcacuuaggcaagcucgaaauggauuucgauuuuugcgaagguacaacaguuguuguaacagaagauugcggaaauagagggccaucccuucggacaacgacagcaaguggaaaauuaauaacagaguggugcuguaggucauguacacuaccaccacuaagauaccgaggugaagacggaugcugguacgggauggaaauccguccauuaaaagaaaaagaagaaaauuuaguuaauuccuugguuacagcgggucauggucagauugacaauuuuucacuaggcgugcuagggauggcacuauuccuugaagaaaugcuucguacgcguguaggcacgaagcaugcaauucuucuugucgccgugucauucguaacuuuaauaacugguaacauguccuucagagaucuuggacgcgugaugguaaugguaggugcaacaaugacugaugacauuggaauggguguuaccuaccuugcacuucucgcagcauuuaaagugaggcccacuuucgcagcuggucuuuugcuaagaaagcuaacaaguaaagagcugaugauggcuacgauugguauugcauuacuaagccaaaguacaauaccagaaacaauucucgaauuaaccgacgcguuggcccugggaaugauggugcugaaaauagugcgaaacauggaaaaauaucagcuagccguaaccaucauggcuaucagcugugucccuaacgcaguaauacuucaaaaugcuuggaaaguuucauguacgauucucgcagcaguaucgguaaguccuuuguuguuaacaaguagccagcaaaaagccgauuggauaccauuagcacugacuauaaaaggcuuaaauccaacugccauauuucuaaccacacuaagucgaacuuccaagaaaaggagcuggccguuaaacgaggcaguuauggccgucggcaugguaucuauauuagcuagcucacuacuaaagaaugacauaccuaugacggggccgcuagucgcugguggguuauuaacagucugcuauguauugacaggcagaucagcugauuuagaauuggagagagcagcugaugucaaaugggaggaucaagcugaaaucagcgggaguucgccuauuuuaaguauuacgauaagugaggacggaaguaugucaauuaagaaugaagaagaagaacaaacacucacaauuuuaaucagaaccggcuugcugguaauaucuggagucuucccaguuaguauacccauaacugcagcggcaugguacuuaugggaagucaagaaacagagagcgggaguucucugggauguaccgucaccaccaccuguuggaaaagcugaacucgaagauggugcuuacagaauuaaacagcguggaauuuuugguuauucucagauaggagcaggaguauauaaggaaggaacauuucacacaauguggcacguaacucgcggagccgugcuuaugcauagaggcaaacgaaucgagccaucgugggcggacguuaagaaagaucuuauaaguuacgggggcggcuggaaacuggaaggcgaauggaaggagggugaggaaguacagguacuagcacucgagccaggcaaaaauccgagagcagugcaaacuaagcccgggcuauuuaaaacgaauacgggcacuauaggggcaguaaguuuagauuucagucccggaaccagcggaucgccgauugucgaucguaaagguaagguaguaggacuauauggaaaugggguaguuacucgaagcggagcuuacguaucagcuauagcacaaacugaaaaaucaaucgaggauaacccagagauugaagaugacauuuuuaggaagaaaagauugacuauuauggaccugcauccuggagcugggaaaacaaagagauauuuaccugcaauuguacgugaagccaucaaaaggggccuaagaacauuaauuuuggcccccacgagaguaguagcagcagaaauggaagaagcacuaagggguuuaccuaucagauaccagacgccugcaaucagagcagagcauacuggcagagaaauaguugauuuaaugugucaugcgacauuuacgaugcgacuauuaaguccgguucgaguuccuaauuauaauuuaaucauaauggacgaagcacauuuuacagacccagcuagcaucgcugcaagaggcuauauauccacacguguugaaaugggagaagcugcagguauuuucaugacagcuacaccgccagguagcagggacccuuucccucaaaguaaugcuccuauaauggaugaggaaagagaaauaccagagagaagcuggaacucggggcacgaauggguaacagauuucaaaggcaagacugucugguuuguaccuucaauaaaagcgggaaaugauauagcagccuguuuaaggaaaaaugguaagaaaguuauacaauuaagccgcaaaacauuugauagugaguacguaaaaacacgggccaacgacugggacuucguggucacaacugauaucagcgaaaugggagcaaacuuuagagcggaacgaguuauugacccacgaagauguaugaaaccuguaauauuaacugacggcgaagaacgcguaauauuggcagguccgaugcccguaacccauucuuccgcugcgcaaaggcgaggaaggauaggacgaaaccccaaaaaugaaaacgaucaauacaucuacaugggagaaccauuagaaaacgacgaagacugugccuauuggaaagaagcgaagaugcucuuggacaacauaaacacaccagaggggauaaucccgucaauguuugaaccagaacgagagaaaguugaugccauugauggugaauacagacuaaggggugaagcucguaaaacauucguugacuuaaugcgaagaggugaccuccccguguggcuagcauauaggguugcagcagaagggauaaauuacgcagauagaaggugguguuuugacggaauaaagaauaaccaaaucuuggaagaaaacgucgaaguagaaauauggacaaaggaaggcgaaagaaagaaauugaaaccuagguggcuggacgccagaaucuauucugauccacuagcauuaaaagaauuuaaagaauuugcugcaggacgaaaaagccuaacguuaaacuuaauaacugaaauggggagguuaccaacguucaugacccaaaaggccagagaugcccucgacaacuuagcugugcuucauacagccgaaguaggugggagggcauauaaccacgcauuaagcgaauuaccugaaacguuggaaacauuguuauuguuaaccuuacuagccacuguaacuggcggaaucuucuuauuucuuaugucugggaaaggaauugguaaaaugacgcuuggcaugugcugcaucauuacagcaucuauauuauugugguaugcgcagauucaaccccacuggaucgcugcaucuauaauacucgaguucuucuuaaucgugcuguuaauuccagaaccagaaaagcagcgaacgccucaagauaaucaacugacuuauguagugauugcaauacuaacaguuguugcagcaacuauggccaacgagaugggauuccuugagaaaacuaagaaagaccuaggucuaggaucaauaacaacacaagaauccgaauccaauauauuagauauagaccuaaggccggccucagcauggacccucuacgcaguagcaacgaccuucguuacaccuaugcugagacauucuaucgaaaauagcagugucaauguuaguuugacugcaauugcuaaccaagccacuguguuaaugggacuaggacgagguuggccacuguccaagauggauauaggagugccacuucucgcaauuggauguuacucccagguuaacccaauaaccuuaaccgccgcccuguuacuauugguagcucauuacgcaauaaucgguccaggucugcaagcaaaagcaacacgcgaggcccagaagagagcagcagcugguauuaugaagaacccaacagucgauggaaucacuguuaucgaucucgaaccaauaccguacgauccuaaauuugagaaacagcuuggucagguuaugcuguuaguacucuguguaacacaagugcuaaugaugagaacuacaugggcccuuugugaggcacugacauuagcaacugguccgauuagcacauuaugggaagggaauccugggcguuucuggaacacgacaaucgcaguaaguauggcgaauauauuuagggguucuuaucuugcaggcgcggggcuucuguuuucaauuaugaaaaauacaacaaacaccagacgagggacuggaaauauuggagaaacguugggugaaaaauggaaaaguagacuaaaugcguuagguaaaagcgaauuucagauuuacaagaaguccggaauacaagagguagauagaacauuagcuaaagaaggaauuaaaagaggcgagaccgaucaucaugcagugagucgcggaucugcaaaauuacggugguuuguggaacgaaauauggugacgccggaaggaaaaguaguagacuuagguuguggaagaggagguuggaguuauuauugcggagguuuaaagaauguacgagaaguaaaggguuugacgaaaggagggccaggccacgaagaaccuaucccuaugagcacauauggauggaacuuagugagguuacaaucuggaguagacguauuuuucacuccuccagaaaagugcgacacccuccuaugugacaucggugaaaguuccccuaauccaacaauugaagcugguagaacauuaagaguauugaaucuaguagaaaauuggcuaaacaacaacacucaauucuguauaaagguauuaaauccguauaugccuaguguuauagagaaaauggaaacguuacaacguaaauacggaggggcccuaguaaggaauccauuaagucgaaauucgacacaugaaauguacuggguuucuaaugcaacagggaauauugucucaagugugaacaugauuaguaggaugcuaauuaaccgauucacuaugaaacauaagaaagccaccuacgagccagaugucgaucugggcucugguacaagaaauauaggcauagaaaaugaaauucccaauuuggacauaauagguaaaagaauugagaagauuaaacaagaacaugaaacuucauggcauuacgaccaggaucauccauauaaaacaugggcuuaucacggaucuuacgagacaaaacaaacgggaucugcaucaucaaugguuaauggaguuguucgauugcuuacaaaaccaugggacguugugccaaugguuacccagauggcgaugacugacacuacgccuuucggacaacaaaggguauuuaaagagaaaguugacacaaggacccaggaacccaaagaagggaccaagaaacuuaugaggauuacagccgaaugguuauggaaagagcucggcaagaagaaaacuccgcgaaugugcacgagggaagaauuuacgagaaaagugagaucaaaugcugcuuuaggagcuauauuuacggaugaaaacaaguggaaauccgcccgagaagcugucgaagacucgcgauuuugggaauuaguugauagagaacgcaaccuccauuuagaaggaaaaugcgagaccuguguguauaauaugaugggaaaaagagagaaaaagcuaggagaguucggaaaagcuaaaggaucaagagcuauuugguacaugugguuaggagcacguuuccuagaguucgaagcguuagguuuucuaaacgaagaccacugguuuucucgaagaaauagucugucaggaguggagggugaaggguugcauaaauugggguacauucugcgcgauguaagcaagaaagaaggaggugcuauguacgcagaugauacggccgguugggacacaaggauuacauuggaagaucuuaaaaacgaagaaaugguuacgaaccacaugaaaggcgagcauaagaaacuagcggaagcaauauuuaagcuaaccuaucaaaacaaggucguacguguucaaaggccaacacccagagguaccgugauggacauaauaucaaggaaagaucagagaggaaguggacagguggguacauauggacuuaacacauuuacuaacauggaagcgcagcucauucgacagauggagggugagggaauuuuuaagucaauccagagacuaacaguuacagaagaaauugccguccaaaauugguuggcgaggguaggaagagaaagauuaucccgaauggcuauuucaggcgacgauuguguggugaaaccccuugaugaucguuuugccagugcacuuacugcacuaaaugacaugggaaaaguacguaaagauauacaacaaugggaaccgucaagggguuggaaugauuggacacaaguaccauucuguucacaucauuuucacgaauuaguuaugaaagacggaagaguacuggucguuccaugccguaaccaagaugagcuaauuggacgugccagaauuucccaaggagcuggguggagcuugaaagaaacagcuugucuggggaaaucauaugcgcaaauguggacauuaauguauuuccacagacgugaucugagacuagcggcaaaugcuauauguucagcugugccaucgcacuggguucccacaaguaggacaacauggagcauacaugcuaaacaugaauggaugacgacagaagacaugcuugcgguauggaaccgugucuggauacaagaaaacccuuggauggaagauaagacuccaguugaaagcugggaagaagugccuuauuugggaaagcgcgaagaccaauggugcgguucuuugaucggacucacaagcagggcgaccugggcuaaaaauauccaaacugcgauaaaccagguuagaagucuaauugguaaugaggaauauaccgauuauaugccuaguaugaaaagguuuagaaaagaagaagaagaggcggguguauuaugguaa

SEQ ID NO: 22621 - RNA, 9876 nt, Artificial Sequence
  derived and/or modified CDS sequence (opt6) from DENV-2__EU482728__SS-prME
acugcugguguaauuauaaugcuaauaccaacugcaauggcauuccacuuaacgacacgaaauggagaaccacauaugauaguuggaagacaagaaaaagguaaaagccugcuauucaaaacagaagaugggguaaauauguguacauugauggccaucgaccuaggcgaacugugcgaagauacaauaacuuauaaauguccacuacuaaggcaaaaugaaccugaagauauagacugcuggugcaacucaacauccacauggguuacauacggaacaugcacaacaacgggugaacaucgucgcgagaaaagaagcguugcgcuagugccacacguuggaaugggguuggaaacucgaacugaaacauggaugucuucagaaggcgcuuggaaacauguccaaaggauugagacauggauucuucgucauccaggauucacaaucauggccgcgauacuggcuuacacaaucgguaccacacacuuccaaagggcauuaauuuucauuuuacuaacagcuguggcuccgagcaugacaaugagauguauugguaucucaaacagagacuucguugagggaguuagcggagguucuuggguugacauugugcuggagcaugggucauguguaacaacaauggcuaaaaauaaaccgacucuagauuuugaacucauaaaaacggaagcgaaacaaccagcuacauugagaaaauauuguaucgaagccaagcugacgaauacgacgacagaaucucguuguccaacacaaggggaaccuaguuuaaacgaggaacaggacaaaagguuuaucuguaaacacucuuugguagacagagguugggguaacggcugcggauuguucggcaaaggcggaauaguuacaugcgcaauguucacauguaaaaagaacauggagggaaaggucgugcuccccgagaacuuagaauauacuauugugauaacaccccauucaggugaggaacaugcuguaggaaaugacacuggaaaacauggaaaagaaauaaaaauaacaccacagucaucaauaacagaagcagaauugacuggauaugguacaguaaccauggaauguagcccucgaacuggccuugacuucaacgaaaugguacuacuacagauggaggauaaagcguggcuggugcaucgccaaugguuucuagaccuuccccuuccgugguugccaggugcagacacacaaggaucuaacuggauacaaaaggaaacauuaguaaccuuuaaaaauccccacgcaaagaaacaagacguaguaguauuggguagucaggaaggugcuaugcacacugcuuuaaccggagcuacagaaauucaaaugucaagcgguaauuuacucuuuacuggacaucuaaagugucgacugaggauggauaaauuacaauuaaagggcaugagcuauagcauguguacuggcaaauucaaaauuguaaaagaaauugcugaaacacaacauggaacaauagucauaagaguacaguacgagggcgacggaucaccuugcaaaauaccuuuugaaauaauggaucuagagaaaaggcacguauuaggaagauuaauaacuguuaauccuauagucacggagaaagauagccccguaaacauagaagcugagccaccauucggugauucguauaucaucauuggcguagaaccgggacaauugaaauuaaauugguucaaaaagggcucaagcauuggccaaauguuugaaacgacuaugaggggugcaaaaagaauggcuaucuugggggauacagcaugggauuuuggaucccuaggugguguguuuaccagcauaggaaaagcacuacaucaaguuuuuggcgccauauauggagcagcuuuuucuggagugucguggacuaugaaaauccuaauuggggucauaaucacguggauaggaaugaacagucgaucaacaucauuaaguguuucucuaguacuuguuggaguugucacuuuguauuuaggaguaauggugcaagcugauucugggugugugguauccuggaaaaacaaagaauuaaaauguggcaguggaaucuuuaucaccgauaacguacauacuuggacugaacaauacaaguuccaaccggaaagccccucaaaacuagcaagugcgauucagaaagcacaugaggagggcauauguggaauaagaucuguaaccagacuggaaaaucuuauguggaaacaaaucacgccagaauuaaaucauauuuuauccgaaaaugaagugaaguugacuauaaugacaggcgacauaaaggguauaaugcaagcuggaaaacggagucuacgaccacagccaaccgagcuaaaauauaguuggaaaacaugggguaaggcaaaaaugcuaucgacagaaucacauaaccaaacguuuuuaauugaugggcccgaaacagcggaauguccaaacacgaaucgugcauggaauagccuggaaguagaggacuauggauuugggguauuuucgaccaauauauggcugaaacucagagaaaaacaggaugucuucugugauucgaaacuuaugucagcugcuauaaaagauaauagagcuguucaugcugauaugggauauuggauagagucagccuuaaaugauacguggaaaauggaaaaagcuaguuuuauagaagugaaaucaugucacuggccaaaaucacauacacuguggaguaacggaguacuagaaucagaaaugauuauucccaaaaacuucgcaggaccggugagccagcauaacuacagacccggguaccauacccaaacagccgggcccuggcaucuggggaaauuagaaauggacuuugauuuuugugaaggcacuacagucguuguuacagaagauugugguaaucgugguccuaguuuaagaacaacgacagcaaguggaaaacuaaucacugaaugguguugcagaucuuguacacuaccuccauuacguuacagaggagaggacggauguugguacgguauggaaauuaggccuuuaaaagagaaggaagaaaauuuagugaacucgcuaguaacugcgggacauggacaaauagauaacuuuucgcuagguguuuuagguauggcccuauuucuagaagaaaugcugcggacaagaguaggaacaaaacacgcaauuuuacuuguagcuguaucuuucgugacauugauaacggggaauauguccuuucgcgaccucggaaggguaauggucaugguuggcgccaccaugacagaugauaucgggaugggaguaacguaucuagcauuacucgcagccuucaaaguaagaccaacuuucgcagcaggccuauuguugaggaaacuuacaucuaaggagcucaugauggccaccauugguauagcauuacugucacagucuaccauacccgaaaccauucuagaacugacggaugccuuagccuuagguaugaugguauuaaaaauuguucguaauauggagaaauaucaguuagccguuaccauuauggcaauaagcugugugccuaacgcuguuauccuacagaaugcguggaaagucucauguacaauacuggcggcaguuuccguaucaccucuacuucucacaucuagccagcaaaaggccgacuggauuccgcuggcuuugaccaucaaaggauuaaauccaacagcaauuuuccucaccacuuuaagucgaacuagcaagaaaagaucauggcccuuaaaugaggccguaauggcugucggaauggugucaauauuagcuuccucacuguugaaaaaugacauaccuaugaccgguccauuaguugcaggaggacuacucacaguuuguuaugucuuaacuggccguagugccgaucuugaauuagaaagagcggcagauguuaaaugggaggaccaagcagaaauaucugggucgaguccaauauuauccauaacaauuagugaggacggaucaaugucaaucaaaaacgaagaggaagaacaaaccuuaaccauacuaauacggacaggauugcuuguaaucagugguguuuuccccguaagcaucccuauaacggcagcugccugguacuugugggaagucaagaaacaaagggcaggcgugcugugggauguaccuaguccaccaccuguuggcaaagccgaauuagaggacggggcuuauagaauaaaacaacguggcauuuucggguacagccaaauuggcgcaggaguuuauaaggagggcacuuuccauacaauguggcacguuacuagaggggccgugcucaugcacaggggcaaacgcauagaaccuucaugggcagacgucaagaaagauuuaauuucguauggugguggcuggaaacuagagggugaauggaaagaaggagaagagguacaaguuuuagcccuagaaccuggcaaaaaucccagggccguucaaacgaaaccaggacuauuuaaaaccaauacuggaacaaucggggcuguuucguuagacuuuaguccaggaacuucagguucaccgauuguugauagaaaaggcaaaguuguuggacucuacgguaauggggugguaacgagaucuggugcguacguuagugcgauugcccaaaccgaaaagaguauagaagauaacccagaaauugaagacgacauauuccgaaagaaaaggcugacaauuauggaucugcaucccggugcgggaaaaacaaagagauauuuaccagccauagucagggaagcuauuaaacgaggacucagaacacuaauacucgccccaacccggguuguggcggcagaaauggaagaagcauugcggggucugccaauaagauaccagacgccggcaauaagggcagaacacacuggccgggaaauugucgauuuaaugugccaugccacauucacaaugagacuuuuaucaccgguaaggguuccaaacuacaauuuaauaauaauggacgaagcucauuucacagauccagcaaguauagccgcacgugguuauauuucaacaaggguugaaaugggggaagcagcaggaaucuuuaugacagcaaccccgcccgguucuagagauccauucccacaaucgaaugcgcccauuauggacgaagaaagagaaauuccagaaagaaguuggaacucagggcaugagugggugacggacuucaaaggaaaaacugucugguucguacccucgaucaaggcaggaaaugacauagccgcguguuuacgcaaaaauggaaagaagguaauacaacugucacgaaaaacguucgacucugaauaugucaaaacacgcgccaaugauugggacuuuguagugaccacagacaucucggaaaugggugcuaacuuuagagcagaacgugucauugacccgagacgaugcaugaagccgguuauauugacggauggugaagaaagggugauacuugcuggaccaaugccuguuacacacucguccgcagcucaacgaagggguagaauaggacggaacccaaagaaugaaaaugaccaguacauuuauaugggagagccucuagaaaaugacgaagacugcgcacacuggaaagaagcaaaaauguuacucgauaacauaaauacaccagaaggcaucauaccgaguauguuugaaccugagagggaaaaaguagacgcuauugacggcgaauauagguuacggggugaagcuagaaaaacuuuuguagacuugaugcggcgaggcgauuuacccguuuggcuagcguacagaguggccgcagaaggaauaaacuaugcugaucgucgcugguguuuugauggaaucaaaaacaaccagauccuagaggagaauguugaaguagaaauuuggaccaaagaaggugagaggaaaaagcucaaaccacguugguuagacgcgcgcauuuauucugauccauuggcacugaaagaguuuaaggaauuugcagcuggucgcaaaagccuuacuuuaaacuuaauaaccgaaaugggaagacugccaacauuuaugacucaaaaggcccgcgacgcucuagacaaucuggcaguuuuacacacggcagaaguaggagggagagccuauaaucaugcauugucggaguuaccagaaacccuagaaacauuacugcuauuaacuuuacuugcaaccguuaccggagggauauuuuuauuccugauguccggaaagggcauugguaaaaugacacuugguauguguugcauaauaaccgcaucaauucuacuaugguaugcacagauucagccucacuggauugccgcaagcauaauccuagaguuuuuccuaauaguguuauuaauacccgaaccagaaaagcaacggacuccucaagacaaccaacuuacguacguuguaauugcaauacuuacaguuguugccgcaacuauggcuaacgaaaugggauuuuuggaaaagacuaagaaagaucucggacuugguucgauaacaacccaagaaucugaaucaaauauacucgauauagaccuacggccagcaucagccuggacccuuuaugcaguugcgacaaccuucgugacuccgaugcuucgacacuccauagaaaacuccucuguuaacgugagccuuaccgcaauagcaaaucaagcaaccguguugaugggucucgggcgggguuggccguuaagcaaaauggacauagguguaccuuuacuagcuaucggauguuacagucaggugaauccaauaacauuaacagcagcauuacuguuguugguagcacauuacgcuauaauaggaccggggcugcaagcgaaggccacacgcgaagcccagaaaagagccgcugcuggaauuaugaaaaauccaacaguggacggcauaacagugauagauuuagaaccgauaccuuacgauccuaaauuugagaagcaacuuggccaagucauguuauuaguccuuugugugacucaaguuuugaugaugaggacaacaugggcacuaugcgaagcacuaacacuagcgacaggaccaauuucaaccuugugggaaggaaauccaggcagauuuuggaacacaacuauugcgguuucuauggcaaauaucuuucgaggauccuaucuagccggagcuggauuauuauucaguauaaugaaaaauaccacgaacacaagacgaggaacgggcaacauaggagagacuuuaggagaaaaauggaaaagcaggcuuaaugcgcuaggaaaaagugaguuccagaucuauaagaaaucagguauccaagaaguagacagaacauuggcaaaagaaggaauaaaaaggggugagacggaccaucaugcagugagucgggguagugcaaaacuucgaugguuuguggaacguaauauggucacgccagagggcaaaguaguagaucuaggguguggaagagguggauggagcuacuauugcggaggccuuaaaaacguaagagaaguaaaaggccuaacaaaaggugguccuggacaugaggaaccuauaccaaugucaacguauggauggaauuuaguaagauuacaaucaggggucgauguauuuuucaccccaccggagaaaugugacacgcucuuaugcgacauuggagagucgagcccaaacccuacaauagaagccggacguacacugcgugugcucaaucucguagaaaauugguuaaauaauaauacucaauuuuguauuaaaguauuaaacccauacaugccaagugucauugaaaagauggaaacccuacaacgaaaauacggaggagcauugguaagaaacccuuuaaguagaaauucuacucacgagauguauuggguauccaaugcuacuggaaauaucgucucuaguguaaacaugaucuccagaaugcuuaucaauagauuuaccaugaagcacaagaaagccacuuacgaaccggaugucgauuugggaucaggcacccgaaauauuggaauagaaaaugagauuccaaauuuagacauuauaggaaagagaauugagaaaauaaaacaagaacaugaaacauccuggcauuaugaccaggaccauccguauaaaacgugggcguaucacgggagcuacgaaacaaaacagacggggucugcuucaaguaugguaaacgguguaguaagacuccuaaccaaaccgugggauguuguuccaaugguaacucagauggcaaugacugauacuacuccauuuggucaacaacgaguauuuaaagagaaggucgacacucguacacaggagcccaaggaaggaaccaagaaauuaaugaggauaacagcggaaugguuguggaaagaacuugggaaaaagaaaaccccaagaaugugcacaagagaggaauuuacacgaaaaguaagaagcaaugcagcacuaggggcaaucuucacggaugaaaauaaguggaagucugcaagagaagcuguagaagauagccgguucugggaacuuguugauagagaacgcaaucuacauuuggaaggcaagugugaaacuuguguauacaauaugaugggaaaaagggaaaagaagcuaggagaguucggcaaagcaaagggaagcagagcaauaugguauauguggcuuggugccagauuucuagaauuugaagcauuagguuuucuaaaugaggaucacugguucucaagggguaauucuuugagcgggguggagggagaaggacuucauaaacuuggcuauauucuuagagaugugucuaagaaagagggaggugccauguacgcagacgauacugcaggaugggauacccgcauuacauuagaagaucucaaaaaugaggagaugguuacaaaucauaugaaaggagaacauaagaaacuugcagaagcgauauuuaaguuaacauaccaaaauaaaguuguaaggguacagcgcccaacaccacgaggaacagugauggauauuauuucccgaaaagaucaacgaggcucaggacaaguggggaccuaugguuugaacacguuuaccaacauggaagcacaguuaauaaggcaaauggaaggagaagggauuuucaagagcauccaaagacucaccgugacagaggaaaucgcagugcaaaauuggcuagcaagggucggacgagaaagauugucaagaauggcaauuucuggugacgauuguguagucaaacccuuggaugaccguuuugcuucugccuuaaccgccuuaaaugacaugggaaaaguaagaaaagacauacaacaaugggaacccucuagaggauggaacgacuggacucagguaccauucugcagccaucauuuucaugaauuaguaaugaaggauggucgagugcuaguuguaccgugucgaaaucaggaugagcuuauagggcgcgccagaauuagucagggugccggauggucguuaaaagaaacagcgugucuugggaaaucuuacgcgcaaauguggaccuuaauguacuuucacagaagagacuuaagacuugcagcgaaugccauuugcagugcagucccaagccauugggucccaaccuccaggacuacauggucaauacacgccaagcaugaguggaugacaacugaagauaugcuagcaguauggaaccggguauggauacaagaaaauccguggauggaagauaaaacuccgguagaauccugggaagaagugccuuauuuaggcaaacgugaagaucaaugguguggaucucuaauuggauuaacgagccgagcuacuugggcuaaaaauauacagacagcgaucaaucaaguacgaucucugauuggcaacgaagaauauacagacuauaugcccucaaugaagcgauuuagaaaggaggaagaagaggcugguguauugugguag

SEQ ID NO: 22622 - RNA, 9876 nt, Artificial Sequence
  derived and/or modified CDS sequence (opt6) from DENV-2__EU482729__SS-prME
acagcuggaguaaucauuauguuaauuccaacagcgauggcauuucauuuaacuacucgaaauggugaaccgcauaugauaguuggaagacaagaaaaaggaaaaucgcuacucuuuaaaacagaagacgguguaaauauguguacacuaauggcgaucgacuugggagaauuaugugaagacacaaucacauauaaaugucccuugcuacgucaaaacgaacccgaagacauagauugcugguguaauagcacaaguacauggguaacauauggcacauguacaaccacaggggaacaccgccgugagaaaagaaguguagcauuaguaccacauguaggaaugggauuagaaacgaggaccgaaacguggaugucaucagaaggcgcauggaaacauguacaacgaauugaaaccuggauacuaagacaccccggauuuacgauaauggcugcuauacuagcauacacgauuggaacaacucauuuucagcgugcacuaauuuucaucuuguuaacagccguagcucccucaaugacaaugagauguauaggaaucucaaaccgcgauuuuguagaaggcgugucgggaggaaguuggguagauauaguacuugaacacggaucaugcguuacaacuauggcgaaaaauaaaccaacucuagacuuugaauuaauaaaaacugaggccaaacagccagccacauuaagaaaauauugcauagaagcgaaacuaacuaauacuacuaccgaauccagauguccaacacagggagaaccgucauuaaacgaagaacaagacaaacgguucauauguaaacacagcaugguugauaggggguggggcaacggauguggauuauuugguaaaggaggaaucguaacaugugcaauguucacguguaagaaaaauauggagggaaaaguaguauuaccggagaaccuugaauauacuauagugauuacaccucacucaggagaagaacacgcaguagggaacgacacaggaaaacauggcaaagaaauaaaaauuacaccccagucaucuauaaccgaagcugaguuaacugguuacggaaccguuacuauggaaugcucacccaggacgggacuagauuucaaugaaaugguccuuuuacaaauggaggauaaagccugguuaguacaccgacagugguuccuagaccuuccacuuccgugguuaccaggagccgauacucaaggcucaaauuggauccaaaaagaaacucuaguaaccuuuaaaaauccgcacgcuaagaaacaagacgucguugugcucggaagucaagaaggagcuaugcacacggcacugacaggagccacugaaauccaaaugucgucggguaaccuauuauuuacuggacaccucaaauguagauugagaauggauaaacuacaauuaaaagggaugucuuauaguauguguaccggaaaauuuaaaauaguuaaagagauagccgaaacacaacacgguacaauaguaauacgaguacaguacgagggagaugggucaccuuguaaaaucccauucgaaauaauggaucucgaaaaacggcauguuuuaggaagauugauaacggugaauccaauuguaacagagaaagauucacccguuaauauagaagcugaaccacccuuuggugacucguacauaaucauuggaguagagccaggccagcucaaacuaaacugguuuaagaaaggcagcagcaucggucaaauguuugaaacaacuaugagaggcgccaaaaggauggcgauauuaggugauacagcaugggacuucgguagucuggguggaguauuuacaucaauagguaaagcucuacaucaagucuucggugcuauauauggagccgcuuuuucaggggucaguuggacaaugaaaauauugauuggaguaauuauuaccuggauagggaugaacucacgcucaacaucgcucucggucaguuuaguguuaguaggagugguuacauuguaucuuggugugaugguacaagcugacucuggaugcguaguuucauggaaaaauaaagaauuaaaaugcggaagugggauuuuuauaacugauaacguucauacguggacugaacaauacaaauuucaacccgaaucaccgagcaaauuagcuagcgcaauacaaaaagcacaugaggagggaauuuguggaauuagaucgguaacaagacuugagaaucugauguggaaacagauuacgccagaauuaaaccauauauugagugagaaugaagucaaauuaacaaucaugacaggagaaauaaaaggaauaaugcaggcgggcaaaaggagcuuacguccacaaccaacugaauuaaaauauucauggaaaacuuggggcaaagcgaaaaugcucaguacagaaucgcacaaucaaacauucuugauagaugggccagagaccgcggaaugcccaaacaccaauagagcguggaacucgcuagaaguagaggauuacggcuuugguguauuuucaacgaacauauggcuaaagcuaagagaaaaacaagauguauuuugugauaguaagcugaugagugccgcaauuaaagauaauagagcuguacaugcggauauggguuacuggauagagagcgcgcuaaaugauacauggaaaauggaaaaggcgucauucaucgaaguaaaaaguugucauuggcccaagucccauacacuuuggucaaacggaguauuagaaucugaaaugauuauaccgaaaaacuucgcugggccuguaagccaacauaauuaucgaccuggcuaucauacucaaauugcgggcccauggcauuuaggcaaacuugaaauggauuuugauuuuugcgaagggaccacaguagucguaacugaagauuguggcaauagagguccaucacugaggaccacaacggccucagguaaguugauuacagaaugguguugccgaagcuguacucugccacccuuaagauaucguggcgaggauggguguugguaugggauggaaauacgccccuuaaaagagaaagaggaaaaccuuguuaauucauuaguaacugccggacauggacaaauagacaauuucucucuagggguucucggaauggcauuauuccucgaagaaauguugcgaacgagggucggaacaaaacacgcuauacuacugauagcugucaguuuuguaaccuuaaucacggguaauaugaguuuucgggaucuaggaagaguaaugguaaugguaggagcaacaaugacugaugauauuggaaugggaguaaccuacuuagcccuacucgccgcauucaaaguucguccaacauucgccgcaggacuuuuacuucguaaacuaacaucuaaagagcugaugauggcuacgauuggaauagccuugcuuucacagucuacaauuccugaaaccauauuagaauuaacagaugcacucgcccucggcaugauggucuuaaaaauaguaagaaauauggagaaguaccaacuagcagugaccaucauggcaaucucguguguaccgaaugcagugauacuacaaaaugcuuggaaagucucaugcacaauauuagcggcaguuagugugaguccauuauuauuaacuagcucacagcagaaggcugauuggaucccccuggcucucacgauaaaaggacuaaaucccaccgcuauauuucucacaacauugagucguacauccaagaaaagaucauggccgcuaaacgaagcuguaauggcggugggcaugguaagcauauuggcuucgucauuacucaaaaaugauaucccuaugacugguccacugguagcaggagguuuauuaacaguauguuaugugcucacggguaggagcgcugaucuagaauuagaaagagcagccgaugucaaaugggaagaccaagcagaaaucucagguaguagucccauucuaagcauaacaauaucggaggauggaucaaugaguaucaaaaaugaagaagaagaacaaacacugacaauacugauacguacaggucuccuaguuaucaguggcguauuuccgguaucaauuccaaucacugcggcagcaugguaucucugggaaguuaagaaacaaagagcuggugugcucugggaugucccgagcccaccuccuguagguaaagcagaauuagaggauggcgcauauagaaucaaacagcgggguauauuuggguauucacaaauaggagcugguguauacaaggaaggcacauuucauacaauguggcaugugacacguggcgcagucuuaaugcauagagguaagcguauagagccaaguugggcagacgucaagaaagauuuaauaaguuacggagguggauggaaacucgaaggagaauggaaggaaggagaagaaguacaagucuuagcuuuagaaccaggaaagaacccaagagcuguacaaaccaaaccgggacuauucaaaacaaacacagggacgauaggagcaguauccuuggacuuuucaccugggacaucggggucgcccaucguugacagaaaaggaaaagugguagguuuguaugggaacgggguuguaaccagaucaggcgcauauguaucagcaaucgcacaaacagagaaaaguauugaagacaauccugagauagaggaugauaucuuuagaaagaaacgccuaacaauaauggaccuacacccuggagcaggcaaaacuaaacgauacuuacccgcgauagugcgagaggcaauaaaaagaggucuuagaacauugauuuuagcgccaacaagaguaguagccgccgaaauggaggaagcguuaagagggcucccuaucagguaucaaaccccugcgaucagagcugaacauacaggacgagaaauaguggacuuaaugugucaugcaacuuuuacaaugcggcuccucucaccaguuagagucccuaauuauaacuuaauaauaauggacgaagcacauuuuaccgauccugcaucuauugcggcucgaggauacauaucaacacggguugagaugggugaagcugcugggauuuucaugacagcaacuccuccaggaucuagggaucccuuuccacagucgaacgcaccuauuauggacgaggagagagaaaucccagagcgcaguuggaacucagggcaugaguggguuaccgauuucaaaggaaaaacggucugguucguacccaguauuaaagcuggcaaugauauagccgcaugcuuaagaaagaaugguaagaaagucauccaauuaucgagaaaaacauuugacagcgaauaugugaaaacaagggcaaaugauugggacuuuguaguaacaacagauauaucagaaaugggugccaauuucagagcugaaagagugauagacccucgaagaugcaugaagcccguaauuuuaacggauggagaagaaagaguaauucuggcaggaccaaugccuguuacacacucaucugcggcccaaaggcggggaagaauaggacgcaaucccaaaaaugaaaaugaccaguacauauacaugggagaaccccuagaaaacgacgaagacugcgcuuauuggaaagaggcuaaaauguuauuagacaauauaaauaccccagaggguauaauacccaguauguucgagccagaaagggagaagguggaugcgauagauggugaauauagacuacguggcgaggcaaggaagacauuugucgacuugaugagaagaggagacuuaccaguaugguuagccuacagaguugcugcggaagguauaaacuacgccgaucgucgcugguguuucgaugguauaaagaacaaccaaauuuuggaggagaacguugaaguugaaauuuggacaaaagaaggugaacguaagaaacuaaaaccccggugguuagacgcaagaauuuauucagacccauuagcucuuaaagaauuuaaggaguucgccgcgggacgaaaaagucucacuuuaaaucugauaacagaaaugggcagacugccaacuuuuaugacacaaaaggcaagggaugcccuggacaaucuagcugucuuacacacggcggaagucgguggacgcgcauauaaucaugcguuaagugaacucccagaaacguuagagacacuucucuuacuaacuuuacuagcuacgguaacgggcgggaucuucuuguucuuaaugaguggcaagggaauugggaaaaugacccuagguaugugcuguauaaucacagccaguauacuauuaugguaugcacaaauacagccacauuggauagcugcaucuauaauucuagaauuuuucuuaauaguuuuguuaaucccugagccagaaaaacaaaggacuccucaagauaaccaauuaacauauguaguaauugcuauucuaaccgugguagcggcuacgauggcaaacgaaaugggauuucuagagaaaaccaagaaagaucucggguuagguucaauuacuacacaagaauccgaaucaaauauacuugauaucgaccuaagaccugcaagugccuggacuuuauacgccgucgcaaccaccuuugucacaccaaugcugcgucacuccauagaaaauuccucuguuaaugucaguuuaacggcuauagcaaaccaagcuacaguacuaaugggacuaggaaggggguggccauugucuaagauggacauaggcguaccucuguuagcuauaggaugcuauagucaaguuaauccgauaacauuaacugccgcauuacuacuccuaguagcucacuaugcgauaauagguccuggcuuacaagcuaaggccacucgagaagcccaaaagcgagcugcggcugggauaaugaaaaaucccacuguugacgggauuacagucauugaucuagaaccuauacccuacgacccaaaauucgaaaaacaauuagggcaagugaugcuacuuguucuaugcgucacgcaaguuuuaaugaugcgcaccaccugggcucucugugaagcgcugacauuagcaaccggaccaauuucuacccuuugggaaggaaacccgggccgcuuuuggaauacuaccauagcaguuaguauggcaaauauuuuuagaggcagcuaccuugcuggcgcuggacuuuuauuuucaauaaugaagaacacaacaaauacccggagggguacaggcaauacgggcgagacauuaggagaaaaauggaaauccagauuaaacgcacuaggcaaaagcgaauuucagauauacaaaaagucugguauccaagaaguugauagaacgcuugcaaaggaggguauaaaaagaggcgagacggaccaccacgcaguaucacgaggaucugcaaaacuaagaugguuugucgagaggaacauggugacgccggaggggaaagucguugauuuagggugcgguagagguggauggagcuacuauugcggaggucuuaaaaauguuagggaaguaaaagguuugacuaaaggcgggcccgggcacgaagaaccuauaccuaugagcacguacggauggaaucuaguacgucugcaaucagguguagacgucuucuuuacaccacccgaaaagugugacacauuguugugugacauuggcgagucgucaccaaaucccacaauagaagcaggcagaacacuacguguauuaaauuugguagaaaacuggcuaaacaacaauacccaauuuugcauaaaagucuuaaacccguauaugccuucaguuauagaaaagauggagacccuacagagaaaauauggaggggcgcuugugcggaauccauuaucuagaaauucaacacaugagauguauugggucagcaaugcgacaggaaacaucguauccuccgucaacaugaucagucgaaugcuaauaaauagauucacaaugaagcauaaaaaggcaacauacgaaccagauguugaccugggaagugggacaaggaacauaggcauugaaaaugagaucccaaaucuugacauaaucggaaaaaggauagaaaagauaaaacaagaacaugagacguccuggcauuaugaccaagaccaucccuacaagacuugggcguaucacggaaguuaugaaacuaaacaaacgggaagugcaucuucaaugguuaauggagugguucgauugcuuacuaagccaugggaugucguaccaauggucacucaaauggcuaugacagauacaacaccuuuuggacaacaacguguauuuaaagaaaaaguggauacacgaacgcaagaaccaaaggaagggaccaagaaacugaugcgcauuaccgcagaauggcucuggaaagagcuaggcaagaagaaaacaccaagaauguguacacgagaagaguuuacuagaaaaguaagaucgaaugcggcacuaggagcaauauuuaccgaugaaaacaaauggaaaagcgcuagggaggcaguagaagauucuagguucugggagcuaguugacagagagagaaaucuucacuuggaagguaaaugcgaaacguguguauauaauaugaugggaaaacgagagaagaaacugggagaguucggaaaagcaaaaggcucacgagccauaugguauauguggcuuggcgcacgauuuuuagaauuugaagcacuaggauuucuaaacgaagaucacugguuuaguagacgaaacucccuuuccggcguugaaggagaaggacuccacaaacucggcuacauacuuagagauguaucgaagaaagaagguggugcuauguaugcagacgauacagcggggugggacacuagaaucacacuagaagaucuuaaaaaugaggaaauggucacaaaucacaugaagggggaacauaagaaacucgcagaagcuauuuuuaaacuaacguaucaaaacaaggugguaagaguacaacgaccaacaccuaggggaacugucauggauauaauaagccggaaagaucaaagagggagcggccaaguagguacuuaugggcucaauacauuuaccaacauggaagcgcaacugauacgccaaauggaaggugaagggauauucaaaagcauucagagauuaacggugaccgaagagauagcuguacagaauuggcuugccagagucggacgagaacgacuuaguagaauggcgauaucgggggaugauuguguugucaaaccuuuagacgaucguuucgcuucugcucuuacagcauuaaacgacaugggaaaagugaggaaagauauucagcagugggagccuagccgaggcuggaaugauuggacucagguucccuucuguagucaucauuuccacgagcuaguuaugaaggacggaaggguccuagugguaccauguagaaaucaggaugaacugaucgguagagcacgaauaagucaaggagcggguuggucuuuaaaggaaacagccugucucgguaagagcuacgcacaaauguggacacuaauguauuuccaucgucgagacuuacgacucgcagccaaugcaaucuguucagccguacccucacauugggugcccacaagcagaacuacguggucgauccaugcuaaacaugaauggaugacaacugaggacaugcucgcugucuggaaucguguguggauacaggagaauccauggauggaagauaaaacccccguagaaaguugggaagaaguucccuacuuaggaaaacgagaggaccaaugguguggcucacugaucggauuaacaucgagggcgacuugggcgaaaaauauucaaacagcuauaaaucaagucagaucacucauaggaaaugaggaauauacagauuacaugccaucgaugaaaagauuccgaaaagaggaggaagaagcagggguuuuaugguaa

SEQ ID NO: 22623 - RNA, 9876 nt, Artificial Sequence
  derived and/or modified CDS sequence (opt6) from DENV-2__EU482731__SS-prME
acggcagggguaauugugaugcuaauaccgacuguuauggcuuuccauuuaacuacuaggaauggugagccacacaugauaguagggagacaggaaaaaggaaaaucacuguuauucaaaacugaggacggaguaaacauguguacacuaauggcaaucgauuuaggagagcuaugcgaggauacaauaacguauaaauguccgcuacuuagacaaaaugagccugaagacauagacuguuggugcaauucgacaaguacauggguaacguaugguacuugcacaacgaccggagaacauaggagagagaaacgaucuguagccuuaguuccucacguagguaugggauuagaaacgaggacagaaacauggaugagcucugaaggugcuuggaaacauguacaaagaauagagacuuggaucuuacgucauccgggauucacgauuauggcugcuauauuagcuuauacuaucgggacaacccauuuucagagagcuuuaauuuucauccuguugacagcuguagcuccguccaugacaaugagauguauaggaauaucuaaccgcgacuucgucgaagguguaagugggggcaguuggguugacauuguuuuagaacauggaaguuguguaacaacuauggccaaaaauaaaccaaccuuagacuuugaacuaauuaaaacugaagcaaaacaaccggcaacgcuuaggaaauauugcauagaagcaaaacuuaccaauacgacaacugaaagccgauguccaacucaaggggaaccuagcuugaacgaagaacaagacaaaagauuuauuugcaaacauucuaugguagacaggggauggggaaaugggugcggccuauuugggaaaggagguauagugacgugugcaauguuuacaugcaaaaagaauauggaaggcaaaauuguucagccggagaauuuagaguauaccauaguuauaacaccucauucgggagaagaacaugcggugggaaaugacacaggcaaacaugguaaagaaauaaaaauuacuccucaaagcagcacaacugaagcugagcuuacgggauauggaacuguuacuauggaaugcagcccucgaacgggguuggauuuuaaugagaugguucuucuacaaauggaggauaaagcauggcuggugcacagacaaugguucuuagauuuaccgcuaccauggcuaccaggagcagauacucagggcuccaacuggauacaaaaagaaaccuugguaacauuuaaaaauccucaugcgaagaaacaagauguugugguacuagguagucaagaaggugcaaugcauacagcucuuacaggagcuacagagauacaaaugucgagugguaaccuuuuauuuaccggucaucuaaaaugucgccuucgaauggacaaacugcaacugaaaggcaugagcuauucaaugugcaccgguaaauuuaaaauagucaaagagauagcagaaacccaacaugguacgauuguaauacgaguacaauacgagggagacgguagcccguguaaaauuccuuucgaaauaaccgaccuagagaaaagacauguguuagguagauuaauaacgguuaacccuauagugacggaaaaagaugcaccuguuaauauagaagcagaaccgccauucggggauucauauaucauuguaggaguggaaccuggccaauuaaaacuaaacugguuuaaaaagggaucaucgauuggacaaauguuugaaacaacaaugcgaggcgcaaaacggauggcaauacuuggcgauacugcuugggacuucgguagcuuaggaggagucuuuacaucaaucggaaaagcucugcaucaaguauucggagcuauuuauggugcagcauuuaguggaguaagcuggacaaugaagauccuaaucggcgucauuauaaccuggauagguaugaacucgagaagcacaucuuugucagucucguugguucuagucggcguaguaaccuuauaccuuggcgcaaugguacaggcagauucugguuguguaguaaguuggaaaaauaaagaacuaaaguguggcagcggaauuuuuauuacagauaacguccauaccuggacggaacaauauaaguuucaaccggaaucaccaaguaagcuagcgagugcaauccaaaaagcacaugaagaaggaaucuguggaauccgguccgugacacgacuggaaaaccuaauguggaagcaaauaaccccugaauugaaucauauacuauccgaaaacgagguuaaacugacgauaaugacgggugauaucaaaggcauaaugcaggcuggcaaaaggagucuccgaccgcagccuacggaacugaaauauucauggaaaacuugggguaaggcaaaaauguugucaacggagucccacaaucaaacauuuuuaauagauggaccagaaacugcagaauguccaaauacgaacagagccuggaacucgcuggagguggaggauuauggguucggugucuuuacuaccaauaucuggcuaaaacuacgagaaaagcaagacguauuuugcgauucaaaacuuaugagugccgcuauaaaggauaauagggcagugcaugcggacaugggauacuggauagagucugcucuuaacgacacauggaagauggaaaaggccagcuuuauugaaguuaaaagcugccacuggccaaagucacauacccuauggaguaauggaguucucgagucggaaaugauaauucccaaaaacuuugcaggcccaguaucccagcauaauuauaggccaggauaccauacccaaacagccggaccauggcaccuuggaaaauuagaaauggacuuugacuuuugcgaggguacuacgguaguagucacagaagacugcgggaauagaggacccagcuuaagaacaaccacugcaagugggaaguuaauuacggaauggugcuguagaucauguacucugccuccucuaagguauagaggcgaggacggguguugguauggaauggaaauucggccccuaaaagaaaaggaggaaaaccuggugaacagccucgugacagcuggucauggccaaauugauaacuucucacuaggaguguugggaauggcauuauuuuuagaggaaauguuacgcacccgaguuggcacaaaacaugcaacguuauuaguagcccucucuuucguaacacugauuacugggaauaugucauuuagagacuuaggaagagugaugguaaugguuggggccacaaugacugaugauaucgguauggguguaacuuaccuagcucuuuuagcagcauucaaaguaagacccacguucgccgccgggcuucuucuacggaaauugacaucaaaagaacuaaugauggcaaccauugguaucgcacuucuaagccaguccacgcuaccggaaacaauuuuagaguuaaccgaugcucucgcguuagguaugaugguauuaaaaauaguaagaaauauggagaaauaccaacuagccgugacgaucauggcgauuaguuguguucccaacgcugucaucuugcaaaacgcauggaaagucaguuguacaauuuuagcagccguuagcgugaguccacuucuauuaacgucgucacaacaaaaagcagauuggauuccacuagcacucaccauaaaagggcuaaauccuacugccaucuuucuuaccacguuaucgagaacaaguaagaaacguaguuggccauugaaugaagccauuauggcagucggaaugguuucaaucuuagccucauccuuauugaaaaaugauauaccuaugacuggcccccuaguagccggaggucuauugacaguauguuauguauuaacaggacguagcgcggaccucgaacuugaacgcgccgccgauguuaaaugggaagaccaagcugaaauuucggguuccagccccauacugucaauaacaauuucggaagacgguagcaugucuaucaaaaaugaagaagaagaacaaacguugacgauauuaauucguacagguuuacucguaauaagcggggucuuccccguaaguauaccaauuacugcagcagcaugguaucugugggaggucaagaaacagcgugcagggguuuuaugggaugugccgaguccaccaccugucggaaaagcggaauuggaagacggggcauauaggauaaaacagagaggaauacuuggauacagucaaauuggcgccgguguauauaaagaaggaacauuucauacaauguggcacguuacuagaggcgcaguacucaugcaucgaggaaaaagaauagaaccuucaugggcggacgucaagaaagaccuaaucuccuacgguggugguuggaaauuggaaggggaguggaaagaaggagaagaaguacaaguauuagccuuagaaccggguaaaaauccaagagccguucaaacaaaaccagguaucuucaagacaaauacgggaacaaucggcgcagucucccuagacuucuccccuggaacaagcggaagcccaauagucgacagaaaaggaaaaguuguaggcuuauauggaaauggaguaguaacacguucuggcgcguauguaucugcuaucgcacaaacugaaaaaucaaucgaggauaauccugaaauugaagaugauauauuuagaaagaaacgauuaacuauaauggauuugcauccuggggcuggcaaaacuaaacguuacuuaccagcgaucguaagagaggccaucaaaagagggcuacgaacauugauauuggcaccaacacgaguuguagcggccgagauggaagaagcauuaagaggguugccaauuagauaucaaacuccugcgauaagggcagagcacacaggaagagaaaucguugaucucaugugucaugcuacguucacaaugagguuguugagcccaguaagaguuccuaacuauaaccuaauuaucauggacgaggcgcauuuuacugacccggcaucaauagccgcaagaggguauauaaguacgcgaguagaaaugggagaagcagcaggaauuuucaugacggccacgccgccagguucucgagacccuuuuccucagaguaaugcuccgaucauagaugaagaacgugaaaucccagaacgaucauggaacucgggucaugaguggguaaccgacuuuaaaggcaagacaguaugguucguaccaucaauaaaagccggcaacgacauagcagcuugcuuaaggaaaaauggcaagaaagucauucagcuauccagaaaaacauucgacuccgaauaugugaaaaccagagcaaaugauugggauuuuguagucacuacggauauuagcgaaaugggugcaaauuuuaaagcggaaagaguaaucgacccgagaagauguaugaaaccgguuauauugacagauggagaagaaagaguuauucuugcaggcccaaugccagugacacauagcagcgcggcacaaagaagaggacguauuggacgcaaucccaaaaacgaaaacgaucaauacauauacaugggcgaaccacuagaaaaugacgaagacugugcacauuggaaggaagcaaaaauguuacuggauaauauuaacacgccggaaggaauaauaccuucaauguuugaaccugaaagagagaaaguugacgcuauagauggagaauauagauuaagaggagaagcaagaaaaacauucgucgaucuaaugagacgcggagaucuuccggucugguuagcauauaaggucgccgcugaagggauuaauuacgcugaucgcaaauggugcuuugauggcauaaagaacaaccaaauucuugaggaaaacguugagguagaaauuuggacaaaagagggggaaagaaagaaauugaaaccaagauggcuagaugcccgaauauacucagacccacuugcacuuaaagaguuuaaagaauuugccgcagguagaaagucauuaacauuaaacuuaauaaccgaaaugggacgccuaccaaccuuuaugacccaaaaagcccgaaaugcccuggauaaccuagcuguacuucacacagccgaagucgggggaagggcucacaaucacgcuuuaucagaacucccagaaacauuggagacacuccuauuacuaacacuccuugcaacugugacuggugggauauuucuguuuuuaaugucaggcaaagguauaggaaaaaugaccuuagggauguguuguauuauaacagccaguauauuguuaugguaugcacaaauccaaccacauuggaucgcagcaagcaucauacuugaauuuuuccuaauaguauuauuaaucccagaaccagaaaagcaaagaacaccacaggacaaucaguugacuuacguugucauagcaauucuaacaguuguggcugcgacuauggcgaacgaaaugggauuuuuggagaaaacuaagaaggauuuagguuuuggaucgauuacgacucaggaaagugaaaguaauauccuggauauugauuugcguccagcuucggcauggacuuuauaugcgguugcaacaacauuuguaacuccgaugcuucgacauaguauugagaacaguucgguuaauguuucuuuaaccgcgaucgcuaaccaagcgacgguucuaaugggucuaggcaaaggauggcccuuaaguaagauggacauuggaguaccgcuauuagccauaggcugcuacucgcagguaaaucccauaacacuuacagcagcucuauugcucuuaguugcacacuaugcgauuauaggcccggguuuacaggcaaaggcaacuagagaagcacaaaaacgugcggcggcaggaauuaugaaaaacccaacuguagauggaauuacgguuauugaucuagaaccuauacccuaugacccaaaauuugaaaaacaauugggacaaguaauguuguuaauauuguguguaacucaaguuuuaaugaugcgaaccacgugggcuuuaugcgaagcauuaacuuuagcuacgggucccauaagcacauuaugggaaggcaaccccggcagauucuggaauacuacaauagccguaagcauggcaaacauauuuaggggaucauaccuugccggagcaggcuuauuauucagcauaaugaaaaauaccacaaacacaagacgcggcacgggcaacguaggugagacguuaggagagaaauggaaaucaagauuaaaugcacuagggaagagugaguuccagaucuauaagaaaucagggauccaagaaguugaucgaacucuagcaaaagaaggcauaaaacggggagaaacagaccaucacgccguaagcagaggaucagcaaaauuaagaugguuugucgaacgaaacaugguaacacccgaagguaaaguaguggaccuaggcugcggaaggggcgguuggucguauuacugugguggucuuaaaaacguaagagagguuaaaggccuaacgaaaggugggccuggacaugaagaacccauaccuaugucuacuuauggauggaaucucguccgcuuacaaaguggcguagacguguucuuuacuccacccgaaaaaugugauacacuuuuaugugauauuggugaaaguagucccaacccuacuauugaagccggccgcacauugagagucuuaaaccucgucgaaaacugguugaauaauaacacacaauuuugcaucaaaguacuaaaucccuauaugcccaguguuauagagaaaauggaaacccuucaacgaaaauacggaggugcgcucgucaggaaccccuuaucuagaaacucuacucacgaaauguacuggguuaguaacgcuacaggaaacauagucucaucugugaauaugauaucccgcaugcugauaaauagguuuacaaugaaacacaagaaagcaacauacgaaccugacguagaccugggaaguggcacgagaaauauugguaucgaaagugaaauuccaaaccuugauauaauaggaaagcgaauagagaaaauuaaacaagaacaugaaacgagcuggcacuacgaucaagaucacccauauaaaacuugggcuuaccauggauccuacgaaacaaaacagaccgguagugcgucaucgaugguaaacggagucguacguuuguugacaaaacccugggauguaguaccuaugguaacacagauggccaugacagauacuacucccuucggacagcaacggguauuuaaagaaaagguagacacuagaacucaagagccaaaagaaggaacuaagaaauugaugaagauaacagccgagugguuauggaaagaguuaggaaagaagaagacaccucgaauguguacaagagaggaauuuacacgaaaagugagaaguaacgcagcccuuggagcuauauuuacugaugaaaauaaauggaaaagcgccagagaggcuguggaagacggaagauucugggaauuggucgauagagaacguaauuuacacuuagaaggaaaaugugaaacauguguuuacaauaugaugggcaagagagagaagaaauuaggugaguuuggaaaagccaaagguucccgggcuaucugguauauguggcuaggggcacgcuucuuagaauuugaagcucuuggauuucuaaaugaagaucacugguuuucgagaggaaauagucuaucgggaguugagggcgaaggucuucauaggcucggauacauauuaagggaagucggcaagaaagagggaggagcaauguaugcagaugacacugcuggcugggauacaagaauaacauuagaagaccugaaaaaugaagaaaugguaacgaaucauaugaaaggggagcauaagaaacuagccgaagcaaucuucaaauuaaccuaucagaauaagguaguuaggguucaaagaccuacgccacgcggaacggucauggauaucauaucgcgcaaggaucaacgugggaguggacaaguagguacauauggucuuaacaccuucacaaauauggaagcccaauugauccgucaaauggagggggaggguauuuuuaaaucgauacaacauuuaacagcuacggaagagauagcuguacagaacugguuagcaaggguagguagagaaagauuaucaaggauggcaauauccggagaugacugcguggugaaacccauugaugauagguuugcgucggccuuaaccgcuuuaaaugacaugggaaaaguaagaaaggauauccaacagugggaaccuucuagaggauggaaugauuggacccaagugccauuuuguucucaucauuuucaugagcuagucaugaaagauggcaggguacuuguugucccuugcaggaaccaagaugagcucauuggacgagcacguauaagucaaggcgcugguugguccuuaaaagaaacggccugucucggaaagaguuacgcccaaauguggacucucauguauuuucauagaagggacuuaagauuagcggcaaaugcgauaugcagcgccguucccagucacugggucccgacaucaagaacaacaugguccauacaugcaaaacacgaauggaugacaacagaagauaugcuggcaguauggaauagaguuuggauacaagagaauccguggauggaggauaaaacaccaguagaaucaugggaagaggugccauacuuaggaaaacgggaagaucaguggugugguucacuaauaggacuuacgucccgagcaacuugggccaaaaauauucaaacggcuauaaaccaaguccgcagcuugauaggaaacgaagaguacacugacuauaugccaaguaugaaacgauuucgaagagaagaagaagaagcgggagucuuaugguga

SEQ ID NO: 22624 - RNA, 9876 nt, Artificial Sequence
  derived and/or modified CDS sequence (opt6) from DENV-2__EU482732__SS-prME
acuguuggagucauaauaauguuaauucccaccgcuauggcauuccaucuuacuacucgcaauggggaaccccauaugauaguagguagacaagaaaaagggaaaucacugcucuuuaaaacagaagauggaguuaauaugugcacauuaauggcaauagauuuaggagaacuuugugaagacacuauaacguacaaaugucccuuauuacgacaaaacgaaccagaagauaucgauugcugguguaauaguacaaguacuuggguaacauacggaacauguacuacuaccggugaacauagaagagagaaaaggucaguagcucuuguaccucauguaggcaugggacuagaaacacgaacagaaacauggaugaguucagaaggggcuuggaaacacguucaacgaaucgaaacauggauuuuaagacauccagguuuuacuaucauggcugcuauacuugcauauacgauaggaacaacccacuuucaacgagcgcuaaucuuuauucuguugacggcaguagcuccaaguaugaccaugagauguauugguauaaguaauagagauuuuguugaagggguaucaggaggaaguugggucgacauaguguuggaacauggcucaugugugacuacuauggcgaaaaauaaaccaacgcuugacuucgaauuaauaaaaaccgaagcaaaacaaccugcaacacugagaaaauacuguaucgaagcaaaacuuacaaauaccacuacagaaucaagauguccuacucaaggugaaccgucacuaaacgaagaacaagauaaacgauuuauuuguaaacauaguaugguagauaggggauggggcaaugguuguggacuauuuggaaaagguggaauaguuacuugcgcaauguucacaugcaagaaaaauauggagggcaaaguaguccugccagaaaaucucgaauauacaauaguaauaacuccacauaguggugaagaacacgcaguaggaaaugauacuggcaaacauggaaaagaaauuaaaauaacaccacaaucaucaaucacagaagcugaauuaaccgguuauggcacuguaacuauggaaugcuccccgagaaccggacuugacuuuaaugaaaugguucuucuacaaauggaagacaaagcgugguugguucaucgucaaugguucuuagaucucccucuacccugguuaccuggcgccgauacccaagguucuaauuggauucaaaaagaaacacuggucaccuucaaaaauccgcaugcuaagaaacaggauguggugguuuuagguagucaagaaggggcuaugcacacagcccugacaggcgcaacagaaauccaaaugucaucaggaaaucuacuguuuacugggcaccuaaaaugcagguugaggauggacaaauuacaacuaaaagguaugucauauucuaugugcacagguaaauucaaaauuguaaaagaaauugcugaaacucaacauggaacuauaguaauaagaguucaauacgaaggugauggcagucccuguaaaauccccuuugaaauaauggaccuugaaaaacgacacguuuuaggccgacugauuacaguuaaucccauagugacugaaaaagacucaccagugaauauagaggcagaaccaccauuuggagauagcuauauaauaaucggaguggagccgggccaauuaaaauugaacugguuuaagaaagguagcuccaucggucagauguuugaaaccacgaugcgcggagccaaaagaauggcaauccuaggugauacagcaugggacuuugguucgcuuggcggagcauuuacgucuauagguaaagcauuacaucaaguauucggugcgauauauggcgcggcuuucagcggagucucauggacuaugaaaaucuuaauaggugugauuaucacuuggauugguaugaacucaagaaguacaucacuuaguguaagucuagugcugguuggugugguaacccucuauuuaggaguuaugguccaggcagauagcggguguguaguaucauggaaaaacaaagaauuaaaaugugguuccggcauauucauuacugauaacguccacacguggacagaacaguauaaauuccaaccugaaucaccuucgaaacuagccuccgccauucaaaaagcacaugaggaaggcauauguggaauaagaucuguuacgcgccucgaaaaucuaauguggaaacagauuacaccagaacuuaaucacauauuaucagaaaaugaaguuaaauuaaccauuaugaccggagauauuaaaggaaucaugcaagccgguaaaaggagucuccgaccacaaccaacugaacugaaauauagcuggaaaacauggggcaaagcuaaaaugcuaucaacggaaagucauaaucagaccuucuuaauugauggcccagagacagccgaaugcccuaauaccaacagggcuuggaacuccuuggagguggaggacuauggauuugguguauucucaaccaacaucuggcuuaaauuaagagaaaaacaagauguauuuugugacucuaaauugaugagcgcugcaauaaaagauaaccgagcaguacaugcugacaugggcuauuggauugaaucugcccuaaacgacacuuggaagauggaaaaggcgaguuuuaucgaaguaaagagcugccauuggccgaaaagucauaccuuauggucaaauggaguacuugaaagcgaaaugaucaucccuaagaauuuugcugguccuguuagucaacauaauuaccgaccugguuaccacacucaaacagccggaccguggcaucuggguaagcuagaaauggauuuugacuuuugcgaggggacuacaguugugguaacagaagauugugggaauagaggaccuuccuuacggacaacaacggcguccggaaaguugauaacagaauggugcugucgaucguguacauuaccuccacucagauaccgaggcgaggaugguuguugguacggcauggaaauuagaccguugaaagaaaaggaagaaaaccuggugaacagccuaguaacggcuggacacggacaaauagacaauuucaguuugggaguuuuagggauggcucuauuuuuagaagaaauguuacgcacaaggguagguaccaagcaugcaauacuauugguagcgguuucuuuuguaacucuuauuacagguaacaugucauuuagagaucugggucgcguuauggucaugguuggugcuacaaugaccgaugauaucgggauggggguaacauaucuagcucuacucgcagcuuucaaggugagaccuacauuugcagccggguuacuucuaagaaaguugacuucaaaggaauuaaugauggcaacgauaggaauagcccuauugagucaaucuacaauucccgaaacuauauuagaacuaaccgacgcauuagcguuaggcaugaugguacugaaaauuguaaggaacauggaaaaguaucaacuagccguuacuauuauggcaauuaguuguguaccuaaugcagucauuuuacaaaacgcuuggaaaguaucaugcacuauauuggcggcaguuucggucaguccccucuuguuaacaucgucacaacaaaaagccgauuggauaccacuggcauuaaccauaaaaggauuaaauccaacagcuauuuucuuaacuacuuuaucaagaaccuccaaaaagcggucauggccccucaacgaagcuguuauggcagucggcaugguaaguauacuagcauccucgcuucucaaaaacgauauacccaugacggguccguuggucgcggguggauuacuuaccgucuguuauguacuaacaggacgaagcgcagauuuagaguuggaacgagcagcugacguaaaaugggaagaucaagcugagauauccggcagcagcccgauacuaucgauaacuauaagcgaagacggaucgaugaguauaaagaaugaagaggaagaacauacauuaaccaucuugaucagaacgggacuauuggugauaaguggaguauucccugucucaauuccaaucacugcagcagcaugguacuuaugggaagugaagaaacagcgagcugguguacuaugggacguuccaucaccuccgccgguaggcaaagcagaauuagaagacggagcuuacaggauaaaacaaagagguauauuuggauacagucaaauaggagcaggaguuuauaaagaagguacuuuucacacuauguggcaugucacuagaggagcaguccuaaugcauagggguaaacguaucgaacccucuugggcugacgucaagaaagaucucauaucauacggcggaggauggaaguuagaaggcgaauggaaggagggagaagaaguucaaguauuggcacuagaaccgggcaaaaauccacgagccguacaaacuaaaccaggucuauucaaaacgaacacuggcacuaucggugcaguaucacuagacuucucaccaggaacuagcgguucacccauaguagaucgaaaaggaaaagugguuggucuuuacggaaauggaguagugacacgaucaggagcauacguuucggcgauugcucaaacagagaaguccauugaggacaauccggaaauagaagaugauauauucaggaagaaaagacuaacuauaauggaccuccacccaggagcgggcaaaacaaaacguuaucuaccagccauuguaagagaggccaucaagaggggucugagaaccuuaauccuagcccccacucgcgucgucgcagcagaaauggaagaagcacuucgugguuugccuauuagguaucaaacaccagcuauaagagcagagcauacagguagggagauuguagaccugaugugccaugcaacguuuacaaugagacuguuaucacccguucgcgugccaaauuauaaucuaauuauuauggacgaagcccauuuuacugacccagcgaguauugcagcucgugguuacauuucaacccggguggaaaugggugaagccgcaggaauauucaugacugccacaccaccgggaaguagagacccauuuccacagaguaaugcacccaucauggaugaggaacgagaaauaccugagcggucauggaacagugggcacgaaugggucacugacuuuaaaggaaaaacggucugguucguuccaaguaucaaggccggaaacgacauagcagcgugucuaaggaaaaaugguaagaagguuauucaacuaucaagaaaaacauuugauucggaauauguuaagacucgggcuaaugacugggauuuugugguaacuacagauauuagcgaaaugggagcaaauuuccgggcagaaagagugauugacccuaggcguugcaugaagccuguaauacugacagauggcgaagaacggguuaucuuagcagguccuaugccugucacucauaguagugcagcacaacguaggggcagaauaggcaggaauccgaagaacgaaaacgaccaguauaucuauaugggagaaccgcuugaaaacgacgaagacugugcccauuggaaagaagcaaaaaugcuuuuggacaauauuaacacucccgaaggaauaauacccucuauguuugaaccagagcgggaaaaaguggaugccauugauggcgaguauagauuacguggcgaagcaaggaaaacuuuuguggaucugaugagaagaggugacuuaccuguauggcuagccuauagaguagcugcagagggaauuaacuacgcugauagacgauggugcuuugauggaaucaaaaacaaccaaauauuagaagagaauguugaaguagaaauauggacaaaggaaggagaaaggaagaaauuaaaaccacguugguuggaugcacgaauuuauagcgacccacuagcccucaaagaauuuaaagaguucgcagcgggccgcaagagucuaacuuuaaacuugaucacagaaaugggaagacuccccacauucaugacacaaaaagcuagagaugcauuagauaaucuagcagucuugcauacagcggaggugggaggcagagcuuauaaucacgcacucagugagcuaccagaaacucuugaaacucuacuuuuacugaccuuauuggcgacaguaacagguggcaucuuccucuuccucaugagugggaaaggcauagggaagaugacuuuagggaugugcuguauaaucacugcuaguauucuauuaugguaugcacaaauccaaccacacuggauagcagcaucaauaaucuuagaguucuuuuugauaguucuauuaauaccagaaccugaaaaacagcggacuccccaagauaaucaacuaacuuacgucguuauugcuauuuuaacaguaguugcggcaacaauggcuaaugaaaugggauucuuagaaaagaccaagaaagaucuuggccuggguaguauaaccacacaagaaagcgaaucaaacauacuagacauugaucuucggccagcaucagccuggacacuauaugcaguagcaacuacuuucgugacaccaaugcugcggcauagcauugaaaacucaaguguuaauguaucauuaacagccauugccaaucaagcuacagucuugaugggauuaggaagaggauggccacuaagcaaaauggauauaggcguaccuuuacuggcuauagggugcuacagccaaguuaaucccaucacauuaacagccgcgcuacuucuauugguggcacauuaugcgauaauagggccaggacuacaagcgaaagcuaccagagaggcucagaaacgagcggcagcagguauuaugaaaaauccuacuguggacggaauuacugucauagaucuagagccuauaccauaugauccaaaguuugaaaaacaauugggucagguaaugcuauuaguuuuaugcguaacucaaguacucaugaugcggacaaccugggcccucugugaagcacuaacauuagccaccggccccauaaguacgcuaugggagggaaacccgggcagauuuuggaauacaacaaucgcuguaucgauggcgaauauuuuuagaggaucauaucucgcgggagccggccuucuguucucaauuaugaagaacacaacaaauacacgaagagguacuggcaacauuggcgaaacauuaggggaaaaauggaaaagcagauuaaacgcacuuggcaaaucagaguuucaaauauacaagaaaucuggcauucaagaagucgacagaacguuagcaaaagagggaauuaaaagaggcgaaacagaucaucacgcaguuucacgaggaucggcaaaacuuaggugguucguugagaggaauaugguuacccccgaggggaaaguaguagaccuuggaugcggaagaggagguuggaguuacuacuguggagguuugaaaaacgucagggaaguuaaaggguuaacaaagggcggaccaggacacgaagaaccuaucccgaugaguacauaugguuggaauuuaguucgguuacaaagcgguguugauguguucuuuacaccacccgaaaagugugauacauugcuuugcgauauaggggaaucuagccccaauccuacuauugaagcgggaaggacacuaagaguacucaaccugguugaaaacugguuaaauaauaauacucaguuuuguauaaagguauuaaaucccuauaugccaaguguuauugagaaaauggaaacucuccaaagaaaauaugguggagcacuuguuagaaauccauugucccgaaauagcacgcaugaaauguacuggguuucgaaugcaaccgguaauauaguuucaaguguaaauaugauaagcagaaugcuaaucaaccgauuuacaaugaaacauaaaaaggcaacguaugaaccagauguugaucucggaucgggaacaaggaauauagguauagaaaaugaaauuccuaaccuagacauaaucggaaaaagaauagagaaaauaaaacaagaacaugagacaagcuggcacuaugaucaggaucauccuuauaaaacaugggcauaucauggaucauaugagacaaagcagacugggucggcgucgaguauggucaacggugucguaaaauuacugacuaaacccugggaugucgugcccauggucacacaaauggcuaugacugauacaacgccauucggacaacaaagaguauuuaaagaaaaaguugauacuagaacccaggagcccaaagaagguacuaagaaacuaaugagaauaacagcugaauggcuguggaaagaauuaggaaagaagaaaacuccacgcauguguacuagggaagaauuuacccgaaagguucggucgaaugccgccuugggcgcuauuuuuacagacgaaaacaaguggaagucugcacgugaagccguggaggacagcagauucugggaguuaguggaucgagaacgcaaucuccaccuagagggaaagugugagacguguguauauaauaugaugggcaaacgcgagaagaaacuuggcgaauuuggaaaagcuaaaggauccagggcuaucugguacaugugguuaggagcacgauuucuugaguucgaggcuuugggauucuugaaugaggaucacugguuuaguagaggcaacucuuuaucaggaguagaaggggaaggccuucacaaauuaggauauaucuuacgugacgucaguaagaaagagggcggugcaauguaugcugaugauacugcaggaugggauacacguaucacucuagaagaucucaaaaacgaagagaugguuacaaaccacaugaaaggagaacauaagaaacuggcagaagcuauauuuaaacucacauaccaaaauaaaguagugagaguacaaagacccacaccuagaggaaccguaauggacauuauauccagaaaagaccaacggggaaguggacaggugggcacauaugggcuaaauacauucacaaauauggaagcacaacuaauaagacaaauggaaggagaaggaauuuuuaaguccauucagagguugacuguuacagaggaaaucgcagugcaaaauugguuggcaaggguaggacgugagagguugucuagaauggccauauccggagacgacuguguagucaaaccuuuagaugaucgcuucgcuagugcucuaacagcauuaaacgacauggguaaaguuagaaaggauauucaacaaugggaaccuucuagggguuggaacgauuggacccaaguacccuuuugcucucaucauuuucaugaguugguaaugaaggaugggagaguuuuagugguaccaugucgaaaucaagaugaauuaauaggaagggcaagaauaucucaaggugcugguugguccuuaaaagaaacagcaugccucggcaaguccuaugcacaaauguggacucuaauguauuuccacagaagagacuuacgccuagcugccaacgcaaucugcagcgcaguucccagccauuggguaccaacaucuaggacaacauggaguauacaugcgaaacacgaguggaugaccacagaagacaugcucgcgguguggaauagaguuuggauacaagaaaauccauggauggaggacaagaccccgguugaaaguugggaggaaguuccguauuugggaaaaagggaagaucaauggugcgguucgcucaucggauuaacauccagagcaacaugggccaaaaauauacaaacugccauuaaucagguucgcagccuuauagggaacgaagaauauaccgauuauaugccgucuaugaagcguuuccguaaagaagaagaagaggcagggguuuuaugguaa

SEQ ID NO: 22625 - RNA, 9876 nt, Artificial Sequence
  derived and/or modified CDS sequence (opt6) from DENV-2__EU482733__SS-prME
acagcaggaguuauaauaauguuaauaccaacugcgauggcuuuucaccuaacaacucgcaauggggaaccacauaugauaguugggcgacaagaaaaagguaaaucucuauuauuuaaaacagaagauggaguuaacaugugcacauuaauggcaauugaccuaggcgaacucugugaggauacuauaacuuacaaauguccacuucuuagacaaaacgagccugaagauauagacuguuggugcaauucaacuagcaccugggugaccuauggaacgugcacaacgaccggagaacauagacgagagaaaagaucagucgcauuagugccacauguuggcauggguuuagaaacacguacagaaaccuggaugucuucagagggcgcguggaaacacgugcaaagaaucgaaacuuggauauugcgucauccuggcuucaccauaauggcugcaauucucgcuuacacuaucggcacuacccauuuccaacgagcacuaaucuuuauucuauuaaccgcuguggcgcccucuaugacgaugagauguauaggaauuaguaacagggacuuuguggagggaguuucagguggaaguuggguggauauuguccuagaacacggauccuguguaacaaccauggcuaaaaauaaaccaacgcuagauuuugaacuaauaaaaacagaagcuaaacaacccgcaacacuaaggaaauauuguauagaagcgaaacucacuaauacuaccaccgaaucacgaugcccaacucaaggagaaccaucccuuaaugaagaacaagauaaacguuucauaugcaaacauucgaugguugauagaggauggggaaacggcugugggcuuuucgguaaagguggaaucguaaccugugccauguuuacaugcaaaaagaacauggaaggcaaaguaguacuaccagaaaacuuggaauacacuaucguaauuaccccacauucuggagaagaacacgccgucggaaacgacacagguaaacacgguaaagaaauaaaaauuacaccucagucuucaauaacagaggcugagcuaacaggguacgguaccgucacgauggaauguagccccaggacuggacuggacuuuaacgagaugguauuacugcaaauggaagacaaagcaugguuaguucaucgucagugguucuuagacuuaccauugccaugguugcccggagcggauacucaaggaucgaauuggauccagaaagaaacucuuguaaccuucaaaaauccucacgcuaagaaacaagauguaguuguauuagguucacaagaaggggcuaugcacacagcauuaacaggcgccacagaaauacaaaugucuucgggcaaucuauuauucacuggacacuuaaaaugucgucuccgaauggacaaauuacaacugaaagggaugucuuauaguauguguacugguaaauucaaaauaguaaaagaaauagcggagacacaacauggcaccauugugauaagaguacaguaugaaggagaugguucuccuuguaaaauccccuucgaaauuauggaucucgaaaaacggcauguucuaggaagacuaaucacaguaaauccgaucguuacggaaaaggauagucccgucaacauagaggccgaaccaccguucggcgacaguuauauuaucauuggggucgaaccuggucaauugaaauuaaacugguuuaagaaagggucuucaauagggcaaauguucgaaacgacaaugaggggugcuaaacguauggcuauacugggugacacugcaugggauuuuggaucuuuagguggcguuuucaccaguauaggaaaagcgcuacaucaagucuucggugcgaucuauggugccgcuuuuucgggaguaucauggacuaugaaaauacuaaucgggguuauuaucaccuggaucgggaugaauaguagaucuacaucuuuguccguaucacucguauuaguaggagucguaacuuuauacuuaggcguaaugguucaagccgauucuggcuguguuguaucauggaagaacaaagaacucaaaugcgggucgggcauauucaucacagacaacgugcacacguggacagaacaguauaaauuccagcccgagagucccucaaagcuagcaagcgcaauacaaaaggcucaugaagaagguauaugcgguauacgaucgguaacaagauuggaaaaucuaauguggaaacaaauuacacccgaauuaaaucauauauuaucagaaaaugagguuaaauugaccaucaugacgggagacauaaaagguauaaugcaagccggaaaaagauccuugcgaccucagccgacagaguuaaaguauucauggaaaaccugggguaaggcaaagaugcuauccacugagucccauaaucaaacauuccuaauagauggacccgaaacugcagaaugucccaacacaaacagagcauggaacucauuagagguagaagauuacggauucgguguauuuucaaccaauaucuggcuuaaauuaagagaaaaacaagauguauuuugcgacaguaaacuuaugucggcggcaauuaaagauaauagagcaguacaugcagauaugggcuauuggauagaaucugcuuuaaaugauacguggaaaauggagaaagccucuuuuauugaaguuaaguccugucauuggccgaagucacacacucuguggucaaauggaguguuagaaagugagaugauuaucccaaagaauuuugcuggaccaguaagccagcauaauuauagaccaggauaccacacacaaacagcuggcccuuggcaccuggguaagcucgaaauggacuuugauuucugugaggguacaacuguugugguaacugaagauuguggaaaccgggggccgucacuccgaaccaccacagcgucagggaaacuaauuacagaaugguguugucgcucuugcacccuaccuccccuaagauaucgaggagaggaugguugcugguaugggauggaaauaaggccacuuaaagaaaaagaggaaaauuuaguuaauagucuugugacagcuggccauggacaaauagauaacuuuucauugggaguauuagggauggcguuauuucuagaagaaauguuacgcacgagggucggaacaaaacacgcuauacuauuaguugcuguauccuucguaacauuaauaacugguaacaugagcuuuagagaucugggucgugucauggugaugguaggggcaacaaugacugaugacauagguaugggcguaacauaucuagcauuacuagcagccuucaaaguacgacccaccuucgcugcagguuuacuauugcgaaaacuaaccagcaaagaacuaaugauggcaacaauagggauagcauuauuaucgcaguccacuauaccggagacuauacuggaacuuacugaugcacuagcgcucgguaugaugguguuaaaaauuguuagaaacauggaaaaauaucaacuagcaguaacgauaauggcuauuaguugugugcccaacgcugucaucuuacagaaugcuuggaagguaagcuguaccauacuugcagccgucuccgugagcccacuuuuacuaacaagcagccaacaaaaagcugacuggauuccgcuagcguuaacgauaaagggauugaauccuacugcgauauucuuaacuacccugucaagaacaagcaagaaacgcagcuggccacuuaaugaagcggugauggcuguagguaugguaagcauucuagcaagcaguuuguuaaagaaugacaucccaaugacagguccauugguagcaggaggauugcuuacaguauguuacguccugacaggacgcagugcugaucuagaauuggaacgcgcagcugaugugaaaugggaagaccaggcggaaauuucuggaucgaguccuauacugaguauaacgauuagcgaagacggaaguaugucaauuaaaaaugaagaagaggaacagacucuaacaauccugauaaggacaggguuauuaguaauuucaggaguuuucccuguaucaaucccgauaacggcggcugcaugguacuuaugggagguaaagaaacaacgugcaggcguuuuaugggaugucccuucuccgcccccaguuggaaaagcggaacucgaggauggagccuauaggauaaaacaacguggaauauucgguuauagccaaauuggggcuggaguauacaaggaaggcacguuucauacaauguggcauguaacaagaggagcaguucuaaugcaccgagggaaacgaauugaaccuucuugggcggaugucaagaaggacuuaaucaguuacggagguggcuggaaacucgaaggugaguggaaggaaggugaagaaguccaaguguuagcauuagaacccggcaaaaauccucgagccguucaaacgaaaccaggucuuuuuaaaacgaacacgggaacaauaggggcaguaucucuugauuucucgccaggaacauccgggagcccuaucguagauagaaaagguaaagugguaggauuauauggaaauggagucgugacucgaagcggagcauacguguccgcaauagcacaaacugagaaaucuauagaggauaauccagaaauagaagaugauauuuuccguaaaaagcggcuuacuauaauggaccuacacccaggagcagguaaaacuaaaagguaccuucccgcaaucguuagagaagcuauuaaaagaggacugagaacguuaauacuagcgccgacgcgagugguagcagcagaaauggaagaagcacuacgaggauuaccaauaagguaccaaacgccugcaaucagagcagaacacacaggcagggaaauuguggaucuaaugugucacgcuacauucacuaugcgacugcuaucaccaguucgagucccuaacuacaaccuuauuauaauggacgaggcacauuuuacagauccugcgaguauugccgcaagggguuauauuuccacaagaguugaaaugggugaagcagcagguauauuuaugaccgcuacuccgcccgguucuagagaccccuuuccacaaagcaaugcccccauuauggaugaggagagagagauuccagaaaggaguuggaacaguggacaugaauggguaacagauuuuaaaggaaaaacgguaugguuuguaccaaguaucaaagcugggaacgauaucgccgcuuguuuaaggaaaaacggcaagaaaguuauucaguuaagucguaaaacauucgauucagaauaugugaagacgagagcaaaugacugggacuucguaguuacaaccgauauuucagaaaugggggccaacuuuagagcagagcgugucaucgauccgcgacgcugcaugaaaccggugauacuaacggauggugaggagaggguuaucuuggccggaccuaugcccgucacacauucaagugcagcucaaagacgcggacguaucgguagaaaucccaaaaaugaaaaugaucaguauauauacaugggggaaccccuggaaaacgacgaagacugugcucauuggaaggaagcaaaaaugcuacuugauaauauuaacacaccagaaggaaucauaccgucaauguuugagccagaaagggaaaaaguagacgcaaucgauggagaauauagguuaagaggggaggcccgcaagacauuuguagauuugaugaggaggggagaccucccgguauggcucgcguaccgcguugcugcagaaggcauaaauuacgcugacagacggugguguuuugacggaaucaaaaauaaccaaauucuugaagaaaauguugaaguugagauuuggacgaaagaaggagagaggaagaaacugaaacccagauggcuagaugcacgaaucuacucggauccuuuagcguuaaaagaauuuaaggaguuugcagcuggacgaaaaaguuugacccuuaaccuuauaacggaaaugggucgauugccaacauucaugacucaaaaagccagagaugcgcucgacaacuuggcaguauuacacaccgccgaaguggguggcagagcguacaaccaugcuuuaucugaacuaccagaaacucuggaaacguuauuguuacugacauuacuugcaacagucacagggggaaucuucuuguuuuuaaugaguggaaaggguauuggaaagaugacucuggguaugugcuguaucauaacggcgucuauccuacugugguaugcucaaauucaaccacacuggauugcagcuagcauuauauuagaguucuuucuuauuguucuuuugaucccagaaccagaaaaacagaggacaccccaggacaaccaguuaacuuauguuguuauugcgauucuaacagucguagcagcaacaauggcaaacgagaugggauucuuagaaaagacuaagaaagacuuaggcuuggguucaauuacgacacaagaaucagaauccaauauccuugacauugauuugagaccagccucagcauggacuuuauaugcuguugccacgacauuuguaacacccaugcuccggcacaguauugaaaauucaucuguuaacguuucucuaacugcuauugcaaaucaggcaacaguacuaaugggucuaggucguggguggccauugucaaaaauggauauaggaguaccacuacuugcaauaggguguuauucucaagugaauccuauaacguuaacagcugcuuuacugcuuuuaguugcucacuaugcgaucauugggccaggacuucaagcuaaagcaacucgagaggcucagaaaagagcggccgcuggaauaaugaaaaacccuacuguagacgguauaacaguuauagaucuagaaccaauuccguacgacccgaaauuugaaaaacaauuaggucaagugaugcuauugguccuaugcgucacacagguuuuaaugaugaggacgacaugggcucuuugcgaggcauuaacauuagcgacagguccaauaucgacucuaugggaagguaacccaggaagauuuuggaauacuacaauagcaguaucgauggcaaauauauuuagaggcaguuauuuggcgggagcuggucugcuauucaguauuaugaaaaacacaacuaauacaagaagggguacgggaaauauaggagaaacacuuggcgaaaaauggaaaucucgauugaacgcacucgguaaaagcgaauuucaaauauacaagaaaagugguauccaagaagucgaccgcacucuggcuaaagagggcauuaaaagaggcgagacugaucaucaugcuguuucgcgaggaucagcuaaacuacguugguuuguugaaagaaauauggucacuccugaaggaaagguuguggauuuaggaugcgggagaggaggguggaguuauuacuguggaggucucaaaaaugucagggagguaaaaggguuaacaaaggguggcccaggucaugaggaaccaaucccuaugaguacguauggauggaauuuaguuagacuacaguccggcguagauguguucuucaccccacccgaaaaaugugauacccuacuuugcgacauaggagagaguucaccaaaccccacgauagaagccgguagaacauuaaggguacuuaaucuagucgagaacugguuaaacaacaauacccaguuuuguaucaaaguuuuaaauccguauaugccaucaguaaucgaaaagauggaaacauugcaacgaaaguacggaggugccuuagucagaaacccauuaucuagaaacucaacgcaugagauguacuggguuuccaacgcaacaggaaacaucguaucuaguguaaacaugauaucuagaaugcuaaucaaucgcuuuacaaugaaacacaaaaaggcaacguaugaaccugauguugauuugggaaguggaacuagaaacauaggaaucgaaaaugaaauucccaaucuggauauaaucggcaagagaauagagaaaauaaaacaagaacaugaaacgagcuggcacuaugaucaagaucauccauauaaaaccugggcauaucacgguucauacgaaacaaaacaaacuggaucggcuaguucaaugguaaauggagucguacgauuauuaacgaaaccuugggaugucguacccauggugacucaaauggcuaugacagauacgaccccguucggccaacagagaguauucaaggaaaaaguugauacucgaacacaagaaccaaaagaaggaaccaagaaacuuaugcggauaacagcagagugguuauggaaagaauuagggaagaagaaaacaccacgaaugugcaccagagaggaguuuacuagaaaaguuagaucaaacgcagcguuaggagcaauuuucacagacgagaauaaauggaaaucugcacgagaagcaguggaagauucaagauuuugggaacuuguagauagagaaagaaaccuucaucuugaaggaaagugugagacgugugucuauaauaugauggggaagcgugagaagaaacuuggagaguucggaaaagccaaaggaucaagagcgauaugguauaugugguuaggcgccagauuuuuagaguucgaagccuuaggauuucuaaaugaagaccacugguuuucaagagguaauucacuaucgggugucgaaggcgaggguuuacacaaacugggguauauucucagagauguuagcaagaaagaagguggggcuauguaugccgaugauacugcugguugggacacacguaucacacuagaggaucuuaaaaaugaagagaugguaacuaaucauaugaaaggggaacacaagaaacuagcagaggcaauuuucaaacucacauaucaaaacaaagucgugagggugcaaagaccaacaccaagagguacgguaauggauaucauaucaagaaaagaucaacggggaucaggacaagugggcacguacggauugaauacauucacaaacauggaagcucaacucaucagacaaauggaaggagaagggauauuuaaaucuauccaacgcuugaccguuacggaagaaauugcgguacaaaauugguuagcgcgugugggaagggaacgucuaucaagaauggcgauuaguggugacgacuguguaguuaaaccacuugaugaucguuuugcaagcgcucuuacagcccuaaaugauaugggcaaagugcgaaaagauauacaacaaugggaacccaguaggggguggaaugauuggacccaaguaccauuuuguucgcaucauuuccacgaacugguaaugaaagauggaagaguauugguugugccaugucggaaccaagacgaauuaauugggagggcaagaauaucacagggagcuggcuggagccuuaaagagacugcauguuugggcaaaaguuacgcacaaauguggaccuuaauguacuuccacagaagggaucucagacucgcugcaaacgcuauauguucugcagucccuucccacugggucccaacaucuaggacaacuuggaguauacacgccaaacacgaauggaugacuacagaagacauguuggcaguguggaauaggguguggauacaagaaaauccuuggauggaggacaaaacgccuguagaaucaugggaagaagugccuuaucuuggaaaaagagaagaucaauggugugggagccucauuggguuaacaucuagagcuaccugggcuaaaaauauucaaacggcuauaaaucaaguacgaucuuuaaucgggaaugaagaauauacagauuacaugccuucuaugaagcgauucaggaaagaagaagaggaggcuggaguguuaugguaa

SEQ ID NO: 22626 - RNA, 9876 nt, Artificial Sequence
  derived and/or modified CDS sequence (opt6) from DENV-2__EU482734__SS-prME
acagcugguguuauaguuaugcuaaucccuacugcaauggcauuucauuugaccacgcgaaauggagagccgcauaugauaguuggaaggcaagagaaaggaaaaucuuuauuauucaaaaccgaagacggaguaaacauguguacccuuauggcgaucgacuuaggagaacuuugcgaagacacuauaaccuauaaaugcccguuauugaggcagaacgaaccugaagauauagacuguuggugcaauucaacgaguaccuggguaacguaugguacauguacaacuaccggagaacauagacgugaaaaacgaaguguugcauuaguuccucacguagggaugggccuagaaaccagaacagaaacauggauguccagcgaaggagcauggaaacauguucagagaauagaaaccuggauccuacgacaccccgguuuuacaauuauggcagcgauuuuggcauauacuauuggaacaacucauuuucaaagggcucuuauuuuuauuuuauuaacagcgguggcgccaaguaugacaaugcgaugcauaggaauaagcaauagagauuucguagaggggguaucaggugguucuuggguugauauaguacuggaacaugguucauguguuacaacgauggccaaaaacaaaccaacucuagacuuugaacugaucaaaacagaagcaaaacaacccgcaaccuuacggaaauauuguauagaagcaaaauuaaccaauacgacaacagaaaguagauguccaacccagggagaaccgagucuuaaugaagaacaagauaaaagauucauuuguaaacacucaaugguagacagaggauggggcaacgguuguggacuguucgguaaaggaggaaucguaacgugcgcaauguucacuuguaagaaaaacauggaagggaaaauugugcaaccugaaaacuuagaauacacaauaaugauaaccccacauuccggggaagaacaugcaguuggcaacgacacuggaaaacaugggaaagaaauuaaaaucacaccacaaaguaguauaacagaagcagaauuaacaggguaugggacaguuaccauggaguguucaccgcguacagggcuagauuuuaaugagaugguauuguuacaaauggaagauaaagccugguuaguucacaggcagugguuccuagauuuaccauugcccuggcuaccuggagcggacacucaggggagcaacuggauacaaaaagagacccuuguaacauucaaaaauccacaugcuaagaaacaagauguuguggugcuaggaucucaagaaggagcaaugcacaccgcauugacaggagcaacugagauacaaaugucaucgggaaaucucuuauuuacgggccaccuuaaaugcagguugaggauggacaaauugcaacuuaaaggaaugagcuauucaaugugcacaggcaaauucaaaaucguaaaagaaauugcugaaacacaacacggaacaauuguaauaagaguccaauaugagggggacggaucccccugcaaaauaccuuuugaaauaauggacuuagagaaaagacacguacuaggacggcucauuacggugaauccgauugucaccgaaaaagauucaccaguaaacauugaggcugagccaccuuucggugacucuuacauaauaauaggagucgagccaggucaacuaaaacugaacugguuuaagaaagggaguaguauaggucaaauguucgaaaccacaaugcguggugcaaaacgaauggcgauacucggagacacagcaugggacuucgggucauuaggagguguguucacaagcguagggaaagcacuacaucaaguuuuuggagcgaucuacggggccgcauuuucaggagucucuuggacaaugaaaaucuuaauagggguaauaauaaccuggauaggaaugaacucgagauccacaucucuaagcgugagccuaguacucgugggagugguaacucuauaucucggagcaauggugcaggcagacucgggcuguguagucucauggaaaaauaaagaacuuaagugcggaagcgguauauucauuaccgauaauguccauacauggacggaacaauauaaauuucaaccugaaucgccaagcaaacucgcauccgcuauacaaaaagcacaugaagaaggaaucuguggaaucagauccguaacucgguuagaaaauuugauguggaaacagauaacucccgaacucaaccauauucuaucugaaaaugaagucaaguuaaccauaaugacuggcgauauaaagggaauuaugcaggccgguaaaagaucauugcguccccaaccgacugaacucaaauauucauggaagacauggggaaaagcaaaaaugcuaaguaccgagucacauaaucaaacauuuuugaucgacggcccagaaacggcugaauguccgaacaccaaucgcgcauggaauagccuugaaguggaggacuacgguuucgggguguucacgaccaauaucuggcuuaaauuacgggaaaagcaagauguauuuugugauucaaaguugaugagugcugccauaaaggauaaccgcgcagugcaugcagacaugggauacuggaucgaaucagcacuuaacgauaccuggaaaauggagaaggcuucauuuaucgaaguaaaaaguugccauuggcccaaaucucauacacuauggucuaacggaguacuggaguccgaaaugaucauacccaaaaacuucgccggacccguaucgcaacauaauuaccgaccaggauaucacacacagacagcagguccauggcaucugggcaaacucgaaauggauuucgauuucugcgaaggcacaacaguugucguaacagaagacugcgguaacagaggaccgucuuugagaacaaccacagcaucaggcaaguuaauuacggaaugguguugucguucuugcacuuugccaccacugcgauacaggggagaagacggauguugguauggaauggaaaucagacccuugaaggaaaaagaggaaaauuuagucaacagcuuaguaacagcaggucauggacaaauugauaauuuuagccucgggguacuuggaauggcuuuguuccuugaagaaaugcuuaggaccagggucgggacuaaacaugcuauucuccugguggcagugucguuuguuacauugaucaccggaaauaugucguuuagggauuuagggagggugaugguaaugguaggggcuacaaugacagacgacauaggaauggguguaaccuacuuagcguuauuagcagcuuuuaaaguccgaccaaccuucgcagcaggacuucuacuaagaaaguugacaagcaaagaacuuaugauggcuaccauaggaauugcauuguuaagucaaaguaccauacccgaaacaauccuagaacuaacagacgcccuugcucuugggaugauggccuuaaagauagucaaaaauauggaaaaauaccagcuugcagugaccauaauggcgaucagcugcguaccuaacgcugugauccuacaaaaugcuuggaaaguaucuuguacuauucucgcagcaguaagugugagccccuuguuguuaacuuccucacaacaaaaagcagauuggauaccucuagcuuugacaauaaaaggucucaauccuaccgcuauauucuuaacaacccucagucgaacgucgaagaaaagaucauggccgcuaaacgaagcgauaauggccguugguaugguuucuauauuagcgaguucucuacucaaaaacgauauccccaugacggguccucucguugcggguggauuauuaacaguuuguuacguacuaacaggaagaucugcagaucuagaauuagaacgcgccgccgaugugaagugggaagaccaagccgagauaucggguucaaguccuauccuaagcauaacaauuucugaagacggaucaaugucaauacgaaacgaggaggaagaacaaacccuuacgauauuaaucagaaccggauuauuaguuauuucgggugucuuuccaguaaguauaccgguaacggcagcagcuugguaccugugggagguaaagaagcaaagggcuggaguucuaugggauguaccuucaccaccaccagucgggaaggcagaauuggaagacggugccuaucgaauuaaacaaagagggauauugggcuauagccagauuggagccggcguauauaaagaagggacguuucauacaauguggcacguaacaagaggggcagucuuaaugcaccgaggcaagagaauagaaccaagcugggcugaugugaagaaagacuugguaucauacggaggaggguggaagcuagaaggcgaauggaaggaaggagaagaaguccagguacuggcacuugaaccggggaaaaauccacgagcuguccaaacaaaacccggaauuuuuaaaacaaauaccgguacuauaggagccguuagcuuagauuucucaccuggaacguccgggucuccuaucgucgauaggaaaggaaaaguaguuggacucuacgguaacgggguaguaacaagaucaggugcauauguuucagcaauagcgcaaaccgagaaaagcauagaggauaacccagagauagaagaugauauauuucgcaagaaacgacuaaccauaauggaucuacacccaggugcaggcaaaacaaagagauauuuaccugcgauaguaagagaagccauuaaacgaggacugagaacuuuaauauuagcgccaacuagagucguagcagccgaaauggaggaagcgcuuaggggcuugcccauuagauaccaaacaccagcgauuagagcagaacacacuggacgugaaauagucgaucugaugugccacgcuacauucacaaugagacuucuaaguccaguccgaguuccaaacuacaacuuaauaauaauggaugaagcucauuuuacugacccagcaagcauagcggcuagaggauauauaucuacacgaguagaaaugggagaagccgcggguauauuuaugacagcaacacccccggguagucgugaccccuuuccacagaguaacgcuccaauuauggaugaggaacgugagaucccagagcgaaguuggaauagcggacaugaauggguuacagauuuuaaaggaaaaacaguaugguuugugcccaguauaaaagcuggaaaugacaucgcagcaugucucaggaaaaacggcaagaaagugauucagcucuccagaaaaacauuugacucugaauacgucaaaacaagagcuaaugauugggacuucgugguuacuacugauaucuccgaaaugggagcaaacuuuaaagcagagaggguaauugacccuaggagguguaugaaaccggucauacuaaccgauggggaagaaagaguuauacuugcaggucccaugcccguuacucacaguagugcagcacaaagacgcggaagaauuggaagaaaccccaagaaugaaaaugaucaauacaucuauaugggggaaccauuagaaaacgacgaagacugugcacacuggaaggaagcaaaaaugcuguuagauaacaucaauaccccagaaggcauaauaccaaguauguuugaacccgaacgggaaaaaguugaugcaauugauggagaguaccguuuaaggggugaagcuagaaaaaccuucguagauuugaugcgcagaggagauuuaccaguguggcuagcuuauaaaguggcagcugaaggaauaaacuacgcggaccgucgcuggugcuucgaugguauuaaaaauaaucagauccuggaagaaaacgucgaaguagagauauggacaaaagagggugaacguaagaaauuaaaaccccguuggcuugacgcacgcauuuacucggacccucuugcacuaaaagaauuuaaagaguuugcagcuggucgaaaaagccuuacacuaaaucuuaucacagaaaugggacgccuuccuacguuuaugacacaaaaggcacggaacgcccuugauaaccuggcuguuuugcauacugccgaagccgguggaaaagcauacaaccaugcacugucugaacugccggagacauuggaaacguuacuacuacuaacgcuauuagcaacaguaacuggaggaauuuuccuguuucugaugucugguaaggggauaggaaaaaugacucucgggauguguuguauuaucaccgcaaguauauuguuaugguacgcacagauucaaccacauuggaucgcggcaagcauuauacucgaauuuuuccuaauuguguuauuaauaccugaaccggaaaaacaacguaccccgcaggauaaccaauugacguauguaguuauagcaauucuaacagucguugcagcaaccauggcuaacgaaaugggguuucuugaaaagacuaagaaagauuuagguuuaggaaguauuaccacacaagaaucugagaguaauauauuagauauugauuuaagaccagcuucggcguggacuuuauaugcaguugcuacgacuuuugugacuccgauguugagacauuccauagaaaauucaucagucaaugugaguuugacugcuauugcgaaucaagcaacuguuuuaaugggacuaggcaaaggcuggccauuaaguaaaauggacauaggcguaccuuuauuagcuauuggauguuauagucaaguuaauccgauaacucuuacagcagcgcuccuacucuuaguggcccacuaugcuauuauaggaccaggacuacaagcaaaagccacacgagaagcccaaaaacgagcagcggcuggaauuaugaaaaauccgaccguugacgggaucacuguuauagaccuugaaccaauaccguaugaccccaaauucgaaaaacaacuaggacaaguaauguuauuaauucuaugcguaacacaagugcuaaugaugcgaacaaccugggcucuaugcgaagcacuaacauuagcaacagguccuauaagcacgcuaugggaaggaaauccgggacgauuuuggaauacgaccauagccguaaguauggcaaauauuuuucgaggaagcuaccuagcuggagcagguuuacuauucucuaucaugaaaaacacaacaaauacaagacgagguacaggaaauaucggagaaaccuuaggagaaaaguggaaaagcagguuaaacgcucuugguaaaucugaguuccaaauuuauaagaaaagcgguauacaagaaguagacaggacacuugcuaaagaaggcauuaaaaggggagaaacggaccaucacgcaguaucucggggaucagcaaaauugcguugguuuguagaacgaaauaugguaacuccagaagggaaagucguugaucugggauguggacgaggaggauggucauauuauugcggagggcucaaaaacguccgggaaguaaaaggacuaacaaaaggaggcccaggucaugaagaaccuauuaccaugaguacauacggauggaaucuaguuagguugcaaagcggagucgauguauucuuuacaccaccagaaaaaugugauacuuugcuuugcgauauaggggaguccaguccuaauccuaccauagaagcuggccgaacacuccgcguauuaaaucugguggagaauuggcuuaacaacaacacgcaguuuugcaucaaaguauugaauccuuacaugccaaguguuauagaaaagauggaaacucuacaaagaaaauaugguggagcucuuguacggaacccauuaagcagaaacucaacucaugagauguacuggguuuccaaugcaacuggaaacauaguuaguucuguuaauaugaucaguagaauguuaauuaacagauuuaccaugaagcacaagaaagcuacauaugagccagauguugaucuaggaucagguacgcgaaauauugguauugagagugaaaucccaaacuuagauauuauagguaagaggaucgaaaagauaaaacaggaacaugaaacuucauggcacuacgaucaggaccauccauauaaaacaugggcauaccacggaucuuacgaaacaaagcagacugguucagcuaguuccaugguaaaugguguuguccgcuuacuaacaaagccaugggaugugguuccuaugguuacacagauggcaaugacugacacgacacccuucggacaacaaagaguguuuaaagagaaaguugauaccagaacacaagagccuaaagaagggacaaagaaauuaaugaaaauuacggcagaauggcuauggaaagaauuggguaaaaagaaaacaccccguauguguacuagggaagaauuuacaaggaaaguuaggucgaacgcugcccuuggagcuauuuucacagacgaaaacaaauggaaaucugcuagagaagcgguugaagauggaagguuuugggaauugguagacagagaaagaaauuuacaccuagaaggcaagugugaaacgugcguauauaauaugauggguaagagagagaagaaauuaggggaauuuggcaaagccaagggaucacgcgcgauuugguauauguggcuuggagcacgauuccuugaguucgaggcgcugggauucuuaaaugaagaccauugguucucuagagguaacaguuugucuggagucgaaggggaaggauugcaucggcugggauauauacuacgagauguuaguaagaaagaaggaggagcaauguacgcagacgacacggcuggaugggauacgaggaucacauuagaagaccucaaaaacgaggaaaugguuacuaaccauaugaagggugagcauaagaaacuagcagaggcaauauuuaaacucacauaucagaauaaaguugucagagugcaaagaccaacgcccagggggacuguuauggauauaauaagcaggcgggaucagagaggaaguggccaaguaggaacuuacggccuaaauaccuuuacaaacauggaagcacaauugauuagacaaauggagggagaaggaauauuuaaaucuauccaacacuuaaccguaacugaagagauagcaguacagaauugguuagcucgaguggguagagaacguuugucacgcauggcaauuaguggugacgauugcgugguuaagccuauagaugauagguucgcgucugcuuuaacagcauuaaacgacauggggaaaguaagaaaggauauucaacaaugggaaccuucacgggguuggaaugacuggacccaaguucccuucugcucacaccacuuccacgagcuaguaaugaaagauggucggguccuaguuguaccauguagaaaucaagacgaacuuauagguagagcaagaaucagucagggagcaggauggaguuuaaaagaaacugcuuguuuaggaaagucauacgcccaaauguggacacucauguauuuucacagaagagaucuaagauuagcagcgaaugcaauauguagcgcaguacccagccacuggguaccuacauccaggacgacauggucaauucacgcuaagcaugaauggaugaccacugaagauaugcucgcaguauggaaucguguguggauacaagaaaacccguggauggaagacaagacgccagucgaaucgugggaagagguacccuauuugggaaaacgugaagaccaaugguguggcucacucauaggucuuaccucucgcgcaacgugggcaaagaacauucaaaccgcaaucaaccaagugaggucucucaucggaaaugaagaauauacggauuacaugccgucaaugaaacgauucaggcgagaagaagaggaagccggaguacugugguag

SEQ ID NO: 22627 - RNA, 9876 nt, Artificial Sequence
  derived and/or modified CDS sequence (opt6) from DENV-2__EU482735__SS-prME
acugcuggaguaauagucaugcuaauucccacagcuauggcuuuucauuuaacaacgagaaauggugaaccccacaugauaguaggaagacaagaaaaaggaaaaucacugcuauuuaaaacugaagauggaguuaauaugugcacucuuauggcuaucgaccuaggugaauuaugugaagacacaauuacguauaaaugucccuuauuaagacaaaaugaaccugaagauaucgauugcugguguaauucaacgaguacauggguaaccuaugggacauguacgacuacaggugaacaucggagagagaaacgaaguguugcgcucguaccccacgucgguaugggacuugaaacacgaacugaaacuuggaugaguagugaaggugcauggaaacauguacaaagaauugaaacauggauucuaagacauccaggauuuacuauaauggcagcaaucuuggcuuacaccauaggaacaacacauuuccaaagagcgcugauuuucauucuacucacagcgguagcaccaucaaugacgaugagauguauuggaauuucaaacagggauuuuguggaagguguaucuggagguucguggguggacauuguccuagaacaugguuccugcgugacaacgauggcuaaaaauaaaccaacuuuagauuuugaacuaaucaaaacagaggcgaaacaaccugcuacgcugcgaaaauacugcauagaagcaaaacucacaaacacgacgacggagaguagaugccccacacaaggagagcccucacuaaacgaagaacaagauaaaagauuuauuugcaaacauuccaugguagauagaggguggggaaauggaugcggacuauuuggaaaaggagguauuguaacaugugcaauguuuacuugcaagaaaaacauggaaggaaaaauaguccaaccagagaacuuggaauauacaauaaugaucacgccacacaguggagaagaacaugcagucggcaacgauacaggaaaacauggaaaagaaauaaaaauuacuccacagaguucaaucacagaagcugagcuaacgggauacgggaccgugacaauggaauguucaccucgaacagguuuggauuuuaaugagaugguacuguuacaaauggaagauaaagcauggcuaguacauagacaaugguuucuagaucugccauuaccauggcuuccaggagcagauacucaagguaguaauuggauucagaaagaaacuuuaguaacuuucaaaaauccucaugcaaagaaacaagauguaguuguguuaggcagccaagaaggagcgaugcauacugcuuuaacuggggcaacagaaauacaaaugagcucgggaaacuuacuauuuacuggucauuugaaaugcagauuaagaauggauaaacuucagcuaaaaggaaugucauacaguaugugcacagguaaauuuaaaauugugaaagaaaucgcugaaacgcaacauggaaccauaguaauacguguccaauaugaaggagauggcucaccauguaaaauucccuuugaaauuauggaucuagagaaaaggcauguauugggaaggcuaauaacgguaaacccuauagugacugaaaaagacaguccugucaacaucgaagcggagcccccuuuuggugauuccuacaucaucauaggugucgaaccagggcaauuaaagcucaauugguuuaaaaagggguccucuauagggcagauguuugaaacaaccaugagaggggcaaaaagaauggcaauacuaggagacacagccugggauuuugggucucuaggaggaguguuuacaaguguaggaaaagcauuacaucaaguguuuggagccauuuauggagcugcguuuucaggaguauccuggacaaugaaaauccugaucggagucauaauuacguggauuggcaugaacucuagaucaacaaguuuauccguuagccuaguauugguugguguaguuacacuguaccuaggugccaugguacaagcagacaguggauguguuguauccuggaagaauaaagaacucaaguguggauccggaauuuuuauaacagauaacguacauacauggacagaacaauacaaguuucaaccagaaucaccaucuaaacuugcaucagcuauucaaaaagcacacgaagaagguauaugugguauucgaucggucacgaggcuugaaaaucucauguggaaacaaauuacucccgaauuaaaucacauccuuuccgaaaaugaggugaaacugacgauaaugacuggcgauauuaagggcauaaugcaagcagggaaaagaucuuuaaggccccagccuacugaacugaaauauagcuggaaaacuugggguaaagcaaaaaugcuuucaaccgaaagucauaaucaaacuuucuuaauagacggaccugagaccgcagaauguccaaauacaaauagggcauggaauaguuuagagguugaagauuacgguuuuggaguuuucacuacaaacauuugguuaaaguuaagagagaagcaagauguguuuugcgacucaaaauuaaugagcgcagccauaaaagauaacagggccguccacgccgacaugggguauuggauagaaucagcauuaaaugauacuuggaagauggagaaggcaaguuuuauagaaguuaaaucaugccauuggccuaaaagucacacauuauggucaaauggagucuuggaaagugaaaugauaauaccuaagaauuuugcugguccagucucgcaacacaacuaucggccaggauaccauacccaaacugcuggcccuuggcaucucgguaaauuggaaauggauuucgauuuuugcgaaggaacaacaguugugguaacggaagacuguggaaacagaggaccgucucugagaacgaccacugcuaguggaaaacuaauaaccgaaugguguugccggagcuguaccuuaccaccauuacgcuacagaggcgaagauggcugcugguauggaauggaaauacgucccuuaaaagaaaaagaagaaaaucugguuaauucgcugguuacggcugggcacggccaaauugauaacuucagcuuggggguuuuaggaauggcuuuguuuuuagaggagaugcuacgaacaagggucgguacuaagcaugcaauacuuuuaguugcuguuuccuucguaacucuuauaacgggaaauaugucuuucagagaucucggacgaguaaugguuaugguaggcgcgacuaugacagaugauauagguaugggcgucacuuaucuagcccuacuugcugcguuuaaaguacgcccaaccuuugcugcaggcuuauugcuucggaaacuaacuucaaaagaacuuaugauggcuacaauuggaaucgcacuauuaucccaguccacaauuccagaaaccauauuagaacucacagacgcuuuggcccuggguaugauggcucucaaaauagucaaaaauauggagaaauaucaacuggcaguaaccaucauggccaucucuugcgucccgaaugcagucauucuacaaaacgcauggaaagugucguguacgauacuagcugcaguauccguaucuccucucuugcucacuagcucucaacaaaaagcagauuggauaccgcuggcguuaacaauaaagggacugaacccuacggccauuuuucuaacuacucuaucccguacgagcaagaaaagaagcuggccgcucaaugaggcaauaauggcagucggaaugguaucuauucuugcuuccucacugcucaaaaaugauaucccuaugacagggccguuaguagcaggaggucugcucacuguauguuacguuuugacuggacggagcgcagaucuugaguuagaaagggcugccgaugucaaaugggaggaccaagcagaaauuucaggaucauccccaauacucucaauaacgauuagcgaagaugguucaaugaguaucagaaaugaagaagaggagcagaccuuaacuauucucauuagaacaggcuugcuugugauuuccgggguguuuccgguuucuauacccguaacagcggcugcgugguaccucugggaagugaaaaagcaaagagcugguguuuugugggauguucccagcccaccaccgguaggcaaagcagaguuagaagauggggcauaccggauuaaacaaagaggcaucuuggguuacucacaaaucggagcaggaguguacaaagaagguacauuucauacuauguggcauguaacucgaggagcaguacuuaugcacagagguaaaaggauagaaccaaguugggccgacguuaagaaagacuugguauccuacggaggaggauggaaguuagagggugaauggaaggagggagaggaaguacaaguucuagcucucgaaccggggaaaaacccaagagcugugcagaccaaacccgguauauucaaaacaaacacagguacaauaggagcagucagucuagauuucucaccagggacgucaggcucccccaucguagacagaaaagguaaaguaguaggauuguaugggaaugguguagucacgagaucgggagcauacguuagcgccaucgcucaaacagaaaagucgaucgaagauaaucccgaaauugaagaugacaucuucaggaaaaagcgauuaacaauuauggacuugcauccuggagcagguaaaacaaaaagauauuuaccugcaauaguucgugaagcaauaaaacgaggauuaagaacauuaauauuagcaccuaccagaguaguagcagcagaaauggaggaagcacuaagggggcuaccgauucguuaucaaacuccugcgauacgugcggaacauacuggcagagaaauaguugaccucaugugccacgcaacuuucacaaugcgacuacuuaguccuguacgaguaccaaauuacaaccuaauuauuauggacgaagcucacuuuacggauccggcaucgauagcggcaagaggauacauaucuacgcguguagaaaugggugaagcugcagggauuuuuaugaccgcaacaccuccuggaucacgagauccauucccgcagaguaaugcgccuaucauggacgaagaacgggaaauaccugaacggaguuggaacucgggucacgagugggucaccgauuuuaagggaaaaacuguaugguucguuccgucaauaaaagccggaaacgauauugcugccugcuuacggaaaaacgggaagaaaguaauucaauuaucaagaaaaacauuugauagugaauaugucaagacuagagcuaaugacugggacuuugucguuacaacggauauaucagaaaugggagcaaauuuuaaagcagaacggguuauagauccacgacguuguaugaagccagugauucuuaccgauggagaagaaagaguuauacucgcggggccaaugccuguuacacacucaagcgccgcucaaaggaggggucgaauuggacgaaaccccaaaaaugaaaacgaucaauauauuuacaugggggaaccacuggaaaacgacgaggacugugcacacuggaaagaagcuaaaauguuguuagacaauauuaauacaccugaaggaauuauuccgagcauguuugaaccggagcgggaaaaaguagaugcaauagacggcgaauacaggcuacguggagaagcaagaaaaacuuuuguggaccucaugaggagaggugaucuccccguuugguuggcauauaaaguagcugcugaagggauuaauuacgcugaucgccgaugguguuuugacgguauuaaaaauaaucagauauuagaggaaaacguggagguagagauauggaccaaagaaggugaaaggaaaaagcuaaaaccuagaugguuagaugcaaggaucuauucugauccauuggccuuaaaagaauuuaaagaauuugcugccggcagaaaaucauuaacguugaaucuuaucacagaaaugggucgacuccccacuuuuaugacucaaaaagcacgcaaugcccucgauaaccuugcuguauuacacacggcagaagccggugguaaagcauacaaccaugcauuaagcgaacucccagaaacacucgagacucuacuuuuacucacuuuacucgcaacgguuacaggaggaaucuucuuauuucucaugagcgguaaaggaauagguaagaugacauuagguauguguuguauuauaacugcuuccauccuuuuaugguacgcacaaauucagccacacuggauugcugcguccaucauccuugaauuuuuccuaauagucuuauuaauaccagagccggaaaaacagcgaacaccccaggauaaucagcuaaccuaugucguaauagccauauuaacgguaguagcugcuaccauggcuaacgaaaugggauucuuagagaagacuaagaaagauuuaggauugggaaguauaacaacccaagaaucagaaagcaauauacuugauauagaucugcggccagcgucggccuggacccuauaugcaguagccacaaccuuugucaccccaauguugcgacacucgauagaaaauucgaguguaaaugugucgcugacggcgauagcuaaucaagcaacuguucucaugggucuagguaaaggguggccgcuaagcaagauggauauaggugugccacucuuagcuauaggauguuauagccaagugaacccgauuacuuuaacagcugcacuacuauugcuaguugcacacuaugcaauaauagguccaggauuacaagcuaaagcuacucgcgaggcccaaaagcgagcagcggcagguauuaugaagaauccuacgguggacggcauaacaguaauagauuuagagccuauacccuacgaccccaaauuugagaaacaauugggacaaguuauguuacucauucucugcgugacacaaguucuaacaaugagaacuaccugggcgcuaugugaagccuuaacuuuagcaacggguccaaucucuacguuaugggaaggaaacccgggaagauucuggaauacaacaauagcgguuuccauggcuaauauuuuuagggguucuuaccuagcaggggcaggguuauuauuuagcauuaugaaaaacacaacaaacacacggagaggcacaggcaauauuggugaaacccuaggcgaaaaauggaaaagcagacuuaacgcacuagguaagagugaauuucaaauuuacaaaaagucuggcauucaagagguagacagaacauuagcaaaagaaggcauuaaaagaggggaaacggaccaucacgcaguuaguaggggcucggcaaaauuacggugguucgucgaacgaaacaugguuacaccagaaggaaaagugguagauuugggaugcggccgaggcggguggucauauuacugcggugggcucaaaaauguccgcgaaguaaaaggauuaacgaaaggaggacccggacaugaggaacccauaccgaugucgacauacgguuggaaucugguacgucuucaaucuggcguugacguauucuuuacuccacccgaaaaaugcgauacgcucuuaugugauauuggugaaucgucuccaaacccuacaauagaggccggacgcaccuuaaggguacucaauuuaguagaaaauuggcuaaacaauaauacucaauuuuguauuaaggugcucaauccguauaugccuucagugauagagaaaauggaaacuuuacaacgaaaauacggaggugcucuaguucgcaauccuuuauccagaaacaguacacacgaaauguauugggucuccaacgcuacaggcaauauaguuaguucgguaaacaugauaucuagaauguuaauaaauagauuuaccaugaaacauaagaaagcuacauacgagccggauguggaucucggaucagguacuaggaacaucgguaucgaaagcgaaaucccaaacuuagacauaauuggaaaacgaauagagaaaaucaagcaagagcaugaaacgucauggcauuacgaucaagaucaucccuacaagaccugggcauaucaugguaguuacgaaacaaaacagaccgguagugcuuccagcauggucaacggcguaguaagacuuuugaccaaacccugggaugugguaccgauggugacgcaaauggccaugacagacacaacaccguucgggcaacagagaguguuuaaagaaaaaguagauacucgaacccaagagccaaaagaaggaacuaagaaauugaugaagauaaccgccgaaugguuauggaaagagcucggcaagaagaaaacuccuaggauguguacgagggaggaauuuacccgaaaagugcgcucuaaugcugcgcucggagcaauauuuacugacgagaauaaauggaaaagugcacgcgaggccguugaagauggaagauuuugggagcuaguagauagagaacgaaauuuacacuuagagggaaaaugugaaacauguguuuauaauaugaugggcaaacgggagaagaaauugggcgaguucgguaaagcgaaggggaguagagcuaucugguauauguggcucggggcaagauuccuagaauuugaggcgcuggguuucuuaaacgaggaccauugguuuucucgaggaaauucccuuucaggcguugaaggagaaggauuacaucgacuuggauacauucugagggauguaaguaagaaagaagguggagcgauguaugcagaugacacagcagggugggauacgaggauaaccuuagaagaccuaaagaacgaagaaauggugaccaaucauaugaaaggugagcauaagaaacuggcagaagcgauauuuaaguuaacuuaucaaaauaaagugguuaggguccaaagaccaacuccgcgaggaacagugauggacauaauuucgagacgagaucaaagaggaucaggucagguaggaacguacggucuaaacacguuuacuaauauggaagcucaacuaauucgccaaauggagggagaaggaauauuuaaaucaauacaacauuuaacaguuaccgaggaaaucgcaguacaaaauuggcuggcacgcguggggcgggagcgucuuucaaggauggcuaucucuggagaugauugcgugguuaaacccauagaugauagauuugcuucugcccuaaccgcauugaacgauaugggaaaaguacguaaagacauccaacaaugggaaccuuccagaggauggaaugacuggacucagguaccuuuuuguucccaucacuuucacgaacugguuaugaaggacgggagaguauuaguugucccaugccgaaaucaggacgagcuaauagggcgagcaagaauaucacagggagccggauggucauugaaagagacagcuugccuaggcaaaucauacgcucaaauguggacauuaauguauuuccaucgacgcgauuuacgauuagcugcaaacgcgauauguucugcuguaccaucgcacuggguuccgaccaguagaacgacuuggucaauacaugcaaaacaugaauggaugacaaccgaggacaugcuagcgguguggaauaggguauggauucaagaaaacccauggauggaggauaaaacaccuguggagagcugggaagagguuccguauuugggaaagcgugaagaccaaugguguggaucacucauugguuugacuucaagagccacuugggccaaaaauauacaaacagcaauaaaucaggucaggagucuuauuggaaaugaagaauacacggacuacaugccaucaaugaaacguuuucgcagggaagaagaggaagccgguguguuaugguaa

SEQ ID NO: 22628 - RNA, 9876 nt, Artificial Sequence
  derived and/or modified CDS sequence (opt6) from DENV-2__EU482736__SS-prME
acggcugggguaauuauuauguuaauacccacagcaauggcuuuucacuuaacaacuagaaauggggaaccucauaugauaguggggagacaagaaaaaggaaaaaguuuacucuucaaaacggaagaugggguaaauauguguacacuuauggcuauugacuugggagaauuaugugaagacacgauaacuuacaaauguccauuacucaggcaaaaugaaccagaagauauagacugcugguguaauucgacaaguacuugggucacauaugggacauguacaacuacuggagaacacagacgcgagaaaagauccguugcgcuuguaccucacguggguaugggauuagaaacaagaaccgaaacuuggaugucguccgaaggagcauggaaacauguccaaaggauagaaacguggauacuuaggcacccuggcuuuacgauuauggcagcaauauuagcauacacuauuggaacaacucacuuucaaagagcacuaauauuuaucuuguuaacagccguggccccgucuaugacuaugagauguauaggaauuaguaaucgggauuucgucgaaggaguaucuggagggucuuggguagauauuguauuagaacacggaaguuguguaaccaccauggccaaaaauaaaccuacguuagauuuugaacuaauuaaaacggaagccaaacaaccggcuacacugagaaaauacuguauagaagcuaaacugaccaauacaacaacagaaucccgaugcccuacacaaggggaacccaguuuaaaugaagaacaagauaaacgauucguguguaaacauuccaugguagacaggggauggggaaauggcugcgguuuauuuggaaaaggaggaauaguuacgugugcgauguuuacuuguaagaaaaauauggaagggaaaguaguucuuccagaaaauuuagaauacacaauuguaauaacuccacacuccggagaagaacacgcaguuggcaacgacaccgguaaacaugggaaagagauaaaaaucacaccccaaaguuccauaaccgaagcagaacucacgggauauggcacuguaacuauggaaugcagcccgagaacaggucuagauuuuaacgaaaugguacuauugcaaauggaagauaaagccugguugguacauagacaaugguucuuagauuuaccgcuuccauggcuaccgggagcagauacucaggguaguaauuggauacaaaaagagacuuuaguaacauuuaagaauccucaugcuaagaaacaagacguaguagugcuuggaagccaagaaggcgcuaugcauacugcauuaacuggcgcaacugaaauacaaauguccagcggcaaucuccuuuucacugggcaucuaaagugucgcuugcgcauggacaaauugcaauugaaaggcaugucauacaguauguguacagguaaauucaaaaucgugaaagaaauagcagagacgcaacauggaacuauagugauacgaguccaguacgaaggagauggaagcccauguaaaauucccuucgagauuauggauuuagagaaacgacaugucuuaggaaggcuaauaaccguaaauccuaucguagccgaaaaagacucgccagugaacauagaggccgaaccacccuucggugauucguauaucaucauagguguugagccgggacaguugaaacuaaacugguuuaaaaagggaucauccauuggucaaauguuugaaacaacaaugcggggagcgaaacguauggccauucuaggggauacugcgugggacuuuggaucccucggaggaguuuuuacuucaaucggcaaagcacuacaucaaguguucggagcuauuuacggagcagccuucucaggcguaucuuggacaaugaaaauacuaauaggcguaauuauaacauggauaggcaugaacucucggagcacaucuuuaucggucucgcuagucuuagucgggguuguaacccuuuauuuaggugcuaugguucaggcugacagcggcuguguggugucauggaaauccaaggaauuaaaauguggaaguggaaucuucaucacggacaacguccauacguggacugaacaauacaaauuccagccagagucgcccucaaaauuagcguccgcgauacaaaaagcacaugaagaaggaauaugcggaaucagauccguaaccagauuagaaaauuuaauguggaaacagauuacgccugaauugaaucacauucuaucagagaacgagguuaaauuaacaaucaugacuggcgacauuaaaggaauaaugcaagcagguaaacggagccuacgcccacagccaacagaacuuaaauauucuuggaaaacauggggaaaagcuaagaugcuaucuaccgaaucucacaaucaaacuuucuuaauagauggaccugaaacagccgaauguccaaacacuaaccgcgcguggaacucacuagagguugaggacuauggauuuggcguguuuacgaccaacauuuggcugaaacugagggagaaacaagauguauucugcgacuccaaauugaugucagcugcgauaaaagauaaccgagcuguucaugcugacaugggcuacuggauagagucagcucugaacgauacauggaaaauggaaaaagccucauuuauugagguaaaaucaugucacuggccuaagagccauacacucuggucaaauggcguguuagaaucagagaugaucauuccuaaaaauuuugcaggaccagugucacaacauaacuacagaccaggcuaucacacacaaacggcgggcccuuggcaucuuggaaaauuagaaauggacuucgacuuuugugaaggaacuacuguaguagucacagaagacuguggaaacagaggacccagucuuagaacuacgacugcaagcgggaaauuaauuacagaauggugcugucguucguguaccuuaccaccauuacgauacagaggcgaggaugguugcugguacggaauggagauaaggccacuuaaagaaaaagaagaaaaucuaguaaauagucugguaacagcgggucacgggcaaauagauaauuuuucguuagguguacugggaauggcuuuauuuuuagaagaaaugcuaagaaccagaguuggcaccaaacacgcaauguuauuaguuguaguaucuuucguaacccuaauaacagguaauaugaguuucagggaucuaggaagaguuaugguaaugguaggugcaacuaugacugaugacauagguauggggauuaccuaucuggcccuucuugcggcauucaagguaaggccaacguuugcugcgggacucuuauuaagaaaacuaacgucgaaagaguuaaugauggcuaccauugguauagcccucuuaucacagucaacgauacccgagaccauacucgagcucacugacgcuuuggcgcugucaaugaugguauuaaaaauuguacggaacauggaaaaauaccaacuugccgugacgaucauggccauuagcugugugccgaacgcaguaauccugcaaaacgcauggaagguuaguuguacgauuuuggcagcagugucagucucgccacucuuacuaacgucuagucaacaaaaggcagauuggauaccgcuagcucuaacuauaaaaggucucaacccgacggcaauauuccugaccacuuuaucccguacaagcaagaaacgaucuuggccauugaacgaagcgauaauggcaguuggcaugguuuccauuuuagcuaguucauuguuaaagaaugacauacccaugaccggcccccucguagcugggggucuauuaacagucuguuacguucuuacaggccgauccgccgaucuagaauuagaacgugcagcagauguuaaaugggaagaucaagcugaaauaagugguucuagucccauucucaguaucacaauaucggaagauggaaguaugaguaucaaaaaugaggaggaagaacagacgcuaacgauacuuaucagaacuggacuguuaguuauuagugguguuuuuccagucaguaucccuaucaccgcagcggcuugguacuuaugggaaguuaagaaacaaagggcgggaguuuuaugggauguaccauccccacccccagucgggaaagcggaauuagaggauggugcuuaccgcaucaaacagcgaggaauauuaggguacucacaaauaggugcaggcguauauaaggaaggaacauuucauacaauguggcauguuaccaggggugcaguucuuaugcacagaggaaaacguaucgaaccaagcugggccgauguuaaaaaggauuuaauuagcuacggcggcggguggaagcuagagggggaguggaaagaaggagaagaaguccagguccuggcacuagaaccgggcaaaaacccgagagcaguccaaacaaaaccaggacuauucaagacuaauacaggaacaauaggagcaguaagucuagauuuuucuccagggacgagcgggagcccuaucguugaucguaaagggaaaguagucgguuuauaugguaacggaguaguuacucgaaguggagcauacguguccgcaauagcucaaacagagaaaaguauagaggacaacccugaaauagaagacgacaucuuuagaaagaaaaggcuaacaaucauggaccuacauccgggagcggggaaaacuaaaagauaucuaccagcaaucguacgagaggcaauaaaaagagggcuaagaacauuaaucuuggcaccuacccgaguaguagccgcugaaauggaagaagcguuaaggggauuaccaauccgcuaccaaacaccagcaauucgagcagaacauaccggucgugagauuguagaucuuaugugucaugcuacauucaccaugagacuacuuagcccgguaagaguuccaaauuacaaucuuaucaucauggaugaagcacauuuuacagauccagcgucaauugcagcaagaggguauauaucaaccagaguagaaaugggagaagcagcagguauauucaugacggcaacaccuccuggaaguagagaucccuuuccacaaucuaaugcaccuauaauggaugaagaaagagaaauacccgaacguucauggaacucaggucaugaaugggugaccgacuuuaaaggaaaaacaguaugguucgucccaucaaucaaagcgggaaaugauauagcggcuugccuccggaaaaacggcaagaaaguaauucaauugucccgaaaaacauuugauagugaauauguaaaaacacgugcaaaugauugggauuuuguaguaacaacagauauaucggaaaugggugcgaauuuuaaggccgaaagagugaucgauccucgaagaugcaugaagccgguaauacuaacugacggugaggagcgaguaauauuggcaggaccaaugccaguaacacauucuagugccgcacaaagacgaggacguauugggagaaauccuaaaaacgaaaacgaccaauacauauauaugggggagccacuagaaaaugaugaagauugcgcacacuggaaggaagcuaaaauguuacuagauaauauaaacacgcccgagggcauaauaccaaguauguuugagccagaaagggaaaaaguugaugccauagacggagaauauagguuacgaggagaagcgagaaaaacguucguagaucugaugcguagaggagaucucccaguauggcuugcuuacagggucgcagcggaagggauuaacuacgccgaccggcguugguguuucgaugguauuaaaaacaaucaaaucuuggaagagaauguagaaguagaaauuuggaccaaagaaggugaaagaaagaaacucaaaccacgauggcuugaugcccgcauauacagugauccauuagcguuaaaggaauuuaaggaguuugcugcagggaggaaaaguuugacacuaaaccuaauuacagagaugggccgacuaccuacauuuaugacacaaaaagccagagaugcacuagauaauuuagcuguuuuacacacagcugaggcuggugguagagcuuauaaccaugcuuuaucugaguuaccugagacucuugagacacuauugcugcucacuuuacuugcuacaguaacgggcgggauuuuucucuuccucauguccgguaaaggcauagguaaaaugacgcuaggaauguguugcauaauaacagcgaguauauuauugugguaugcacaaauacaaccgcacuggauagcugccucgaucauuuuggaguucuuuuuaauaguucuauuaauuccggaaccagaaaagcaacguacaccucaagacaaucagcugacuuauguagugauugccauauuaacuguuguggcagcaacaauggccaaugaaauggguuuccuagagaagacgaagaaagaucuaggguuggggaguauagcuacacaagaauccgaaucaaacauucuagacauugacuuaagaccggcaucagccuggacuuuauaugcggucgcuacuaccuucguaacaccaauguugaggcauaguauagaaaauucaaguguaaacguaucccuuacggcaauagcgaaucaagcgacuguuuuaauggguuuagguaaaggcuggccccugucuaagauggauaucgggguuccccuauuagcuauuggauguuacucucaagugaauccuauuacucugacagcugcuuuguuacuccugguagcucacuacgcuauaauaggaccuggguuacaagcgaaagcuacgagggaagcucagaaaagagccgccgcugggauuaugaagaauccaacuguugacggcauuacuguuauagaucuggaaccuauaccuuaugauccaaaauuugaaaaacaauuaggacagguuaugcuauuaauacuuugugucacucaaguuuuaaugaugcguacaacaugggcccuaugugaagcucuaacucuugcuacugguccaauaaguacacugugggaagggaauccaggaagguucuggaauacaacgaucgccgugaguauggcaaacauuuuucggggaucauauuuggcaggcgcggguuuacuauuuucgauuaugaagaacacaacaaauacucguagagguacuggaaauauuggugagacacuaggcgaaaaguggaagucacgacugaacgcgcucggaaaguccgaguuccaaauauauaagaaaucagguauucaggaagucgacagaacacuagcaaaggaagggauaaaaagaggggaaacagaucaccacgccgucucgaggggaucagcaaaacuaaggugguucguggaacgaaauauggucacgccggaggggaaaguuguugaucuagguugcgguagaggaggcuggucauacuacugcggcggacuaaagaauguacgagaagucaaaggguuaacaaaagguggaccagggcaugaagaaccaauaccgauguccacguacggauggaacuuaguuagacuacagagcggaguugauguguucuuuacaccaccugagaaaugcgacacccuuuuaugugauauaggagaaagcaguccuaauccuacaauagaagcgggcagaaccuugagaguauuaaaucuaguagagaauuggcugaacaauaauacacaauuuugcauuaaaguccuaaaucccuauaugccgaguguuauugagaaaauggaaacccuacagaggaaguauggaggcgcguuaguuagaaauccacuaaguagaaauucuacacacgaaauguauuggguaaguaacgcuacuggaaauauagugagcucaguuaauaugauuagucgaaugcugauuaacagauucacaaugaaacacaagaaagcuaccuaugaacccgauguagauuuaggauccgggacaagaaacauagggauagagucagaaaucccgaaucuagauauuaucgggaaaagaaucgagaaaauaaaacaagagcacgaaaccaguuggcauuacgaucaggaucauccauacaagacuugggcuuaccaugguuccuaugaaacaaagcaaacaggaucagccucgaguauggucaacggagucguacgucugcucacuaaaccaugggaugucguaccaaugguaacccaaauggcuaugacagauacaacaccauuuggacaacagaggguuuucaaagagaaagucgacacaagaacgcaggagccuaaagagggaaccaagaaacuaaugaaaaucacagcugaaugguuauggaaggaacucggcaagaagaaaacuccaaggaugugcacucgugaagaguucacccgaaaagugagaucgaaugcagcucuaggcgcaauuuuuacagaugaaaacaaauggaaaucggcaagggaggccguagaagauagucgauucugggaauuaauugaucgcgaaaggaaccuucauuuggaaggaaaaugcgaaacaugugucuauaauaugaugggcaaaagagagaagaaacucggagaguucgguaaagcuaagggcuccagagccauuugguauaugugguuaggugcucgcuuucuagaguucgaagcucuagguuucuuaaaugaggaccacugguuuucacgagguaacucucugucaggcguugaaggagaggguuugcaccggcuaggcuauauacugagagaugucucuaagaaagagggaggagcaauguaugcagaugacacggcuggcugggauacaagaaucacuuuagaagaccugaaaaacgaggaaaugguaacuaaccauaugaaaggugagcauaagaaacuugcagaagccauauucaagcuaacauaucaaaacaaaguaguaaggguacaacgaccuacuccacgaggaacgguaauggauauaauaucaagacgcgaccaacgaggcuccgggcaaguggguacauauggucuaaauacuuuuaccaauauggaagcacaauugauuagacaaauggaaggagaaggaauauuuaaaaguauccaacauuuaacggugacagaagagauugcggugcaaaacuggcuggcacgaguugggagagaaagauugagucguauggcaauuaguggagaugacuguguuguaaaaccacucgacgauagauuugcaagcgcccuaacggcuuuaaacgauaugggaaagguaagaaaggacauacaacaaugggaaccuaguaggggcuggaacgauuggacacagguccccuucuguagucaccauuuucacgaacucguaaugaaagauggaagaguuuuagucguacccugcagaaaccaagaugaacugauuggaagggcucgaauaucgcaaggcgcuggguggucguuaaaagaaacagccugcuuagguaaaagcuacgcacaaauguggacacuaauguacuuucaucgaagagauuuaagguuagcugccaaugcgauuugcagcgcagucccuagccacuggguuccaacaucgaggaccaccuggaguauccaugcgaaacaugaauggaugacuacagaagacauguuagccgucuggaaucgaguguggauccaggaaaacccauggauggaagacaaaacuccugucgagucuugggaagaagucccguaucuaggaaaaagagaggaccaguggugcgguucguugauuggacuuacuucgagggccacaugggcuaaaaacauacagacagccauaaaucaaguaagaucacuuaucggcaacgaagaguauacagauuauaugcccucaaugaagagauuuaggagagaagaagaagaggcagggguacuuugguga

SEQ ID NO: 22629 - RNA, 9876 nt, Artificial Sequence
  derived and/or modified CDS sequence (opt6) from DENV-2__EU482737__SS-prME
acugcugggguaauaguaauguuaaucccaacagcuauggcuuuucaucuaacaacgagaaauggagaaccucauaugaucguugguagacaagaaaaagguaaaucucugcuguuuaaaacagaagacggaguuaauauguguacauuaauggcaauagacuuaggagaacuuugcgaagauacuauaacauauaaaugcccgcucuugagacaaaacgaaccugaagacauagauugcuggugcaauucaacaucuacauggguuacuuacggaacauguaccacaaccggcgaacauagaagagagaaaagaucgguagcauuagucccacacgucgguaugggacuagaaacgcgaacugaaacauggaugucuagugaaggugcauggaaacauguucaacgaauagaaacuuggauuuugagacacccgggauuuaccauuauggcggcuauauuagcauauacuauaggaacuacacauuuucaacgagcauuaauauuuauauuauuaacggcaguagcaccaaguaugacgaugagguguaucgggauaucaaaccgugauuuugucgaaggaguuagcggaggcucauggguugacauaguguuggagcacggguccuguguuacuacaauggccaaaaauaaaccaacucucgauuuugaauuaauaaaaacagaggcaaaacagccggcaacucuuaggaaauauuguauugaagcaaaacugaccaauaccacgacagaaucucgaugcccgacacaaggagaaccaagucugaaugaggaacaagacaaacgauucguaugcaaacauagcaugguagaccgcgguugggguaacgggugcggucuuuucgggaaaggcggaauaguuacuugugcuauguuuacuuguaagaaaaacauggaagguaaagugguguuaccagaaaaucuagaauauacaauaguaauaaccccacacagcggggaggagcaugcuguagguaaugacaccgguaaacauggaaaagaaauuaaaauaacuccacaaagcucaauaacagaggcagaguugacugguuacgguacagugacaauggaauguaguccucgaaccggauuagacuuuaaugaaaugguuuuacuucagauggaagauaaggcgugguuaguucauagacaaugguuucuugauuugccccuuccuuggcugcccggagcugauacgcagggaaguaauuggauccaaaaagaaacuuuaguaacauucaagaauccucacgcuaaaaagcaagacguaguuguucuagggagccaggaaggggcaaugcacacagcucuaacuggagcaacugagauacaaaugagcagugguaauuuguuauucacaggucacuugaaaugccgauuacguauggauaaacuacagcuaaagggaaugucuuacaguauguguacgggaaaguuuaaaauaguaaaagaaauagcagaaacacaacaugguacaaucguaauacgcguucaauacgaaggugauggcucuccauguaaaauaccauucgaaauaauggaccuggagaaacgacacguccuaggaaggcuaauuaccguaaauccaauuguagcugagaaggacagcccuguaaacauagaagcggaaccuccauuuggagauucuuauauuaucauagguguggagccgggucagcuuaaacuaaauugguucaagaaagguaguucaauuggacagauguucgaaacgacaaugagaggagcaaagagaauggcaauucuaggggacacagcaugggauuucggaagccucggcggaguuuuuacuucaauaggcaaagcacuucaucaagucuucggagcgauauacggugcggccuucucaggaguuaguuggaccaugaaaauucuaauugguguuauaaucacauggauugggaugaauaguagaagcacuucucuaucgguuagccuaguccuaguaggagucguaacauuauauuuaggugcaaugguccaggcugauagcgguugcguuguuuccuggaaaucgaaggaacucaagugugguagugggauauuuaucacugacaauguacauacuuggacggaacaguauaaauuucaaccggaaagcccgagcaaauuagcuagcgcgauccaaaaagcgcacgaagaaggaauaugugguauuagaucaguaaccagauuggagaacuugauguggaaacaaaucacuccagaauuaaaucauauacucucugaaaacgaaguaaaguuaacuauaaugacaggagauaucaaaggcauaaugcaagcaggaaaaagaucgcuacgaccacaaccaacugagcugaaauauaguuggaaaaccuggggcaaagcgaagauguuaucaacagaaucccacaaccaaacuuuucuaauugaugguccagaaacagcggagugucccaacaccaauagggcuuggaacucuuuggagguugaagauuacggcuucgggguauucacaacaaacauauggcuaaaauuacgugaaaaacaagauguuuucugcgauucuaaauugaugagcgcugcaaucaaagacaacagagcaguucaugcagauaugggcuacuggauagaauccgcauuaaaugauaccuggaagauggaaaaggcuucuuucaucgaaguuaagaguugucauuggccuaagucgcacacucugugguccaauggggucuuggagucggaaaugauaaucccaaagaauuucgcagguccagugucccaacacaauuaucgaccaggauaccauacgcaaacggcaggcccuuggcacuugggcaaacuugaaauggauuuugacuuuugcgaagggaccacaguaguagugacugaggacugcgguaaucgcgguccuagucuacgcaccaccaccgcaagcgggaaacugauuaccgaaugguguuguagauccugcacccucccuccuuuaagauaucgaggagaagauggauguugguacggaauggaaauccguccacugaaggagaaagaagagaaucugguuaauucauuagugaccgcugggcauggacagauagacaacuucucgcuaggaguauuggguauggcguuauucuuagaagaaauguuaagaacucgaguaggaacuaaacacgcgaugcuguuaguaguuguuagcuuugugacccuaaucacaggaaacaugaguuuccgagaucuuggccggguaauggucaugguaggggcuacgaugacagacgacauuggaaugggcauaacauauuuagcacuucuagcagcauuuaaaguuagaccuacuuucgcagcaggccuauuauugagaaaacuaacaaguaaagaauuaaugauggccacaaucgggauagcauuauugucgcaaagcacgauaccugaaacaauacucgaacucacggacgcauuagcguuaaguaugaugguucuaaaaauaguaaggaauauggagaaauaucaguuagcuguaacgauuauggcaauaucaugcguaccaaaugcuguaauacuacaaaacgcauggaaggucucuuguacuauucuagcagccgucucuguuucaccgcuccuacugacauccucacagcaaaaagcagacuggauaccguuagccuuaacgauuaagggguuaaauccuacugcgauuuuucucacaacauuaagucgaaccaguaagaaacguucuuggccgcuaaaugaagcuauuauggcaguaggaaugguuucuauuuuagcaagcucuuuacucaaaaaugacaucccaaugacagguccauuaguagcgggaggacuccucacaguaugcuacgugcuuaccgguagaagcgccgacuuggaauuagaacgagcugcagaugugaaaugggaagaucaagcugaaaucaguggcuccagccccauauuaucuauaacuaucagcgaagacgggaguaugucuauuaaaaacgaagaagaagaacaaaccuuaacaauucuaauucgaacaggccuauuagucauaucaggcguuuuuccgguuaguauccccauaaccgcugcggcuugguauuugugggagguaaagaaacagagagcagggguucuuugggaugucccaagcccaccaccagucggaaaagccgaacuugaagauggugcauaccgaauuaagcaaagagggauacuuggauauucgcaaauuggugcuggaguauauaaagaagggacauuucacacaauguggcacguaacuagaggagcaguucugaugcauagaggaaaaaggaucgaaccgaguugggcagacguuaaaaaggaccuuaucucauauggaggcggguggaagcucgaaggugaauggaaagaaggggaagaagugcaagugcuagcgcuggagccagggaaaaaucccagagcugugcaaacgaagccaggacuuuuuaaaacuaacacuggcacaaucggcgcggugagcuuagauuuuucaccugguacuucugggagcccaaucguugaccgaaagggaaaagucguaggacuauacgggaacggagugguaacgagaaguggagcguauguaagugcuauagcccaaacggaaaaaucaauugaggauaaccccgaaauagaagaugacaucuuuagaaagaaacgauuaacaauaauggaucuacacccuggagcagguaagacaaaacgauaucuaccugcaaucgucagagaagcuauuaaaaggggucuaaggacauuaauucucgcaccuacgcgcguuguagcagcggaaauggaagaagcucuaagaggacucccuauucgauaucaaacgccggcuauacgagcggagcacacuggaagagagauagucgacuuaaugugucaugcaacauuuacgaugagauuauuaucuccgguacguguuccuaauuauaacuuaauaaucauggaugaagcccacuuuacagauccugcuaguauugcagcgagaggcuauauaaguacaaggguagaaaugggugaagcagcaggaauauuuaugaccgcuacgcccccgggcucacgcgauccauucccacagucuaaugcacccauaauggacgaagaaagagaaauucccgaacgcucauggaauagcggccaugaauggguaaccgauuuuaagggaaagacgguuugguuuguccccagcauuaaggcuggcaacgacaucgcugcgugccucaggaaaaaugguaagaaaguaauucaguugucaagaaagacauucgacucagaauacgugaaaacacgagcuaaugacugggauuucgugguaacuacagacauaucggaaaugggggccaacuucaaagcagaaaggguaauagauccaagaagaugcaugaaacccgucauauuaacagauggagaagaacgugucauacuugcugguccaaugcccgugacacacagcucugcagcucagagacgaggccguauaggucguaacccuaaaaaugagaaugaucaauauaucuauaugggugagccacuagaaaaugacgaagauugugcacacuggaaagaagcaaaaauguugcucgauaacauaaacacgccagagggcauaauaccuaguauguucgagccugaaagagaaaaaguugacgcgaucgauggagaauacagacuuagaggugaggcuagaaagaccuuuguugaucugaugaggagaggggaucuacccguauggcuagccuaucgaguagcagcugaggggaucaauuacgcagauaggcguugguguuucgaugguauuaagaacaaucaaauucuagaagaaaauguggagguugaaauuuggaccaaagagggagaaagaaagaaacuuaagccgagauggcuagacgcaagaaucuauucagauccauuagcauuaaaagaauuuaaggaauuugccgccggucgcaaaucccuaacguuaaauuuaauuaccgagaugggcagguuaccaacauucaugacccagaaggcaagagaugcacuugacaaucucgccguacuacacacggcggaagcugggggaagggcguacaaucacgcuuugagcgaacuaccugagacgcucgaaacucuuuuauuacuaacucucuuagcaacagucacaggcgguauauuuuuauucuuaaugucuggaaaaggaauaggaaaaaugacgcuagggauguguuguauaauuacagcaucaauucuacuuugguacgcucagauacaaccacauuggaucgcugccucgauaauacuggaguuuuucuuaauaguccuauuaauaccugaaccugaaaaacagagaacaccucaagauaaucaacugacauauguagucauagcgauccuuacggucgucgcugcuaccauggcaaaugagauggguuuucuagagaaaacgaagaaagaucuaggucuaggaagcauugccacacaagagucggaaaguaauauucuugacauagacuuaagaccagcuucugcguggacauuauaugcaguugcaaccacauuugugacccccauguuaaggcacaguauagaaaauaguaguguuaacguaagucuuacugcuauagcaaaccaagcaacuguauugaugggacucggaaaaggauggccauuaucuaaaauggauauaggaguuccauuacuagcaauaggcuguuacagucaaguaaauccgauaacguuaacagcggcgcuucuauuauuagucgcacacuaugcaauaauugguccgggauugcaagcuaaagccacucgugaagcucagaaaagagcagcggcaggaaucaugaaaaacccaaccguggauggaaucacggugauagaccuugaaccaaucccauaugauccgaaauuugaaaaacaguugggacaagugaugcuuuugauuuugugugucacacagguucuaaugaugagaacaacgugggcucuuugugaagcccuuacauuagcgacugguccaauaucgacccuaugggaagguaacccgggaagauuuuggaacacgaccauagccguuucuauggcaaacauuuucaggggaagcuaccuagcgggagccggacuuuuauuuagcaucaugaaaaauacuacaaacaccagaagggguacugggaacauuggggaaacacucggcgagaaguggaagagucgauuaaaugcucuagguaagagcgaguuccaaaucuacaagaaaucuggcauucaggaaguggaucggacucuugccaaggaaggaaucaaaagaggcgaaacugaucaucaugcugugucccgaggcagugcaaaacuaagaugguucguugaacgaaauaugguaaccccagagggcaaaguuguugaccuaggaugcgggcgcgguggguggagcuauuauuguggaggccuaaagaaugugagagaaguaaaagggcuuaccaaagguggcccaggccacgaagaaccuauaccaaugucaacauauggauggaauuuagucagauugcagaguggaguagauguauucuuuacgccaccugaaaaaugcgauacucuucuuugugacaucggagaauccagcccaaacccuacuaucgaggcagguagaacacuacgcgugcuaaauuuaguggaaaauuggcucaacaauaacacccaauuuugcauuaaaguauuaaaccccuauaugccuucaguuauagagaaaauggagacacuacaaaggaaauacgguggcgcacucguacgcaaucccuuaagucguaacucaacacaugaaauguauuggguuucaaacgcuacaggaaauauuguauccaguguuaauaugauuucucgcaugcuaauaaauagauuuacuaugaagcauaagaaagcaacuuacgaaccagauguggaccucgggagugguacucgcaacaucggaauagagucugagaucccaaaccuugacauaauagguaaaaggauagagaaaauaaaacaagaacaugaaaccaguuggcacuacgaccaagaccacccuuauaaaaccugggcauaccauggcucauacgaaacaaaacaaaccgggagcgcuaguucaauggugaaugguguggucaggcugcuuacgaagccuugggauguagucccaaugguaacacaaauggccaugacugauacaacgccguuuggucaacaacgaguguuuaaagagaagguugacacacgaacacaagaaccuaaggaggguacgaagaaacuaaugaaaauuaccgcugaguggcuauggaaagaacuaggcaagaagaaaacaccucgaauguguacuagggaggaguucacaagaaaaguuagaucuaacgcugcuuuaggcgcuauuuuuaccgaugaaaacaaauggaaaucagcucgugaagcaguagaagacucaagauuuugggaacuuauagauagggaaagaaauuuacaucuggaagggaaaugcgaaacguguguauauaauaugauggguaaaagggagaagaaacugggagaauuuggaaaagcgaaagguaguagagcuaucugguacauguggcuuggggcaagauuuuuagaauuugaagcucucggcuuucuaaacgaggaucacugguuuaguagaggaaauucgcuuucaggaguagaaggggaaggacuacauagacuggguuacauacuacgagauguaaguaagaaagaggguggcgccauguacgcagacgacacagcugggugggauacaagaauaaccuuagaggaucuuaagaaugaagaaaugguuacaaaccauaugaagggagaacauaagaaguuggcugaagcgauauuuaaauuaacguaccaaaacaaaguggucagaguacaaagaccgaccccaagaggaacagucauggacauuauaagucgucgugaccagagaggauccggacaaguugguacauauggacuaaauacuuuuaccaacauggaagcacaguuaauaagacaaauggaaggugaaggcauauuuaaaucaauccaacaccugacuguuacugaagaaauugcaguucaaaacugguuagcucggguuggacgcgagcgacuaucaagaauggcgaucaguggagaugauugcguuguaaaaccuuuagaugauagguucgcuagcgcacuaacagcccugaacgauaugggaaaaguucggaaagacauucaacaaugggagcccucgcguggauggaaugacuggacccaagucccauucugcagccaccauuuucaugagcuaguaaugaaagacgguagagugcuaguggugccuugcagaaaucaagacgaguuaauuggacgggcccguauaucccagggugcuggguggagucugaaagaaacugccugccuaggcaaaaguuacgcacaaauguggacucuaauguauuuucacaggagagacuuacggcuugccgcuaaugcuauaugcuccgcgguuccaucgcauugggugccaaccucgagaacaacuugguccauucacgcgaaacaugaauggaugacgacggaagacaugcuagcaguauggaacagaguuuggauacaggaaaauccguggauggaggauaagaccccgguagaguccugggaagaagucccauaccucgguaagagagaagaccagugguguggguccuuaauaggacucaccuccagggcaaccugggccaaaaacauccaaacugcuauaaaccaaguaaggucacuaauaggaaacgaagaauauacagauuauaugccaaguaugaaacgguuuagaagggaagaagaggaagcaggaguacuaugguaa

SEQ ID NO: 22630 - RNA, 9876 nt, Artificial Sequence
  derived and/or modified CDS sequence (opt6) from DENV-2__EU482739__SS-prME
acugcuggugucaucauaauguuaauccccacagcaauggcauuccauuuaacaacgaggaauggagaaccacacaugaucguaggaagacaagaaaaaggaaaaagccuuuuguucaaaacagaagauggagugaacaugugcacauuaauggcuaucgacuuaggagaacugugugaagauacaauaaccuauaaauguccacuacugcgccaaaaugaacccgaagacauugauuguugguguaauaguacuuccacuugggugacuuaugguacuuguacuacgacaggugaacacagaagggaaaaacggaguguagcucuaguuccucauguagguauggggcuggaaacaagaacugaaaccuggaugagcagcgaaggugcuuggaaacauguacaaagaauugaaacguggauacuucgucauccaggauuuacuauuauggcagcaauauuggcguauaccauagguacuacgcacuuucagagagcuuuaaucuucauccuacucacugcaguagcgccaucaaugacuaugagguguauaggaauuucaaacagagauuucguugaagggguaucaggggguucauggguagacauaguauuagagcacgguaguugcguaacuaccauggcgaaaaauaaaccgacguuagauuucgagcuaauaaaaacagaagcaaaacaaccugcaacucuacguaaauacuguauagaggcaaaacuuacuaauacaacuaccgaaaguagauguccaacacagggagaaccaucacuuaaugaagaacaagacaaaagauucauuugcaaacacucgaugguggacaggggaugggguaauggguguggacuuuuuggcaaaggaggaauaguuaccugcgcaauguuuacauguaagaaaaauauggaaggaaagguugugcuaccagaaaauuuagaauauacaaucguaauaacaccacacucgggagaggaacaugcaguugguaacgacacaggaaaacacggaaaggaaaucaagauaacgccacagaguagcauaacugaagcagaauuaacaggauaugguaccgugacaauggaguguagcccgcgaacaggacuagacuuuaaugaaauggugcucuuacaaauggaggacaaagcaugguuggugcacagacaaugguuccuugaucuaccuuugccaugguuaccuggugcggauacacaaggaucaaauuggauacaaaaagaaacauuagugacauuuaaaaauccucacgccaagaaacaagauguuguaguguuagguagucaagaaggugcaaugcauacugcguuaacaggagcaacugaaauacaaaugagcagcgggaaccuucuauuuacaggacauuuaaaauguagacugagaauggacaaauuacagcuuaaagguaugaguuauaguaugugcacagguaaauucaagauaguaaaggaaauugcagagacucaacaugguacgauuguaauaagaguacaguacgaaggagaugguagcccuugcaaaauuccauuugagauaauggaccuggagaaacgucaugucuuagguagguuaauuacaguaaacccaauugugaccgaaaaagacucacccgucaacauagaggcagaaccuccuuuuggagacucauacauaauaauuggcgucgaaccagggcaacuuaaacugaauugguucaagaaagguuccuccaucggccagauguuugaaacgacuaugagaggggcgaaaagaauggcaaucuuaggggauacagcaugggacuuugggagucugggugggguauucacuucuauaggaaaggcuuuacaccaaguauuuggugcuauauauggcgcugcguucagcgguguuagcuggacgaugaaaauacuaauugguguuauuauaacuuggauagggaugaacucuaggucuaccucgcugucagugagucuaguguuaguugggguaguuacguuauaucuaggaguaaugguacaggccgauucuggguguguagugaguuggaaaaauaaggagcuaaagugugguucaggaauuuuuauaacagacaacguucauacauggacagagcaauauaaauuucagccagaaucgccaucuaaguuagcgucagcaauacaaaaagcacacgaagaagggauuugcgguauucgcucgguaaccagauuagagaacuuaauguggaaacaaaucacaccugaguuaaaccacauacugagcgaaaacgaaguaaaacuuacuauuaugacaggugacaucaaagguauaaugcaggccggaaaaagguccuuaagaccucaaccaaccgaacuaaaauauaguuggaagacuugggguaaggcuaaaauguuaucuacugaaagucacaaccaaacauuccuaauagaugguccagagacugcagaauguccuaauacgaaucgagcauggaauaguuuagagguagaggauuauggguuugguguauuuucgacuaacaucuggcuaaaguuacgagaaaaacaagacguauuuugugacagcaaauuaaugagugccgcaauaaaagauaaucgggcaguacacgcugauaugggcuauuggauagaauccgcauuaaacgauacuuggaaaauggaaaaggcuuccuucauagagguuaaaucaugccacuggccuaaaagucacacccuauggucaaaugggguccucgaaucagaaaugauuauacccaaaaauuuugcgggaccaguuucgcaacacaauuauagaccuggauaccauacacaaacggcaggaccuuggcauuugggaaaacuugaaauggacuuugauuuuugcgaaggaaccacgguaguuguuacugaagauugugguaacagaggaccgucucuaaggacaacaacugccagcgguaaauuaauuacugaaugguguugucguucauguacccuuccgccuuuaagguaucgaggugaagaugguuguugguacgggauggaaauacguccccugaaggaaaaagaggaaaauuugguaaauucauugguaaccgcuggacacggacaaauugacaauuuuagucuaggaguacucgggauggcgcuauuuuuagaggagaugcuaagaaccagaguggguacaaagcacgcuauccuucuuguagccguaucuuucguaacacucauaacuggcaauauguccuuuagagaccuugguagagugauggucaugguaggugcgacaaugacggaugauauugguaugggagucacauauuuagcucuacucgcugcauuuaagguaagaccgacuuucgcagcagggcuacucuuaagaaaacuuacuucuaaagaauuaaugauggccacaaucggcaucgcgcuauuaucgcaaucaacuauacccgaaacaauucuagagcuaacugacgcgcuagcacuugggaugaugguacuaaaaaucgucagaaaucuagaaaaguaccaacuagcuguaacaauuauggcuauaucaugcgucccaaaugcuguaauauuacaaaaugcguggaaagucucauguacuauucuugcagcaguuucuguaucgccguuauuacuuacaaguucacagcaaaaagcggacuggauaccacuggcguuaacuauuaaaggguuaaacccaacagcuauuuuucucacgacuuuaucaagaacgucuaagaaacgaucuuggccauugaacgaagcagucauggcaguagguauggucucaauuuuggcuuccagcuugcuuaagaaugauauaccuaugacaggaccccuaguugcaggcggucuacuaaccguaugcuauguccuaacuggaaggucagcugauuuagaacucgagagagcugcggauguaaaaugggaggaucaagccgagaucucagggucaaguccaauuuugaguauaacgauaucggaagacggaucaaugagcaucaaaaaugaggaagaagaacaaacauugacaauauuaauaagaacuggcuuacugguuauuaguggaguuuucccggucucuauaccuauaacggcugcagcuugguacuuaugggaagugaaaaagcaacgcgcgggagugcuaugggacguacccucuccaccaccuguaggaaaagcagaacuagaagacggcgcuuacagaauaaagcagagaggcauauucgguuauucccagauuggagcaggaguauacaaagaagguacauuucacacuauguggcaugugacgaggggcgcuguacuuaugcacagaggaaaaagaauugagcccaguugggcagacgucaagaaagauuuaauaucauaugguggcggauggaaacuagaaggugaauggaaggaaggugaagagguucaagugcuagcacuagagccaggcaaaaauccuagagcuguucaaacuaaaccuggguuauucaaaacuaacacggggacaaucggagcaguaaguuuagacuucaguccaggaacaucuggaagcccaauagucgauaggaaaggaaaaguagucggccuuuacggcaauggagugguaacacgaucuggugcguaugucucggcaauagcgcagacagaaaagaguauagaggauaacccugaaauagaagaugacauuuucaggaagaaacgauuaacaauuauggauuuacaucccggugcagguaaaacaaaacgauaucuaccggcuauagucagagaagcuauaaaaagaggcuuacgcacguuaauuuuagcgccgacaaggguggucgcagcagaaauggaagaggcuuugcgaggcuuaccuauaagguaucaaacgccagcaauacgagcggagcacacaggaagagagauaguugaccuaaugugucaugcuacguuuaccaugcgauuacuuucuccaguaagagugccuaauuacaacuuaaucauaauggaugaggcccauuuuacagauccagcaaguauugcagcccguggguauauaagcacuagaguagaaaugggugaagcggcaggaaucuuuaugacugcuacucccccuggaucacgagacccauucccacagagcaaugccccaauaauggacgaggaacgagaaauaccagagagaagcuggaacaguggccacgagugggucacagacuuuaaaggaaaaacaguuugguuugucccaucuauuaaagccggaaaugacauugcagcaugucuuaggaaaaauggaaagaaaguuauacagcugucacgcaaaacauuugacagugaguauguaaaaacucgagcaaacgauugggauuucguuguaacaacggacauuagugagaugggcgcaaacuuccgggcagagagaguaauagauccuaggagguguaugaagccgguuauacuaacggacggugaagaaaggguaauuuuagcuggucccaugccugugacucauaguucugccgcacaaagacgaggucgaauagggagaaacccgaaaaacgaaaacgaccaauacauuuauaugggcgagccauuggaaaacgaugaagauugcgcacacuggaaagaagcaaaaaugcuauuggauaacauuaacaccccggaaggcaucauaccaaguauguucgagccugaaagggaaaaaguugaugcuauagacggcgaauacagguugcguggugaagcaagaaaaacauuuguagaucuuaugaggcgaggugaccuccccguuuggcuagcuuaucggguagccgcggaaggcaucaauuaugcagacagacgaugguguuuugacgguaucaagaauaaccagauacuagaggagaauguagagguggaaauuuggacuaaagaaggcgaaagaaagaaauugaaaccacgauggcuagacgcaagaaucuauagcgauccauuagcguuaaaggaauuuaaggaauuugcagcaggaaggaagucccuuacucuuaauuuaauaacggaaaugggccgacuaccaacauucaugacccaaaaagcgcgugacgcgcuggauaaucuagcggucuuacacacugcugaggucggagggagagcuuacaaccaugcccuaagugaacuacccgaaacauuagaaacguugcugcugcuaacauuauuagcuaccgugaccggugguauauuuuuauuuuuaaugucgggcaaagggaucggaaaaaugaccuuaggaauguguuguauaauaacggcgucuauacuacuuugguaugcucaaauucagccucacuggauagcagccucgaucauacuagaauuuuucuuaauaguuuugcuaauuccagaaccagaaaaacaaagaacaccacaagacaaucaacuaaccuacguagucauagccaucuuaacaguuguggcagcuacaauggcuaacgagauggguuuucuggagaaaacuaagaaagaucuagguuuaggaucaaucacuacgcaggaaucagaauccaauauccuugauauagaccucagaccagcaucugcuuggacccuauaugcaguggccacuacauucguaacccccauguuaaggcacucaaucgaaaacucuucagucaacguuucacuaacugcgauagcaaaccaagcaacuguuuuaaugggauuagggagagguuggccguuaucaaagauggacauagguguuccauugcuagcaauuggauguuauucacaagugaauccaaucacguugacugcggcucuacuacuauuaguggcacacuaugccauuauagguccgggcuuacaagcaaaggcaacaagagaagcucaaaaacgagcggcagcaggcauaaugaaaaauccaacgguagacgguauaacgguaaucgaccuagagccgauaccauaugacccuaaauuugaaaagcaauuaggacaaguaaugcuacucguacucugcguaacacaaguacuuaugaugagaacaacuugggcccuaugugaagcccugacccuugcaacuggacccauaucaacauugugggagggaaaucccggccgauuuuggaauacuacuauagccgucucaauggccaauauauuuagagggucauauuuggccggugcgggacuucuguucaguauaaugaaaaacacgacaaauacaagaagaggcacuggaaacauaggagaaacccucggagaaaaauggaaaucucgcuuaaaugcguuaggaaagucagaguuccaaaccuacaaaaagucaggcauucaggaaguagauagaacccuagcaaaagaaggaauuaagagaggugaaacagaucaucaugcaguuucacgugguagcgcaaaacuacgcugguuuguagagcguaacaugguuacuccugaaggaaaaguggucgauuuaggaugugggagaggaggguggucauacuacugcggcgguuugaaaaauguacgggaaguuaaaggucucaccaaaggaggaccuggccaugaagaaccaauaccuaugaguacuuauggauggaacuuagucagauuacaaucgggaguagacguauucuuuacaccuccugaaaaaugugacacacugcugugugauauuggggagucuucaccuaacccuacaaucgaagcagguagaacacugcguguguuaaaccucguagagaauuggcuaaacaacaacacacaauuuugcauuaaaguccucaauccguacaugccaucaguuauagaaaagauggaaacucuucaacguaaauauggaggggcucuugucagaaacccacuaaguaggaauagcacacaugaaauguauuggguaucuaaugcaacggggaauauaguaaguaguguuaauaugaucucacgcauguugauaaaucgauuuacaaugaagcacaagaaagcaacauaugaaccugacguagaccuugguucuggaacucgaaauaucgguauagagaaugaaauaccgaaccuugauaucauuggaaagagaauagagaaaauuaagcaggaacacgaaaccaguuggcacuacgaccaagaucauccuuacaaaaccugggccuaccaugguuccuacgaaacaaaacaaacgggaucagcaucaucaauggugaacggaguuguuaggcuacucacaaaaccaugggacguaguaccgaugguaacccaaauggcuaugacagauacuacacccuuuggucagcaaagaguauuuaaagaaaaaguugauacaaggacucaagaacccaaagaggggacaaagaaacuuaugagaauaacggccgaauggcuuuggaaagaacuugggaaaaagaaaacucccaggaugugcaccagagaggaguucacucgaaaaguaaggaguaacgcggcuuuaggagcgauauuuacggacgagaauaaguggaaaagcgcccgagaagcuguagaggauagccgauucugggaacucguagauagggagaggaaucuucaucucgaagguaagugcgagaccuguguauacaauaugaugggaaaaagggagaagaaacuaggagaguuuggcaaagcgaaaggaucgagagcuauaugguauaugugguuaggcgcacgcuuccucgaauuugaagcccugggguucuuaaaugaagaccacugguuuuccagaggaaauucacucucagguguagaaggugaaggacugcauaaacuaggauauauuuuaagggacguaucaaagaaagaaggaggggcuauguaugcagacgauacggcggguugggacacaagaauuacuuuagaagaucuuaaaaaugaagaaauggugacaaaccauaugaagggagaacauaaaaagcucgccgaagcaauauucaaauugacuuaccaaaacaaagugguucgaguacagaggccaacgccacgcgguacaguaauggacauuauuucacguaaggaccaaagagggagcggccaagugggaacauacgggcuuaauacuuuuacuaauauggaggcgcaacuaauacgacaaauggaaggggaaggaauuuucaagucaauacaacaucucaccgucacugaagaaauagcagugcaaaacugguuggcuagaguuggccgggaaagauuaagccgaauggcaauaagcggagaugauugugucgucaaaccuuuggaugacagauuugcgucagccuuaaccgcuuuaaaugauaugggcaaagucagaaaagauauacaacaaugggagccaucgagagguuggaaugauuggacucaagugcccuuuugcagccaucacuuucacgagcuaguaaugaaagacgguaggguacuugugguuccauguagaaaccaggacgaauuaaucggccgagcccguauaucucaaggagcgggauggucguugaaagaaacugcgugccugggaaagaguuaugcacagauguggacgcugauguacuuucaucgaagggauuuacgacuugcggcgaaugcuauauguucggccguaccaagucauuggguaccuacuucaaggaccacuuggucgauucaugcaaaacacgaauggaugacuacagaagacaugcucgcaguguggaaucggguuuggauucaagagaauccauggauggaagauaagaccccaguugaaaguugggaagagguaccuuaccuaggaaagagggaagaccaaugguguggcagcuuaauuggacugacaaguagggcgacgugggccaaaaauauucagacugccaucaaucaaguuagaucuuuaaucgggaaugaagaguauacagacuacaugccaucgaugaaaagauuucgcaaagaagaggaagaagcuggaguucugugguag

SEQ ID NO: 22631 - RNA, 9876 nt, Artificial Sequence
  derived and/or modified CDS sequence (opt6) from DENV-2__EU482740__SS-prME
acagcaggggucauuauaauguuaauuccuacggccauggcuuuucaccugacuacaagaaauggugaaccccacaugauaguaggcagacaggaaaaagguaaaagcuuguuauucaaaacugaggaugguguuaauaugugcacacuuauggccauagauuugggagagcuaugcgaagacacuauaaccuacaaaugucccuugcuacgacagaacgaacccgaggauauagauuguugguguaacucgacuucgacauggguuacauauggaacuuguacuacaacuggagaacacagacgcgaaaaacgaucaguugcgcuuguaccacacguugguaugggucuugaaacgcgcacagagacuuggaugucaucggaaggcgcuuggaagcaugugcaaaggauugaaacguggauacuccgccauccgggauucacaauuauggcagcaauauuggcauacacaauuggaacaacacauuuucagagggcucucaucuuuaucuuauugacggcaguagcuccaaguaugacgaugagauguauaggaauaaguaaccgagacuucguugaaggugucaguggaggaaguuggguagauauuguauuagagcauggauccuguguuacaacgauggcuaaaaauaagccgacauuagauuucgaacugauaaagacugaagccaagcaaccagcgacuuugcgaaaauauuguauugaggcgaaauuaacaaacacaacuacggaaucaagauguccaacacaaggggaacccucucuaaacgaggaacaagauaagcgcuuuguauguaaacauagcaugguagaccggggauggggaaauggaugugguuuguuuggaaagggagguauuguuaccugcgcaauguuuacauguaagaagaacauggaagggaaaguaguccucccggaaaacuuagaauauacaaucgucauuacuccccauucaggagaagagcaugcuguggggaaugacacggguaaacauggaaaagaaauaaaaaucacaccgcaaaguucaauuacagaggcagaauuaaccggauacgggaccgucaccauggaauguucgccgcggacuggcuuagacuuuaaugaaaugguauuacuacaaauggaagacaaagcguggcugguccaucgacaaugguuucuagauuuaccauuaccuugguugccuggcgcugauacacaaggaaguaacuggauacagaaagaaacucuugucacuuuuaaaaauccacacgcuaaaaaacaggauguaguaguauuagggucgcaagagggcgccaugcauacugcauuaacaggugcaacggaaauacagaugaguucaggaaaucuacucuuuacaggacauuuaaagugccgauugagaauggauaaacuacaguugaaaggaaugucauacucuaugugcacaggcaaguucaaaaucguuaaggaaaucgcugaaacccaacacggaacaauaguuauuagaguucaauaugaaggagacgggaguccuuguaagauuccauucgaaauaauggaccuagaaaaaagacauguacugggacgauuaauuacugucaacccaauaguaacugagaaagacagcccuguaaauauugaagcagagccgccauucggugauucauacaucauuauagguguugaaccuggucaacuaaaauuaaacugguucaagaaaggaaguucuauaggucaaauguuugagacuacgaugagaggagcuaagaggauggcuauccuaggagauacggccugggacuuuggaucuuugggggggguguuuacauccaucggaaaagcgcuucaucaaguguuuggugcaauauauggugccgccuuuuccggagugucauggaccaugaagauucugauaggggucaucauuaccuggauuggaaugaacucgcguuccacaucucucucgguaaguuugguguugguggggguugucacccuguauuuaggagccaugguucaggcagauucuggaugcguugugucguggaaaucaaaagaauuaaagugugguucggguaucuuuaucaccgauaauguccauaccuggacugaacaauacaaauuucagccagaaagucccucaaaauuagccucagcuauacaaaaagcgcaugaagaaggcauaugugguauaagaaguguuacuagacuugaaaacuugauguggaaacagauaacgccagaauuaaaucacauucuaucagagaaugaagucaaauugacaauaaugacuggagauaucaaagggauaaugcaaccugguaaaagaucgcuacguccacaaccuacugaguugaaguacucuuggaaaacuuggggaaaagcaaaaauguuaucaacggagucacauaaucaaacuuuucuaauagauggaccagaaacggcugaaugcccgaauacuaacagagcauggaauaguuuggaaguagaagacuacggauucgguguauuuacaacaaauaucugguugaaguuacgagaaaagcaagaugucuuuugugauucaaaauuaaugucugcggcaauuaaggauaacagagcagugcaugcugacaugggauauuggauugaaucagcacuaaaugauacuuggaaaauggaaaaggcaaguuuuauugaaguaaaaaguugucauuggcccaagucccauacauuauggucaaacggaguccuggaaucagagaugauuauucccaagaauuucgcugguccagugucucaacauaauuaucguccaggauaucauacccagacagcaggcccauggcaucuugguaaacucgaaauggauuuugauuuuugcgagggaacuacaguagugguuacggaagacugcgguaacagagguccgucccuccguacgacaacagcaaguggaaaacuaauuaccgaaugguguugcaggucgugcacacuuccgccacugagauauaggggagaagacgguugcugguacgguauggaaauuagaccauuaaaagaaaaagaagaaaaccuaguuaacagcuugguaacugcgggucauggccagauugacaacuucucuuuaggaguucuaggaauggcacuguuucuugaagagauguuacguacccggguugguacuaaacacgcaauuuuauuaguagcgguuaguuuuguaacgcuaauaacgggaaauauguccuuccgcgaccuagguagagucauggucaugguuggugcaacaaugacagaugacauaggaaugggagugacuuaccuugcucugcuagcagcguucaaaguaagacccacguuugcagcagguuuguuacuucgaaaauuaacaucgaaggagcuuaugauggcgacuauagguauagccuuauuaucacaaucuacaauuccagaaacaauauuagaacuuacagacgcacuugcgcucggaaugaugguacuaaaaauuguacggaacauggaaaaauaccaacuagcagugacaauaauggcgauuucguguguaccaaacgccguuauccugcaaaacgcuuggaagguaucuugcacuauucuugcgguuguaucugucaguccacuauuauuaacuucuucacagcagaaggcagauuggauaccucuagcuuugacaauuaaaggucuaaauccaacugccauauuccuaacaacacuaagucgaacuuccaaaaaacggagcuggccauugaacgaggcaauuauggcggugggaauggucucaauucuagccuccucacuuuuaaaaaacgacauuccaaugacugguccauuaguugcaggcgggcuauugacaguauguuacguuuuaaccgguagaagugcggacuuagaacuagaaagagcugcagauguuaaaugggaggaucaagcagaaauaucuggcucgucaccgauuuuaucuauaaccauuucugaggauggaaguaugaguauaaaaaaugaagaggaggaacaaacguuaaccaucuugauaagaacaggauuacuaguuaucuccggcguauuccccguuaguauccccauaacagcugcggcaugguaccuuugggaaguaaagaaacagagagcgggaguccuuugggauguccccucuccuccaccaguaggaaaagcagaauuggaagacggcgccuacagaauaaagcagcgagguauccugggauauagucaaauuggcgcaggaguguauaaagaaggaaccuuccacacgauguggcauguaacacggggagcaguauugaugcauagaggaaaacgaauagaaccaucaugggcagacguuaagaaggaccuuauaucuuauggcggggguuggaaacuagagggugaauggaaagaaggugaagaagugcaaguguuggcauuggagccuggcaagaauccccgcgcaguccaaacuaagcccggacuauuuaaaacuaacacuggcacuauaggagccguuagccuugauuuuagcccuggaacaaguggauccccgauagucgaucgcaaagggaagguugucgggcuguauggaaauggggucguaacaagauccggagcguauguuucugcaauagcgcaaacagaaaaaagcaucgaggacaauccugaaauagaagaugacauauuuaggaaaaaacgauugaccauaauggauuuacaucccggagcugguaaaacaaaacguuauuuaccagcaauuguaagagaagcaaucaagaggggguugaggacauugauacucgcgccaacgagaguaguugcggcugaaauggaagaagcgcuacgggggcugccaauuagauaucaaaccccggccauaagagcagaacauacaggacgugaaaucguagauuuaaugugccaugcaacauucacaaugcgauuacuaagucccguaagggucccaaauuauaacuuaauaauaauggacgaggcucacuucacugaccccgcaucaauugcugcccguggcuauaucucaacacgagucgaaaugggagaagcagcaggaaucuucaugacugcuacaccaccgggaucacgggacccguucccgcaaucgaacgccccuauuauggaugaagaacgcgagauaccugaaaggaguuggaacucaggucaugaauggguaacggauuucaaaggaaaaacuguaugguuugucccgucaauaaaagccggaaaugauauagccgcgugucugagaaaaaaugguaaaagggugauacagcucucuagaaaaacguucgauucggaguacguaaaaacuagagcaaacgacugggacuucguuguaacaacugacaucagcgagaugggcgcgaauuuuaaagcagaaagagucauagauccaaggcgaugcaugaagcccgugauacuuacagauggagaagagagggucauuuuagcggggccaaugcccgucacccauaguucagcggcacaacgcagaggaagaauuggaagaaacccuaaaaacgaaaaugaucaauauauauauaugggagaaccucuugaaaacgacgaagauugcgcucacuggaaggaggcuaagaugcuuuuggacaauaucaauacgccagagggaauuauccccaguauguuugaaccggagagagagaaaguggaugcaaucgauggagaguauagacugagaggugaagcccggaaaacauucgucgacuugaugagacgaggggauuuaccgguaugguuggcauaccguguugcggcagaaggaauuaauuacgcggauagaagguggugcuucgauggaaucaaaaacaaucaaauuuuggaggaaaacguggagguggagauuuggacuaaagaaggugaacgaaaaaaguuaaaacccagaugguuagacgcucguauuuauucagauccucuugcuuuaaaagaguuuaaagaauucgcagcaggucggaagagccuaacguugaacuugaucacagaaaugggaagauugccgacauucaugacacaaaaggcuagagaugcucuggacaauuuggcgguacugcacacagccgaggcgggcggacgggcauacaaucacgcauuaucagaacuaccagaaacacuagaaacacuuuuacuucugacacuucuagccaccguaacugguggaauauuucuauuuuuaaugucuggaaaagguauuggaaaaaugacucuagguauguguuguauaauuacugcauccaucuuguuaugguacgcccaaauucaaccgcauuggauagccgcuucgauuauucuugaauuuuucuuaauagucuuacuuauaccagaaccagaaaaacaacgcaccccgcaagauaaccaauuaacauauguuguuauugccauacuaacagucguugcugcuacaauggccaaugaaaugggauuuuuagaaaagacuaaaaaagaccuugguuuggggucgauaacgacccaagaaucagaaaguaauaucuuagauaucgauuugaggccggcguccgcauggacguuauacgcgguagccaccacuuuugugacuccuaugcuuagacauuccauagaaaauagcucagugaaugucucguuaacugcaauugcuaaccaagcaaccguauuaaugggacuagguaaagguuggccauugagcaaaauggauaucggagucccguuauuagcuauuggauguuauucacaaguuaacccuauuaccuuaacagccgcucuuuuauuauuaguagcgcauuacgcuauuauuggcccaggacugcaagcaaaagcaacacgagaggcacaaaagcgagcugcagcugguauaaugaaaaauccuacaguagauggaauaacagugauagaucuagaaccaaucccguaugaucccaaguucgaaaaacaguuaggacaaguaauguuauuaauuuuauguguaacacaaguacugaugaugcggacaacuugggcuuugugugaagccuuaacacucgccacagggccuauuucaacucuaugggaagggaauccagguagguuuuggaacacgacaauagccguaaguauggcuaauauuuucagggguaguuaccuggcaggugcaggacuacuguuuagcauaaugaaaaauaccacuaauacgaggaggggaaccggaaauauaggagaaaccuuaggagagaaguggaaaucucggcucaaugcacuugggaagucagaauuccaaauuuauaaaaaaucaggaauccaagagguagaccggacucuagccaaagaagggauaaagcgaggugagacggaucaucaugcuguaucgagaggaagugcaaaacugagaugguucguagaaagaaauauggugacucccgaaggaaagguaguagauuuagggugcggaagaggagguuggaguuauuauugcggcgggcuuaaaaacguaagagaaguuaaagguuugacaaaaggcgggccaggacacgaagaacccauaccuaugaguacuuacggcuggaauuuaguaagacugcagucaggcguugauguuuuuuuuacuccaccagaaaaaugugauacacugcuuugcgacauaggugagucgucgccaaacccgaccauagaagcugguagaacguugagaguccucaauuugguggaaaacuggcuaaacaauaacacccaauucugcguaaaaguguuaaacccauacaugccaaguguuauagaaaaaauggaaacuuuacaaagaaaauauggaggcgcacuagugagaaacccccucucucguaauagcacacaugaaauguacuggguguccaaugccacagguaacauaguaucaucaguaaacaugauaucccguaugcuaauuaacagauuuacuaugaaacacaagaaagcaacguaugaaccggauguagaccuaggcaguggaacaagaaauauuggaauagaaucagaaauuccuaacuuagacaucaucggcaaacggauagagaaaauuaaacaggaacacgaaacaaguuggcauuaugaccaagaucacccguauaaaacuugggcguaccaugggucauacgaaacuaaacaaacagguagcgccagcaguauggucaacggaguggucagacuauugacgaagccuugggacguaguaccuaugguaacccaaauggccaugaccgauacaacaccuuucggccaacagcgcguauuuaaagaaaaaguagauacucguacccaggagccuaaagaaggaacaaagaaacuaaugaagauuacugcggaauggcuguggaaagaguuaggaaaaaaaaaaacgccgcgaauguguacuagagaggaauuuacaagaaaaguaagaagcaacgccgcuuuaggcgccauauuuacugacgaaaauaaauggaaaucggcuagagaggcaguagaggauuccagauuuugggaacucauugauagagaacguaauuuacaccucgaaggcaaaugcgagacuuguguguauaauaugaugggaaaaagagaaaaaaaauuaggugaauuugggaaagcuaaaggcucccgagcuauaugguacauguggcuuggcgcacgcuuuuuagaauuugaagcgcucggguucuugaaugaggaccacugguuuucaagggggaauaguuugaguggaguagagggcgaaggguugcauagauugggauacauacuccgagacguaucaaaaaaagaaggaggagcgauguaugcugaugacacagcagguugggacacucgaauuacucuugaagaucuaaaaaaugaagaaaugguaaccaaucacaugaaaggggaacacaagaagcuagccgaagcuauauuuaagcuaaccuaucaaaauaagguugucagagugcaacgcccaacaccgcgaggaacagugauggacauaauaagcagaagagaucaaagaggcucaggacaaguaggcacuuacggauuaaauacauuuaccaauauggaggcucaguuaauacggcaaauggaaggagaagguauuuucaaaagcauacaacacuugacaguaacggaggaaauagccguucaaaacugguuggcacgggucggaagggagagauuaaguagaauggccauaaguggagacgacugugugguaaaaccguuggacgaucgguuugcaagcgcacucacagcucuaaaugacaugggaaaaguuaggaaggauauucaacaaugggaaccgucuaggggauggaaugauuggacacagguuccauuuuguucccaucacuuucaugaacuuguaaugaaagacggccggguacuaguuguuccaugcagaaaucaagacgaacuaauaggcagagcgcgaauaagccaaggagcuggauggagucuuaaagagacggcaugccuaggaaaauccuacgcccagauguggacucuaauguacuuccaucggagagauuuaagacuagcugcgaacgcaaucuguucggcaguaccgagucauugggucccaacuucuagaaccacuuggaguauucaugcuaaacacgaguggaugacuacggaggacauguuggccguuuggaacagaguauggauucaagaaaacccauggauggaagacaaaacgcccgucgagucuugggaggaagucccauauuuaggaaaacgagaagaucaauggugcggaucucuuaucgggcugacaucgagagcaacuugggccaaaaacauacaaaccgcaauuaaucaagugcgaagucuaauaggaaaugaggaauauaccgacuacaugccuucaaugaagcgauuuagaagagaagaagaggaggcaggaguacucugguaa

SEQ ID NO: 22632 - RNA, 9876 nt, Artificial Sequence
  derived and/or modified CDS sequence (opt6) from DENV-2__EU482741__SS-prME
acagcaggagugauuaucaugcuuaucccaacagcaauggcguuucauuuaacgaccaggaacggggaaccacacaugauugugggucggcaagaaaaagguaaaucucuuuuauuuaaaacagaagacgggguuaacaugugcaccuuaauggcgauagaccuaggugaacuaugugaagacacaauaacuuauaaauguccguuauuacgacaaaacgaaccagaagacaucgauuguuggugcaauucaaccagcacauggguaacauaugguacuugcacgacgacuggggaacaucguagagaaaaacguucgguggcccuaguaccacauguaggaaugggucuugaaacuagaacagaaaccuggaugucaagcgaaggggccuggaaacacguacaacgaauagaaaccuggauacugcgacaucccggauuuacaauaauggcagcgauauuagcuuauacaaucgguacaacacauuuucaaagagcgcuaauauucauauugcuaacugcaguugcucccucuaugacuaugagauguauagggauuucaaaucgagauuuuguagaagggguauccggagguucgugggucgauauuguccuugaacacgggagcugcguaacgacaauggccaaaaauaaaccaacucuggauuuugaacuaaucaaaacagaagcgaaacaacccgcaacauuaagaaaauacugcauagaagccaaacuaaccaacacaacaacggagucacgcugcccaacgcaaggagagccaagucuuaaugaggaacaggauaaaagauuuguauguaaacacaguauggucgacaggggauggggcaauggcuguggucuauuuggaaaaggcgggauagucacuugugcuauguuuacuugcaagaaaaauauggaggggaaagugguguugccggaaaaucuagaguacaccauuguaauaaccccacauucaggggaagaacaugcaguuggaaacgauacagggaaacaugggaaggaaauuaaaauuacgccccaaagcucaauaacagaggcagaacuaaccggguauggaacaguuacuauggaauguucaccuagaacaggccuagauuucaaugaaaugguuuuauuacaaauggaagacaaagcaugguugguacaccgacaaugguuucuugaucuuccguuaccuuggcuuccaggugcugauacgcaagguuccaauuggauacaaaaggagacacuggugacguucaaaaauccacaugcuaagaaacaagacguugucgugcuggggucacaagaaggagcuaugcauacggcauugacgggagcgacggagauacaaaugucgucagguaacuuauuauucacaggucaucuuaaaugccgacuacgcauggacaaacuacaauugaaagggaugaguuauagcauguguaccggaaaauucaaaaucguaaaagaaaucgcugaaacccagcacggaacuauagucauuagaguacaauacgaaggggauggcucacccuguaaaauacccuuugaaauaauggaccuagagaaaaggcauguguuggggagguuaaucacaguuaaucccauuguugcagagaaggacaguccaguaaacauugaagccgagccgccuuuuggagauucauauauaauaaucgguguagaacccggacagcugaaacuuaauugguucaagaaaggaucaucaauaggucaaauguucgaaacaacgaugaggggugccaaacguauggcuauuuuaggcgauacagcgugggacuucgggucgcuagguggaguauuuacaucaauagguaaggcccuucaccaaguuuuuggagcuauuuacggugcagcauuuucugggguaaguuggacuaugaaaauauuaauaggcgugaucauuaccuggauaggaaugaacucacgauccacaucacuuucgguaaguuuaguucuaguaggcguuguaacauuguauuugggugccauggugcaagccgauucuggguguguaguuucauggaaaaguaaagagcuuaaaugcgggagcggaaucuucauuacggauaaugugcauacguggacugaacaauacaaauuucaaccagaaucuccgagcaaauuagcgagugcaauucaaaaagcccacgaagaaggaauuugcggaauaagaucugugacccgauuggaaaaccuaauguggaaacaaauaacaccagaacuaaaucauauacugagugagaacgaaguaaagcucaccauaaugaccggagauauuaaaggaauaaugcaggcaggaaaaaggagcuugaggccccaaccaacugagcugaaauauagcuggaagaccuggggcaaggcaaaaaugcuaagcacagaaagucacaaucagacauuuuuaauugauggaccagaaacugccgaaugucccaacacaaaucgcgcguggaauaguuuagaggucgaagauuauggguuugguguuuucacaacaaauaucuggcugaaauuaagagaaaaacaagacguauucugcgauucaaaauuaaugagugcugccauaaaggauaacagagcugugcaugcagacaugggguauuggauagagucagcuuuaaacgauacuuggaaaauggaaaaagcuaguuucauagaggugaaaagcugucacuggccaaaaagucauacacuguggucaaaugguguauuagagucagagaugaucauacccaaaaauuucgcagggccagucagucaacauaacuaucgaccaggcuaucacacccaaacugccggaccauggcacuugggaaaguuggaaauggacuucgacuuuugugaagguaccaccgucgucguuacagaagacugcgguaaccggggaccaucccuaagaacaaccacagcauccggcaaguugaucacagaaugguguuguagaaguuguacucuaccgccccuccguuaucgaggugaagacggcuguugguauggaauggagauaagaccacugaaagaaaaagaagagaaucuagucaauuccuuagugacagcaggucauggacaaaucgacaauuucucccugggcguauugggaauggcacuauuuuuagaggaaauguuacgaacaagaguagguaccaaacacgcgaugcuccuaguagucgucagcuuuguaacacugauuacagguaacaugucuuuuagagacuuagguagaguaaugguuauggugggugcuacaaugacggaugacaucgggaugggcauaacguacuuagccuugcuagcggcuuuuaaaguaagaccuacuuuugcugcaggucuuuuguuacggaaacuaacaagcaaagaauugaugauggcaaccauaggcauagcuuuauugucacagaguacuauaccagaaacaauauuagaacucacagacgcuuuagcuuuagguaugaugguccugaagauaguacgaaauauggaaaaauaucaauuagcggugaccauuauggcuauaaguugcgucccaaacgcaguaauuuuacaaaaugcguggaaaguuucguguacuauucuagcagcaguuagcguaagcccccuacuacucacaagcucacaacaaaaggcagauuggauaccauuagccuuaacaauaaaagggcugaacccgacggcaauauucuuaacaacgcuaucacgaacuagcaagaaacguaguuggccauuaaacgaagcaauuauggcuguaggaauggugaguauacuugcauccagccugcugaagaacgacauucccaugaccgguccuuuaguagcuggaggacuccugaccgucuguuacguucuaacaggcaggucugcugaucuugaacucgagcgagcugcagauguaaaaugggaagaucaagccgaaauaaguggcucgucuccaauucuaucaauaacuaucuccgaagauggaagcaugaguauuaaaaaugaggaggaagaacaaacacugacaauucuaauaagaacaggauuacugguaauaaguggaguguuuccugugaguauaccaaucacagcugcagcaugguaccugugggaggucaaaaagcaacgagccgggguauuaugggauguaccuuccccaccgccugucgaaaaagcugaauuagaagauggugcuuauagaauaaaacaacgggggauucugggauacucccaaauaggagccggcguauauaaagaaggaaccuuccauaccauguggcacguuacuaggggugccguacugaugcauagaggaaagagaauagagccaucaugggccgacgugaaaaaggaucuaaucucuuacggagggggcuggaaacuugagggggaauggaaagaaggagaagaaguccaaguguuagccuuagaacccggcaaaaauccgcgcgcuguccaaacgaagccuggccuauuuaaaaccaacaccgguacgaucggugcugugucccuugacuuuagucccgggaccagcggaucacccauuguugacaggaaaggcaaagugguaggauuauacggaaacggaguuguaacaagaaguggcgccuacgucuccgccauagcacaaacugaaaaaucuauagaagauaacccggagauagaggacgacauauuuaggaagaagcgguugacuauaauggaccuacauccgggugccgggaaaaccaaaagauaucugccugccaucguccgagaagcaauaaagaggggauuacggacgcuuauacuagcccccacuaggguaguggccgcagaaauggaagaagcacuuaggggucuacccauaagauaccagacaccagcuauaagagcugaacacacagguagggaaauaguagaucuuaugugucacgcaacguuuacaaugagacuucugucgccugugagagucccaaauuacaaucugauaaucauggaugaggcucacuucacagauccggcaaguauagcagcacgugguuacauuuccacacggguggaaaugggagaagcagcugguauauucaugaccgcaacaccaccagggagccgagacccauuuccucaaucaaaugcgccaauaauggaugaagaacgagaaauaccugaacgcucauggaacagcgggcaugaguggguaacugacuuuaaaggcaaaacagucugguuuguaccaaguauuaaagcggguaaugauaucgcagcgugccucaggaagaauggaaagaaaguaauacaacuaaguaggaaaacguuugacucagaguacgugaaaaccagagcaaaugauugggauuuuguaguuacaacugauauaagugagaugggagcuaauuucaaggcagagcggguaauagauccccguagauguaugaaacccguaauauuaacugauggugaggaaagagugauuuuagcgggucccaugccugucacccauucaucagcggcacaaagacgagggagaauaggccggaaucccaaaaaugagaaugaccaauauauuuauaugggugaaccacuagagaaugacgaagauugcgcccauuggaaagaagcaaaaauguuacucgauaacaucaacacaccagagggaaucauacccaguauguucgaaccagaaagagaaaaaguagaugcgauagauggagaauaucgcuugagaggagaagcuaggaaaacauuuguagacuugaugagaaggggagauuuaccggucuggcuagcauacagaguagcagcagaaggcauaaauuacgcugacagacguugguguuuugauggcaucaaaaacaaucaaaucuuagaagaaaauguggaaguagagaucuggacgaaagaaggagaaaggaagaaacuuaaaccuagguggcuagaugcacguauauauucggauccuuuagcuuuaaaagaguuuaaagaguucgcugcgggacguaagaguuuaacauuaaaucuuauuacagagaugggccgauuaccaacuuuuaugacucaaaaagcaagagaugcccuagauaauuuggcaguacuacauacugcggaagcaggagggcgagcauacaaucacgcacuaucggaacuuccagagacacuagaaacacucuugcuauugacacugcuugcuacuguuaccgggggcauauuucuuuuucuaaugucgggaaaagguaucggaaaaaugacccuuggcauguguugcauaauuacggcaucaauacuucuaugguaugcccaaauucaaccacacuggauagcugcauccauaauauuagaguucuuccucauaguacuacugaucccugaaccagagaagcaaagaacaccgcaagauaaccagcuaacguauguagugauugcuauccuuacugugguagcagcgacgauggcaaacgagaugggguuuuuagagaaaacuaagaaagaucuuggacucggaucaauagcgacccaagaaagcgaguccaacauacucgauaucgaucuucgaccugcaagugcuuggacacuuuacgcaguagcgacuacuuuugucacaccgaugcugagacauucaauugaaaauucuagcguuaacgucagcuuaacugcgauugcaaaucaagcuacuguuuuaauggggcuaggcaaagguuggcccuugucaaaaauggauauagggguuccacuccuugcgauaggaugcuacucacagguuaauccgauuacccuaacggcggcguuguugcuccuaguagcucacuacgccauaauagguccuggauuacaagccaaggcgaccagagaagcccaaaagcgagcagcggcuggaauuaugaagaaccccacuguggacggaauuacaguaauagauuuggaaccaaucccauaugauccaaaauucgaaaaacaacuuggccaaguaauguuauuaauauuaugugugacacaaguacuaaugaugcgaaccacuugggcccucugcgaggcacucacgcuagcaaccggaccgauaaguacacuuugggaggguaauccaggaagauucuggaacacaacaauagccguuuccauggcuaacauuuuucgaggaucguauuuagccggggcaggguuauuauuuagcauaaugaagaauaccacaaacacacgaagagguacagggaauauuggugaaacacuuggcgagaaauggaaaagccguuuaaacgcucuugggaaaucagaguuccaaaucuacaaaaagagcgggauacaagaaguugacagaaccuuagcgaaagaagguauaaaacggggugaaacugaucaccaugccgucucuagggguagcgcuaaacuacguugguucguagaaaggaauaugguaacacccgaaggcaaaguaguugauuuaggguguggcagagguggguggucuuauuauugugguggacucaaaaacguuagagaaguaaaaggacuuacaaaagggggaccuggucacgaagaaccaauuccuaugucgacauacggauggaauuuaguaaggcugcagucgggaguagauguuuucuucacucccccugaaaaaugugauacuuuauuaugcgauaucggcgaaagcaguccaaauccaacaauugaagcagguagaacgcuaagaguacuaaacuuaguugaaaauugguuaaauaauaauacgcaauuuugcauaaaagugcucaauccauacaugccaucagucauagaaaagauggaaacccuacaacguaaauauggcggagcccugguucgaaacccacuaagccggaacaguacgcaugaaauguauugggugucaaacgcaacgggaaacaucguaucuuccguaaauaugauuucuaggaugcuaauuaacagguuuacaaugaaacauaagaaagcaacuuacgaaccggacguagaucuagguaguggaacacgaaacauagguauagagucugaaauuccaaacuuagauauuauaggaaagcgaauugagaaaaucaaacaagagcacgaaacaaguuggcauuaugaccaggaucacccauauaaaacuugggcuuaucacggaagcuaugaaaccaaacagacagguucagccuccaguaugguuaacgguguaguucgacuauuaaccaaaccgugggacgugguuccuaugguaacacaaauggcuaugaccgacacaacgccauucggacaacagaggguauuuaaggagaagguagacacacgaacucaagaaccuaaagaaggaaccaagaaacuaaugaaaauaacagccgaaugguuauggaaagaauuaggcaaaaagaaaacgccccguauguguacacgagaagaguucacucgaaaaguccgaucgaacgcggcgcuaggggcuauauucacugacgagaauaaauggaagucggcacgagaagcuguugaagauagucgcuucugggagcugauagacagggaacgaaaucuacaucuugaaggaaaaugugaaacauguguauacaacaugaugggaaaaagagaaaagaaacuaggagaguucggaaaggcgaaaggaagucgcgcgaucugguacauguggcuaggcgcgagguuuuuagaguuugaggcacugggauuucucaaugaggaccacugguucucaagaggaaauucucuaucugggguagaaggggaagguuugcaucgacucggauacauacuaagagaugugaguaaaaaggaaggaggagcaauguaugcagacgauacggcaggaugggauacaagaauaacacucgaagaccucaaaaacgaagaaaugguaacuaaccacaugaaaggcgagcauaagaaacuagcagaagcaauauuuaaacuuacauaucaaaauaaagugguucgaguccaaagaccaacuccgcgugguacuguuauggauauaauuucacggagggaucaacgaggaagcgggcaaguaggaaccuacgggcuaaauacuuuuacuaacauggaagcgcaauuaauccgacaaauggaaggagaaggaauuuuuaaaucaauacaacaccucacugucacugaggaaaucgcagugcaaaauugguuagcaaggguagguagagagcguuugucccguauggccauaagcggcgacgauugcguaguaaaaccccuugacgacagauucgcuucagcguuaaccgcccuaaacgauauggggaaaguacgaaaggacauucaacagugggaaccuagucguggauggaacgacuggacucagguacccuucuguagucaucacuuucacgaacuugugaugaaggaugggaggguacuugugguuccuugucgaaaucaggaugaacucauuggaagggcaagaaucagccaaggugcagguuggucacucaaagagacugcuugccugggaaaaagcuaugcgcaaauguggacuuuaauguacuuucaccguagagaccugagauuagcugcaaaugccauuuguuccgcaguaccaucucauuggguccccacguccagaacaacuuggagcauucaugccaaacacgaauggaugacaacagaagauaugcuagccguuuggaacagaguguggauucaagagaauccauggauggaagacaaaacuccaguggaaagcugggaggaaguuccuuacuuagguaaacgcgaagaccaauggugcgguucacuaauaggacuuacgucgcgggccaccugggcuaagaacauucaaacagcuauuaaucaagucaggucuuuaauaggaaaugaagaauacaccgauuauaugccaucaaugaaacgcuuccguagagaagaagaagaggcaggcgucuugugguga

SEQ ID NO: 22633 - RNA, 9876 nt, Artificial Sequence
  derived and/or modified CDS sequence (opt6) from DENV-2__EU482742__SS-prME
acggcagggguaaucauaauguuaauaccgacggcuauggcauuucaucugacaacacgaaauggagaaccacacaugauaguaggaagacaagaaaaagguaaaagccuacuguuuaaaacugaagacgguguaaacauguguacguugauggcgauagaccuuggagaacugugugaagauacgaucacauacaaauguccucuacuaagacaaaacgaaccagaagacauagauuguuggugcaauucaacaucuacauggguuacauacggcacuuguacaacgacaggggaacauagacgugagaaacgaucagucgcccuggugccacacguuggaaugggcuuagaaacaagaacugaaacauggaugagcagugaaggagcauggaaacauguacaacgaauagaaacauggauccuaaggcauccaggauuuacuauaauggcagcaauucuagcauacacuauuggaacaacacacuuccaaagagcauugauauuuauuuuacucacugcuguagcucccucaaugacgaugcggugcaucgggauaucgaaccgagauuuuguugaagggguaucaggugggucaugggucgauauuguccucgaacacgggucuuguguuacgacuauggcuaaaaauaaaccaacacuagacuuugaacuuaucaaaacagaagcaaaacaacccgcaacacuaagaaaauauuguauugaagcaaaauuaacaaacacuacuacagaaagucgcuguccaacacagggugaaccaucauuaaacgaagaacaagauaaaagguucguauguaaacacaguaugguugauaggggaugggguaacggaugcggacuguuuggaaaaggagguauaguuacgugcgcgauguuuaccuguaaaaagaauauggaagggaaagugguucuuccagaaaaccuugaauauacuauaguuaucacuccccacaguggagaagaacacgcagucggcaaugauacaggaaaacacggcaaagaaauaaaaauaacuccccaaagcaguauuacagaagcggagcuaacaggcuacggaacggucacuauggaaugcucuccgcgaacaggccucgacuucaaugaaaugguacuguuacaaauggaagauaaagcauggcuaguccauagacaaugguuuuuagacuuaccauuacccuggcuaccaggagcagauacucaaggaagcaauuggauucaaaaagaaaccuuagucacuuuuaagaauccucaugcgaagaaacaagauguaguaguauuggguucacaagaaggagcgaugcacacagcuuuaacaggcgcuccugaaauacaaauguccucugguaaccuucuuuuuaccgggcaccugaaaugcagauugagaauggacaaacuucaacuaaaggguauguccuauuccaugugcacuggaaaauuuaaaauaguuaaagaaaucgcagaaacacagcacgguacgauagucauaagagugcaguacgaaggcgauggaucaccauguaaaaucccguucgaaauaauggaccuagaaaaacgacauguucugggacgguuaauuacaguaaauccaauaguaacggagaaagauucacccguaaacauagaagcagaaccgcccuucggugauucauauauaauaauagguguugagccaggacaguuaaaauugaauugguucaagaaaggaaguucaaucgggcaaauguuugagacaacuaugagaggagcuaagaggauggcgauuuuaggggauacggcaugggacuucgguaguuuagguggaguauuuacgaguauugguaaagcccuccaucaaguuuucggagcgauauauggcgcagccuuuucaggcgugagcuggacgaugaagauuuuaauagggguuauaauaacauggaucggaaugaacucucgaaguaccagccuaagugucucucuaguuuuaguuggcguaguaacguuauaccuuggagcaaugguucaagcugacuccgguugcguagugucuuggaaaagcaaggaauuaaaaugugguaguggcauauucauaacugacaauguacauaccuggacagaacaauauaaauuccaaccggaaucaccaaguaaauuagccucagccauucaaaaagcacaugaggaaggaauuugcgggauacgcaguguaacacgauuagagaaucucauguggaaacaaauaacuccugaacucaaucacauauuaucagagaacgagguaaaauuaacaauaaugacuggugauauaaaaggcauuaugcaggcugggaaaaggagccuuagaccacaaccaacagagcugaaauacuccuggaagacaugggggaaagcaaaaauguuaucuaccgaaagucacaaccaaaccuuccuaauugaugguccggagacugcggaauguccuaauaccaaccgagcguggaacucguuggaaguggaagauuauggauucggcguauuuacaacaaacaucuggcuaaaauugcgagaaaagcaagaugucuuuugcgacagcaaguuaaugagcgcagccaucaaggauaauagggcaguccaugccgauaugggauacuggauagaaucugcucuaaaugacacguggaaaauggagaaggcuucguuuauugaaguaaagucgugucauuggccaaagagucauacucuauggucaaacggaguccuagagucugagaugaucauacccaaaaauuucgcgggcccaguaucacaacauaacuaccgaccugguuaccacacacaaacagcgggaccauggcaccucggaaagcuagagauggacuuugacuucugugaaggaacgacgguaguagugacggaagacugugguaacagggggcccucuuugaggaccacaacagcaucagguaaacuuauuacagaauggugcugucgaucauguacuuuaccuccauuacguuauagaggagaggacggguguugguauggcauggaaauacguccacuaaaggaaaaggaagaaaauuuagugaacucucuaguaaccgcgggacauggacaaaucgacaauuuuucgcucggcguucucgguauggcacuguuucuagaagaaaugcuaagaacucgagugggaaccaaacaugcgauacuauugguagcuguaucauucgugacauugauaacuggaaauaugucauuuagagaccuaggacgagugauggugaugguuggagcuacaaugacugacgacauugguaugggggugacuuaucuagcuuuacuagcugcuuuuaaaguucgaccaacuuuugcugcuggauuacuauuaaggaaguuaacgucaaaggaacuuaugauggcaacuauaggcauagcauuacuaucacagaguaccaucccagaaacaauuuuggaauuaacagacgcguuggcucuuggaaugaugguuuuaaagauaguaaggaacauggaaaaguaucaacuagcaguaacaaucauggcgauuaguuguguaccuaaugcggugauauuacaaaaugcguggaaaguuucuuguacaauacuagcggcaguaucaguaagccccuuacuacucaccucaagucaacaaaaagccgauuggauaccccuagcccuaacgaucaaagguuuaaauccaacagcaauauuccuuacuacccucucaagaacuagcaagaaacgaagcuggccacuuaacgaagcaauuauggcgguuggaaugguuucaauucuugcaaguaguuuacuuaaaaaugauauaccaaugaccggacccuuaguagccgggggucuuuuaacaguauguuacguguuaaccggaaggagcgccgaucucgaguuagaaagagcggcugauguaaaaugggaagaucaagcagaaauaucuggaaguucacccauccucaguaucaccauaucagaagauggcagcaugagcauuaaaaaugaagaggaagaacaaacccuaacaauucucauucguacagggcuucuaguuauauccggcguuuucccgguaagcauuccgauaacagcggcagccugguaucuaugggaaguaaagaaacaacgagcugguguacuaugggauguaccaucaccuccaccagugggaaaagcugaguuggaggauggagcauaucggauuaaacaacguggcauccuaggguacucacaaauuggugcaggcguuuauaaagaaggaaccuuucacaccauguggcacguaacuaggggcgcgguuuuaaugcacaggggaaaaagaauagaaccaucuugggcagacguaaagaaagaccugauaaguuauggagggggauggaaauuggaaggagaauggaaagagggugaagaaguacaaguacucgcacuggaacccggaaagaacccuagagcugugcaaaccaagccuggcuuguuuaagacgaacacggguacaaucggagcagugucauuagauuucucacccgggacaagcggcucgccgauaguagauagaaagggaaaaguggucggucuauauggaaauggaguaguaacuaggucaggagcuuacguuucugcuauagcucaaacggaaaagaguauugaagauaacccagagauugaagaugauauauucaggaagaaaagacuaacaauaauggaccuccauccuggugcagggaaaacaaagagauaccugcccgcuauaguaagggaagccauaaaaagagggcuacguacacugauucuagcaccuacucguguaguagcggccgaaauggaagaagcgcuucgcggguuaccgauuagguaucagacaccggcuauaagagcagaacauacaggccgagagauugucgauuugaugugucaugcaacguucacaaugagguuacuaagccccgugcgggugccaaauuauaaccuaauaauaauggaugaagcacauuuuacagauccagcuucuauugcagcgaggggcuacaucucgacaaggguagaaaugggugaagcagcaggaaucuucaugacugccacucccccuggcucacgugauccauucccucagucaaaugcuccaaucauggaugaagaaagggaaauuccagaacgcaguuggaacucuggucacgaguggguaacugauuuuaaaggaaaaacagugugguuugugccauccauaaaagcuggaaaugauauugcugcauguuugaggaaaaacggcaagaaaguaauacaguuaagccggaagacguuugauagcgaauauguaaaaaccagggcaaaugacugggacuuugucgucacaacagacauuucagaaaugggggcaaacuuuaaagcagagcgcguaauagacccacgacgaugcaugaaaccuguaauucucacagauggagaagaacgaguaauucuagcaggaccaaugccuguaacacauucgucagccgcacaacgacggggacgaauaggcagaaauccgaaaaaugagaaugaucaauauauauacaugggagaaccuuuagaaaaugaugaagauugugcacauuggaaagaagcuaaaaugcuacucgacaacauaaauacaccagaaggaauaauaccgaguauguuugaaccggaacgagagaaaguagaugcaaucgacggagaauaucggcuacgaggagaggcaagaaagacuuuuguagauuuaaugagaagaggggaccuuccgguaugguuggcauauagaguggcagcggaaggaauaaauuacgcugaucgaagaugguguuuugauggaaucaaaaauaaccaaaucuuagaagagaauguagaaguagaaauuuggacuaaagaaggagaaagaaagaaacucaaaccgcguuggcuugacgcaaggauauacucugauccacuagcuuuaaaagaguucaaagaguuugcugccgguagaaaaucauugacauuaaaccuuauuacggagaugggacgccuuccaaccuucaugacacagaaagcaagagacgcauuagauaauuuggcaguuuuacauacggcagaagccggagguagagcauacaaccaugcauuaagcgaauugccugaaacgcucgaaacacuguuacuguuaacguuacuggcugcugugacgggaggaauuuuccuuuucuuaaugucagggaaaggaauugguaaaaugacacuagguauguguuguaucauaaccgcauccauacuauuaugguaugcgcaaauccaaccgcacuggauugcggcaagcauaauccuugaauuuuuccuuauaguacuucuuauuccugagccagagaaacaaaggacaccacaagauaaccaguuaacguacgucguaauugcgauacuaaccgucguagcugcaacaauggcuaacgaaauggguuucuuagagaaaaccaagaaagaccuugguuuagggucgauaaccacucaagaaagugagaguaacauuuuagauaucgaucucaggcccgccuccgcguggacucuguacgcggucgcaaccacuuuuguaacuccuaugcuucgccauaguaucgaaaacuccagcguaaauguaucacuuacagcuaucgccaaccaggcgacaguucuaaugggauuagguaaaggauggccucuaagcaaaauggauauugggguacccuuacuagccauuggcuguuauagccaagucaaccccauaacgcugacagcagcgcugcuccuauuaguagcacauuaugccauuaucggaccuggccuacaagcgaaagcuacgagggaggcgcagaaaagagcggcggccggaaucaugaaaaaucccacgguagauggaauaacaguaauagauuuagaaccaauaccuuacgacccgaaguuugaaaaacaacuggggcaggucaugcuacucauuuuauguguaacacaaguacucaugaugagaaccaccugggcucucugugaagcauugacauuagcuacuggaccaauuaguacguuaugggagggaaacccuggucgcuucuggaauacuacaaucgcaguaucaauggcgaauauauuccguggaucuuauuuagcgggagcagggcucuuauucagcauaaugaaaaacacuacuaauacucgaagagguacaggaaauaucggagagacuuuaggagaaaaguggaaaagccguuuaaaugcgcuagguaaaagcgaauuucaaauauauaagaaaucuggcauccaagaaguagauagaacccuagcgaaagaaggcaucaaaaggggugaaacugaccaccaugcugugucaagggguucugcgaaauuaagaugguucguagaacgaaacauggucaccccagagggaaaaguaguggaucugggaugcggucgagguggauggagcuacuauugugggggacucaaaaacgugagggagguaaagggucuaacaaagggaggcccugggcacgaagaaccuauaccuaugucaacguauggauggaacuuaguaaggcuacaaucagggguugacguauuuuucacaccuccugagaaaugugauacgcuccuaugugauauuggcgaaaguagcccgaaccccacaauagaagcuggcagaacuuuacguguucugaaucugguagagaacugguuaaauaacaauacccaauuuuguauuaagguacuaaaucccuauaugccgagcguaauagagaaaauggagacauugcagcguaaauauggaggggcgcugguaagaaacccucuuucuagaaauucuacacacgagauguacuggguaucaaaugcaacagguaauaucgucaguucagucaauaugauuaguagaaugcuuauuaaccguuuuaccaugaaacacaagaaagcaacauaugaaccugacguagaucugggauccggcacacguaacauaggaauagaaagcgaaauuccaaaccuugauauaauaggaaaaagaauagagaaaauaaaacaagaacacgaaaccucauggcacuaugaucaagaucauccauacaaaacuugggcuuaucaugguucauacgaaaccaaacaaacagggagugccagcucuauggugaaugguguaguaagacugcuaacaaaaccuugggaugugguucccaugguuacacaaauggccaugacagacacaacuccauuugggcaacagagagucuuuaaagaaaaaguagacacgagaacgcaggaaccuaaagaaggaacaaagaaacucaugaaaauaacugccgaauggcuauggaaagaacuggggaagaagaaaacgccaaggaugugcaccagggaagaguucacuagaaaaguacguuccaacgcagcccuaggggcgauuuuuaccgaugaaaauaaauggaaguccgcgagagaagcaguagaagauucaagauuuugggaacucauugaccgagagagaaacuuacaccucgaagggaagugcgagacgugcguauacaauaugauggggaaaagagagaagaaacuaggggaguucgguaaagccaaaggcaguagggcuauaugguauauguggcuuggggcaagauuccuagaguucgaggcauuaggauuucucaaugaagaccauugguucucaagggguaacagcuugucuggaguagaaggggagggucuacauagguuggguuauauauuaagggauguuagcaagaaagaaggaggagcaauguacgcggaugauacagcuggaugggauacacgaauaacgcuggaagaccucaaaaaugaagagauggugaccaaucauaugaaaggugaacacaagaaacuagcagaagcaauuuuuaaauuaacauaccaaaacaaagucguccgggugcaacggcccaccccgcgagguacagugauggacaucauuucucgcagagaucaaagaggaaguggccaaguuggaacauacggguuaaauacguuuacgaauauggaagcgcaauugauccggcaaauggaaggagagggcauuuuuaaaagcauacaacacuuaacgguaaccgaagaaauagcuguccaaaauuggcuugcaaggguaggccgagaaagacuuuccagaauggcuaucaguggugaugauuguguugucaaaccacuagaugaccgauucgcaucggcuuuaacugcccucaaugauaugggaaaggugcgcaaagacauacagcagugggaaccgagccgcgguuggaacgauuggacacaggugccauucugcagucaccacuuccaugagcuagugaugaaagauggcagaguguuagugguaccauguagaaaucaagaugaacuaaucgguagagcaagaauuagccagggggcaggauggagccuuaaagaaacugcaugccuaggaaaaaguuacgcucaaauguggacccugauguacuuucauagaagagaucuuagauuagcagcaaaugcgauauguuccgcugugcccucacacugggucccaaccaguagaacuacguggucaauccaugcgaaacaugaauggaugacuacagaagacaugcuagcugucuggaaucgaguuuggauccaagaaaacccauggauggaagacaaaacgccuguagaguccugggaagaagugcccuaccuugguaaacgcgaagaucagugguguggaucacuuauugguuuaacaucacgggcaacaugggccaaaaacauucaaacagcgauaaaucagguucguagcuuaauugggaaugaggaguauacggauuauaugcccagcaugaaaagauucagaagggaggaagaagaggcagggguacucugguga

SEQ ID NO: 22634 - RNA, 9876 nt, Artificial Sequence
  derived and/or modified CDS sequence (opt6) from DENV-2__EU482744__SS-prME
acagcuggaguuauuauaauguugauaccuacggcuauggcauuccaccuuacaacacguaacggagaaccacacaugaucgucgguagacaggaaaaaggaaaaucuuuauuauucaaaacagaagacggcguuaauauguguacacuaauggcaauagaucuuggugaacuaugugaagauacaauaaccuacaaauguccauuacuucgucaaaaugaaccugaagauauugauugcugguguaacucuacaucaacguggguaacguacggaacaugcacaacaacaggggaacacagaagagagaaaagaaguguagcguuagugccgcacgucgguaugggcuuagaaacucgaacagaaacauggaugucgagugaaggagcuuggaaacacgugcaaagaauagaaaccuggaucuugaggcacccuggauucacaauuauggcagcaauacuagcauacacaaucggaaccacacauuuucaacgcgcucuuauuuuuauccuacuaacggccgucgcucccaguaugaccaugcgaugcaucggcaucaguaauagagacuuugucgaaggcguaucagggggaaguugggucgauauuguacuagaacacgguucuugcguaacaacaauggccaaaaacaaaccuacucuggauuuugaacuaauuaaaacugaagcaaaacagccagcaacgcuccgaaaauacugcauagaagcuaaauuaacaaauaccacuaccgaaagucgaugcccuacacagggagaaccuaguuuaaaugaagaacaggacaaacgguucguaugcaaacauucgaugguggacagggguuggggcaacgguugcggccuauucgggaaaggugguauaguuacuugcgcaauguuuacauguaagaaaaauauggaggggaaaguuguauuaccagaaaaucuagaauacaccauagugauuacuccgcacaguggagaggaacaugcaguagguaaugauaccgggaaacauggcaaggaaaucaaaauuacuccgcaguccucuauuacugaggcagaacuaacaggguacgggacuguuaccauggaaugcucgccgcggacugggcuagacuucaaugaaaugguccuacuacagauggaggauaaagcauggcuuguacaucgacagugguuuuuagaccugccuuuaccauggcucccaggagcugacacacagggcucgaauuggauacaaaaagaaacccuagugacguucaaaaauccacacgcuaagaaacaagauguggucguauuaggaucucaggaaggagcuaugcacacugcacugacaggugcaacagaaauccaaaugagcuccgguaauuuauuguucacaggccacuugaaguguagauuaagaauggauaaauugcagcuuaaaggaaugaguuauuccauguguacaggaaaguucaagauuguaaaagagauugcagaaacacaacacgguacuauugugauaaggguucaauaugaaggggaugguagcccaugcaaaaucccauuugaaaucauggaccuugagaaaagacauguacuuggucguuuaaucacaguuaauccaaucguaacugaaaaggauucaccagucaauauugaggcagagcccccguuuggggacuccuauauaauaauaggaguagagccugggcaacuuaaacuaaauugguuuaagaaaggaagcucgauaggccaaauguucgagacgaccaugagaggggcaaagcgaauggcaauacuuggugacacggcuugggauuucggaucauugggagggguauuuacuucaauaggcaaggcacuucaccaaguuuuuggagccaucuauggugccgcauuuagcgggguuaguuggacgaugaaaauccuuauugggguaaucauuaccuggauuggaaugaauagcagaucaaccagccuuucuguaucauugguuuuaguaggcguaguaacacuauacuuaggagcaaugguacaagcagauuccggcugcguuguaaguuggaaaaacaaagagcucaagugcgguucaggaauauucauaacagauaauguucacacguggacagaacaguacaaauuucagcccgaaucuccaaguaaauuagcaagugcuauacaaaaagcacaugaagaaggcauauguggaauccgaucuguaaccaggcuugaaaauuuaauguggaaacaaauaacacccgaauugaaccauaucuuaagugaaaaugaggugaaacuaacuauuaugaccggagauauuaaaggaauuaugcaggccggcaaaagaucacuacggccgcaacccaccgagcuuaaauauaguuggaagacguggggaaaggcaaaaauguuaucuacugaaucucacaaucaaaccuuccuaauugauggaccagagacagcagaauguccgaacaccaaucgagcguggaauagccuugaaguagaggacuauggauucggcguauucacaacaaauaucuggcuaaaguuacgcgaaaaacaagacguauuuugugacucaaaauuaaugucagccgccaucaaagauaacagagccguacacgcagacaugggauacuggauagaauccgcacuaaaugacaccuggaaaauggaaaaggcaaguuuuauagaaguaaaaucgugucacuggccuaaaucacauaccuuauggucaaauggaguacuugagagcgaaaugauaauaccgaaaaacuuugccgggccugugucacaacauaacuacagaccaggguaccauacgcagacagcggguccauggcacuuaggaaagcuagaaauggacuuugauuuuugugaagguacgacagugguagucacggaggauugugguaaccgaggaccuucacuaagaaccacaacagccucaggcaaauugaucacugaaugguguugcagauccugcacgcucccuccgcucagauaccgaggggaggaugguuguugguaugggauggagauaaggccccucaaagaaaaagaagaaaaccuaguaaauucguugguaacagcuggccacggacaaauugacaacuuuucauuaggaguacuaggaauggcacuauuuuuggaagaaauguugaggacuaggguagggaccaaacaugcuauccucuuagucgccgugucguucgugacguuaauaacgggaaacauguccuuuagagaucuuggacggguaauggucauggugggcgcuacgaugacugacgacauugguauggguguuacauaccuggcgcugcuagcugcauuuaaaguuagaccuaccuucgcggcgggacuacuucuuagaaagcuaaccucaaaggaguuaaugauggcuacaauuggcauagcucuacuuucacaaagcacgauaccggaaacuaucuuagaauuaacagaugcauuggcccuaggaaugaugguccuuaaaauaguaagaaacauggaaaaguaucaguuagcaguauccauaauggcuauuagcugcgucccuaacgccgugauuuuacaaaaugccuggaagguaaguuguacaauccuugcugcugugucgguuucuccauuacuguuaacgucaucccaacaaaaagcagauuggauaccauuagcacugacuaucaaaggucuuaauccuacagcaauuuucuugacgacauuaagucgcaccagcaagaaaaggaguuggccucuaaaugaagcaauaauggcugugggaauggugaguauacuugcaucaucacuucucaaaaaugauauuccgaugacugggccucuagucgcuggagggcuucuuacagucuguuauguccugacgggaaggucggcggauuuggaacuugaaagagcugcagaugucaaaugggaagaucaggcagaaauaagugguaguucgccuauucucuccaucacaauuucagaagauggaaguaugucuauuaagaaugaagaagaagaacaaacauuaacaauacuaauucgcaccggauuacuuguaauuuccggagucuuuccgguaucuauaccaauaacagcagcugcuugguauuuaugggaaguuaaaaagcaaagagcgggagucuuaugggaugugccaucaccacccccagucggaaaggcagaguuggaagauggggcauaccgcauaaaacagagagguauauuaggguacucucagauaggcgccggaguauacaaggagggaacauuucacaccauguggcauguaacacgaggugcaguauuaaugcacagaggaaaacgaauagagccaucaugggcggaugucaagaaagaucuaaucaguuauggugggggauggaaacuggaaggugaguggaaagaaggggaagaaguacaaguacucgcacuugaaccgggaaagaauccgcgagcagugcaaaccaagccaggccuuuuuaagacaaauacaggaacuauuggggcgguaagccuagacuuuucuccagggaccaguggaucaccuauuguggauagaaaagguaaagucgucggcuuauacgguaauggaguugugaccagauccggggcauauguaucugccauugcacaaaccgagaaaagcauugaagacaauccagaaauagaagaugauauauuuaggaagaaaagauuaaccauaauggaucuucaucccggugcgggaaaaacaaaacguuauuuaccugccaucguuagggaggcuaucaaacgcgggcugagaaccuuaauauuagcaccgacacgcguagucgccgccgaaauggaagaggcguuaagagguuuaccaauuagauaucaaacacccgcgauuagagccgaacacacuggaagagaaaucguagaccuuaugugccaugcaaccuuuacaaugagauuauuauccccgguaagaguuccaaacuauaauuugauaauaauggaugaagcccacuucaccgacccagcguccauugccgcuagaggauacauaaguacaagaguugaaaugggagaagccgcaggaauauucaugacugcuaccccuccgggaucaagggauccuuuuccacaaucuaaugcuccaaucauggacgaagaaagggaaauuccggaaagaaguuggaacucaggccacgaauggguaaccgauuuuaaaggaaaaaccgucugguuuguacccaguauaaaagcugguaaugacauagcagccuguuugaggaaaaacgguaagaaagucauucaacuuuccaggaaaacauucgacagugaauauguuaaaacaagggcgaacgacugggauuuuguaguaacaacagacauaagugagaugggagcaaacuuuaaagccgaacgaguuaucgauccgcgaagauguaugaagccagugauccuuaccgauggcgaggaacgagucaucuuggcaggaccuaugccuguuacgcauuccucagcggcccaaagaagaggcagaaucggacguaauccaaagaacgaaaacgaccaauauauauacaugggugaaccacuagaaaaugacgaggacugugcccacuggaaggaagcaaaaaugcuguuagacaacauaaauacuccggaaggcauaauaccgucaauguuugaaccugaacgugaaaaaguugaugcuauagauggugaauaccgacuacguggcgaggccagaaagacauuuguagaccuaaugcgacguggagacuuaccaguaugguuagcauacagaguagcugcagaagggauaaauuacgcagauagaagaugguguuucgauggcaucaagaauaaccaaauccucgaagagaauguagaagucgagaucuggacaaaagaaggcgaacgaaagaaacuuaaaccaagguggcuagaugcaagaauauauuccgauccacuagcacuuaaagaauuuaaagaauuugcagcaggacgaaaaucauugacacuaaacuuaauaacagagaugggcagacucccuacauuuaugacgcagaaggcaagggaugcguuggauaaccucgcagugcuacacacugcagaagcaggcggacgugcuuauaaucacgcauuaagugagcuacccgaaacuuuagagacauugcuccuuuuaacucugcuagcaacaguuacaggaggcauauuuuuguuucuaaugucaggaaaaggaauuggaaaaaugacuuuaggaauguguugcauaauuacagcguccauucuacuaugguacgcucaaauucagccacauuggauugcagcgucaauaauauuagaguucuuccuuauaguauuacuaauuccugaaccugaaaaacagcgaacaccacaagacaaucaauuaacauauguggugaucgcaauacuuaccgugguagcagcaaccauggcuaaugaaaugggauucuuggaaaagaccaagaaagaccuuggacuaggcaguauuaccacccaagagucugagagcaacauuuuagacauagaucuaagaccugcgucugcguggacacuauacgccguagcaacuacauuuguuacaccgauguuacgccauagcauagaaaauagcucuguaaauguuagcuuaacggcaauagccaaucaagcaacuguuuugaugggacuagggaaaggauggccuuuauccaaaauggacauuggcgucccgcuauuagccauuggcugcuauagccaaguaaauccaauuacauuaacagcagcgcuauuauuguuggucgcucacuaugcuauaauaggaccgggcuuacaagcgaaagcgacuagagaagcucaaaaacgcgcugcugccgguauaaugaaaaauccaaccguugacggaaucacaguaauagacuuggaaccaauuccuuacgaucccaaauuugaaaaacaauuaggucaaguaauguuauuaauucucugcguaacucagguccuaaugaugagaacaacaugggcacucugugaagcguuaacuuuagcaacuggaccaaucucuacgcuuugggaagggaauccggggagauucuggaauacaaccauugcggucucaauggcuaauauuuuuagaggcaguuaccuagcgggggcaggucuccuauucucaauaaugaaaaacacuacuaacacaaggcgcggcacaggaaauauuggagaaaccuugggugaaaaauggaaaagcagacucaacgcauuaggaaaaagcgaguuccaaaucuauaagaaaucuggcauacaagaaguagauagaacauuggccaaagagggcaucaaaagaggagaaacugaccaucacgcagucagccgaggcagugcaaaauugagaugguucgucgaaagaaacaugguuacaccugagggaaaagugguagaccuagguuguggacguggagguuggagcuacuauugugggggucuuaaaaacguaagagaagugaaaggcuuaacaaaagggggaccgggacaugaagaacccauucccaugucaacauauggauggaaccuaguuagauugcaaaguggcguggacguauucuuuacaccaccugaaaaaugcgauacgcuuuugugugauauuggagaaaguucgcccaauccaaccauugaagccgggagaacacuuaggguucuuaauuugguugaaaacuggcugaacaauaacacucaauucuguauaaaaguccuaaauccguacaugcccucaguaauagaaaagauggaaacucuucaaaggaaauacggaggugcauuggugagaaauccccuaucaagaaauucuacacacgaaauguacuggguuucaaacgcaacaggcaacauaguauccaguguuaauaugaucucaagaauguuaauaaacagauucacaaugaagcauaaaaaggcaacauacgagccggauguagaccuagguagcgguacucggaacauuggaauagaauccgagauaccaaauuuggauauaauugggaagcgcauagagaaaauaaaacaagaacaugaaacuucguggcauuacgaccaggaucaccccuauaaaaccugggcguaccacgguucguaugaaacgaaacagacggguagcgcaucuagcaugguuaacgggguagugcgauuacuuacgaaaccaugggaugucguacccaugguuacgcagauggccaugacugauacaaccccuuuuggacaacagaggguuuuuaaggaaaaaguggauacaagaacacaagaacccaaagaaggaacuaagaaacucaugaagauaacagcugaaugguuauggaaggagcuaggcaagaagaaaacuccaagaaugugcacucgggaagaauuuacacguaaaguaagauccaaugcagcguuaggagccauauuuacggacgaaaauaaauggaaaucagcacgugaagcaguggaagauuccagguucugggaacugaucgauagagaaagaaaccuacauuuagaaggcaaaugcgaaacaugcguuuacaacaugauggggaaacgugaaaagaaacugggagaauuuggcaaagcuaaaggaagucgugcaauaugguauaugugguugggagcgcgguucuuagaguucgaagcgcuaggauuuuuaaacgaagaucauugguuuucccgaggcaauucucuaucaggaguugagggggaggggcuacauagguuaggauauauccucagagauguuucaaagaaggaaggaggagcaauguacgcagacgacaccgcgggaugggauacccggauuacucuagaagaccucaaaaaugaagaaauggugaccaaccacaugaaaggagagcauaaaaagcuagcagaagcuauauuuaaauugacauaucaaaauaagguuguucgagugcaacgaccuacuccacgaggaaccgucauggacauuauaucgagacgagaucaacgaggaaguggccaggugggaacuuacggacuaaauacuuuuacuaauauggaggcacaauugauucgacaaauggaaggggaagguauauuuaaaucuauacaacaucuaacugugacagaagagauugccgugcagaauuggcuagcaagaguaggaagagaacgacuaucgcggauggccauaaguggugaugauuguguaguuaaacccuuagaugaccgcuuugcuagugcgcugacugccuugaaugacaugggaaaaguccgaaaagauauucagcaaugggaaccaucaagaggauggaacgacuggacucaaguaccauucugcagccaccauuuccaugagcuaguuaugaaggauggcagaguauuaguaguaccuuguagaaaccaagacgaacugauuggacgagcgagaaucucucagggagcagguuggucacugaaagaaacagcuugucuagggaaaucguaugcacaaauguggacccuaauguacuuucaucggagagaucucagacuagcugcuaaugcuauuuguagcgcaguuccaucccauuggguaccaaccucgaggacuacuuggaguauacaugcgaaacaugaauggaugacuacggaggauaugcuggcggucuggaauaggguauggauucaagagaacccguggauggaggauaaaacgccgguagaaagcugggaagagguuccguaccuggguaaaagagaagaucagugguguggaucgcuaaucggacuaacauccagagcaacaugggccaaaaacauucagacagcaauuaaccaaguaagaucauuaaucgguaacgaagaauauacggacuauaugcccucgaugaaaagauuucguaaggaagaagaggaagcaggaguccuaugguga

SEQ ID NO: 22635 - RNA, 9876 nt, Artificial Sequence
  derived and/or modified CDS sequence (opt6) from DENV-2__EU482745__SS-prME
acagcggguguaauaauaaugcuuauaccuaccgcuauggcguuucauuuaacaacuagaaacggggaaccucauaugauagucgggagacaagaaaaaggaaaaagucuacuauuuaaaacggaagaugguguaaacaugugcacacucauggcuaucgaucugggugagcuaugcgaggauaccauaacuuauaaaugucccuuacuaagacagaaugaaccagaagauauagauuguugguguaauucaacauccacauggguaaccuaugguacaugcacuaccacuggagagcauagaagagagaaaagaucaguagcccuaguuccucacgugggaaugggacuagaaacgagaacggaaacguggaugaguucagagggggcauggaaacauguacaacgcauagaaacauggauauuacgccauccugguuucacuaucauggcagcgauucuagcuuacacaaucggaacaacacauuuucagagagcccucauauucauccuacucacugcgguagcaccaagcaugacuaugcgcuguauagggauauccaauagggauuucgucgaaggaguaaguggcgguucauggguagacauuguucuugaacauggcagcugugugacaaccauggcuaaaaauaaaccaacgcuggacuuugaacuaauuaaaaccgaagcaaaacaaccugcgaccuuaagaaaauacugcauagaggcaaaacugacgaauacgaccaccgagucucguuguccaacgcagggagaaccaucauuaaacgaagaacaggacaaacgauucguguguaaacauucuaugguagaccgagguuggggcaauggaugcggacuuuucggcaaaggcggaaucguaacuugcgcuauguuuacuugcaagaaaaauauggaagguaaaguuguucuaccagaaaaucuagaguauacuauuguaauaacuccgcacaguggugaggaacaugcaguagguaaugacacagguaaacacggaaaagaaauuaaaaucacuccccaaucaaguauaacggaagcagaacuuaccgguuauggaacgguuacuauggaauguaguccccgaacugguuuggauuuuaaugaaaugguuuuacuacaaauggaagauaaagcauggcugguacaccgacagugguuccuagaucugccucuacccuggcugccuggagcggacacacaaggcaguaauuggauucaaaaagagacgcuaguaacauucaaaaacccgcacgccaagaaacaagauguggugguauuaggaucucaagaaggagcaaugcauaccgcgcuuacgggagcaaccgagauacaaauguccucgggaaacuuacuguucacugggcaccuaaaauguagacucagaauggauaaauuacaguuaaaaggaaugaguuacaguaugugcacgggcaaauucaaaaucgucaaagaaaucgcagaaacacaacacgggacaauagugauaagggugcaauacgagggggaugguucgccauguaaaauaccauucgaaauaauggaucuggagaaacgccacguguuagguaggcuaaucaccgucaaccccauuguaacugaaaaagauucgcccguaaauauagaggccgagcccccauucggggauagcuauauaauaauaggcguagagccuggccaacuaaaauugaauugguucaagaaagggaguagcauaggucagauguuugaaacaaccaugcggggugcgaaaagaauggcuauucucggcgauacggcgugggauuuugguucccuagggggaguauuuacgucaaucgggaaagcgcuccaucaaguguuuggagcuauauauggagcugcauuuucgggcgucuccuggacaaugaaaaucuuaauuggaguaauaauuaccuggauaggaaugaacucaagaucaacaucuuugucaguaaguuugguauuaguaggcgugguaacacucuauuuaggggcuaugguccaagccgauagugggugcgucguaucguggaaaucuaaagaauuaaaaugcggcaguggcauauuuauaacagauaacguucacacauggacugaacaguauaaauuccagccugaaagcccaaguaaacuugcgagugcaauccaaaaagcucaugaagaaggaauuugcggcauaagaucggucacaagauuagagaaucuaauguggaaacaaauaacaccugaacugaaucauauacuaagcgaaaacgagguuaaauuaacaauaaugaccggagauauaaaagguauuaugcaagcugguaaacguagucuaagaccacagccaacugaauuaaaauacagcuggaagacauggggcaaagccaaaaugcugucuacagaaagccacaaccguacauuucugauugacggaccagaaacagccgaauguccaaauaccaaccgagcauggaacucccuagaagucgaggacuaugguuuuggcguguuuacaaccaauauauggcuaaaauugagagaaaaacaagauguguuuugugacucaaagcucaugucugcugcaauaaaggacaauagggcaguccaugcugauaugggauacuggauagaaucagcauuaaaugacacauggaaaauggaaaaagcaucguuuauugaaguaaaaaguugucauuggccuaaaucgcacacucuauggaguaauggaguacuggaaucagagaugauaauucccaagaacuucgcugguccuguaagucaacacaauuaucgaccaggguaccacacccagacagcaggaccauggcauuuaggcaaauuagaaauggacuucgauuuuugugaaggcacaacugugguagugacagaagacuguggaaacaggggaccgucacuacggacaacuacagcauccgggaaauuaaucaccgaaugguguugccgcagcugcacucuaccaccguuaagguaucggggugaggacgguugcugguacggaauggaaauaaggccauugaaagagaaagaggaaaacuugguuaacucucuaguaacugcaggacauggacaaauagauaauuuuucacuuggcguacuagggauggcccuauuucuagaagaaaugcuaagaaccagaguggggacuaaacaugcuauacuacucgucgcaguaucuuucguaaccuuaauuacgggcaacaugagcuuucgggaucuagggcgaguaaugguuauggugggagcuacaaugacggacgacauaggaaugggcgugaccuaccuugcguuauuagcagcguuuaaaguuaggccgacguucgcugcuggucuuuuacuaaggaaauuaacaaguaaagaacuaaugauggcgacgauagguauagcauuacuaucacaaaguacaauuccagagacaaucuuagaauuaacagaugcauuagcuuuggggaugauggugcuaaaaauaguuagaaacauggaaaaauaucaacuggcggucacuauaauggcaauaucaugcgugcccaacgcaguaauauuacaaaaugcauggaaagugucguguacuauacucgcugccguaucaguguccccuuuacuauugacuucuucacaacagaaggcagauuggaucccacuagcccugacuauaaaaggauugaauccuacagcuauuuuucucaccacuuuaagccgaacaaguaaaaagaggucauggccacuaaacgaagcuauuauggcuguagggaugguaucaauccuagcgagcucauuacucaaaaaugacauccccaugacaggaccgcugguagccggaggguuacugacaguguguuacguuuugacagggcgaucggcagacuuagaacuagaacgagcugcugaugucaaaugggaagaucaggcggaaauuucaggaucgucaccuauauuaagcauaacuauaucagaagauggaucuauguccaucaagaaugaggaagaggaacagacauugacaauacucauaagaaccggcuuauuagugauaaguggcgucuuuccggugucuauaccaauaacggcggcggcuugguauuuaugggaagucaagaaacagagagccgguguacuuugggacguucccaguccaccacccguugggaaagcagaauuggaagacggagcauauagaauaaaacaacggggcaucuugggguacucccaaauaggagcggguguauauaaagaagguacauuucauacaauguggcacguaacccgcggugccguauuaaugcaucgcgguaaacguauugaaccaucuugggccgauguuaagaaagacuugauaagcuacggggguggcuggaaacuagaaggcgaauggaaagagggugaagagguccaaguguuagcgcuugaaccagggaaaaacccaagagccguccaaacaaaaccgggacucuuuaagacaaauacuggaacuauaggagcagugucacuggauuuuucacccgguacaucugguagcccgauuguagauagaaaaggcaagguagugggccuauauggaaacggagucguaacuagaucuggcgcauacguuucagccauagcccagaccgaaaaguccauugaggacaauccugaaauagaggacgauauauuucgaaagaaaaggcucacaauaauggauuuacaucccggggcagggaagacgaaacgauacuugccugcuauuguaagagaagccauaaaacgugguuuacgcacacuaauucuggcucccacccgcguaguugcggcugagauggaggaggcauuacguggacuaccgauaagguaccaaaccccagcaauaagagcagaacacacaggaagagaaaucguagauuugaugugucaugcuacauucacaaugagguugcuaucuccuguaaggguaccgaauuauaaucugauuauaauggaugaagcgcauuucacugauccagcgagcauagcagcaagaggauacauaucaacaagagucgaaaugggagaagcggcaggcauauuuaugacagccacacccccuggauccagagaucccuucccccagagcaaugcaccaaucauggaugaggagcgagaaauaccugaaagaucuuggaauagcgggcacgaauggguaaccgacuuuaagggaaaaacuguuugguucguaccaagcauaaaggcuggcaacgauauagccgcgugcuuacggaaaaacggcaagaaaguuauucaacuuagucgcaagacauucgauucggaauauguaaaaacacgugcgaaugauugggacuuuguaguuacaacagauauaucagaaaugggugcaaacuuuaaggcagaacgaguaauagauccuagaagaugcaugaaaccggucauucugaccgacggagaggaacgaguaaucuuagcgggcccuaugccagucacgcauucaucagcagcgcaacgaagagguagaauagguagaaauccgaaaaaugagaaugaucaauacauauacaugggagaaccauuagagaaugaugaggacugcgcacauuggaaagaagcaaagaugcuccuagacaauauaaauacgccugaaggcauuauuccgucaauguuugaaccagagcgggaaaaaguugaugcaauagauggugaauauagacuaaggggagaagcacgaaaaacguuuguagauuuaaugcgccgaggugacuuaccaguauggcuagcauaucgagucgcagcagaagguauaaacuacgcggacagacguuggugcuuugacggaauuaaaaauaaucaaauauuagaagaaaauguggaaguagaaauauggacgaaagagggagagaggaagaaacuuaaacccagaugguuggaugcaaggauuuacucagacccguuagcucuuaaagaauuuaaagaauuugccgcaggccgcaaaagucuaacauugaauuugauaacagaaauggguagauuaccaacauuuaugacacaaaaagcgagagacgccuuagacaauuuagcaguacuacauacagcugaagcgggcggacgggcauauaaucacgcuuuaucagaacuaccagaaacacucgaaacacuacuauuauugacauuguuagccacgguaacugggggcauauuucuauucuugaugucugguaaaggaauaggcaagaugacauuagggaugugcuguauuauuacagcuucuauccuacuaugguacgcgcaaauacaaccccauuggauagccgcaucaauuauauuggaguucuuuuuaauagucuuacuaauacccgaaccagagaaacaacggacaccucaagauaaucaacuaacauacguugugauagccauucuuacaguaguagcagccacaauggcgaacgaaaugggauuccuagaaaagacuaaaaaggauuuaggcuugggaaguauaacgaccaaagaaucugaaucuaacauauuagacauugaccuccguccugcuucagcauggacuuuguaugccgucgccacaacauuugugacccccaugcuacgacacaguauagaaaacucaaguguuaauguaucacuaacagcaauugcaaaucaagcaacagucuuaaugggguugggcaaaggauggccauuaaguaagauggacaucggaguuccuuuacuagcuaucggcugcuauucgcaaguaaacccaauaacuuugacagcagcguugcuauuguuaguagcccauuacgccauaauagggccuggguuacaggcaaaagcaacuagagaagcgcaaaagagagccgcagcgggaauuaugaaaaaucccacugucgacggaaucacuguaauagacuuagaaccuauaccauacgacccgaaguuugagaaacaauuggggcaaguuauguuauuaauucuaugcguuacgcaaguuuuaaugaugagaacaacuugggccuuaugcgaagcucugacgcuugcaacaggucccauuucaacacugugggaagguaauccgggcagauuuuggaauaccacgaucgcaguuucuauggcaaauauuuuucguggcucauaucuagcuggcgccggucuacuauuuucgaucaugaaaaauacaacaaacacacgaagagggacugguaauauuggggagacucuaggagaaaaguggaaauccaggcuaaacgcccuaggaaaaagugaauuucaaaucuacaagaaaagcggcauacaagaagucgacagaacacucgcaaaagagggaauuaagcgaggagaaacagaucaccaugccguuucgcgcggaagcgcuaagcuaagaugguuuguugagcguaauauggucacaccggagggcaagguaguagaccuugguugcggaagaggagguugguccuacuauuguggaggccugaaaaauguuagggaaguaaaagggcuaacaaaaggcggaccaggccacgaggaacccauuccuauguccacuuacggauggaaucuuguaagauuacaaucuggcguggacguauuuuucacaccuccugaaaaaugugauaccuuguuaugugauauuggagaaaguucaccaaacccaacaauagaagcagguagaacacuucggguucucaaccuaguggaaaacugguuaaacaauaauacacaauuuuguauuaagguauugaaucccuauaugccuucaguaauagagaaaauggagacauuacaaaggaaauacggaggugcuuuaguaaggaacccccucuccaggaacucaacacaugaaauguacuggguuaguaacgcaacuggcaauauaguauccucaguuaacaugauaagccgaauguuaaucaauagguucacgaugaaacauaagaaagccacauacgagcccgacguagaccugggaagcggaacgcgaaacaucggaaucgaauccgaaaucccaaauuuagacaucauuggaaagaggauagagaaaauaaaacaagaacaugaaacaaguuggcauuaugaccaggaucacccauacaagacaugggcuuaucacgguucuuacgagacuaaacaaacaggcucagcgucgagcaugguuaauggaguugugagauuacugacaaaaccuugggacguaguaccuauggucacucaaauggcuaugaccgacaccacaccauucggucaacagcgcguauuuaaagagaaaguugauacaaggacucaagaaccuaaagaagguaccaagaaacuaaugaaaaucacagccgaaugguuauggaaggaacuuggcaagaagaaaacacccaggauguguacaagagaagaauuuacacguaaagucagaagcaaugcagcucucggcgcaauuuuuacugacgagaauaaguggaaaagugcacgugaagcaguagaagauucccguuucugggaacuaauagaccgugaacguaaucuccaucuggaaggaaagugugaaacuuguguuuauaacaugauggguaagcgagaaaagaaacuaggcgaguucgguaaagcaaaaggaucucgcgcaauaugguauauguggcucggagcaagauuucuugaauuugaagcauuaggcuuccucaaugaggaucauugguucagccgaggaaauucacuuucuggaguugaaggugaaggucuacauagacugggauauauucugagagauguguccaagaaagaaggaggggcuauguacgcugacgacacagccggaugggauacgaggaucacccuagaggaccucaaaaaugaagaaauggucacaaaucauaugaaaggugaacauaagaaacuugcagaggcaauuuucaaacugaccuaucaaaauaaaguggucagagugcaaagaccgacaccgagaggaaccguuauggauauuauuucuagaagagaccagagaggaucaggucagguaggaacauacggccucaauaccuucacaaauauggaagcucaguuaauacgacaaauggaaggggaagguauuuuuaaaucaauccagcaccuaaccgucacagaagagauagcuguacaaaacuggcuugcgagaguaggacgagaaagguuaagccgcauggcuauuaguggagaugauugcguggucaaaccgcuagacgaucgguuugcuagugcauugaccgcacuuaaugauaugggcaagguucgcaaggacauccaacaaugggaacccagucggggauggaacgauuggacacaaguuccuuuuuguagucaucauuuucaugaguuggugaugaaggauggaaggguucuaguagucccguguagaaaccaagacgaauuaaucggccgagcgagaauaucacaaggugcgggcuggucuuuaaaagaaacagcuuguuuagggaaaucuuaugcgcagauguggacauuaauguauuuucaucgaagggauuuaagauuggcggccaaugcuauauguucggcaguaccuagccacuggguaccaacgucaagaaccacgugguccauacaugccaaacacgaguggaugacaacugaagauauguuggcaguauggaauaggguauggauccaagagaaucccuggauggaggauaagaccccuguagaaagcugggaagagguaccauaccuaggaaagcgugaagaucaauggugcggaucuuuaauaggauuaacuagcagagcuacaugggcgaagaacauacaaacagcgauaaaucaagugaaaucucuuauagguaacgaagaauauacggacuauaugccgucuaugaagcgcuuccgaagagaagaggaagaagcuggaguacuaugguga

SEQ ID NO: 22636 - RNA, 9876 nt, Artificial Sequence
  derived and/or modified CDS sequence (opt6) from DENV-2__EU482746__SS-prME
acggcaggaguuauuauuauguuaauaccgacggcuauggcuuuucauuuaacuacccgaaauggggaaccacauaugauagucggacgacaggagaaaggaaaaagucuacuauucaaaacugaagauggaguaaauaugugcacucugauggcaauagacuuaggagaguuaugcgaagauacuauuacauacaaaugcccacugcuaagacaaaaugaaccggaagauauagauugcuggugcaauaguacgagcacaugggucacauacggaacaugcacgacuacgggagaacaucgucgggagaaaagaucgguggcccuagugccgcauguuggaaugggccuagaaacuagaacagaaacauggauguccucggagggagcauggaaacauguucagagaauugaaacauggauucuacgacauccaggauuuacuauaauggcugcuauacuagcuuauaccauaggaacuacccacuuccaacgcgcacuuauauucauacuacucacagcugucgcaccgucaaugacgaugagaugcauagguauaaguaaccgcgauuucguugaaggcguaagcggcggcaguuggguagacauaguacuagaacaugguucaugcguaacaacaauggcuaaaaauaaaccaacgcucgacuuugaacugauaaaaacugaggcaaaacaaccggcaacucugagaaaauacuguauugaggcaaaacucacaaacaccacuaccgaaucacgaugcccaacgcagggggaaccgucauuaaacgaagaacaagauaaaagauuugucugcaaacacucaaugguagacagaggguggggcaacggaugcggacuauuuggaaaaggagggauaguuaccugcgcgauguuuacguguaagaaaaauauggaaggaaaagucguucugccggaaaauuuagaauauacuauaguaauuacgccacacagcggggaggaacaugccguaggcaaugauacgggaaaacaugguaaagaaaucaaaauuaccccacaaucuaguauuacugaggcugaauuaacaggauauggaacugugacuauggaauguaguccccgaacaggcuuggacuuuaacgaaaugguauuacuacaaauggaggacaaggcuugguuaguacaccgacaaugguuuuuagaccuuccauugcccuggcuuccaggagcggacacgcaaggcuccaacuggauacaaaaagaaacccuugucacauuuaaaaacccgcaugccaagaaacaagauguagugguccuggggucacaggaaggugcaaugcacacagcguuaacgggagcuacugagauacaaaugaguagcgggaaucuauuauucaccggucaucugaaaugucguuuaagaauggauaaacuacaacugaaaggaaugucguauucuaugugcacagguaaauuuaaaauaguaaaagagaucgcggagacacaacacgguaccauuguaauaagaguccaauacgagggggacgguucacccuguaaaauaccuuuugaaauaauggaccuagagaaaaggcaugugcuuggaagauuaaucaccgugaaccccauaguaacggagaaagacucaccuguuaauaucgaagcggagccuccauucggggacaguuacauaauaauaggaguggaaccaggacaacuuaaauuaaauugguuuaagaaaggaucaucaauugggcaaauguucgaaacgaccaugaggggagcaaaaagaauggcaauccugggagauacugcgugggauuucggguccuuagguggaguauuuaccaguauaggaaaagccuuacaucaggucuucggugccauuuacggagcagcuuuuucugggguuucguggacaaugaaaauauuaauaggugugauuauuacguggauuggcaugaauaguaggaguacgagucucaguguuucucuaguccuuguaggggucgucacacuauaucuaggcgcuauggugcaagcagacucagguuguguugugaguuggaaaagcaaagaacuaaaaugugggaguggaauauuuauuacggacaacguccauacguggaccgagcaauauaaguuccagccagaaagccccuccaaacucgcuucugcgauucaaaaggcacacgaagaaggaauaugcggaauacgaagcguaaccagguuagagaaucuuauguggaagcagauaacccccgaacuaaaucauauauuaucagaaaacgaaguuaaacucacuauaaugacaggugauaucaaaggaauuaugcaagcaggcaagagaaguuuacguccacaaccgacagaauuaaaauauucauggaagacauggggcaaagcgaaaaugcugaguacugaaucgcauaacagaaccuuuuugauugacggaccggaaacagcggagugcccaaauacaaauagagcauggaauagccuagagguugaagacuacggauuugguguauucacuaccaauauauggcuuaaguuaagagaaaaacaggauguuuucugugauuccaaauugaugagugcugcaauuaaagacaaucgggcagugcacgccgauaugggcuauuggauagagucugcccugaaugacacauggaagauggagaaagccaguuucauugaaguaaaaucaugucauuggccuaagucacacacucuauggucaaaugguguccuagagucagaaaugauuauacccaaaaauuucgcaggucccgugucucaacauaauuaccggccuggguaccauacacaaacagcggguccauggcauuugggaaaacucgaaauggauuucgauuucugcgaaggaacuacuguugucgugacagaggauuguggaaaucgugggccaaguuugcguacuacuacagcauccggaaaauuaauaacugaaugguguugcagaagcuguaccuuaccaccccuccguuaucguggugaggauggaugcugguacgguauggaaauacgcccacugaaggaaaaagaagaaaauuuaguaaacucguuagugaccgcgggucauggccagauagauaacuucagucuaggagugcuaggcauggcucuuuuccuggaagaaauguuaagaacccguguagguaccaaacaugcaaucuuguuaguggccguaucuuucguuacucuaauaaccggaaauaugaguuuuagagaucuaggccgaguaaugguaauggucggagccacgaugacggaugauauuggaaugggcgucacauaccuugcucuuuuggcggcauuuaaaguaagacccacguucgccgcuggauugcucuuaagaaaauugacgucaaaggaacugaugauggcaaccaucgguaucgcauugcuuagucaaucaacaauuccagaaacaauacuagagcuaacggacgcacuggcucuaggcaugaugguacuuaaaauagugagaaacauggaaaaauaucaacuagccgucacaauuauggcgauaucguguguuccaaaugccguaauauuacagaacgcauggaaaguaaguugcaccauucucgcagccguuucgguaagcccccuucuacuuacaagcucucaacagaaagcagacuggauaccauuggcacugacaauaaaaggacucaauccaacugcuauauuuuuaaccacauuaagccggacgaguaaaaagagaaguuggccuuuaaacgaagcaaucauggcagucgguaugguuuccauucuugcaagcucgcuauuaaagaaugauauaccgaugaccggaccucucgucgcaggagguuuacuuacgguaugcuauguuuuaacaggcagaucggcagauuuagaguuagaacgagcagccgauguaaaaugggaagaucaagcggaaauaucagguagcaguccaauucuaucgauaacaauaagcgaagacggauccaugucaaucaaaaacgaagaagaggaacagacccugacaauacuaauacgaacuggcuuguuggucauaagugguguuuucccagugucaauuccuauaacugcagccgcaugguaccuaugggaggucaagaaacagcgagccgguguguuaugggauguaccguccccuccaccaguuggaaaagcagaauuagaagauggagcauaccgaauuaaacagcggggcauucuagguuauagccaaauuggcgccggaguuuacaaagaaggaaccuuccauacuauguggcauguaacgcgaggggcuguccucaugcacagaggaaaacggauugaaccaucuugggcagauguaaagaaagaccuaauuaguuacggcggcggcuggaaauuggaaggugaauggaaagaaggagaagaaguacagguauuagcguuggaaccugggaaaaauccucgagcuguacagacaaaacccggauuguuuaagaccaacaccggcacaauuggcgcaguaucguuggauuucaguccgggcaccagcggguccccaaucguugaucgaaaaggaaaaguagucggauuauauggaaacggaguagucaccaggaguggugccuauguaagugcuauugcccaaacagagaaaucaauagaggacaaucccgaaaucgaagaugauauuuuuagaaagaaacgacuaacaauuauggaccuacauccaggagcagguaagacaaaaagguauuuaccagcgauaguacgggaggcaauaaaacgaggacuaagaacacuaaucuuagcuccaacuaggguaguagcagcagaaauggaagaagcguuaaggggacuaccgauaagauaucagacaccggcuauuagagccgagcacacgggaagagaaauaguugaccuuaugugucaugcaacuuucacaaugcgacuucucucaccaguacggguacccaauuauaauuuaauuauaauggacgaagcgcacuuuaccgauccagcuucgauugcugcacggggguacauaucaacgagaguugagaugggugaagcagcagguauauucaugaccgcaaccccuccagguagcagagacccauucccccaaucaaacgcgcccauaauggaugaagaaagagaaauuccggaacguucuuggaacucaggccaugaguggguaaccgacuuuaaaggaaagacaguuugguuuguaccaucaauuaaagccggcaaugacauugccgcuugccugagaaagaacggcaagaaaguuauccaguuaucaagaaaaacauucgauagcgaguaugugaaaacacgagccaaugacugggacuuuguaguaacaacagauauaucagaaaugggagcaaacuucaaagcugagagagugauagauccaagacgaugcaugaaacccguuauucucacugacggagaggaacgagugauucucgccgggccaaugccuguaacacauucaucugcugcacaaagacgaggaagaauuggcaggaaccccaaaaaugaaaacgaucaauauauauacaugggcgagcccuuagaaaacgaugaagacugcgcgcauuggaaggaagccaaaauguuauuagacaauauuaauacaccagaaggcauaauaccaucuauguuugaacccgagagagagaaaguugacgcaauagacggugaauauagauuacgaggggaggcacgcaaaacauuuguggaucugaugagacgaggagaccugccgguuugguuagcauauagaguggcagccgaagggaucaacuaugcagaccgacgauggugcuuugauggcaucaaaaauaaccaaauacuugaagaaaauguggaaguggaaauauggacaaaagaaggcgaacgaaagaaauugaaaccacggugguuagacgcacguaucuauagugaucccuuagcacugaaagaauuuaaagaauuugcagcuggacgcaaaucguuaacgcuuaauuugauaacugaaaugggucguuugccgaccuuuaugacacaaaaagcucgggaugcccuagauaauuuagcgguguugcauacugcugaggcagggggccgcgccuauaaucaugcguuaucagagcuucccgaaacacuugaaacucuauugcuacuaacuuugcucgcaacagucaccggaggaaucuuccuauuuuuaaugucuggaaagggaaucggaaagaugacacuuggaauguguuguaucauaacagcaucaauauugcuaugguacgcacaaauacaaccccauuggaucgccgcgucaaucauucuugaauuuuucuuaauagugcuauuaauacccgaaccugaaaaacaacgcacgccucaggauaaucagcuuacauacgugguuauagcuauuuugacuguaguagcagcaacaauggcuaacgaaaugggcuuccucgaaaagaccaaaaaggaucuaggauuggggucuaucacgacgcaggaaucagagagcaauauacuagacauagaccuaaggccugcaagugcuuggacgcuuuaugccguagcuacaacuuuuguaacaccaauguuacgucauagcauagaaaauaguaguguaaacgucaguuugacagcgaucgcgaaucaagcaacgguuuuaaugggacuuggaaaaggguggccccugucaaaaauggacauagguguaccacugcuugcaauaggguguuauagccagguaaacccaauaaccuuaacggccgcauugcuucuacuuguagcacauuacgcgaucauugguccuggacuacaagcuaaagcaacaagagaagcacaaaaacgcgcugccgcugggaucaugaaaaacccaacaguugacggaauaacaguuauagauuuggaaccaauaccauaugauccgaaauucgaaaaacaauugggacaaguaauguuauuaauccuaugcguuacacaaguauuaaugaugcguacaacaugggcauugugugaagcucuaacccuugcgacaggucccauaaguacucugugggaaggaaauccgggccgauuuuggaauacuacgauagccguuaguauggcuaauauauucagagguagcuaucuggcaggggcaggacuauuauuuuccauuaugaaaaacacuacuaauacaagaagagggacaggcaacauaggagagacccucggcgaaaaauggaaaagucgcuuaaacgcauugggaaagagugaguuucaaauauauaagaaaaguggcauucaagaaguagaccggacuuuggccaaggaggguauuaagagaggcgaaacagaccaucacgccguuagcagaggauccgccaaauugagaugguuuguagaacgaaacaugguaacaccugaaggcaagguagucgaucuaggcugcgggcgcgguggcuggagcuacuauugcggaggacucaaaaacguuagagaaguaaagggacuaacaaaaggaggaccgggacaugaggaaccaauaccuaugaguacauauggauggaauuugguaagauuacaaucuggugucgauguauucuuuacuccgccggagaaaugugauacuuuacugugcgacauuggcgaaucaaguccaaacccuacaauagaagcaggacguacacuacgaguacuaaauuuaguggagaacugguuaaauaauaauacacaauucuguaucaagguucuaaauccauauaugccgucagucauugagaaaauggaaacccuacaacgcaaauauggcggggcauugguucgcaauccgcuaucacgaaacaguacccaugagauguacuggguaaguaaugcuacggguaauauaguuuccucgguaaauaugaucucacguaugcugauuaaucgauuuaccaugaaacauaagaaagcaaccuaugaaccugauguggauuuggggucuggaacaagaaauaucggaauagaauccgaaauaccuaaccuggacauaauaggaaaaagaauagagaaaauuaagcaagaacaugagaccuccuggcauuacgaccaggaucacccuuauaaaacaugggcauaucauggaucguacgagaccaaacaaacuggauccgcaaguaguauggucaauggaguugugagacuccuaaccaaacccugggaugucguuccaauggugacucaaauggcgaugacagauaccacuccauuuggccaacaacguguauuuaaggaaaaaguugauacgagaacgcaagagccaaaagaaggaacaaagaaacucaugaaaauaacagcagaaugguuauggaaagaauuagggaagaaaaagacuccucguauguguacacgugaagaauuuaccagaaaagugcgcucaaaugcugcacuuggagcaauauuuacagaugagaauaaguggaaaucagcacgagaagcuguugaagauucuagauuuugggagcuaauagacagagagcguaaccugcaucuugaggguaaaugugaaacaugcguauacaacaugauggggaaaagagagaagaaacucggcgaguucggaaaggcuaaagggagccgagcaauuugguauaugugguugggugcacguuuccuagaguuugaagccuuaggauuucuuaaugaagaccauugguuuucacguggcaacucauuaucugguguagagggcgaaggccuacauaggcuaggcuacauuuugagggacgucagcaagaaagagggaggagcuauguacgcugacgauacggcagguugggauacacguauaacauuggaggacuuaaagaaugaagaaauggucacaaaucacaugaaaggagaacacaagaaacuagccgaggccauuuucaaauuaacauaccagaauaaaguuguaagaguucagaggccaacgccccgggguacagugauggacauaauaagccgucgugaucaaaggggauccgggcaaguggggacauauggauugaauacauucacaaauauggaagcccaacuaauuagacaaauggaaggugaaggaauuuucaaaucuauacaacaucuuacgguaacggaagaaauugcuguacaaaacugguuagcuagagucggaagagaaagauuaaguagaauggccauaucaggugacgauugugugguaaaaccacuagacgauagguuugcuagugcucuuacggcucuaaacgauaugggaaaagucaggaaagauauacaacaaugggaaccaucaaggggauggaaugacuggacacaagugcccuuuuguucacaucauuuccaugagcugguaaugaaggacggcaggguuuuaguaguaccaugucgaaaucaagaugaacugauuggccgugcgcguauaagucagggggcaggauggagucucaaagaaaccgcgugucuggguaaauccuacgcucaaauguggacucucauguauuuccaucgacgcgaucuaagacuagcugcaaaugcgauauguagugcaguaccaagucauugggugccgacaagucgcacaacuuggaguauccaugcuaagcaugaguggaugacaacagaggacauguuagcgguauggaauagggucuggauucaggaaaacccguggauggaagauaaaacuccaguagaauccugggaagagguaccauaucuuggaaaacgugaagaccaauggugcggcagcuugauaggucugacaaguagggcaacaugggccaaaaacauccaaacagcaauuaaucagguuaggagcuuaauugggaaugaagaauacaccgauuacaugcccucaaugaaaagauucagaagagaagaagaagaagcgggaguauuaugguaa

SEQ ID NO: 22637 - RNA, 9876 nt, Artificial Sequence
  derived and/or modified CDS sequence (opt6) from DENV-2__EU482590__SS-prME
acugcuggaguaauuaucauguugauaccaacugcaauggcauuucaucuuacaacaaggaacggugaaccccacaugauuguugggaggcaggaaaaagggaagaguuuauuauuuaagacugaagauggcguuaauaugugcacuuuaauggcgauugaucuaggugagcucugcgaagacacgauaacuuauaaauguccucuguugagacaaaacgaaccugaggacauagauuguuggugcaauuccacuucaaccugggucacuuaugguaccuguacaaccacgggagagcacagacgagaaaaaaggagcguagcauuaguaccucauguugguaugggauuagagacuagaacagaaacuuggaugucaagcgaaggagcuuggaagcauguacagcgaauugaaacguggauuuugcgacacccuggcuucacgaucauggcggcuauauuagcguacacaauaggcacgacccacuuucagagggcauuaaucuucauuuuguuaacggcaguggcaccaucaaugacgaugcguugcauuggcauuucuaaucgugauuuuguugaaggcguuagugguggaagcuggguagauauaguacuagaacauggcagcuguguaacaacgauggcuaaaaauaagccgacucuagacuucgaacuaaucaagacugaagcuaaacaacccgcaacauuacgcaaauauugcauagaagcaaaguuaaccaauacuacaaccgaaucaagaugcccuacacaaggugagccaucucuuaaugaagagcaggacaaaagauuugucugcaaacacucaaugguugacagaggcuggggcaacggguguggacuauucgggaagggcgggauugucacaugugcgauguucacguguaaaaaaaauauggaagggaaagugguauuaccagaaaaucuagaauacacuauaguaauuacuccgcauuccggcgaggagcaugcaguagggaaugacacaggaaagcauggaaaagagauaaaaauaacuccacaguccucuauaacagaggccgaacucacugguuaugggacaguaacaauggaauguucaccuagaacuggacuugacuuuaaugagaugguacuauuacagauggaagauaaagcauggcuuguacaucgucagugguuucuugauuuaccucugccuugguuaccuggugccgacacacagggaaguaauuggauacaaaaggaaacacuuguuacuuucaagaacccacaugcaaaaaagcaagauguagucgucuuaggaucacaagaaggagcaaugcacacugcauugacuggagcaacugaaauucaaaugagcucaggcaaccuucucuuuacaggacauuuaaaaugucgcuuaagaauggauaaauuacaacuuaaaggcaugucauauaguauguguaccggaaaauuuaaaauuguuaaagaaauugcagaaacgcaacauggaaccauaguaaucagggugcaauaugaaggagacggaaguccguguaaaauuccuuuugagauuauggaccuggaaaaaaggcauguuuuaggucgucuaauaacaguaaauccuauuguuacagaaaaagauucaccuguaaacauugaagcggaaccuccguuuggagauucuuacauuauuauaggaguagaaccaggucaacucaaacuaaauugguucaaaaaagggucaucaauaggacaaauguuugaaacaacaaugcgcggugcuaagagaauggcaguccugggugacacagccugggacuucggcagccuuggcggcguauuuacuucaauagguaaagcauugcaccaaguauucggagcgauauauggagcggcuuucaguggcgucucuuggacuaugaaaauuuuaauaggaguaauaauaaccuggauagguaugaauucaaggaguacaagucuuucagugucacuaguccuaguuggaguugugacguuauacuugggugccaugguucaagcugauucaggaugcguuguaaguuggaaaaacaaagaacucaaaugcggaucagggauauuuauuacugauaacguccauacuuggacagaacaauauaaguuccaacccgaaucgccgucuaaacuggcaagugcaauacaaaaagcgcaugaagaaggcauuugcgggauacggucaguuacuagauuagagaaucuuauguggaagcaaaucaccccagaacuaaaucacauauuaagcgagaaugaaguaaaauuaacaauaaugacgggugacaucaaagguaucaugcaagcaggaaaaagaucuuuaagaccacaaccuacggagcucaaauauucauggaaaaccugggguaaggcuaaaauguuaagcacugagccgcacaaucaaacuuucuuaauagauggaccagaaacagcggaauguccaaacacaaauagagcauggaacucguuagaggucgaagacuacggguuuggaguauuuacaacuaacauaugguuaaaguugcgugagaaacaagauguauuuugcgacaguaaacuaaugucugcugcaauaaaggacaauagagcuguucacgcggauaugggcuacuggaucgaaagugcgcuaaaugacacauggaaaauggagaaggcuucauuuauagaagugaaaucaugucacuggccaaagucacauacccucugguccaauggugucuuagaaagugaaaugauaauuccgaaaaauuucgcagggccggugagccaacauaacuaucguccuggcuaccacacacaaacggccggacccuggcaucuuggaaagcuagagauggauuuugauuucugugagggaacgacggugguggugaccgaggauugcggcaacagggguccgagucuaagaacaacuacagcgagugggaaacugauaacugaguggugcugcagaagcugcaccuuaccuccacuaagguauagaggugaggauggauguugguaugguauggagauacgaccauugaaagagaaagaggagaacuuagugaacagccuaguuacagcagggcauggacaaaucgauaauuuuucuuuggggguacuugggauggcauuauuucuagaagaaaugcuacguacacguguaggaacaaaacaugcaauacuauugguugcuguuucauuugucacauuaaucacaggaaacaugagcuuuagagauuuaggacggguaaugguaaugguaggcgcuacaaugacagacgacauaggaaugggugugacuuaccuagcccuguuagcugcuuucaaaguuagaccuacuuucgcagcgggauuacucuuacguaaguuaacgaguaaggaacuaaugauggcaacgauuggaauagcucuacuaagccaguccacaauaccugaaacuauacuagaauugacagaugcauuagcacuugguaugaugguccuaaaaauuguuagaaacauggaaaaauaucaauuagccguuacaauaauggcgauuucuuguguuccgaaugcuguuauauuacaaaaugcuuggaaaguaagcuguacuauacuagcggcaguaucgguaucaccgcuccuguugaccaguagccaacaaaaagcugauuggauuccauuggcacuuacuauuaaggguuugaauccgacagcaauauuccuaacaacacugaguagaacgagcaaaaaacgcagcuggccuuugaaugaagcaauaauggcaguuggaaugguuaguauauuagcuucgaguuuacuaaaaaacgacauaccgaugacugggccguuaguagcugggggauuacuaacaguuuguuauguacugacagggagaucggcugauuuagaauuagagagggcagcagacguaaaaugggaggaucaagcggaaauaaguggcucgucgccuauucuguccauuacgaucuccgaagacggaagcaugucaauuaaaaaugaggaggaggaacaaacccuaacaaucuuaauaagaacaggguugcuaguaauauccggcguauuucccguuagcauacccauaacagccgcugcuugguaucucugggaggugaaaaagcaaagagcugguguuuuaugggaugugccaucuccaccuccgguaggaaaggcagaguuagaggacggugccuauagaaucaaacaacguggaauccuaggauauagucaaaucggagccggcguauauaaagaagggacuuuccauacgauguggcaugucacuagaggugcuguacuaaugcauagagggaaaagaaucgaaccaaguugggcagauguuaaaaaggaccugauuuccuacggaggagguuggaagcuagaaggugaauggaaagaaggcgaagaaguccaagucuuggcucucgagccggggaaaaauccgcgugcaguacaaacgaaacccggauuguucaaaacaaauacuggcacaauaggugcggugagucucgauuucucgccagggacgaguggauccccgauuguugauagaaaagguaaaguuguaggccuauaugguaauggugucguuacacguaguggagcauacguaucagccauugcacaaacagaaaagagcauagaggauaaucccgaaaucgaggaugauauauuuagaaaaaaacgacuuacuauuauggauuuacaccccggugccgggaaaacuaaaagguaccugccggcuauaguucgagaagcuauuaagagaggacugcgaacacucauauuagccccuacucguguuguugcagcugaaauggaagaagcucucaggggacugcccauacgauaucagacuccugccaucagggcagaacauacaggccgggagauaguagauuugaugugucacgcuacuuucacuaugagauuauugaguccggugagaguaccuaacuacaacuuaauuauaauggaugaagcgcacuucaccgacccugcuucaauagcggcuaggggauauauaucuacaaggguagaaaugggcgaggcagcugggauauucaugaccgccacgccaccaggaucgagagauccauuuccgcaaaguaaugcgccgauauuagaugaagagagggagauuccggaacgaucauggaacaguggucaugaauggguaacugacuucaaagggaaaacaguaugguucgugccuaguauaaaagccggaaaugacauagcagcuugucucaggaaaaaugguaaaaaaguuauacaguuaucaagaaaaacauuugacagugaauacguaaaaacaagagccaaugacugggacuucguaguaacaacugacauaucagaaaugggugcgaauuucaaagcagaaagaguuauagacccaagaagauguaugaagccaguaauacuaacagauggugaagaaagaguuauauuggcaggacccaugccgguuacacacucaagcgccgcccaaagaagaggaagaaucggcagaaauccuaagaaugaaaacgaccaauauauauauaugggggaaccauuagaaaacgaugaagauugugcucacuggaaagaagcgaaaaugcuacuagacaauauuaauaccccggaggguauuauaccaaguauguucgagccugaacgggaaaaaguagacgcuaucgacggggaauaucguuuaagaggcgaagcgaggaagacguuuguagauuuaaugagaaggggcgauuuaccuguuuggcuugcuuacagagucgccgcugaaggaauaaacuaugcggacagacggugguguuuugacggaaucaaaaauaaccaaauccuagaagaaaacguugagguagaaaucuggacuaaagaaggagaacguaaaaaacuaaaaccgcguugguuagaugcaagaauuuauucagauccgcuugcauuaaaagaauuuaaagaguuugccgcuggcagaaaaucauuaacccuuaauuuaaucacagaaaugggcagguuaccaacauuuaugacacaaaaagcaagagaugcacucgauaacuuagcuguauuacacaccgcggaaguuggcggucgcgcuuauaaucaugcacuaagugaauuaccugaaacccuagaaacgcuucuucuauuaacacuuuuagccacaguuaccgguggaauauuccucuuccuuaugagcggcaaaggaauugggaaaaugacuuuaggaaugugcuguauaauuacggcgaguauucuguuaugguacgcgcagauucaaccucacuggauugcagcaucaauaauacuagaauucuucuuaauuguucuuuugauuccggaaccggaaaaacaaaggacuccacaagacaaccaguuaacauauguaguuaucgcaauauugaccgucguggcagcaacuauggcuaaugaaaugggguucuuagaaaagaccaaaaaagaccuugguuuaggaagcaucacaacacaagaaagcgaaucaaacauacucgauauugauuuaagaccagcgucagcuuggaccuuauacgcaguggcaacaacauuugucacucccauguuaagacacaguauagaaaauucaagcgugaauauuucuuuaacagccauugcgaaccaagcaaccgugcugaugggacuaggaaaaggauggcccuuauccaaaauggacauugguguaccuuugcuagcaauagguuguuacucacagguaaaucccauaacacugaccgccgcucuguuacuucuuguugcucauuacgcaauaauuggaccaggauuacaagcaaaagcgacccgugaagcacaaaaacgagccgcugccgggauaaugaaaaacccgacgguagacgggauaaccgucauugaccuagaaccaauuccauacgacccaaaguuugaaaaacaacuaggacaaguaaugcuacucaucuuaugcguuacacagguacuuaugaugcgaacuacaugggcacuuugcgaggcccugaccuuagcaacgggacccauaagcacccuaugggagggcaaucccggcagauucuggaauacaaccauagcugucucaauggcaaauauauuuaggggaucguaucuugcuggugcuggucuccuuuuuucuauuaugaagaauacaacuaacacacgaagaggcacugggaauauaggagaaacauuaggggaaaaguggaaguccagauuaaacgcauuaggaaaaagugaauuucagauauacaagaaaucuggaauucaagaagucgacagaacacuggcaaaggagggaauuaaacguggagaaacugaccaucaugcagugaguagagggagugcaaaacuccgaugguucguggaacgcaauauggugacaccagaagguaaaguuguugaccucggauguggccgcggagguuggucguauuauugcggaggcuuaaaaaauguucgagaaguuaagggccugacuaaaggaggaccaggccacgaagagcccauaccuaugagcacauacggauggaaucuugugcgacuacaaagugguguggauguuuucuucacgccaccggaaaaaugugauacguugcuuugugauauaggcgaaucaucacccaauccaacuaucgaagcagggcgaacguugaggguacugaaucugguagaaaacugguuaaacaacaauacucaauucugcauaaaggucuuaaauccuuacaugccuucaguaaucgagaaaauggaaacuuuacaaagaaaauauggaggugcacugguacggaauccacuuucaagaaauaguacucaugagauguacugggucuccaaugcuacgggaaacauuguuuccucuguaaauaugauuucgcgaauguuaauaaauagauuuacgaugaaacauaaaaaagccaccuacgagccggaugucgaucuugguagcggaacucgcaacauaggaaucgagucagaaauaccgaauuuagacauuauuggcaagagaauugagaaaauuaaacaagagcaugaaacaucguggcacuaugaucaagaccacccauauaagacuugggccuaccaugguagcuaugagacaaaacaaaccggaagcgccucuucgaugguaaaugggguagugcgacuacuaacaaagccaugggacguaguccccauggugacccaaauggcgaugacagacacuacuccauuuggacaacaaagaguauuuaaggaaaaagucgacaccaggacacaagaaccgaaagagggcacuaagaagcuuaugaagauuacagcagaaugguuguggaaagagcuuggcaaaaaaaaaacaccucgaauguguacgagagaagaauucacacgcaaagucaggagcaaugccgcacucggagcaauuuucacugaugaaaacaaguggaaaagugcgagggaggcaguagaagacaguagguuuugggaguugauugauagagaacgcaaucugcacuuagaggguaaaugugagacaugcgucuauaauaugaugggaaaacgggaaaaaaaacuaggggaauuuggaaaagcaaaaggcagucgggcaauaugguacaugugguuaggggcuagauucuuagaauuugaggcacuuggcuuucuaaaugaagaucacugguucaguagagggaacuccuuaagugguguagagggcgaagguuuacauagauuaggguacauacuacgcgauguuagcaaaaaagaggggggagcaauguaugcagaugauacggcaggaugggacacacgaaucacauuagaggauuugaaaaaugaagaaaugguuaccaaucauaugaaaggcgaacauaaaaagcuagcugaagcaauauuuaaacuaaccuaccagaauaaggugguacggguucaaagaccuacgccuagaggaacaguuauggacauuauuaguagaagagaccaacguggcucaggacagguuggaaccuauggucugaacaccuuuacaaacauggaagcacaacuuauaagacagauggaaggugaaggaauuuuuaagucaauacaacaucuaacgguuaccgaagaaauugcgguacagaacuggcuugcccgaguaggaagagaacgccugucaagaauggccauaaguggcgaugacuguguagugaaaccuuuagaugauagauucgccucagcauugacugccuuaaaugacaugggcaaaguucgcaaagacauucaacaaugggaacccagccgaggcuggaacgacuggacccaaguaccguuuuguucacaucacuuucacgaacugguaaugaaagauggacggguucuuguaguacccugucgcaaucaggacgaauuaaucgguagagcaagaauaucgcagggagcaggguggucucucaaagagacagcaugccuaggaaaaucauaugcccagauguggacguuaauguauuuucaccgaagagaccuuagacuagcagccaaugcuauaugcagcgcugugccuucacauuggguuccaacaucgaggacaacauggucaauacacgcgaaacaugaauggaugacgacggaggauauguuagccgucuggaaucgcguguggauccaagaaaaucccuggauggaggacaaaaccccaguugaaaguugggaagaaguuccuuauuuggguaaacgggaagaccaauggugugggagucuuauaggguuaaccuccagggcgaccugggcuaaaaauauucaaacagcuauaaaccaggucagaucucugauugguaacgaagaauauaccgauuauaugccgucuaugaaaagauuccgacgugaggaagaagaagccgggguguuaugguga

SEQ ID NO: 22638 - RNA, 9876 nt, Artificial Sequence
  derived and/or modified CDS sequence (opt6) from DENV-2__EU482594__SS-prME
acugcuggugucauaauuaugcuaauccccacggcaauggcauuucauuuaacaacgcguaacggagaaccccauaugauaguugggcgacaagaaaaagggaaaaguuuacuuuuuaaaacagaagauggggugaacauguguacuuuaauggcgauagauuuaggugaguuaugcgaagacacuauuacuuauaaauguccauuacuaagacaaaaugaaccggaagacauugauugcugguguaacaguaccaguacauggguuaccuacggaacaugcaccacaacaggagagcacagaagagaaaaacguaguguagccuuaguuccacauguagguaugggucuugaaacacguacggagacauggaugucaagcgagggagcauggaaacacguacaacgaauagaaacauggauauugcgucaucccgguuucacuauuauggcagcaauacuagcuuacacuauagguaccacccacuuccaaagggcauuaauauuuauacuauuaacagcaguagcaccaucaaugacuaugcgauguauaggaauuagcaacagggacuuuguagaaggcgugucuggaggauccuggguggauauaguuuuggagcaugguagcuguguaacuacaauggcgaaaaacaaaccuacuuuagacuucgaacugauaaaaacggaagcaaaacaaccugcaacauuacgaaaauauugcauagaagcaaaauugacaaauacaacuaccgaaaguagauguccaacccaaggggaaccaucccuuaaugaggaacaagacaaaagguuuguauguaaacacagcaugguagauagagguuggggaaacggcugugggcuguuugguaaagggggaauugugacuugugcaauguuuacuugcaagaaaaauauggaaggcaaaguugucuuaccggagaaccuagaauauaccauaguaauuacaccucauucaggggaggagcaugccguaggaaacgauaccgguaaacaugguaaagagauuaaaauaacaccacagagcaguaucacagaagcugaguuaacuggcuacgguaccguuacgauggaguguucaccaagaacagguuuggauuucaaugaaaugguacuucugcaaauggaagacaaagcauggcuaguacaccgccaaugguuccuagacuuaccacugccauggcuuccuggagcugauacccaaggaucuaacuggauacagaaagagaccuuaguaacauucaaaaauccccaugccaagaaacaagauguagugguccucgguucacaagaaggagcgaugcauacagcuuuaacaggagcuacagagauucaaaugucuaguggaaacuuauuauuuacaggacaccuaaaaugccgccucaggauggacaaauuacagcugaaaggaaugagcuauucaauguguacggguaaauucaaaauugugaaagaaauugcagaaacgcaacacggaacuauaguaauaagaguccaauacgaaggcgacggcucuccauguaaaauuccguucgaaauaauggaccuugagaaacgacacguguuggguagacucauaacagucaaccccauaguugcugagaaagacucgccgguaaauauagaagcugaaccuccauuuggagauucauacauaaucauaggcguugaaccggggcaacuaaaauuaaauugguuuaagaaagggucaaguauuggccaaauguuugagacgaccaugcguggugcaaagcgaauggccauacuaggagauacggcaugggauuuuggcucauuagguggugucuucaccucaauuggaaaagcacuucaccaaguuuuuggagcuauuuauggcgccgcuuuuucaggcgucagcuggacuaugaaaauauugauugguguuauuauuacauggauugguaugaacuccaggucaacaucgcuuaguguaagucuggucuugguuggaguugugacauuauaccuuggugcaaugguacaagccgauucaggaugcgugguuucauggaaaucuaaggaauugaaaugugggagcggaauauucauuacagauaauguacacaccuggaccgaacaauauaaauuccaaccagaaucacccucuaaacuggcuucggcaauacaaaaagcacacgaagaagguauaugugguauuagaagcguaacaagguuagaaaaucucauguggaaacagauaacgccagaacuuaaccauauacuuagugaaaaugaaguaaaauuaacaauaaugacuggggacauuaaaggcaucaugcaagcagggaagcggucauuacgaccucagcccacugagcuuaaauauucuuggaaaacaugggguaaagcaaagauguuaucgaccgaaucacauaaccaaacguuuuuaauugacgguccugagacagcagaauguccgaauacaaauagagcauggaacucauuggagguggaagauuauggauuuggugucuuuacgacuaauauauggcuaaagcugagagagaaacaagacguguuuugcgacaguaaauuaaugucggcugcaaucaaagacaaccgcgcaguccacgcagauauggguuacuggaucgaaucagcacuaaaugacacauggaagauggagaaggcuucauuuauagaggucaaaucuugccacuggccgaaaucucauacauuguggucgaauggaguauuggagagugaaaugauuauuccuaaaaauuucgccgguccuguaagccaacauaauuacaggccaggauaucacacacaaacagcgggcccuuggcaccuggguaaacuugaaauggacuucgauuuuugugagggaacaacaguaguagucacggaggauuguggcaacaggggaccuaguuuacguacgacuacagcaucgggaaaacuaaucacggaauggugcugccggagcugcacccugccaccacuuagauaccguggcgaagacgguuguugguacggcauggaaauucgaccguuaaaagaaaaagaagagaaccuaguaaacucuuuaguaacggcaggucacgggcaaauugauaacuuuucauuagguguuuugggaauggcauuauuuuuagaagaaaugcuuagaacccguguaggcacuaagcaugcgauauuauugguggcgguaucauuuguaacacucauaacagguaauaugagcuuccgugacuugggacgaguuauggucauggucggggccacaaugacggaugacauuggcaugggaauaacuuaucuagcuuuacuagcagcuuuuaaaguaagaccaaccuuugcggccggucuauuacuaaagaaacucacaaguaaggagcuuaugauggcuacuauagguauagccuuguuaagucaaucaacgauuccagaaacgauauuagaauugacagacgcacucgcguuagggaugaugguauuaaaaauaguaaggaauauggaaaaguaccaacuggcuguaaccauaauggccauuagcuguguuccaaaugcuguaauucuacagaacgcuuggaaaguaucuugcacgauauuggcagcagugucagucucgccguuauuauuaacgucuucccaacaaaaggcagauuggauaccucuagcuuuaacaauaaaagggcugaauccuacggcuaucuucuugacuacccuaucacgaacaaguaagaaacgaagcuggccguuaaaugaggccauuauggcgguaggaaugguaagcauauuagccuccagucuacuuaaaaacgacauacccaugacagguccacugguugcugguggucuucucaccguauguuacguuuuaacuggaagaucagcagaucucgaguuagaacgugccgcggaugugaaaugggaggaucaggccgaaauuucgggaucgucaccuauauuaucaauaacaauaagcgaagauggaaguaugaguaucaaaaaugaagaggaagaacaaacucugacuaucuuaauaaggacaggacuccuaguaaucagcggagucuucccuguaucgauacccauaaccgcagcugcuugguauuugugggaagucaagaaacaaagagccggaguacucugggauguaccaagucccccuccggugggaaaagcagaacuagaggacggcgcauaucguauaaagcaaagaggaauacuagguuauucccaaauaggggcugguguauacaaagaagggacauuucauacaauguggcaugucacucguggagcaguauugaugcauaggggaaagcguauagaaccauccugggcugaugucaaaaaggacuuaaucuccuacggaggcggauggaaguuggagggggaauggaaggaaggagaggaaguucaagucuuagcuuuagaacccggcaaaaauccaagagcuguacaaacuaagccaggauuauuuaaaacaaacacgggaacuauuggggcuguuucucuugauuuuucaccagguacgagcggcagcccgauaguggauaggaaaggaaaaguaguaggacuguacgguaacggaguaguaacacgauccggagcuuaugucagcgcuaucgcacaaacagaaaagaguauugaagacaacccagagauugaagacgauauauuuaggaagaaaagacuuacuauaauggacuuacacccuggagcuggaaaaacaaaacgcuaucugcccgccauagugagagaggcaauuaaaagaggauugagaacacuuauacuagcaccaaccagagucguagcagcugaaauggaagaggcauuaaggggauuaccuauaagauaucagaccccugcuauacgagcggaacauacuggacgagagaucgucgauuuaaugugccaugcaacguucacaaugaggcuauuaucucccgugagaguaccaaauuauaaccuaauaauaauggacgaagcacauuucacggauccggccagcauagcagcacguggauacauuucaacacgaguggagaugggugaggcggcaggaauuuucaugacagcgacgccgccagguagucgggauccuuuuccacagagcaaugcuccaaucauggaugaggaacgggaaaucccagaaagaagcuggaacucgggacacgaauggguaacagauuuuaaaggcaagaccgucugguucguaccuaguauaaaggcagggaaugauauagcagcgugccuucguaaaaacgguaagaaaguuauucaauuaaguagaaaaaccuucgauagugaauacgucaaaacaagagcaaaugacugggauuucguaguaacuacagacauaucagaaaugggugcuaauuucaaggcagaaagagugauagacccgaggcgaugcaugaaacccgugauuuuaacagaaggagaggaaagaguuaucuuagcagggccaaugccagucacucauucuagugcagcucaacgucggggaagaauaggacgaaauccaaagaacgaaaaugaucaguacauauacaugggugaaccauuggaaaacgacgaagacugcgcacacuggaaagaagcaaagaugcuacuugauaacauaaacaccccagaagguauaaucccguccauguuugaaccagagagggaaaaagucgaugcgauagauggagaauauagacuuaggggagaggcgaggaagaccuuuguagacuuaaugagacgcggcgaccuacccguaugguuagcauauagaguagccgcugaagguaucaacuaugcggaccggcguuggugcuucgauggaaucaaaaauaaucaaauauuggaagaaaauguggaaguggaaauauggacgaaagaaggggaaagaaagaaacucaaaccacguuggcuugacgcgagaauauauagcgacccgcuugcccuuaaagaguucaaagaguucgcagcagguagaaaaucacuaacacuaaacuugauaacagagauggguagauugccaacuuucaugacucaaaaagcucgggaugcuuuagacaacuuagcaguacuacauacagcugaagcgggagggagagcuuacaaucaugccuuauccgaacuaccggagacauuagagacucugcuacugcuaacgcuucucgcgacaguaacaggaggaauuuuucucuuuuuaaugagugggaaagguauaggaaaaaugacacugggaaugugcugcauuauaaccgcgagcauacuucuaugguaugcacaaauccaaccucauuggauagccgcaagcauuauauuagaauuuuucuugaucguauuacucaucccugaaccagagaaacaaagaacaccacaagacaaucaauuaacauauguagugauugcuauacuaacgguuguagccgcuacuauggcaaacgaaaugggguuucuugaaaagaccaagaaagauuuaggauuaggauccaucgcaacacaagaaagcgaaagcaauauuuuggauauugaccucaggccugcaagcgcauggacccuauacgcgguugcuaccacuuucgugacgccaaugcucagacacagcaucgaaaauucaagcgucaaugugucucuaacugcuauagcuaaucaagccacuguccuuaugggucuuggaaagggguggccauuaucaaaaauggacauugguguuccucuccuagcaauuggguguuauucacaaguaaauccaaucacucucacggcagcacuucuauuauuaguggcucacuaugcaaucauagggccgggguuacaagcuaaagccaccagggaagcacagaaaagagcagccgcugggaucaugaaaaaucccaccguagauggaauuacugucauagaccuugaaccaaucccauacgauccaaaauuugaaaagcaacugggacaaguuauguuacuaauauugugugucacacaaguucuaaugaugcgaacuacuugggccuuaugcgaggcucuaacucuagcgacuggaccuaucaguacacuaugggagggcaauccgggaagauucuggaacacgaccauagcaguuucaauggccaauauuuuuaggggauccuaucuugcaggagcaggacuacucuucuccauaaugaaaaacaccacaaacacccgccgggguacagggaauaucggagaaacauuaggagagaaauggaaaucgcggcuuaaugcgcuagggaaaucugaguuccagauuuacaaaaagaguggcauccaagaagucgaccgaacacuagcgaaagagggcauuaaacguggcgaaacagaucaccacgccguuucucggggaagugcaaaacuuagaugguucgucgagcguaauaugguaacuccugaagggaaggucguagaucuaggcuguggaagagggggaugguccuacuauugcgguggacucaaaaaugugagggaaguaaaggguuugacaaaaggaggaccaggacaugaggagcccaucccaaugaguacauaugguuggaauuuaguucgccuacaauccggaguugauguuuucuuuacaccucccgaaaaaugugacacucuucuaugugauaucggugagaguagcccgaaucccacaauagaggcgggucguaccuugcgaguauuaaauuugguagaaaauuggcuaaacaauaauacccaauucugcauuaaaguauuaaauccauauaugccgaguguuauugagaaaauggaaacacuacagcggaaauauggaggugcucuuguuagaaacccacuaagucguaauucgacgcacgaaauguacuggguaucgaacgccacagguaauauuguaucaagcguaaacaugauaagucgcauguugauaaauagguuuacaaugaaacacaaaaaggcuacguaugaaccagauguagaucugggcaguggaacaaggaauaucggcaucgaaucggaaauuccaaaucuugacauuauagggaagcgcauugaaaagauuaaacaagaacacgaaacaucuuggcauuacgaucaagaucacccauauaaaacaugggcauaccacggaaguuacgaaacaaaacaaaccgggagugcaagcucaaugguaaacggcguuguuagacuucuaaccaaacccugggauguggucccuauggucacgcaaauggcgaugaccgacacgacuccauucggucagcaaagaguauuuaaggagaaaguagacacaaggacucaagagccuaaggaggggacuaagaaacuaaugaaaauaacagcagaauggcucuggaaggaacucggcaagaagaaaacaccacguauguguacccgagaagaauuuacaaggaaagugagaucuaaugcagcucugggagcuauauucacagacgaaaauaaauggaaaagugcucgugaagcuguagaagacucacgauucugggaacuaaucgacagggagagaaaccuacaucuugagggaaaaugugaaacauguguauacaauaugaugggaaaaagggagaaaaagcuaggagaguuuggaaaagcuaagggaucaagagcaauaugguacauguggcuuggcgcacgguuuuuagaguuugaagccuuaggauuuuuaaacgaagaccauugguucaguagagguaauaguuuaucgggaguagaaggagaaggucuucauagauuggguuacauucuaagagaugucagcaagaaagaagggggagcaauguaugcugaugacacggcuggaugggauacacguaucacucuggaagaccuuaaaaaugaggaaaugguaacaaaucacaugaagggugaacacaagaaacuagcagaagcaauauuuaaacuaaccuaccaaaauaaaguaguucgcgugcaaaggccaacaccccgugguacagucauggauauaauaagccgaagggaccaacgagguaguggucagguggguacauacggacuaaacaccuucacaaauauggaagcucaacugauacggcagauggagggugaaggaaucuuuaaaagcauccagcaccuuacggugaccgaagagauugcaguacagaacugguuagcccgcguugggcgugaaagauugucucgaauggcuauaaguggggaugacugcgucgugaaaccuuuggacgaucgauuugccucugcacucacagccuuaaaugacaugggaaaggugagaaaagacauacaacaaugggagcccagucgaggauggaaugauuggacacaaguaccuuucuguucacaccacuuucaugagcuagucaugaaagauggacgaguccuaguuguucccuguaggaaccaggacgaacuuaucgguagagcaagaaucagucagggcgcaggauggucauuaaaagaaaccgcaugcuuaggaaaauccuaugcccaaauguggacgcuuauguauuuccacagaagagauuuaagguuagcugcaaacgcaauaugcagugcagugccgagucacuggguuccuacaagcagaacaacaugguccauucacgcaaaacaugaauggaugacuacagaggacauguuagcugucuggaauaggguauggauucaggagaaucccuggauggaggacaaaacuccaguugaaaguugggaagaagugccuuacuuaggcaaaagagaagaucaauggugugguucuuuaauagggcuaacaagucgagcaacaugggcuaaaaauauccaaaccgcuauaaaucaaguuaggagccugauaggaaaugaggaauacacagauuauaugcccagcaugaaacgauucagacgcgaagaagaagaagcaggaguccucugguaa

SEQ ID NO: 22639 - RNA, 9876 nt, Artificial Sequence
  derived and/or modified CDS sequence (opt6) from DENV-2__EU482604__SS-prME
acugccggaguuauuauaauguuaauaccaacugcaauggcuuuucaucuaacuacucgaaacggagaaccucauaugaucguaggacggcaagaaaaagggaaaagucuguuauuuaaaacugaagacggaguaaacauguguacacugauggcuauagauuuaggggaguugugcgaagauacaauaacguauaaaugcccacuacuaaggcaaaaugaaccugaagauauagauuguugguguaacucgacuucgaccuggguuaccuaugguacauguacuacgacuggggaacaccggcgggagaaaagaaguguugcucuuguaccacacguaggaaugggucuagaaacaagaacggaaacuuggaugucgucugagggagcuuggaaacauguacagcgcauugagacauggauacugcgucacccaggauucacuauaauggcugcgauuuuggcguauacuauaggaacaacacacuuccaaagggcucuaauuuuuauacugcugacggcaguagcuccaucuaugaccaugcggugcaucggaauaaguaauagagauuucguggaagggguuagcggagguucguggguugauauaguucuggaacauggauccuguguaacaacaauggcuaaaaauaaacccacgcuugacuuugaauugauaaagacugaagcaaaacaaccggcaacauugcgcaaauacuguaucgaagcaaaauuaacaaacacaacaacugaaagcagaugcccaacucaaggugaaccgagccugaaugaggagcaagauaaacguuuuauuugcaaacacucuaugguagaccgaggauggggaaaugguugugguuuguuuggaaaagggggcauaguaaccugugcgauguuuacuuguaagaaaaauauggaagguaagguaguccaaccugagaauuuggaauacaccauaguaauaacuccacauucaggcgaagaacaugcaguagguaaugauaccggaaaacauggaaaggaaauaaagauaacuccacagucuagcauuacagaagcugaauugacaggcuacggcacgguaacaauggaauguaguccuaggacugggcuggauuuuaacgagaugguauuauuacaaauggaagacaaggcuuggcuaguacaucgacaaugguuucuugauuuaccucuaccuuggcuuccgggugcagauacgcaaggaucuaauuggauacagaaagaaacauuggugacauuuaagaauccgcaugcaaagaagcaagauguaguaguacugggaucccaagaaggcgcuaugcauacggcccuaacaggggcuacagaaauacaaaugucuucuggaaaucuacuauuuacgggacauuuaaaaugccgucuccgcauggauaaauuacaauuaaaagggaugucuuacucuaugugcaccgguaaauuuaaaauaguuaaggaaauugcagagacccaacaugguacaauugugauccggauccaguacgagggagacgggucccccugcaaaauuccauuugagauuaccgaccuugagaaaagacacguacuaggacgauugauuaccgucaauccgauuguuauagagaaagauagcccaguuaauaucgaggcggagccuccguucggagauucuuauaucauuauagguguagaacccgggcaacuuaaacuaaacugguuuaaaaaggguucuucaauaggccaaauguucgaaacaacaaugaggggugcuaaaagaauggcgaucuuaggugauacugcuugggauuuuggaaguuuagguggaguguuuacaaguaucggaaaagcucuccaccaaguguuuggugccauauauggggcugcauucucuggaguuagcuggacaaugaaaauauuaauaggaguaguaauuacauggauaggaaugaauagucgaaguacaaguuuaucaguuucuuuaguauuaguagggguggugacucuuuaucucggugccaugguccaagcagauuccgguuguguaguaucguggaaaaauaaggaacucaaaugcggaagcggaauuuuuauaacagauaacgugcauacuuggacagaacaguacaaauuccaaccugaaucgccguccaaacuugcuagcgcgauacaaaaagcucacgaagagggaauauguggcauucguucggucaccagauuagaaaauuuaauguggaagcagauaacaccggaguugaaucacauacucucugaaaacgagguuaaauuaacaauaaugacaggugauacaaaagggauaaugcaagcuggaaaaagaaguuuaagaccacaaccaacagaauuaaaauacucauggaagacguggggaaaagcuaaaauguugucuacagaaagucauaaucaaacguuucucauagaugguccagaaaccgcggagugcccuaacacaaaucgugcauggaauaguuuggaggucgaagauuauggauucgggguauuuacgaccaacaucugguuaaaacucagggaaaagcaagacguauuuugcgacaguaaacuaaugucugccgcgauuaaggacaaccgagcaguccaugcagauauggguuauuggauagaaucggcauugaacgauacguggaaaauggaaaaagcgagcuuuauagaagucaaaucuugccauuggccuaaaucucacaccuuauggucaaauggaguauuggaauccgaaaugauaaucccgaagaauuucgcaggcccuguuucacagcauaauuauagaccaggauaccauacucaaaccgcgggaccguggcaucucgggaaauuagaaauggacuucgauuuuugugaggggacgaccgugguaguaacagaggauugcggcaaucgagguccuucgcugagaacuaccacagccaguggaaaauugauaacagaauggugcuguaggucguguacucuuccuccuuuacgcuacaggggugaagacgguuguugguauggcauggaaaucagaccguuaaaagaaaaggaagaaaaccuugucaacaguuuaguaacugcgggacacgggcagauagauaauuuuagcuuaggaguauugggaauggccuuauuucuagaggaaaugcuuagaaccagaguaggaacgaagcacgcuauacuccuuguggcaguuucuuuuguaacacuaauaacagguaauaugagcuuccgugaucucggccgcgugauggugaugguuggagcuacaaugacugaugauauagggaugggagugacauaucuagcccugcucgccgcuuucaaagugcgaccaaccuuugcggcaggacuacuauuacgaaaauuaacaaguaaagaguuaaugauggcaaccauuggcauuacguuacuuucacaauccacaauaccggagacaauauuggaauugacagaugcccucgcacuagggaugaugguuuuaaaaauaguccggaauauggaaaaguaccaacuagcugugacgauaauggcaaucucaugcgucccaaacgcuguaauccuacguaaugcguggaaaguaucauguacgauacuagcugcuguaagugucaguccacuacuucuuacgucuucgcaacaaaaggcggacuggauuccucuugcucuaacuauuaaaggccuuaaucccacagccauuuuucuaaccaccuuaucgaggacaaguaaaaagcgaucguggccucugaaugaagcaaucauggcagucggcaugguauccauauuagcgagcuccuuacucaaaaaugauauaccuaugacagguccccuuguggcuggaggucuauuaaccguuugcuacguauuaacaggcaggagugcagaccuggaguuggagagagccgcagacguaaaaugggaagaucaggcugaaauuagugggaguucaccuauacuaucaauuacaaucucagaggacgggucaauguccauaaagaacgaggaggaagaacaaacucuaacuaucuuaauacggacgggguuauuagugauaucuggaguguuuccaguuaguauaccaaucacugcagcugcaugguaucuaugggaagucaaaaagcaaagggccggaguucuaugggacguaccaucacccccaccugugggaaaagccgaauuagaagacggcgcuuacagaauuaagcaaagaggaauccuaggguauucacagauaggcgcaggaguauacaaagaaggcacauuccauacgauguggcauguaacaagaggagcaguucuaaugcacaggggcaaacguauagaaccuaguugggcagaugucaagaaagaccuuauaagcuaugguggcggauggaaacuagaaggagaauggaaagaaggugaagaaguucagguuuuagcacuugaaccaggcaaaaauccaagagcuguucaaacaaaaccaggaauauuuaaaacaaauacuggaacaaucggagcaguaucucuagauuuuucaccggggacaaguggaaguccaauaguagaccgaaaagguaaagucguuggguuauaugggaauggagucguaacaagaagcggagcauauguuucugcaauagcgcaaaccgagaaaucaauagaagacaauccugaaauagaagaugauauuuuucgaaagaaaaggcuaacaauaauggaccuucauccaggagccggaaaaacuaaacguuaucuucccgcaauaguucgagaagcgaucaaaagaggccuuaggacccugauacuggcaccuacacguguaguagccgcggaaauggaagaagcucucagaggacucccaauaagguaucaaaccccagcgauaaaagcagaacacacagguagagaaaucguugaccugaugugccaugcaacauucacaaugagauuauugucaccagugagaguccccaauuauaaccuaauaauaauggaugaagcucacuuuacugauccugcgucaauagcggcaaggggauauauuaguacacggguugagaugggagaagcugcgggaauauuuaugacagcaacaccaccugggagcagagauccuuucccgcaaaguaaugcuccuauaauggaugaggagcgagagauuccugagaggucuuggaacagcggccaugaauggguaacagauuuuaaagguaaaacuguaugguuuguuccuaguauaaaagccgggaacgauauagcagcguguuuaaggaaaaacgggaagaaaguaauacaguuaucacgaaaaacuuuugacagugaauacgucaaaacaagagccaaugacugggauuuuguaguaacaacagauauuucugaaaugggagcaaacuuuaaagcagaaaggguaauagauccaagaagaugcaugaaaccagucauucucacugacggcgaagaacggguaauccuagcagguccuaugccuguuacccacaguagcgcagcacaacgucguggccgaauaggcagaaauccuaagaaugaaaaugaucaauauauauacaugggcgaacccuuagaaaaugacgaggauugugcacauuggaaggaagcaaaaauguuacuagacaauaucaacacuccugaaggcauaauaccuuccauguuugaaccugagagggaaaaggucgaugccauugauggcgaauaucgauuaagaggagaagcgaggaagacuuuuguggauuuaaugagacguggagaccuaccagucugguuagcuuauaaaguggcggcggaggguaucaacuacgcagauagaaaauggugcuucgauggaaucaaaaauaaucaaauauuagaagaaaacguggagguagaaauauggacgaaggaaggagaaaggaaaaaguuaaaacccaggugguuagaugcaagaauauacucggauccgcuugcguuaaaggaguuuaaagaauuugcagcagggagaaaaucauugacacuaaauuuaauuacugaaaugggacgucuaccaacguuuaugacucaaaaggcacguaaugccuuggauaaucucgccguguuacauacugcggaagcaggcgggcgagcuuauaaccaugcccuaagcgaauuacccgaaacgcuagaaacacuuuuauuguuaacacuacuugccaccgucacugggggaauauuccuguuucucaugucuggaaaaggaauaggaaaaaugacguuaggaaugugcuguaucauaacugcaucuguucuuuuaugguacgcccaaauacaaccgcauuggaucgccgcgucuauaauauuagaguucuuuuugauuguacuacuuauuccagaaccagaaaaacagcggacaccccaagauaaccaacuuacauacguaguuauugcaaucuuaacagugguugcggccacaauggcuaaugaaauggguuucuuagagaaaacuaagaaagaucuaggauuaggcucgauuacaacacaggaaagcgagaguaauauacuggauauugauuugaggccggcuucagcauggacucuguaugcaguagcgacuacguucgucacucccaugcugagacauaguaucgagaacucaucggugaacgucucacugaccgccauagccaaucaggcgaccguauugaugggacucgggaaaggcuggcccuuaagcaaaauggauauuggaguaccucuuuuagcaauaggcuguuacucacaaguuaauccgauaacacuaacagccgcacuacucuuauuaguagcgcacuaugcuaucauuggaccaggauugcaagcaaaagcuacucgagaggcacaaaaacgugcagcugcagguauuaugaaaaauccgacuguggauggaauuacaguaaucgacuuagaaccgauaccuuacgauccuaaauuugagaaacaauugggccaaguaaugcuucuaauucuaugugugacgcaaguuuugaugaugagaaccacuugggccuuaugcgaagcccuuacauuggcgaccggcccgauuagcacuuuaugggaaggaaauccaggacguuuuuggaacacuacuauagcugucucaauggcaaacauauuucgaggcagcuaccuugccggcgcgggguuacuauuuucaauaaugaaaaacacgacaaacaccagacgugguacugggaauauaggagaaacacugggagaaaaguggaaaagucgccucaaugcacuuggaaagagugaguuucaaaucuauaagaagucggguauucaagaaguugaccggacauuagcaaaagaaggcaucaaacgaggagaaacagaucaccaugcugugucacgaggaagugcgaaacucaggugguucguagaaagaaauauggugacuccagaagguaaaguagucgaucuagggugcggaagagggggauggagcuauuauuguggaggacugaaaaacguaagggaaguuaaaggcuuaacaaaaggaggcccaggacacgaggaaccaauaccaaugaguacauaugguuggaaccuaguuagacuucagaguggggucgacguauuuuucaccccgcccgaaaagugugacacacuacugugugauaucggugagucuucgccuaauccaacgauagaggcagguagaacuuuaagagucuugaaucuuguugaaaauugguuaaauaacaacacgcaauuuugcaucaaaguccuuaauccguauaugcccucaguuauagaaaagauggaaacgcuacaaagaaaauaugguggggcauugguaaggaauccacuaagccguaauucaacccaugaaauguacugggucucaaaugcuacagguaauauagugaguucagucaacaugauaucacgcauguugauaaauagauuuaccaugaaacauaagaaagcuacuuacgagccggacguggaucuaggaucagggacaagaaacauaggaaucgaaucugaaauaccuaaccuagauauaauagggaaaagaaucgagaaaauaaaacaagaacacgaaacgucauggcauuaugaucaagaucacccauauaaaacaugggcguaucaugguucauacgaaaccaaacaaacugguagcgcgaguucaaugguaaacggcgugguaaggcuacuuacaaagcccugggacguaguccccaugguaacacaaauggccaugacagauacgacgccguuugggcaacaaagagucuuuaaagaaaaaguagauacacgcacacaagaaccaaaggaagguacgaaaaagcucaugcggauaacagcggaauggcuguggaaggaguuggguaagaagaaaaccccuaggaugugcacuagggaagaauuuacgagaaaaguacguucaaaugcggcucugggagcuaucuuuacagaugaaaacaaauggaaaagugcgagagaagcaguugaggauggcagauucugggaacucguagacaaagaaaggaauuuacaccuggaagguaaaugugagacaugcguauacaauaugauggguaagagagagaagaaauuaggcgaguucggaaaggcaaaaggaaguagagcgauaugguacaugugguuaggcgcgagauuuuuagaauuugaagccuuagguuuucucaacgaagaccauugguucucccgaggaaauagucuaucuggcguugaaggggaaggguuacacagauuaggcuauauccuaagggacguuggcaagaaagaagguggugcuauguaugcugacgauacagcaggcugggauacaagaauuacgcuagaagaccucaaaaaugaagagaugguaacuaaucauaugaagggcgaacacaagaaacuugcugaagcaauauucaagcugacuuaucaaaauaagguuguacgaguacaacgaccaacuccaagagguacuguaauggacaucaucucacguagagaucaaagaggaucaggacaaguaggcacuuauggauuaaacacguuuacaaauauggaagcucagcuaauacgacagauggagggagaaggcauauucaagagcauacaacauuuaacagcaaccgaagaaauagcgguucaaaacugguuagccagaguaggacgagaaaggcuuaguaggauggcgaucaguggagaugacuguguggucaaaccuauagaugaucguuuugcaagugcauuaacugcgcugaacgauauggggaaaguaagaaaagacauacaacagugggagcccucacgggguuggaacgauuggacacaaguaccauucuguucacaucauuuccaugaacucguuaugaaagacggccgaguacugguaguuccauguaggaaccaagaugaacuaauagguagagcucggauaucucaaggggcuggauggagcuuaaaagaaaccgccugccuugguaaaucauacgcccaaauguggacuuugauguauuuucaucgacgugauuuacgccuugcagcuaaugccauauguagugcugugccgucacacuggguaccaacgagucggacaacauggucgauucaugcuaaacaugaguggaugacuacggaagacaugcuagcaguauggaacagaguuuggauccaagaaaacccuuggauggaagacaaaacaccaguagaaagcugggaggaagucccguaucuuggaaaacgagaagaucaauggugcggaaguuuaauaggauuaacaagccgagcgacuugggcaaagaauauacaaacugcaauaaaucaaguaagaucccuaauugggaaugaggaauauacagauuauaugcccucaaugaagcgauuuagaagagaagaggaagaagccgguguguuaugguaa

SEQ ID NO: 22640 - RNA, 9876 nt, Artificial Sequence
  derived and/or modified CDS sequence (opt6) from DENV-2__EU482605__SS-prME
acagcaggagucauaauaaugcuaaucccaacggcaauggcauuucaccuaacgacuagaaauggagaaccucauaugaucgucgguagacaggaaaaagggaaaucgcuuuuauucaaaacagaagauggaguuaauaugugcacucuuauggcaaucgacuuaggugaauuaugugaagauacaaucacauacaaauguccauuguuaagacaaaaugaaccugaagacauugacuguugguguaauagcacaucaacuugggugacuuacggaacauguacaacuacaggagaacaucgaagagaaaaacgaagugucgcgcuaguaccgcacguaggaauggggcuagaaacgagaaccgaaacauggaugaguucagaaggagcauggaaacacguacaacgaauagaaacauggaucuugcggcacccaggguuuaccauaauggcagcaauacuugcauacacaauagggacaacacauuuccaaagagcacuuauauucauauuacuuacagcaguugcaccuucaaugaccaugcggugcauugggauaaguaaucgggauuuuguugaaggugucagcggagguucauggguagauauaguauuagaacacgguucuugugugacaacuauggccaaaaauaaaccaacgcuagauuuugaauuaauaaaaaccgaagcgaaacaaccagcuacacuuaggaaauacuguauugaagcgaaacugacaaauacuacaaccgaaucuaggugcccaacccaaggggaaccaucccuaaaugaagaacaagauaaacguuuuauaugcaaacacucgaugguugacaggggguggggaaaugggugcggacuuuucggaaaaggagguaucguaacuugugcuauguuuacauguaagaaaaauauggagggaaaagucguucaaccugaaaaucuggaguauacgauaguuauuaccccucacaguggagaagaacaugcaguuggaaacgauaccgggaaacacggcaaagaaauuaaaauaacuccgcaauccucgaucacagaagcugagcugacaggguaugguacaguaacuauggaguguucacccagaacaggcuuagacuucaacgaaaugguucuacuacaaauggaagacaaagcaugguuaguucacaggcagugguuccuagaucuuccuuuaccuuggcuaccaggggccgacacacaaggguccaauuggauacaaaaggaaacccuaguaacuuuuaaaaauccacaugcaaagaaacaagauguaguaguguugggaucucaagaaggagcaaugcacacagcucuaacgggcgcaacggaaauacaaaugucaucggguaaucuuuuagugacaggucaucuuaaaugcagacuucguauggauaaacuucaauuaaaagguaugagcuauaguauguguacggggaaguuuaaaauugucaaggaaauagcagaaacucaacaugguacaauugucauccgcauucaauacgaaggugacggaucaccuuguaaaauacccuucgagauuacagaccuagaaaaacgucauguuuuagguaggcuuaucacuguuaauccuauaguaaucgagaaagauagucccguaaauauagaagcagagccaccguuuggugacaguuacauuauuaucgggguagaaccuggacaacuaaagcuaaauugguucaagaaagguucaucaaucggacaaauguuugagacgacuaugcgaggugcaaaacguauggcaauccuaggugacaccgcaugggauuucggaucguuaggaggcguauuuacuucaaucgggaaggcuuuacaucaagucuucggcgcuauauauggagcugccuucucaggugugucauggacaaugaaaauccuuauaggcgugguuauaacauggaucgggaugaacucgagauccacgagccucucaguaagccuaguguuaguagggguugucacacuguauuugggugcgaugguccaagcggacaguggauguguaguuucauggaagaacaaagagcugaagugugguucuggaauuuucauuacggauaacguucauacguggacggaacaauacaaguuucaaccugaaucaccauccaaauuagccucagcuauucagaaagcgcacgaagaaggcauauguggaauuagaagcguuacucgacuagagaacuuaauguggaagcaaauaacgcccgaguuaaaccacauacuaucagaaaaugaggugaaauuaacaaucaugaccggugauacgaaaggcaucaugcaagcagguaaacguaguuuacgaccgcaaccaacggaacuaaaguauucguggaaaacuuggggaaaggccaaaauguuaagcaccgaaagucauaaucaaacauuccuaauagacgguccggagacugccgaguguccuaacacuaaccgagcuuggaacucuuuagagguggaagauuauggauuugggguguuuacuacaaauauuugguuaaaguugcgagaaaaacaagacguuuucugugauucuaaacuaaugagugcagcaaucaaggauaacagggcugugcacgcugacaugggauacuggaucgaaucagcucugaaugauaccuggaaaauggaaaaagcauccuuuauugagguaaagaguugccacuggccgaaaucacauacuuuauggucaaauggaguacucgaaucagaaaugauaauaccuaagaauuuugcuggacccguuucgcagcacaauuauaggccggguuaucauacgcaaacagcgggaccauggcaucuaggaaaacuagaaauggauuuugauuucugugaaggcaccacaguaguaguuacugaagacuguggcaauagagggcccaguuuaagaacuacaaccgcaagcggaaagcuaauuacagaaugguguuguagaucuuguacacucccgccucugcgauaucgaggagaagauggaugcugguacgguauggaaauccgaccccugaaagaaaaggaagagaaccuugucaauucguuaguuacugccgggcacggccaaauagauaauuuuucgcuuggaguucuuggaauggccuuguuucucgaagaaauguuaagaacacgagucggcacuaaacaugcgauccuuuugguugcugugucguuugucacguuaauaacaggaaauaugucuuucagagauuuaggcagaguaaugguaauggugggugcaacuaugacagacgacauuggaaugggugucacuuacuuagcacucuuagcagcuuucaagguacgaccgaccuucgcagcagguuugcugcuccgaaaacuuacgucuaaagaauuaaugauggcaacgauagguaucacucuauuaucucaaucaaccauacccgaaacgauacuugaacucacagaugcuuuagcauuaggaaugaugguacuaaaaauaguccgaaauauggagaaguaccaguuagcaguaacaauaauggcaauaaguugcguaccaaacgccguuauccuuagaaaugcauggaaagucucaugcaccauucuugcagcagucucggugaguccacuauuguugacuucaucucaacagaaggccgauuggauaccucuggcucugaccauaaaaggacuaaauccuacggcaauauuucucacuacucuaagccguacaucgaagaaacguucguggccccuaaaugaagcuauaauggccguuggaaugguuaguauacuagcuucgucguuacuuaaaaaugauauaccgaugaccgggccccuaguggcuggaggccugcuuacagucuguuacguucuaacaggaagauccgcggacuuggaacucgagagggcagcagacguuaaaugggaagaucaagcagagauuagcggaucaagcccgauucuaucuauaacaaucuccgaagauggaaguaugagcauuaaaaaugaagaagaggaacaaacucuaacuauucucauaagaacuggauuacucgucaucaguggaguauucccgguaaguauuccaauaacugcagcggccugguauuugugggaggucaagaaacagcgugccgguguuuugugggauguacccucuccacccccuguuggaaaagcugagcuggaagauggagcauauagaauaaaacaaagagguauacuaggauacucacaaauaggugcagggguauauaaagagggaacuuuccacacgauguggcacgucacccguggagcuguacugaugcauagaggaaaacguaucgagcccagcugggcggacgucaagaaagaucuaauaaguuauggcggcggauggaaacuagaaggggaauggaaagaaggagaggagguacaaguccucgcauuagaaccggguaaaaacccucgugcuguacaaacgaaacccggaauauuuaaaacaaacacagguacuauuggagcagugucucuugauuuuuccccgggaacaucaggcuccccuauuguggaucggaaggggaaggugguuggacuauacggaaacggaguaguaacacgauccggcgcauacgugagugcgauagcacaaacagaaaaguccauagaggcgaacccagaaauagaagaugcgauauuucgaaagaaacggcuuaccauaauggaucugcacccuggagcaggaaaaccaaaacgaucacuaccagccauaguacgcgaagccauaaaaagaggguuaagaccguugauuuuggcgccaccccgagucguaccggcagaaauggaagaaccgcuaagaggguuaccgauacgauaucaaaccccggccauaaaacccgaccacacaggaagagaaauuguugcacuaaugugucaugccccguuuacaaugagacuacucucaccagugcgaguaccaaauuacaaccuaauaauaauggaugaggcccauuucacugaccccgcgucaauugccgcacgcgguuacauuuccacgagaguugaaaugggcgaagcagcuggcauauucaugacagccaccccaccgggaucaagagauccauuuccccaauccaaugcaccuauuauggacgaagagagagaaauuccugaaaggagcuggaacucuggucacgaauggguaacagacuuuaaaggaaaaacuguuugguucgucccuucuauaaaagcuggaaaugacauugcugcaugcuuaaggaaaaauggcaagaaaguuauacaguuaaguagaaaaaccuuugauucagaauacguaaaaacccgggcaaacgauugggauuuuguagucacaaccgacauaucugaaaugggagccaauuuuaaggcagaacgagucaucgaucccagaagaugcaugaagcccguaauuuuaacagacggcgaagaacgagucauucucgcaggccccaugccaguuacacauucuagugcggcacagcgcagaggaagaauuggacgaaaccccaaaaacgaaaaugaccaauauaucuacaugggcgaaccacuggaaaaugacgaagacugugcccauuggaaagaggcgaagauguuacuugacaacauuaacacaccagaaggaaucauuccgucaauguuugaacccgaaagagagaagguagacgcuauagacggagaguaucgccuccgaggugaggcgcgaaaaacguuuguagauuuaaugagaaggggagauuugccaguuugguuagcuuacaaaguugcagcagaaggaaucaauuaugcagauagaaaaugguguuucgacgggaucaaaaauaaccagauucuggaagaaaacguggaagucgaaauauggacaaaggaaggagaaagaaagaaacuaaaaccuagauggcucgaugcacgcaucuauucugacccguuagcauuaaaagaguucaaagaguucgcagcuggacgcaagagucucacucuuaaccuaauuacggaaaugggaagauugccaacuuuuaugacacaaaaagcaagaaaugcacuagauaaccuugccgucuugcauacagccgaggcaggagggagagcuuauaaccaugcacuuucugaacuaccugaaacauuagagacauuauuacuacugacacuacuagcaacaguaacgggagguauuuuucuuuuucuuaugucgggcaaggguauaggcaaaaugacccuaggaauguguuguaucauuacugcguccgugcuuuuaugguacgcucaaauucagccucacuggauagcugccaguauaauacuggaguucuuuuuaauaguuuugcuaauaccugaaccggaaaagcaacgaacuccacaagauaaccaacuuacuuacguagugauagccauccuaacugucguagcagcuacaauggcgaaugaaaugggauuccuagagaaaacuaagaaggaccuaggcuuaggcucgauuacaacucaagaaucagaauccaacauacuagauauagacuugaggccugcuagugcuuggacacuguaugccguagcaaccacauuuguaacacccauguuaagacacucaauagaaaacaguagcguaaaugucagucuaacugcgauagcaaaccaagcaacuguccucaugggcuuaggaaagggguggccgcuaaguaagauggauaucggcguaccguuacuagcuauuggaugcuauagucaagucaaucccaucacauugacugcagcacuucuauugcugguagcgcacuacgcgauuauuggaccaggacuucaagcaaaagcaacgagagaagcacaaaaacgagcggcugcaggaauaaugaagaauccaacaguggauggaauaacagucaucgaucuugaaccgauuccauaugauccuaaauucgagaaacagcuaggacaaguuaugcuauuaaucuuauguguuacucaggugcuuaugaugagaacuacuugggcgcucugugaagcgcuuacguuagcgaccgggccgauaaguacacucugggaagguaacccggguagguuuuggaacacgacaaucgccgucucgauggcaaacaucuucagagguucuuaucucgcuggugccgggcuuuuguuuuccauuaugaaaaauacgacuaauacucguagaggaacugguaauauaggagagacucugggcgaaaaauggaaaucacgguugaacgcucuagguaaauccgaguuucaaauauauaagaaaucugguauacaagagguggacagaacacuagcuaaagaggggauaaaacggggagaaacugaucaucacgcuguaucgcgaggcucagcuaaguuaagaugguuuguagagagaaacauggucacacccgagggaaaaguuguagaccugggaugcgguagaggcgguuggucauauuauugcggcggacucaaaaacguucgggagguuaaggggcuaacaaaaggaggaccugggcacgaagaaccgauacccaugucuacauacggcuggaaucucguccgauuacaaaguggaguggauguauucuucacaccaccugaaaaaugugauacgcuccugugugauaucggugaaagcucacccaaccccacuauagaagcaggacguacucuaagaguccuaaauuugguagaaaauuggcuaaacaauaauacacaguuuuguauaaaaguacuaaacccuuauaugccaucugugauugagaaaauggaaacguuacaacguaaguacgguggugcucuuguaaggaauccauuaagccguaauucaacacaugagauguacugggucaguaaugcuaccgggaacauaguauccaguguaaacaugauaaguagaauguuaauuaauagauuuacaaugaaacauaagaaagcgacauaugaaccugauguagaucuuggguccggaacuaggaacaucggcaucgaaagugaaauuccaaaucuugacaucauaggcaaaaggaucgaaaagauuaagcaggaacacgaaaccucauggcauuaugaccaggaccacccauauaaaacuugggcuuaucacgguucauaugagacuaagcagacugguagcgcuuccaguaugguaaauggaguuguucgguuacucacgaaaccuugggauguaguaccaauggucacgcaaauggcaaugacugacaccacaccguuuggccaacaaagggucuuuaaagagaagguagacacaaggacacaagaaccaaaagaagguacuaaaaggcuuaugagaauaacagcagaaugguuauggaaagaguuaggcaagaagaaaacaccacgcauguguacaagggaagaguuuacacguaaaguaagaucaaaugccgcauuaggugcuauauuuaccgaugaaaacaaguggaaaucggcaagagaggcaguagaagacgguagauuuugggagcuuguugauaaggaaagaaaccuccaucucgaggguaaaugugaaacguguguauauaacaugaugggaaaacgagagaagaaauuaggcgaauuugggaaggcuaaggguuccagagcaauuugguacaugugguuaggagcgcgguuccuggaguucgaggcacuaggcuucuuaaacgaagaccacugguuuucccgagggaacaguuugagugguguagaaggagagggauugcaucgacuaggauacauucuuagagauguaggcaagaaagagggaggggcaauguaugcagaugauacggcaggaugggauacucgaaucacacuggaagacuugaagaacgaggaaaugguaacuaaucauaugaagggagaacauaagaaauuagcagaggcgauauuuaaacuuacuuaucagaauaaaguugugcgggugcaaaggccaacucccagaggaacgguaauggauaucauaucaagaagagaccaaagagggucuggucagguaggaacauauggacucaauaccuuuacuaauauggaagcccaacugauuagacaaauggagggggaaggaauauuuaaaaguauacaacaccugacagcgacagaagaaauagcgguacaaaauuggcuugcucgaguuggaagagaacgacuaaguagaauggcgauaucaggagacgauuguguagugaaaccaaucgaugacagauuugccucagcucuaacagccuuaaaugauaugggcaagguucgaaaagacauacaacaaugggagccaucaagaggcuggaaugauuggacccaaguucccuuuugcucucaucauuuucaugaguuagugaugaaagauggaagaguauuggucguacccuguaggaaccaggaugaacuaauaggcagagcacgaauaagucaaggggccggguggagccucaaagaaacagccugucuugggaaaucuuaugcccaaauguggacacuaauguauuuucaucguagagacuuaagauuagcugcaaacgccaucuguagcgcaguaccuagccauugggucccaacgagccgaacgacauggucaauccacgccaaacaugaguggaugacaacggaagauaugcuggcugucuggaacaggguauggauucaagaaaacccuuggauggaagauaaaacaccaguagaaagcugggaagagguaccauaccuagguaaaagagaagaucaguggugcggcucacuaauagguuugacaucuagagccacuugggccaaaaacauacaaacagcuauuaaucaagucaggucacuuauaggcaacgaagaauauaccgauuacaugcccucaaugaaacguuucagacgugaagaagaagaagcaggaguuuuaugguga

SEQ ID NO: 22641 - RNA, 9876 nt, Artificial Sequence
  derived and/or modified CDS sequence (opt6) from DENV-2__EU482606__SS-prME
acugcggguguuaucauuauguuaauuccgacagcaauggcuuuucauuuaacaacacgaaauggggaaccgcauaugaucguaggucgucaggaaaaagguaaaucuuuauuauucaaaacagaagaugguguaaacaugugcacucuaauggcuauagacuugggagaacugugugaagauacgauaaccuauaaaugccccuuacuaaggcaaaaugaacccgaagacaucgacuguugguguaauuccacgucuacauggguaacauacgguacauguacuacgacaggggaacauagaagggagaaaagaucuguugcacucguaccgcacguuggaauggguuuagaaacccguacugaaacauggaugucaagugaaggugcuuggaaacacguacaaagaauugaaacauggauacugagacaucccggauuuacgaucauggcagcaauccuugcauauacaaucgguaccacucauuuccaaagggcauuaauauucauacuccucacugcaguagcgccaagcaugacuaugagaugcauaggaauuuccaauagagauuuuguugaaggaguuucgggaggaucuuggguugauauuguguuagaacauggauccuguguaacaacaauggccaaaaauaaaccaacucuagacuuugaauuaauuaaaacugaagcuaaacaacccgcaacucuacguaaauauuguauagaagcuaaauuaacaaauacuacuacagaaucacguugcccgacacaaggagaaccuucucugaaugaagaacaagacaaaagauuuauuuguaaacacaguaugguagauagaggaugggggaacggguguggacuguuuggaaaaggcggcaucguuacaugugcaauguucacuuguaaaaagaauauggaaggaaaaguaguucaaccugaaaaucuagaauauaccaucgugauaacgccccauucaggcgaagaacaugcggucggaaaugauacaggaaaacauggaaaagaaauaaaaauuacuccacagucauccauaacagaagcagaacuuacaggguauggcacuguuacaauggaaugcucgcccaggacuggauuagacuuuaaugaaauggucuuauuacaaauggaagacaaggcuuggcuuguccauagacaaugguuccuggaccuacccuugccgugguuacccggugcugauacucagggaucaaauuggauucaaaaagagacguuagugacguuuaaaaauccucacgccaagaaacaagauguagucguacucggaagucaagaaggugcaaugcauacagcucuaacgggcgcaacugagauucagaugucaaguggaaauuuauuauuuacgggacaucuuaaaugucgacugagaauggacaaauuacaacugaaagggaugaguuauuccaugugcacgggaaaauucaaaaucguaaaagaaauagcagaaacucaacacggcacuauagugauucguauacaauaugagggugacgggagcccuuguaaaauaccauucgaaauaacagaucuagaaaaacgacacguucucgguaggcugauaacaguaaauccaauaguaauugaaaaagacucaccagucaacauagaagcugagccaccauucggggauucuuacauaaucauaggugucgaaccgggccaguuaaaacuuaauugguucaagaaagggucaucaauuggacaaauguuugaaaccacgaugagaggggcuaaaaggauggcaauauuaggagacacggcaugggauuuugguucacuuggcggcguuuuuaccaguauaggaaaagcccuacaucaaguuuucggagcaauauacggugcagcuuuuagugggguaaguuggacaaugaaaauccuaaucgggguuguuauuacuuggauaggaaugaauagccgcucgacuucgcucagcguuagcuuagugcuaguagguguaguaacacuauaccuuggagcaaugguacaagcugacaguggcugcguggucucauggaaaaauaaagaguuaaaauguggaucagguaucuucauaacagacaauguucacacguggaccgaacaauacaaauuucaaccagagucaccaaguaaguuagcaucagccauacaaaaggcacacgaagaggggauuuguggaauccgaagcguuacgaggcuugagaauuuaauguggaaacaaauuacccccgaacugaaucauauauugagcgaaaacgagguuaaauuaacuaucaugacaggggacacaaaagguauuaugcaagcuggaaagcgaucgcuacggccccaacccacggagcugaaguauucauggaaaacuuggggaaaggccaaaaugcuuucaacagaaucacauaaccagaccuuccuaauugacggacccgagacugcugaguguccgaauacuaauagggcuuggaacuccuuagagguagaagauuacgguuucggaguauuuacaacuaacaucuggcuaaaacuccgagaaaaacaggauguguuuugugacaguaaauuaaugagcgccgcgaucaaagacaaucgcgcuguacaugcagauaugggcuacuggauugagucggcauuaaacgacacuuggaagauggaaaaggcuuccuuuaucgaaguuaaaaguugccauuggccuaaaucccacacauuauggagcaauggaguccucgaaagugagaugauaauccccaaaaauuuugcuggcccaguaucucagcauaacuacagaccaggcuaucauacucaaacugcuggaccauggcaucuuggcaaguuagagauggacuuugacuucugugaaggaacuaccguaguaguaacugaagacugcggaaaccgaggacccucucuucguacaacuacagcuucaggcaaauuaauuacggaaugguguugucgcucauguacauuaccuccgcugagauacagaggugaggacggaugcugguacggaauggaaauacguccauuaaaagaaaaagaggagaauuuaguaaacuccuuaguuacagcaggacauggucagauagauaacuucagucuaggcguucuaggcauggcauuguuuuuagaagaaaugcugcguacaagaguaggaaccaaacaugcuauauuguuaguagcagucaguuuuguaacacuuaucacuggaaauaugucuuucagagacuuagguagagucaugguaauggucggugcgacaaugacggaugauaucggaauggguguaacuuauuuagcguuacuugcagcguuuaaaguucggccaaccuucgcugcaggccuacuacuccgaaaacuuacuucuaaagaauuaaugauggcaacgaucggcauuacguuguuaucgcaaagcacaauucccgaaaccauauuagaauuaacagaugcguuagcacuaggcaugaugguauuaaaaauugugagaaacauggagaaauaccagcuagcaguaacaauuauggcuauaucuugugugccuaacgcugugauacuucgaaacgcuuggaaagugaguuguaccauauuggcugcaguauccguaagccccuugcugcuaacaucuucacagcaaaaagcagauuggaucccacuugcuuuaacuauaaaaggcuugaaucccacugcgauauuuuuaacuacguugucucgcacgagcaagaaaagauccuggccauuaaacgaggccauuauggcuguagguauggugucuauacuagcuucaaguuuauugaagaaugacaucccuaugacggguccauuaguggcuggugggcugcugaccguuuguuacguauuaaccgguaggagugcagaucuagaauuagaacgagcugcagaugugaaaugggaggaucaagccgagauauccggaaguucuccaauauugaguauuacuauaucagaagauggaucaaugucaauuaaaaacgaagaagaagaacaaacucuaacuauuuuaauacguacaggccuacuugugauaucagguguuuuuccaguaaguauacccaucacggccgcggcaugguaucuaugggaagucaagaaacaaagagcggggguuuuaugggacgucccuuccccaccuccggucggaaaagccgaacuagaagauggagcauauagaauuaaacagagaggcauucucggcuacagucagauuggggcaggcguuuauaaagaagguacauuucauacuauguggcacguuacucgaggagcgguacuuaugcauaggggaaagcguauugaaccauccugggccgauguaaagaaagacuugauaucguaugguggugguuggaaacuugaaggagaauggaaggaaggagaagaaguacaaguucuugcauuagaacccggcaaaaaucccagagcaguacaaacgaaaccugggauuuucaaaacaaauaccggaacgauaggagcggucagcuuagacuuuucaccuggaacaucuggaagccccauaguagaucgaaaggggaagguaguaggauuauacgguaacggggucguuacuagaaguggugcguacguaucugcaauagcccagacagagaagucgaucgaggauaauccagaaauagaagaugauauauuucguaagaagagauugacaaucauggaccuacauccaggagcuggcaaaacaaaaagguacuuaccagccauugucagagaggcgaucaaacgggguuuaagaacgcuaaucuuagcuccuacaagggucguugcagcugaaauggaagaggcgcuucgcggccuaccaaucagguaccagacgccugcuaucaaagccgaacauacgggacgugaaauaguagaccuaaugugucacccaacuuuuacaaugagauuguugucaccaguucgugugccaaacuauaacuugaucauaauggacgaggcacauuucacagaccccgccucuauugcagcaagaggcuacaucucuacaagaguggaaaugggagaagcagcggguaucuuuaugacagcaacaccacccggaagcagagauccauucccgcaaagcaacgcgcccaucauggaugaagaacgggaaauaccagaacguucauggaacucuggucacgaauggguuacugauuucaaaggaaagacagucugguucguaccaaguauaaaggccgguaaugauauagcugcuugucuccgaaagaauggaaagaaagugauacaauugucacggaaaacauuugauuccgaauacguaaaaacaagggcgaacgacugggauuucguugugacaaccgacaucucggaaaugggagcaaacuucaaagcugaaagaguuaucgacccgagacguuguaugaagccuguuauacuaaccgauggugaagaaagaguaauacuugcaggaccuaugccggucacacauaguucagcggcacaaagacguggaaggauaggccgaaacccuaaaaaugaaaaugaucaauauauauauaugggggaaccucuagaaaaugacgaagauugcgcacacuggaaagaagcaaagauguuacuagauaauauuaacacucccgaaggaauuauaccuagcauguucgaaccggaaagggaaaaagucgaugcaaucgauggagaguacagacucagaggcgaagcaagaaaaaccuucguugaucugaugcguaggggagauuuaccggucuggcucgcauacaagguugccgcugaagggauuaauuaugcggaucguaaaugguguuucgaugguauuaagaauaaccagauucucgaggaaaacguggaaguagaaauauggacaaaggaaggugaacguaagaaacuuaaaccucgcugguuagacgcuagaauauauucugauccccuugcccuuaaggaauuuaaggaauuugcagccgggaggaaaucacuuacguuaaauuuaaucacugaaauggggcgucuacccaccuucaugacacaaaaagcucguaaugcuuuagacaaucuagcaguauuacauacagcagaggcuggaggcagagccuauaaccacgcacugucagaauuaccggaaacccucgaaacacuauuacuccuaacgcuucuugcgacgguuacaggaggcauuuucuuauuucuaaugucugguaaagguauuggaaagaugacucuagggauguguuguaucaucacagcuaguguguuauugugguaugcacaaauccagccucacuggauagcagcaucuauuauuuuagaauuuuuccucauaguauuauuaauaccagaaccagaaaagcaaaggacuccucaagacaaucaacugacauacgucguaauagccauacugacagugguagccgcuacaauggcuaaugaaauggguuuccuagagaaaacgaaaaaggacuuagggcuaggcaguauuacaacacaagaaucugaaucgaacaucuuggacauagaucuaaggccggcauccgccuggaccuuauaugcuguggccacgacauuuguuacacccaugcuuagacauucgauugaaaacucaagugucaauguuucacucacagcaaucgcuaaccaagcuacaguacuaaugggcuuaggcaaaggauggccucuuucaaaaauggauaucggagucccccuccucgcuauaggcuguuacagccaaguaaauccaaucacauugacggcagcacuucuacuguuaguagcccacuacgccauaauagggccaggucuacaggcgaaagcaacuagagaagcacagaagagagcggcggcaggcauaaugaagaauccgacgguggacggaauaacgguaauugauuuagagccuauuccauaugaucccaaauuugaaaaacaauuaggacaagucauguuauuaaucuugugcgucacacaagucuugaugaugcgaaccacaugggcacuaugugaagcacuaacccuagccaccggaccuaucaguaccuugugggagggaaacccaggucguuucuggaacacaacaauagcgguuagcauggcuaacauauucagaggaucguacuuagcuggagcaggucuacucuuuaguaucaugaaaaacacuacaaauacacggcgcggaacggggaauauaggagaaacucugggagaaaaauggaagucaagacuaaaugcauuggguaaaagcgaguuccaaaucuauaagaaaucagguauucaagaagucgacagaacucucgcaaaagagggaaucaaaagaggagaaacagaccaccacgcgguaagcagggguagcgcgaaauuaagaugguuuguggaaaggaacaugguaacuccagaggggaaaguuguagacuuaggguguggaagaggugguugguccuauuauuguggaggacugaaaaauguccgagaaguaaaaggucuuacuaaagguggcccuggccaugaagaaccgaucccuaugucuacguacgguuggaauuuaguccgucuucaaagcggaguagauguguucuuuacucccccugaaaaaugugauacacuauuaugugauauaggugaaaguucaccuaauccuacuauugaagcaggaaggacccugagggucuuaaaucugguagaaaacuggcuuaauaauaacacgcaauucugcauaaaaguacuuaauccauacaugcccaguguaauagagaaaauggaaacucuucagagaaaauaugggggcgcacugguuagaaaucccuuaagucgaaacucuacccacgaaauguacuggguaucuaaugcaacaggaaacauaguaaguuccgucaauaugauaucccgaaugcuuauaaaucguuuuacuaugaaacacaaaaaggcuacuuaugaaccggacguggaucuugggucagguacucgcaauauagguauagaaucagaaauuccaaacuuagauaucauuggaaaacgaauagaaaagauaaaacaggaacacgaaacaucuuggcacuacgaccaagaucauccauauaaaacgugggcguaucaugggucauaugaaaccaaacagacuggaucugccucuucuaugguaaauggaguggugagauuauuaacaaaaccuugggauguuguaccaaugguuacacagauggccaugacagacacuacaccuuuuggacaacagagaguguuuaaagaaaaagucgacacuaggacccaagagccaaaggaagguacaaagaaauuaaugcguauaacagcagagugguuauggaaagaauuagguaaaaagaaaaccccacggauguguaccagggaagaguucacaagaaagguucgaaguaaugccgcacuaggagccauauuuacagaugaaaauaaauggaaaagugcgcgugaagccguagaagauggaagauuuugggaacuuguagauaaagaaaggaauuugcaucucgaaggaaaaugcgagaccuguguauauaauaugaugggaaaacgggagaagaaauuaggugaauuugguaaagcgaaaggcagcagagcuauuugguauauguggcuaggcgcgagguuuuuagaguucgaagccuuaggauuuuuaaaugaggaccacugguuuagucgcgggaauaguuuaucagguguagaaggcgaaggguuacaccgucuuggcuauauauuaagagauguuggcaagaaagaaggaggagcaauguacgcagacgacaccgcugguugggauacacgcauaaccuuagaagauuuaaagaacgaggaaauggugacaaaccauaugaaaggcgaacauaagaaauuggcagaagccaucuuuaaacuaacuuaucaaaacaaaguggucagaguacaaagaccuacuccgagagggacugugauggacauuauaaguaggcgagaccaacguggauccggacaaguaggaacuuauggcuugaauaccuucaccaacauggaagcacagcugauuagacaaauggagggggaagggaucuuuaagucaauacagcaccuaaccgcuaccgaagaaaucgcugugcaaaacuggcuagcaagaguuggaagagagaggcuuaguagaauggcuauaaguggagaugacugugucguaaaaccgauagacgauagauucgcaucagcauuaacugcucugaacgacaugggcaaaguccgcaaagauauacaacaaugggaaccuucgagagguuggaaugacuggacacagguccccuucugcagccaucauuuccaugaauuggugaugaaagacggucggguauuagugguaccuugccgcaaucaagacgaauugauaggccgcgccaggauaagccaaggggcaggauggucucuaaaagaaacagccugucuugggaaaucguaugcacagauguggacauuaauguacuuccacaggagagaccugcguuuagcggcuaacgcuauaugcucagccguuccaucucauugggugccaacaucuagaaccacauggucaauacaugcaaaacacgaguggaugacuacagaggauaugcuagcuguuuggaaccgcguauggauccaggagaaccccuggauggaagauaaaacaccuguugaauccugggaagaaguaccuuacuuaggaaagagagaggaucaaugguguggaucacugauaggguugacauccagagcuaccugggcuaaaaacauacagacagcuauuaaucaggugcguucucuaaucggaaaugaagaauacacagauuacaugcccucaaugaagagauucagaagagaagaagaagaagccggcgucuuaugguaa

SEQ ID NO: 22642 - RNA, 9876 nt, Artificial Sequence
  derived and/or modified CDS sequence (opt6) from DENV-2__EU482607__SS-prME
acagcagggguaauaguuauguuaauacccaccgcaauggcauuucaucucacuaccaggaacggagaaccacauaugauugucggacgccaagaaaaagggaaaaguuuauuauuuaaaacagaagauggaguaaacaugugcacauuaauggcgauugaucuaggagaauuaugugaagauacgauaacauacaaaugcccacuauuacggcagaaugaaccggaagacauugacuguugguguaacuccacaaguacguggguaacguacgguacauguacgacaacaggagaacaucgaagagaaaaacggucuguagcauugguuccccauguaggaaugggauuagaaacaagaaccgaaaccuggaugaguucagaaggagcauggaaacacguccaacgcauagagacuuggauuuuacggcauccuggauuuacuauaauggcagcaauacuugcuuacaccauaggcacaacucacuuucagagagcacugauuuucauauuauugacagcaguagcuccuagcaugacaaugagaugcauuggaguuucuaacagggauuuuguugaagguguuucuggagguucauggguagacauaguucuggaacaugguucauguguuacuacaauggccaaaaacaaaccaacacuagacuuugagcugauaaaaacggaagcaaaacaaccagcuacccuaagaaaauacuguauagaagcaaaacugacaaacaccacuacugaaagcagaugcccuacucaaggagaaccgagucucaacgaagaacaagauaaacgauucauauguaaacacagcaugguggauagaggguggggaaauggauguggccuauucgguaaaggagggauaguaacaugugcaauguuuacauguaagaaaaauauggagggcaaagugguacagccagaaaauuuagaauauacuaucguaauaacaccacacuccggggaagaacacgcaguugguaaugacacagguaaacaugguaaagaaauuaaaauaacuccucaaucaaguauaauagaagcugaacuuacuggcuauggaacagucacaauggaguguaguccgagaacggguuuagauuucaaugaaaugguccuauuacaaauggaagacaaggcauggcuuguucacagacagugguuccuugaucugccgcucccauggcuacccggggcagauacacaagguaguaacuggauacaaaaagaaacuuuagugacauucaagaacccccaugccaagaaacaagacguaguugucuuaggaucacaggaaggugcuaugcacaccgcccuaacgggugcgacggaaauucaaaugucuucaggaaauuuguuauucacgggacaucugaaaugccgacuaagaauggauaaauuacaauuaaaggguaugagcuauagcaugugcacaggaaaguucaagauaguaaaagaaauagcagaaacccaacacgguaccauaguaaucagaguucaauacgaaggagauggcucaccgugcaaaauaccuuucgaaaucacagauuuggagaaaaggcacguuuuaggaagauuaauaacagugaauccuaucguaacagguaaggauaguccaguaaacauugaagcagaaccaccguucggcgauucuuacauaauaauagguguagaaccuggacaauuaaaauuaaauugguucaagaaggggucaaguauuggccaaauguuugaaacaacaaugagaggugcuaagaggauggcgauacuaggugacacagccugggauuuuggaucgcuaggaggagucuucacaucaauaggcaaagcgcuacaccaaguauucggagccauauauggugcagcauuuucuggggugagcuggacaaugaaaauucugauaggaguaauaauaacguggaucgggaugaauagcagaagcaccagccuuucugugucauuaguucuaguugguguuguaacgcuuuauuuaggggcaaugguccaagcugauagcggaugcgugguaucuuggaagaauaaagaauuaaaaugugguagcggaauuuuuauaaccgacaacguucauacuuggacagaacaauacaaauuucaaccugaaucacccuccaaacuagcaucugccauacaaaaagcgcaugaggaaggaauauguggcauccguucgguaacuagguuagagaaucucauguggaaacaaauaacgccggagcuuaaucauauacuaucggaaaaugaagucaaauuaacuauaaugacaggagacaucaaaggaauaaugcaagcagggaaacgaucccuacgaccucagccuacagaacugaaguacucuuggaagacaugggggaaagcaaaaauguuaucuacugaaagccacaaucaaacguuucuaauagacgggccggaaacggccgaaugcccuaauacaaaucgugcuuggaacuccuuagaaguagaagacuacgguuuugguguuuucacuacaaauauauggcuaaaacuaagggaaaagcaggauguguuuugugauaguaaacuuaugagugcggcgauuaaagauaaccgcgcaguacacgcggauaugggauauuggauugaaucggcacugaaugauacuuggaaaauggaaaaagcaaguuucauagaggugaaaagcugucacuggccaaaaagucauacauuaugguccaauggaguauuagaaucagaaaugauaauccccaaaaauuuugcagguccaguaagucagcauaacuauaggccuggauaccauacgcaaaccgcugguccauggcauuuaggaaaacuugaaauggauuuugacuucugcgaaggaacuacagugguaguaacggaagacuguggaaacaggggcccgucauugaggacaacaacugccagcggaaaacugauuacagaaugguguugccgcuccuguacauuaccgccguuacgauaucggggugaagauggauguugguaugguauggagauuagaccacuuaaagaaaaagaagaaaaucuagugaacucuuuagugaccgcaggucacggacagauagacaauuuuucauugggugucuuagggauggcacuuuucuuagaagaaaugcuccguacacgagugggaacaaaacaugcuauccuacuugucgcaguaucuuuugugacccuaauaacgggaaacaugucauuuagggaucuaggaaggguuauggucauggucggagcaacgaugaccgacgauauaggaauggguguaacuuaucuagcauuauuagcagcuuucaagguaagaccaacauuugcagccggauugcuguuaagaaaauuaacaagcaaggaacuuaugauggcaaccaucggcauagcacuacucucgcaaucaaccauaccugaaacuauacuagaacuaacggaugcgcuagcacuaggaaugaugguucuuaaaauugugagaaacauggaaaaauaucaacuagcuguaacagucauggcaauuuccuguguaccaaacgccguaauucuucaaaaugcauggaaagugaguugcacuauacuugcagccguaucgguaucaccucuuuuacucacuucaagucagcagaaagcggauuggauuccauuggcauuaacgauaaagggucucaacccaacagcuauauuccugacaacauuaucacgcacuagcaagaaaagaaguuggccgcuaaacgaagcgauaauggcaguagguaugguauccauacucgcuaguucgcuacucaaaaaugauauuccuaugacaggaccacuugucgcgggaggguuguuaacaguauguuaugugcuaacaggcagaagcgcagauuuggaauuagaacgagccgcugacguuaaaugggaagaccaggcagaaauaucuggauccucgcccauacuuagcauuacuauaagugaagaugguucaaugucaaucaaaaacgaagaggaggaacaaacacuuacaauccugauccggacuggauuauuagucauaagcgguguguuuccugucagcauccccaucacagcagcugcuugguaucuaugggagguuaagaaacagagagcgggcguuuugugggaugugccaaguccaccacccguuggaaaagcugaauuagaggauggagcauauaggauaaaacaaagagguauucuuggauauucgcaaauaggugcgggcguuuauaaggaagguacuuuucacacaauguggcaugugacaagaggggcuguucuaaugcacagagggaagcguauugagcccagcugggcagaugucaagaaagauuuaaucaguuauggagggggauggaaguuagaaggugaguggaaggaaggggaagagguacaaguucuugccuuagaaccagguaaaaauccccgagcaguucaaacuaaacccggaauuuucaaaacugacaccggcacaaucggcgcugucucauuagacuucucccccgguacaaguggaagcccgauuguagaccgaaaaggaaaaguuguaggacuuuacggaaacggaguuguuacuagaagcggagcauacgucucagcaaucgcacaaacggaaaagucuauugaagacaauccugaaauugaagacgacauauuuaggaagaaaagauuaaccauaauggaucuacacccaggugcugguaaaacgaaaagguaucuuccagcuauaguccgggaagcaauaaaaagagguuugcgaacacuaauauuggcgccaacuagagucgucgcugcugagauggaagaggcucuuagaggacucccaauacgguaccagacgccagccauaaaagcagaacacacugguagagaaauaguugaccuaaugugucaugcaacguuuacuaugaggcuacuuaguccagugaggguccccaauuacaaucucaucauaauggaugaagcacauuucacagacccggcaucaauugcugcucgcggauauauuagcacaaggguagaaaugggagaagccgcagggauuuucaugacagccacaccaccagggagucgagaucccuucccgcaaagcaacgccccaauuauggacgaagaacgcgaaauaccggaacgaucuuggaauagcggacaugaguggguaacagacuuuaaagguaaaaccgugugguucguuccaaguauaaaagcggguaaugacauagcggcuugucuaaggaagaacggcaagaaagucauucaauugagucgcaaaacuuuugacagcgaauauguaaaaacccgcgccaaugauugggauuuuguuguuaccacugauaucagugaaaugggggcuaauuuuaaggcugaacggguuauagacccaagaagauguaugaagccaguuauacuuacggauggcgaagagaggguaauucuugcagguccuaugccuguuacacauucaucugcagcccaaagacggggaagaauagggcgaaaccccaaaaacgagaacgaccaguacauuuacaugggcgaaccuuuagagaaugaugaggacugcgcgcauuggaaagaagcaaaaauguuauuagacaauauaaacacuccagaaggcauaauaccaucaauguuugagcccgaaagagaaaaaguggaugcuauagacggcgaauauagauugagaggugaggccagaaaaacauuuguugaucuuaugcguagaggagaccuucccguuugguuagcauacaaaguugcagccgagggaauuaacuacgcagacaggaaauggugcuuugacggaaucaaaaauaaccaaaucuuagaggaaaauguagagguagaaauauggacaaaagagggagaaaggaagaaauuaaaacccagaugguuagacgcacgaauauauagcgauccuuuagcauuaaaagaauuuaaagaauuugcagcuggucguaaaucgcuggcacuuaauuugauaacagagaugggcagacuacccacauuuaugacgcagaaagcgagaaaugcauuggauaauuuggcggugcuucacaccgcagaagccggugggagagcauauaaucaugcacuuagcgaacuaccugagaccuuggagacguuacuacuucugacauugcuugcaacuguuacuggagggauauuuuuguuccuaaugucugguaaaggaauaggaaaaaugacucucggaaugugcugcauaauuacugcuucuguacuacuaugguaugcacaaauacaaccccauuggaucgcagcgucaaucauuuuggaguucuuccuaaucguacuguuaauacccgagcccgagaaacaacgaacaccacaggauaaccaacuuaccuaugugguaaucgcuauacuaaccguaguugcugcaaccauggccaacgaaauggguuuccuagaaaagaccaagaaagauuuaggucuagguucgaucacgacucaagaaagcgagucuaauauauuagauauugaucuacgaccggcuucagcauggacuuuauacgcuguagcgacaacguuuguaacgccaauguugagacauaguauagaaaacuccagcgucaacguauccuugaccgccauagcaaaucaagcuacaguguuaauggggcuaggaaaggguuggccuuuaucaaagauggauaucgguguaccacugcucgcaauagguugcuauucacagguuaacccuauaaccuuaaccgcugcgcuauugcucuuaguagcacacuacgcgauaauaggacccggacugcaagcgaaggcuacuagagaagcccagaagcgggcagcggccggaauuaugaagaacccaacagucgauggaauaacagugauugacuuagagccaauacccuacgauccaaaguucgaaaaacaauuaggacaaguaaugcugcugaucuuaugcgugacacaagucuuaaugaugcguacaaccugggcgcucugcgaggcuuugacacuagccaccgguccuauaucaacuuuaugggaaggcaacccgggaagauuuuggaacacaacaaucgcaguauccauggcuaauauauuuagaggaucauauuuagcuggagccggacuucuuuucuccauaaugaaaaauaccaccaacacccguagggggacaggaaauauaggggaaacacucggagaaaaauggaagucaagguuaaaugcucucggcaaauccgaguuccaaauuuacaagaaaucaggcauucaagagguggauagaaccuuagccaaagaaggaauaaaaaggggcgaaaccgaucaucaugcggucucacguggcagcgcaaagcuccguugguuuguugagcguaacauggucacuccagaaggaaagguuguggauuuagguuguggacgaggaggauggucuuacuauugugggggauugaaaaaugugagggaaguuaaagggcuaacuaaaggaggcccuggucacgaagaacccauacccaugucgaccuacggauggaaccuuguacgcuuacaaucaggaguggacguauuuuucaccccaccagaaaagugcgauacauugcuuugcgauauuggagaaucauccccaaauccgacuaucgaagcaggaagaacccuuagggugcugaaucuugucgaaaacugguuaaauaauaauacccaauucuguauaaaaguuuuaaauccuuauaugcccucaguaauugaaaagauggaaacguuacaaagaaaauaugguggagcuuuaguucgaaauccucucagucgaaauuccacacaugaaauguauuggguuuccaaugcaacaggcaacauuguuucgucgguaaacaugauaaguaggaugcuuauaaacagauucacaaugaaacacaagaaagcaaccuaugagcccgacgucgaucuugguucggguacgagaaauauaggaauugaaucugaaaucccgaacuuagacauaauagguaaacguauagagaagauuaaacaagaacacgagacgucuuggcacuacgaccaggaccauccauauaaaacaugggcauaccauggaaguuaugaaacuaaacagacaggaucugcgucaaguauggugaacggaguaguaagguuauugacuaaacccugggauguugugccaauggugacucaaauggcaaugacagacacuacaccuuuugggcagcagagaguuuucaaagagaaaguggauacacguacacaggagccaaaagagggaacgaagaaacugaugaaaauaacggcagagugguuauggaaagaauuagggaaaaagaaaaccccucggaugugcacacgagaagaguucacaagaaaaguaagguccaaugcagcacuaggcgcaauuuuuacugacgaaaauaaauggaaaucggcaagagaagcaguagaagauggaagguucugggaacuggucgacagagaacguaaccuucaccuagaaggaaaaugcgaaacuugugucuacaauaugauggggaaaagagaaaagaaauuaggggaguucgguaaagcgaaagggagcagggcaauaugguacauguggcuaggggcacgauuccuugaguucgaagcucuaggcuucuuaaacgaagaccauugguucucccgcggaaauucuuuaucaggcgucgaaggagaaggacugcauagauuaggguacauucuaagagauguagguaagaaggaagguggagcaauguacgcggacgauaccgcaggaugggauacgagaauuacauuggaggaccuuaaaaaugaagagaugguuacaaaucauaugaaaggugaacauaaaaaguuggcagaggcaauauucaaacuaacauaucaaaacaaggucguccggguccagcguccgacuccucguggaacgguuauggacauuauaucuagaaaagaucagcgcgguucgggucaggucggaacguauggacucaauaccuuuacaaacauggaagcccaacugauaagacagauggaaggagaaggaaucuuuaaaucuauucagcaccugacagcgacagaagaaaucgcagugcagaacugguuaacacguguugggcgugaacgacucucuagaauggcaauaaguggagacgauugcguaguaaagccgauagacgauagauuugcuagcgcauuaacagcucuaaacgauauggggaagguucgaaaggacauucagcagugggaaccuucuagagguuggaaugauuggacacagguaccauuuugcucucaucauuuucacgaauugguaaugaaagacggucguguacuugucgucccuugcagaaaccaagacgaacuaaucgguagggcaagaauaucccaaggagccggguggucuuuaaaggagacagcguguuuagggaagaguuacgcccaaauguggacgcucauguauuuccauagacgggacuugcgccuagcagcgaaugccauuugcagugccguaccuucacauuggguccccacaucacggacgacauggaguauacacgcaaaacacgaauggaugaccacugaagacaugcucgcagucuggaaccggguauggauacaggaaaauccguggauggaagauaaaacacccguagaaucaugggaagaaguuccuuaucuuggaaaacgagaagaucaauggugugguucucucaucgggcugaccucacgugcuacuugggccaaaaacauucagaccgcuauaaaccagguuaggucauuaaucgguaaugaggaauacacugauuauaugcccucaaugaagcgauuucgcagagaagaggaagaagccggaguacuaugguaa

SEQ ID NO: 22643 - RNA, 9876 nt, Artificial Sequence
  derived and/or modified CDS sequence (opt6) from DENV-2__EU482608__SS-prME
acagcaggaguuauaaucaugcugauaccuacggcaauggcauuucauuugacaacgcguaauggagaaccacacaugauagugggaagacaagaaaaaggaaagagcuuauuauuuaaaacugaagauggaguaaauauguguacacuuauggcuauagaucuuggagaacuaugugaagacacuauuacguauaaauguccauugcuuagacaaaacgaacccgaagauauagauuguugguguaacucaaccagcacauggguuacguaugguacguguacuaccacaggugagcaccguagagagaaaaggucuguagcccuuguuccgcauguagguauggggcuagaaacaaggacugaaacauggaugucaucagaaggugcuuggaaacauguacaacgaauugaaacguggauauuacgacauccgggauucacaauaauggcagcaauccuugcuuauacuaucggaacuacucauuuccaacgagcauuaaucuuuauucuacuaacugccgucgcaccauccaugacuaugcgauguauaggaauaucaaaucgcgauuuuguugaaggagucucgggaggcagcuggguugauaucguauuagaacacggaucaugcguuacaacgauggccaaaaauaaaccuacauuggauuuugaauuaauaaaaacagaagcaaaacaaccggcaacuuugaggaaauauugcauagaggcaaaacuaacaaacacgaccacagaaucaagguguccaacgcaaggugaaccuucucuaaacgaagaacaagacaaacgauucauauguaaacauagcauggucgaucgaggaugggguaaugguuguggauuauuuggaaaaggaggaauaguuacaugugccauguuuacauguaagaaaaacauggaaggaaaaguaguacagccugagaacuuggaauauaccauuguaauaacaccucacucaggagaggaacaugccguagguaaugauaccggcaaacacggaaaagagaucaaaaucacaccucaauccucgauaacugaggcagaacugacaggauacggcacuguaacgauggagugcucuccuagaaccggauuggacuuuaacgaaauggugcuauuacaaauggaggauaaagcaugguuaguacauagacaaugguucuuggauuuaccauuaccgugguugcccggagcugauacacagggcucuaauuggauccagaaagagacccuaguaacauuuaaaaauccucacgccaagaaacaagauguaguuguacuagguucacaagaaggugcuaugcauaccgcucuaacaggagcaacugaaauucagaugucuucaggaaaucuucuauucaccggacaucucaaaugccgauugcguauggauaaacuccaguuaaaagguaugagcuacucaauguguacagguaaauucaaaaucguuaaagaaaucgcagaaacacaacauggaaccauagugauuaggauacaauacgaaggugacggaaguccauguaaaauucccuucgagaucacagaucuagagaaacgccauguguuaggacgacucauuacaguaaauccuauuguaauagagaaagacagccccguuaauauagaggcagagccuccauuuggugauagcuacauaauaaucggcgucgagccaggccaacuuaaauuaaauugguucaagaaaggaucgagcauaggacaaauguuugaaacuacgaugcgaggagcuaaacgcauggccauauuaggagauacugcaugggauuuuggaucccuagggggaguauucacaaguauaggaaaagcgcuacaccaaguguuuggugcaauauauggagcggcauuuaguggaguaagcuggacaaugaagaucuuaauugggguaguuauaacauggauugguaugaacucgagaaguacgucuuugucugucucgcuuguccuaguugguguuguaacauuauaucuaggagcaaugguacaggccgacagugggugugugguuuccuggaagaauaaggaacugaaaugugguucagggauauuuauaaccgauaauguccauacguggacggaacaauauaaguuucaaccugaaucuccaucaaagcuggcaagugcaauacagaaagcccaugaggaaggaauuugcggaauaaggucaguaacaaggcuugaaaaucuaauguggaaacagauaacuccagaacuuaaccacauacuaagugaaaacgaaguuaaacuuacgauaaugacgggagacacaaaagguauuaugcaggcugggaaacguucccuaagaccucaaccgacagaauugaaauauuccuggaagacguggggaaaggccaagauguugucaacggaaucacacaaccaaacguuuuugauagauggaccggaaacagcagagugucccaauacaaauagagccuggaacucuuuagagguagaggauuacggcuucgguguauucacuacuaauauauggcuuaaacuuagggaaaaacaagacgucuucugugauuccaaacuuaugucggcagcaauuaaagacaauagagccguccacgccgacaugggauauuggauugaaucggcccuaaacgauaccuggaagauggaaaaggcaaguuuuauagagguaaagagcugucauuggccaaaaagucauacuuuguggucgaauggaguccuagagucugaaaugaucauccccaaaaauuucgccgggccagucucccaacauaauuaccgaccgggauaucauacgcaaacagcagggccuuggcaucuaggaaaauuagaaauggacuucgauuuuugcgaagggacuacaguagugguuaccgaagacuguggaaacagaggaccuucccuaagaacaacuacugcuucugggaaauugauaacagaauggugcugucgauccuguaccuuaccaccuuugagguaucgcggcgaagaugguuguugguauggaauggaaauuagaccccuuaaagaaaaagaggaaaaucuuguuaauaguuuagugacugcgggccaugggcaaauagauaacuuuuccuuggguguuuuaggaauggcauuauuccuugaagaaaugcuuaggaccaggguaggaaccaagcaugcgauucuuuuaguagcgguaucauuuguuacguugauuaccggcaauaugucauuucgcgaccuagggagaguuauggugauggucggugcaacaaugaccgaugacauaggcauggguguuacauaccuagcguuauuagcugcuuuuaaaguaagaccaaccuuugcagcaggauuauuacuacggaaacuuacaucaaaggagcuaaugauggcaaccauaggaauuacacuauuaucacaguccaccaucccagaaacuauacuugagcuaacggaugcacuagccuuaggaaugaugguacugaaaaucguucguaauauggagaaauaucaauuagcugucacuauaauggcgauaucaugugucccaaaugcaguuaucuuacguaacgcuuggaagguuucauguacaauucuagcagcaguuucaguuuccccguuacucuuaacgaguucucagcaaaaggcagacuggauaccgcucgcauuaacgauuaagggcuuaaauccaacugcgauuuuccugaccacccucucgcgaacaucaaagaaaagaucauggccauugaaugaagcaauaauggcaguuggcaugguuagcauauuagcgucuuccuuauugaaaaacgacauaccuaugaccgguccuuugguagcugggggauuguuaaccguauguuauguguugacggguagaucugcggacuuggaauuagaacgagcggcagacguaaaaugggaagaccaagccgagauaucugguucuagcccaauccuuagcauaacaaucuccgaggauggguccaugucgaucaaaaaugaggaagaagaacaaacgcugacuauucuaauacgcacuggucuacucguuauaagugguguauucccuguuuccauccccauuacugcagcugccugguauuuaugggaaguuaagaaacaaagagcugguguauuaugggacguacccagucccccuccagucggaaaagcagaauuagaagauggagccuaccguauaaagcaaagaggaauccuaggauauagccagauaggagcgggggucuauaaagagggaacuuuucauacuauguggcacguuacucggggagcuguguuaaugcauagaggaaaacgaauagaaccaucuugggcugaugucaagaaagauuuaauuucauauggagggggauggaaguuggaaggugaauggaaagaaggugaggaaguccagguccuagccuuagaacccgguaagaauccuagggcaguucagaccaaaccuggaauuuuuaaaacaaacacugggacgauuggugccgucagccuugauuuuagcccaggcacuagcggcucaccaauaguugaucgaaaagguaaggucguaggacuuuaugguaacggcguggucacaagaagcggagcuuaugucucagcaauagcccaaacagaaaagucgaucgaagauaauccugagauugaggaugacauauuuagaaagaaacgacuaacgauaauggaucuacauccgggagccggcaaaacgaaaagauaucugccagcgauaguuagagaagcuauaaaaagagggcuuagaaccuuaauacucgcgccaacgcgaguugucgcggcugaaauggaggaagcacuucggggacuaccaauacgguaucaaacuccggcaauuaaggcggaacauacugggcgagaaauuguagauuuaaugugucacgcgaccuucacaaugcgacucuugucaccggugcgugucccaaauuauaauuugauuauuauggaugaagcucauuuuacggacccugccucaauagcagcaagagguuacauauccaccagaguagagaugggagaggcagccgguauauuuaugaccgcuacaccgccaggcagccgagacccauucccucaaucgaaugcaccaauuauggaugaagaacgagaaauacccgaacggucauggaacucuggacacgaauggguaacugacuuuaaaggaaaaacaguaugguucgucccguccauuaaggcuggaaacgacauagcugccuguuuacgaaagaauggcaagaaagugauccaacuguccagaaaaacuuucgauagcgaauaugucaaaacuagggccaacgauugggacuuugucguaacaacagauauuucagaaaugggagcgaacuucaaggcagaaaggguaauagauccuagacguuguaugaaacccguaauccuuacggauggcgaagaaagaguaauauuagcugggccaaugccugucacucacucaagcgcagcccaacgucgcggaagaaucggcaggaauccgaagaaugaaaaugaccaauacaucuacaugggagaaccacucgaaaaugaugaagauugugcccauuggaaagaggcaaagauguuauuagacaauauaaauacuccagagggcauaauaccuaguauguuugaaccggaaagagaaaaaguagaugccauugauggggaauaucgauugagaggugaagcgaggaaaacuuucgucgauuuaaugaggcgcggagacuuaccaguuuggcuugcauauaagguggccgcugagggaauaaauuaugccgaucgcaaauggugcuucgauggcauaaagaacaaccaaauuuuagaagaaaacguugaaguagagauuuggacaaaagagggcgaacguaagaaauugaaaccucgguggcuagaugcccgcaucuacucugacccacuagcguuaaaagaauuuaaagaauuugcggcaggaagaaaaucuuuaacacucaauuuaauaacagagaugggaagguuaccaacuuucaugacacagaaggcaaggaaugcacuagauaaucucgcaguacugcacacugcugaggcuggaggacgagcauauaaucaugcuuugagcgaacuaccggaaacccuagaaacacuacuguuguuaacucuuuuagcaacugugacuggcgggauauuuuuauuucuaauguccggaaaaggcauuggaaaaaugacguuaggcaugugcuguauuauaaccgcuucgguucuacugugguaugcgcaaauucaaccccacuggauugcggcuucaaucauucuugaauuuuuccuuauuguucuacuuauaccugaaccggaaaaacaacgaacaccacaagauaaccaacuuacguacguaguuauagccauauuaacuguaguugccgcaacuauggccaacgaaaugggauuccuugagaaaacuaagaaagaucuaggguuggggaguauaacaacgcaggaaucugaaaguaacauauuagauauagaccuuagacccgcaagugcguggacguuguacgcgguagcaacgacuuuuguaacaccuauguuaagacauagcauagaaaacucgucagucaauguuucacuaaccgccauugcaaaccaagccacggucuuaauggguuuggggaaaggauggccccuuucuaagauggacauaggcguaccucuuuuagcuauuggauguuauucucaaguaaacccgauuacgcuaacugcagcauuauuacugcuggucgcccacuaugcaauaauaggaccuggguuacaagcaaaagcuacacgagaggcccagaaaagggccgcagcgggcauaaugaaaaauccuaccguugacggaauaacaguuauagaucuggagccaauaccuuaugacccgaaauuugaaaagcaacuuggacaaguuauguuauuaauauuauguguaacgcaaguacucaugaugagaacuacuugggcguuaugugaagcucuaacucuugcaacagggccaauaaguacgcuaugggaggguaauccgggccgauucuggaacacaacaaucgcaguuucgauggcaaauauauuucggggaucauaccucgcaggagccggucuacuauuuagcaucaugaagaauacgacuaauacacgaagaggaacgggaaacauuggcgaaacgcuaggagaaaaguggaaaagcagacuaaacgcauugggaaaaagugaguuccaaauauauaaaaagucuggcauucaagaaguagauaggacccucgcaaaagaagguauaaaaagaggggagacagaccaccacgcagucagccgagggagugcaaagcugagaugguuuguagagaggaauauggucacaccagagggcaaggucgucgacuuaggcugcggaagagguggauggaguuacuauugugguggauugaaaaauguaagggaaguaaaagggcuaacaaaagggggacccggucaugaagaacccauucccaugagcacauauggauggaauuuagugcgauuacaaagcgguguagauguauuuuucacaccuccagagaaaugugauacuuuauuaugcgauauaggcgagucaagccccaacccaacaauagaagccggcagaacucuaagagucuuaaaccuuguugagaacugguuaaacaacaauacgcaauuuugcaucaaaguauuaaacccauauaugccgucgguuauugagaaaauggaaacacugcaaaggaaauacggaggugcguuaguacguaaccccuugagccguaauucaacacaugaaauguauugggugaguaaugccacaggaaacauuguauccucaguaaauaugaucucaagaauguugaucaacagauuuacaaugaaacauaagaaagcgacauaugagccugacgucgacuuggguagcgggacgagaaauaucgguauagaaagugagauccccaaccucgauaucauaggaaaaagaaucgagaagauaaaacaggaacaugagacuucuuggcauuaugaucaagaucacccuuacaagacaugggcguaucacgguaguuaugaaacaaagcaaacaggaagcgcuucgucuaugguaaauggcguugugaggcuacucacaaaacccugggacgucgucccuaugguuacccagauggcaaugacugacacaacgccuuuuggacaacagaggguuuuuaaagagaaagucgauacaagaacucaagaaccaaaggaaggaacaaaacguuuaaugcgcaucacggcugaauggcuauggaaagaguuaggaaagaagaaaacaccacgaauguguacccgagaagaauuuacacgaaaaguaaggaguaaugcugcacuaggugcgauuuucacagacgaaaauaaauggaaaucagcucgcgaagcaguagaagauggucguuucugggagcuaguggauaaagaacguaaucuacauuuggaagguaaaugugaaacgugcgucuauaauaugauggguaaacgcgagaagaaauugggugaauuuggcaaggcaaaggguucuagagcaauaugguauauguggcuaggugcacgguuucuagaauuugaggcauugggguuccuaaacgaagaucacugguucucucgcggcaacagucuaaguggaguagagggcgaaggauugcaccgucuaggauacauuuuacgugaugucggaaagaaagaggguggugcaauguaugcggaugacacagcgggaugggacacacgcauaacguuagaagaucucaaaaacgaagaaauggucacgaaccauaugaagggugaacauaagaaacuagcggaggcaauauuuaaauuaacauaucaaaucaaaguagugcgaguucaacguccaacccccaggggcacuguaauggacauaauuucucgaagggaucaaagaggaucuggacaagucggaacuuauggacuuaauacuuuuacgaacauggaagcacaguuaauaaggcaaauggaaggggaaggaaucuucaagucaauacaacauuugaccgccacugaggagauugcgguccaaaacugguuagcucgaguaggacgugaaagauuaucacggauggccauaaguggagacgacuguguaguuaaacccaucgaugacagguucgcuucagcucuaacagcccuaaacgauaugggaaaaguucguaaagauauucaacaaugggaacccagccguggauggaaugacuggacacaaguaccguucugcucacaucacuuccaugaauuagucaugaaagauggaagaguuuuaguuguaccauguagaaaucaagaugagcuaaucgguagagcuagaauaucucaaggagcgggauggagucuaaaggagacagcuugucuagggaaaucguacgcacagauguggacauuaauguauuuccacagaagggaccucaggcuagccgcuaacgccaucuguucagccguuccuucgcacuggguucccacauccaggaccacuuggucaauacaugcgaaacacgaauggaugacuaccgaagacaugcuagcgguauggaaccguguauggauccaagagaacccauggauggaagacaaaacaccagucgaaaguugggaagagguuccuuaucuugggaaaagagaagaucaauggugcgguucacuuauaggucuaacaucaagagcgacaugggccaaaaauauucagacggcaauaaaucaaguaagaucguuaauugguaaugaggaguauacagauuauaugccaagcaugaaaagauuccgucgggaagaagaggaagcaggaguauugugguag

SEQ ID NO: 22644 - RNA, 9876 nt, Artificial Sequence
  derived and/or modified CDS sequence (opt6) from DENV-2__EU687220__SS-prME
acagcuggaguaauuaucauguuaauacccacugcuauggcauuucaccugacgacgagaaauggagaaccgcauaugaucguagggcgacaggaaaaagggaaaaguuuacuuuucaaaacggaagauggugucaacauguguacacuaauggcaauagacuuaggugaauuaugcgaagauacaauuacuuauaaauguccucuacuaagacagaaugaaccggaagauaucgauugcugguguaauucuacaucuacaugggugacauacgguacuuguacaacaacaggagaacaccgccgggaaaaacgaucaguagcacuggucccgcacguugguauggggcuugaaacacgaacugaaacuuggaugaguuccgaaggagcuuggaaacacgugcaacguauugaaacauggauauugagacauccaggauucgcaaucauggcagccauuuuagcuuacaccauugguacaacacauuuucaaaaagcucucauauucauauuacuaacugcaguagcaccaucaaugacuaugagaugcauuggcauaucuaaucgagauuucguggaaggcguuuccggcggaaguuggguugauaucguacuagaacacggaaguugcgucacuacaauggccaaaaauaaaccuacauuagacuucgaacucauaaaaacggaagcaaaacaacccgcaacucuuagaaaauauuguauagaagccaaacucacgaauacuacaacagaaucgagguguccaacacaaggagaaccaucccuaaacgaggaacaagauaaaagauuuauaugcaaacacaguauggucgaccgggguuggggaaacggaugcggucuauucgggaaaggugggauagucaccugugcaauguuuacauguaagaaaaacauggagggcaaaguugucuuaccagagaauuuagaauauacaaucguuauaaccccucacagcggcgaagaacaugcuguugggaacgauacggggaaacacgguaaagaaauaaaaauuacaccucaguccucaauaacagaggcagaacuaaccggguaugggaccguaacaauggaaugcucuccccggacaggcuuagauuuuaacgaaaugguacuauuacaaauggaagagaaagcauggcuaguucauagacaaugguucuuagaucugccacuaccauggcuaccuggcgcagauacacagggguccaauuggauacaaaaagaaacacuugucacuuuuaaaaacccucaugcgaagaaacaggacguaguuguauuagggucucaagaaggugccaugcauacugcacugaccggcgccacggaaauccaaaugucaagugguaaccuccucuuuacaggacaucuaaaaugccgauuaagaauggauaaauuacaauuaaaaggaaugucuuauaguauguguaccgggaaauuuaaaauagucaaagaaauagcagaaacgcaacauggaacaaucguaauacgaguucaauaugaaggcgacggaucaccauguaaaauucccuuugaaaucauggaucuggaaaaacgccauguacuuggaagacuaaucacaguaaauccaauuguaaccgagaaggauucgcccauaaauaucgaagcagagccuccauuuggcgauaguuauauuauaaucggggucgagccgggacaacuaaaacuaaacugguucaaaaaggguagcaguauaggacaaauguuugagaccacgaugagaggugcaaaaaggauggccauauuaggcgauacggcuugggauuucgggaguuuaggaggcgucuuuacaaguaucggcaaagcacuacaucaaguuuucggugcuauauacggugcugccuuuucgggaguaucguggacaaugaagauacuaauagguguaauaauuacauggauuggaaugaacuccaggaguacgucucuaucuguuucauuggucuuaguuggaguuguaacauuauaucuaggagcaaugguucaggcggacaguggaugugugguuucuuggaaaaacaaagaauuaaaaugugggucugggauauuuauaaccgauaauguacauacauggacggaacaauauaaguuucagccugagaguccuucaaagcuagcgucggcaauacagaaagcacacgaggaagggauauguggaauacgaucagucacuagauuagagaaucucauguggaagcaaauuacuccagaauugaaccauauacuauccgagaaugaagugaagcugaccaucaugaccggagauauaaaaggaauaaugcaagcuggaaaaaggagucuaagaccgcaaccuaccgaacugaaauauucuuggaaaacuugggggaaagcgaagauguuaucuacugaaucacauaaccaaacguuuuuaauugaugggccagaaacagcugagugccccaauacgaauagagccuggaacuccuuagaaguagaagacuauggauuuggcguauuuucaacuaauauaugguugaaacuacgugaaaaacaagauguauuuugugauaguaaguuaaugagcgcagcaauaaaagacaaucgagcaguccaugcagauaugggcuauuggauagaaucggcacuuaacgauacauggaagauggaaaaagcauccuucauagagguaaaguccugccacuggccaaaaucacacacacuauggucaaacggaguuuuggaaucagaaaugaucauuccuaaaaacuucgccggcccaguuucccaacauaacuauagaccaggguaucauacccagacugcggggcccuggcaucuagggaaauuagaaauggauuuugauuuuugcgaagggacgacagugguaguaacugaggacugcggcaaucgaggaccuucccuaagaaccacuacugcuucaggaaaauuaaucacagaauggugcugcagaucaugcacauugccaccauuaagguaccgaggagaagaugguugcugguaugggauggagauccgaccucuuaaagagaaagaagaaaauuuaguuaauagccuagucacagcuggacauggacaaaucgauaacuuuucauuagggguuuugggaauggcacuauuccuagaagaaaugcuucguacuagggucggaacaaaacacgcgauacuauuaguugcaguuaguuucguuacauugauaacagggaauaugucuuucagagaucuuggucgagugaugguuauggugggugcgacgaugaccgacgauauugggaugggagucaccuacuuagcuuuauuagcagcauuuaaagugcguccaacguuugcagccggucuauugcucagaaaauuaaccucaaaggaguugaugauggcaacaaucggcauagcauuacugagucaaucgacaauaccugaaacuaucuuggaauugacagaugcuuuggcauuggggaugaugguacucaaaauaguccgaaauauggaaaaauaucaauuggcaguaaccauuauggcgauaucauguguacccaaugccguaauacuauuaaaugcuuggaaaguuaguugcacaauucuagcggcagugucaguuaguccauuauuacugacaucaagucaacaaaaagcugauuggaucccauuggcguuaacgauuaagggauuaaacccuacggcuauauuucuaacaacgcucucuagaacaaguaagaaacguucauggccauugaacgaagcugucauggcaguggguaugguaucaauuuuggcguccaguuuacuuaaaaaugauauaccuaugacugggccauuggucgcgggaggccuacuaacuguuuguuauguacuaaccgguagaagcgcugacuuagaacucgaacgugcugcugaugucaagugggaagaucaugcagaaaucagcggaucuaguccaaucuuauccaucacgauaagugaagacgggagcaugagcaucaagaaugaggaagaggaacaaacauugacgauauuaauacggaccggguugcuaguaauuucaggaguuuuccccgugaguauaccuaucacagcagcagcuugguaccuaugggaagugaagaaacaacgagccgguguacuaugggaugucccaucgccaccaccaguaggaaaagccgaacucgaagauggggccuacagaauaaaacaaagaggcaucuuaggauauagccaaauaggugcuggcgucuauaaagaaggaaccuuccauacuauguggcauguuacuagaggggcuguauuaaugcaccgcggcaaaaggauagaacccucaugggccgacgucaagaaagaucugauaucguacggcggugguuggaaacuggaaggcgaauggaaggaaggugaggaagugcaaguacuugcacuggagccaggcaaaaauccuagggccguacaaacaaaaccgggccuauuuaaaacaaauacgggaacaaucggagccguaaguuuagauuuuucacccgguacaucuggaucuccuaucguggaccgcaaagguaagguuguaggauuguaugggaacggagucguuacacguucaggagcauauguuucagccauagcucaaacagaaaaaucuauagaagacaacccugaaauagaagacgauauauucagaaagaaaaggcuaaccauaauggacuuacacccuggagcgggaaaaacgaaacgauaccucccagccauaguacgcgaagcuauaaaaagaggauuaagaaccuugauauuagcaccgacgagaguuguagcugcagaaauggaagaggcauugcgcggcuuaccaauaagauaucaaacaccggccauaagagccgagcacacaggaagagaaaucguugaucucaugugccaugccacauucacaaugagacuacuuagcccgguccggguuccaaauuauaauuugauuauuauggacgaagcccauuuuacggaucccgcuucaauugccgccagggguuauauaucgacacguguugagaugggagaggcagccgguauauuuaugacggcaacuccaccaggaucuagggacccauucccgcaaucgaaugcuccuauuauggacgaagaaagagaaaucccugaaaggucauggaauaguggacaugaauggguaacagauuucaaagguaagacgguaugguucguuccuucgaucaaggcggggaacgauauagccgcgugucuaaggaaaaacggcaagaaaguaauccaauuaucacgaaaaacuuucgauagcgaauaugucaaaacccgugccaacgauugggauuucguagugacuacagauauaucagagaugggagcaaacuuuagagcugaacguguuauagacccacguagauguaugaaacccguaauauugacagauggugaagaacguguaauauuagcggggcccaugccaguaacucauaguagcgccgcucagagacguggaaggaucgguagaaacccaaagaacgaaaaugaccaauacauuuauaugggagaaccgcuagagaacgacgaagacugugcucauuggaaagaagcgaaaaugcuacuggacaacauaaacacuccugaagguauaauaccaucaauguuugaaccagaaagagagaaagucgaugcaauugacggugaauaucgguugaggggagaagcacgcaaaacuuuuguggacuuaaugagacgaggugaccucccaguuugguuggcauaucgaguagcugcagaaggaaucaacuacgcagaucggcgcugguguuucgacggaauaaagaacaaucagauucuugaagaaaacguagagguagagauauggacgaaagaaggggaaagaaagaaguuaaagccucgguggcuagacgcccgaauauacucggauccucuugcucugaaagaguuuaaagaguucgcagccgggcgaaaaaguuuaacgcuuaaccugauuacagaaauggguagauuacccaccuuuaugacacaaaaagcaagagacgcacucgacaaucuagcggucuuacauacugcggaagcuggagggagagcuuauaaccaugcuuuaucagaauuaccagagacacuugagacccuuuuguugcugacucuacuugcuacgguuaccggcgggauauuccuauucuugauguccgggaaggggauuggaaaaaugacgcuugggaugugcuguauaauaacggcgucgauauuauugugguacgcacaaauacagccccacuggauagcagcuaguauaauauuggaauuuuuccuaauuguccuacucauaccagaaccagaaaaacaacgcacuccgcaagacaaucaacuaacauacgucguuauugcaauauuaacgguaguugcggccacaauggcgaacgagaugggguuccuagagaaaaccaagaaagaccucggauugggauccauuaccacccaggaaagcgaaaguaacauuuuagacauugauuuacgcccagcaucugcauggacuuuauacgcaguggcaacgacauuugugacaccaauguuacgccauucaauagaaaauagcucggucaacguauccuuaacagccauagcuaaucaagcaaccguucuuauggggcuaggaaagggcuggccauuaagcaaaauggauauuggaguaccccuauuggcaauaggaugcuacucacaagucaacccaaucacuuugacagcagcauuauuacuccuaguagcacauuacgccauuauaggaccaggucuacaggcgaaagcaacuagagaagcacaaaaacgugcggccgcagggauaaugaaaaauccaaccgucgauggaaucaccgucauagauuuagagccaauaccuuaugacccgaaauuugaaaagcaacuuggacaagucaugcuucuaauuuugugcguuacucaaguacugaugaugaggacaacuugggcccuuugcgaagcccucacacuugcaacuggaccgauaucaacacuuugggaagguaaccccggacgauucuggaacacaaccauagcuguaaguauggcaaauauuuuuagaggaucauaucuagcaggagcaggguuauuauucagcauuaugaagaauacuacaaacacgagaagaggaacuggaaacauaggagaaacacuuggagagaaguggaaaagcagguuaaacgcucuaggcaaaucagaauuucaaauauauaagaaaagcggaauacaagaggucgauaggacccuagcaaaagaggggauaaagaggggagaaacggaccaucacgcugugagcagagguucggcaaaauuaagaugguuuguagaacgaaacaugguaaccccagaagguaaaguaguugauuuaggcuguggaagaggaggguggucauauuauugugguggccuuaagaacguucgggaaguaaaaggacuuaccaaaggcggacccggccaugaagaaccaauccccaugucgacuuauggcuggaaccuaguccgauuacaaaguggggucgauguuuucuucacuccgcccgaaaaaugugacacacuucuuugugauauaggugaaucgucaccuaaccccacuaucgaagcggguagaacuuuacgaguguuaaaucuuguagagaauugguuaaacaauaauacgcaauuuugcauaaaagugcuaaacccuuauaugccauccguuauugaaaagauggaaacacuucaacgaaaauacgguggagcucuuguaagaaaucccuugaguagaaacucaacucaugagauguauugggugucaaaugcgacuggcaacauuguaucaagcguaaauaugaucucaaggauguuaauaaaccgauuuacaaugaaacacaagaaagcuacuuaugaacccgacguagauuuaggauccggaacgcguaauauuggaauagaaucagagauaccaaaucuugacauaauaggaaaaaggauagaaaagaucaaacaagaacacgaaaccucauggcacuaugaucaagaucauccuuauaaaaccugggccuaucacgguucauacgaaacuaaacagacagguagugcgucaucaauggugaaugguguaguacguuuacugacuaaaccaugggacguuguaccuauggucacacagauggcgaugaccgauaccacaccauucggccaacaaagaguauuuaaagaaaaaguugauacuagaacgcaagaacccaaggaaggaacgaagaaacuaaugagaauaacagcugaauggcuuuggaaagagcuugguaagaagaaaacuccccgaaugugcacucgagaagaguucacaagaaaagugagaaguaaugcagcauuaggugcaauauuuaccgacgaaaacaaguggaaaagugcgagagaagcagucgaagauucucgcuucugggaacuuguagaucgugagaggaaccugcaucuagaagguaagugugagacuuguguauacaacaugaugggaaagagagagaagaaacucggugaauuugguaaagcuaaaggaaguagagccauaugguacauguggcuuggagccagauucuuggaguucgaagcucugggauuuuuaaaugaagaucacugguucucacgcggaaauucuuuaucugggguagagggagagggacuucaccgacuugguuacauacuuagagaugucucgaagaaagaaggaggcgccauguaugcagacgauacggcgggaugggauacucgcaucacauuggaagauuugaaaaaugaagaaauggucacuaaucauaugaaaggagaacauaagaaauuagcugaggcgauauuuaaacuaaccuaucaaaauaagguaguccggguccaaagaccaacccccagaggaacaguuauggacaucaucagcagaagggaccaaagaggaagcggucaagucgguacauaugggcuaaacaccuucacuaauauggaagcgcagcuaauuaggcaaauggagggagaaggaauauuuaagucuauacagcauuuaacggucacggaagagauugccguccaaaauuggcuaguuagaguaggaagggaacgauuaucaaggauggcuauaucuggugacgauugcgucguaaaaccacucgaugacagauuugcaucagccuuaaccgcucugaaugacaugggaaaaguucgcaaagacauucaacaaugggaaccuucucgaggauggaaugacuggacacaagugccauucuguucacaucacuuucaugaguuggucaugaaggaugguagagucuuagugguaccauguagaaaucaggaugaauuaaucggccgugcccguauaucacagggugcuggcuggucgcugaaagagacagcguguuugggcaaaucguaugcacaaauguggacguuaauguauuuucauaggcgagaccuacgauuagcagcgaacgcuauaugcucugcaguaccaucacauuggguacccacauccaggacaaccuggaguauucaugcuaaacacgaguggaugacaacagaggacaugcucgccgucuggaaucgcguauggauccaagagaaucccuggauggaggacaagacgccaguugaaucgugggaagaagugccauaucuagguaaaagagaagaucaauggugugguucacuuaucggcuugaccagucgugccacuugggcuaaaaacauacaaaccgcaaucaaucaggucagauccuuaaucgggaaugaggaauauaccgacuauaugccaucgaugaagagauuuagaagggaagaagaggaggccggaguacuuugguaa

SEQ ID NO: 22645 - RNA, 9876 nt, Artificial Sequence
  derived and/or modified CDS sequence (opt6) from DENV-2__EU726775__SS-prME
acugcggguguaauuguuaugcugauucccacggcaauggcguuucauuuaaccacacguaauggggaaccacauaugauaguggggaggcaggaaaaaggaaaaucuuuacucuuuaaaacagaagauggaguaaacaugugcacauugauggcuauagacuugggggaacuaugugaagacaccauuacguauaaauguccguugcugaggcaaaacgaaccggaagacauagauugcugguguaacucgacaucaacguggguaaccuacggaacuuguacaacuacuggagaacauaggagagagaaaaggucugucgcauuaguaccacacguaggaaugggauuggaaaccaggacagaaacuuggaugagcucugaaggagcguggaaacacguucaacgaauugaaacuuggauucucagacauccagguuucaccauuauggcagcaauacuagcuuauacuauagggacaacccauuuucaaagggcauugauauuuauauuauuaaccgcgguagcuccaucaaugacaaugcgcuguauaggaauaagcaaccgagacuucguugaaggaguaucugguggaagcuggguugacauaguacuggaacacggauccugcgucaccacaauggccaaaaauaaaccuacacuugauuucgaauuaauaaaaacagaagcaaaacaaccagcaacacugagaaaauauuguauagaagcaaaauuaaccaacacaacgacugagucucguuguccaacacaaggugaacccagucugaaugaagaacaagacaaaagauucauuuguaaacacucaaugguggauagagguuggggaaacggaugcgguuuauuuggaaaaggagggaucgucacaugcgcaauguucacuuguaagaaaaauauggaggguaaagugguucagcccgaaaacuuagaauacacaauuguaauuacgccccauucgggugaagaacacgcagucggcaacgauacgggaaaacacggaaaagaaauuaaaauaacuccacaaaguucaaucacggaagcagaauugacugguuauggaacuguaacgauggaaugcuccccucggacaggauuagacuuuaaugagauggucuuacuacaaauggaagacaaagccugguuaguucaucgccagugguuccuagacuugcccuuaccaugguugccaggugcugauacacaagguucgaacuggauccagaaagagacacucguaacuuucaaaaacccucaugcuaagaaacaagauguuguaguacuaggcucccaagagggagcaaugcacacugcauuaacgggggccacagaaauccaaaugucuaguggcaauuuguuauuuacaggacauuugaaauguagauugcguauggacaaauuacaacugaaaggcaugaguuacucaaugugcacagggaaauuuaaaauuguuaaagaaauagcagagacacaacacggaacaauugugauacgagugcaguaugaaggagauggaagucccuguaaaaucccauucgagauaacggaccuagaaaaacgacacguccuagguagauuaaucacaguuaauccgauaguaacagaaaaagacuccccagucaauauagaagcagaaccuccauuuggagauucuuauaucauaauaggaguugaaccaggacaacuuaaacucaauugguucaaaaaggguucaaguauaggccaaauguuugagaccacuaugcgcggcgcaaaaagaauggcaauauuaggcgauacggcuugggacuucggaaguuuaggaggcguguucacaagcauagguaaagcgcuacaucagguauuuggggcuauauauggggcugcguuuagcggagugaguuggacuaugaaaauuuuaauuggagucaucaucacguggauuggaaugaacucgagaagcacaucauugagcgucucucucgucuuaguugguguuguuacauuguaucucggagccaugguacaagcggacaguggaugcguuguauccuggaaaaacaaagaacuuaaaugcgguucaggaauuuucauaacugauaacgugcauacguggacggaacaauauaaauuccaaccagaaaguccaucuaaacuagccucugcuauucaaaaagcucacgaggaaggaauaugcggaauaaggucuguaacacgacuugaaaaucuuauguggaaacaaauuacaccugaauuaaaucacauuuuaagugaaaaugaaguuaaacuaacaauaaugacaggagauaucaagggaauaaugcaagcuggaaaaaggagucuaagaccgcaaccaacagaauugaaauauaguuggaaaacguggggcaaagccaaaauguuaagcacggagucucacaaccaaacguuucuaauugacgguccagagacggcagaauguccuaauaccaaucgggcauggaauaguuuagaaguagaggacuauggcuuuggaguguuuaccacaaauauauggcuuaaacuaagagaaaagcaagauguauucugugacucuaaacucaugagugcugcuauuaaagauaauagagcagugcaugccgacaugggauauuggauagaaucagcauuaaaugacacauggaaaauggaaaaggcuagcuuuauugagguuaaguccugccauuggccaaaaucacauacucuuuggagcaauggcguccuggaaagugaaaugauuauuccgaagaacuucgcaggcccaguuucacaacacaauuauagaccuggauaccacacgcaaacugcuggaccuuggcaccugggcaaacucgaaauggauuucgauuucugugagggaacuacaguagugguuacagaagauugugguaaccgugguccaagucuuaggacgacaacggcaucagguaaacucaucaccgaaugguguugucguaguuguacguugccaccccuuagguacagaggggaagacggguguugguacggaauggaaauucguccauuaaaggagaaggaagagaacuuaguaaauagcuuagugacagcagggcacggccaaaucgauaauuuuucauuaggagucuuaggcauggcuuuguucuuagaggaaaugcuucggaccagggucggaaccaaacaugcgauacugcuuguugcgguaucuuucgugacuuuaauaacgggcaauaugucauuuagggaccuagggagaguaaugguuauggucggggcgacaaugacagaugacauagguauggguguuaccuaucuggcguuacuagcugcauuuaaagucaggccuacauucgccgcaggcuuacuauugcgaaaauugaccuccaaggagcuaaugauggccacaauagguauugcgcuacugucccaaagcaccauuccugaaaccauccuagaauuaacagacgccuuagcucuggguaugaugguucucaagauaguaagaaacauggaaaaauaucagcuagccguaacgaucauggcgaucaguugcguuccgaacgcaguuauucuacagaaugccuggaaaguuaguuguacaauucucgcggcaguaagugucagcccucugcuucuaacaagcagucagcagaaagccgauuggauaccguuggcacuaacgauuaagggcuuaaacccaacagcaauauuuuuaacuacuuugucccgcacaucuaaaaagcgaaguuggccgcucaacgaggcgaucauggcggucggaaugguaucaauacuggcuuccucuuuacucaaaaacgacauaccaaugaccggaccuuugguagccggcggacuuuuaacagugugcuauguuuuaacuggucgauccgcggacuuagaacuugaaagagcggcagaugugaagugggaagaccaagcugaaaucagugguucuucuccaauacuuaguaucaccauaucagaggacggaaguaugaguaucaaaaacgaggaagaagaacaaacauuaaccaucuugauaagaaccgggcuauuaguaauuagcggaguauuucccgucucuauuccaauuacggcggcagccugguaucuaugggaaguuaagaagcaacgagcugggguuuuaugggauguuccauccccgccaccaguugggaaggcagaacuggaagauggcgcauauaggauaaaacaacgaggcauccugggauauucucaaauaggggccgggguguauaaagaaggaacuuuccacacaauguggcauguuacaagaggggccguucuaaugcauagaggaaaaaggauagaaccuaguugggcggaugugaagaaagaccuaauuucguauggaggcgguuggaaacuugaaggugaauggaaggaaggcgaagaagugcagguccuagcguuagaaccaggaaagaauccacgagcaguacaaacaaagccagguauauuucggaccaauacugguacaauaggugccauuucgcuugauuucucaccggggacaucggguucuccaauuguagacaggaaaggcaaaguaguugguuuauauggcaacgguguagugacgagaucgggugcauacgugagcgcaauagcacaaacugaaaaaucaauagaagauaacccggaaauagaagaugauauuuuuagaaagaaacgacuuacuauaauggacuuacacccuggugccggcaaaacaaagagauaccuaccagcaauuguaagagaggcuauuaaaagaggccuaagaacacuaauauuggcaccaacacgggugguagcagcggaaauggaagaagcauuaagaggauuaccaaucagauaucaaacgccugcaauuaaggcugagcauacgggaagagaaauuguugaccuaaugugucacgcaacuuuuacgaugcgauuacuaucaccgguaagaguuccaaauuauaaucuuauaauuauggaugaagcgcauuucacagacccugcuucuauugcagcgcgaggguacauaucuacgcgugucgaaaugggugaagcugcagggauuuuuaugacagcuacgccacccgguaguagagauccguucccacaaucgaaugcaccaauuauggacgaggaacgugaaauaccagaacgaucauggaacaguggucaugaauggguaacagauuuuaagggcaagacuguaugguucguacccucuauaaaggccgguaacgauaucgcggccugccuaagaaagaaugguaaaaagguaauacaacuaagccggaaaacuuucgauagugaauacguaaaaacaagagccaacgacugggauuuugucguaacuacugacauuagugaaaugggagcaaauuuuaaagcggaacgagugauagauccuaggagaugcaugaaacccguaaucuuaaccgacggagaggaaagaguuauauuggcagggccuaugccugugacacacucaucagcugcacaacgaagaggccgcauaggccgcaaucccaaaaaugagaaugaucaauacauuuauaugggugaaccauuggaaaacgaugaggauugugcucauuggaaggaggcaaaaaugcuucucgauaauauuaauacaccagaagggauuauuccaagcauguuugaaccagagcgugagaaaguugacgcgauagauggagaauaucggcuuagaggugaagcaagaaaaacuuucguagauuuaaugagaagaggcgaccugccuguauggcuagcauauaaaguagcugcugaaggaauaaauuacgcggaucguaaaugguguuucgaugggaucaaaaauaaucaaauuuuagaggaaaacguugagguagaaauuuggacuaaggagggagaacggaagaaacuaaaaccgcguuggcuagacgcucggauauacucugauccauuggcauugaaagaauuuaaagaguucgccgcuggcagaaaaucucuaacgcuaaacuuaauaacagagaugggaagacucccaacauuuaugacucaaaaagcuagaaacgcucucgacaacuuagcgguauugcacacagcagaagcgggaggaagggcguacaaccaugcauugucugaauugccggaaacauuagaaacucuacuuuuauuaacucuccuugcuacagugacuggggguauauuuuuauuuuuaaugucugggaaaggaaucggaaaaaugacacuaggaauguguugcauuauaacagcuagcaucuuauuaugguacgcccaaauccaaccacacuggauagcagccaguauaauacuagaguucuuccuaauaguacuauuaauaccagaaccagaaaagcagcguacaccccaagauaaucaacuaacauauguaguaauagccauauuaacuguuguagcugcaacgauggcaaacgagauggguuuucuagagaaaacuaagaaagauuuaggucuggguaguauaaccacccaagaaucagaaucaaauaucuuagauauugaucuucguccagccucggcuuggacacuguaugcuguggcaacuacguuuguaacgccaaugcuacgccauagcauagaaaauaguucgguaaauguaucacugacagcaauagcaaaccaagcaacgguauugaugggauuaggaaagggauggccccucagcaaaauggauaucggaguaccuuuacuagccauuggcuguuacucucaagucaauccgauaacucucacagcagcauuacuucuucuaguggcgcacuacgcuaucauugguccaggucuacaagcuaaggcuacuagagaagcccaaaagagagcagccgcggguauaaugaaaaaucccacugucgacgggauaacaguuauagaccuagaacccauuccuuacgacccaaaauuugagaaacaacugggacaagucauguuguuaauacuauguguuacacaaguccucaugaugagaaccacaugggcgcuaugugaagcacuaacacucgccacuggcccaaucucaacacuaugggaagguaauccagggagguucuggaacacaacgauagcuguguccauggccaauaucuuuagagguaguuacuuggcuggggccggcuuacucuuuucaaucaugaaaaauacgacaaacacgagacgaggaacuggaaauauuggagaaacccucggcgagaaguggaagucacgacucaacgcacuugggaaaagugaguuccaaauuuauaagaaaagugggauucaagaaguggaucgaacacuagcgaaagaagguauaaagcgaggagagacagaucaucaugccguaucgagaggaagugccaaacuaagaugguuuguggaacggaauauggucacgccugaaggaaaaguggucgauuuaggauguggccgggguggcuggucauauuauuguggcggucucaaaaauguuagggagguaaaaggacuuacuaaaggaggacccggccacgaagaaccaaucccgaugaguacauacggcuggaacuugguuaggcugcaaagugggguggaugucuucuuuacuccaccagaaaaaugcgauacuuuauuaugugacaucggcgaaaguuccccgaacccuacaauagaggcaggucguacucuacgaguuuuaaaccuaguugagaauugguuaaauaauaauacucaguuuugcauaaagguauuaaauccauauaugcccucuguaauugagaaaauggagacuuugcagcgcaaguaugggggagcgcuaguaagaaauccacuuucgagaaauucaacacaugagauguauuggguaucuaacgcaacuggcaauauuguaucuucagugaacaugauaucccgaaugcuuaucaauagauucaccaugaagcauaagaaagcuaccuacgagccugacgucgaccuugguucuggcacgcgcaauauaggcauugaaucagagauaccaaauuuagacaucauugguaaaaggauagaaaagauaaagcaagaacaugaaacaucguggcauuacgaccaagaucacccuuacaaaaccugggcauaucaugguucauacgagacgaaacaaacggggucagcaagcucaaugguaaacggaguuguaagacuuuuaacgaagcccugggauguaguaccuaugguaacgcagauggcaaugacagauacaacaccguuuggucaacaacgaguauuuaaggaaaaaguagauacuagaacucaagagccaaaagagggaacgaagaaacuaaugaaaauuacugcagaauggcuuuggaaggaauuggggaagaagaaaacuccacguauguguacacgcgaagaauuuaccagaaaaguuaggagcaaugcagcucuaggugcaauuuucacagaugaaaauaaguggaaaucggcccgagaagcaguagaagacggucguuuuugggaauuaguagaucgugaaagaaauuuacauuuagagggaaagugcgaaaccugcguuuauaauaugauggggaagcgagagaagaaacuuggggaguucgggaaagcuaaaggcucaagagcaauuugguauauguggcucggcgcuagauuccuagaauuugaggcacuaggguuucuuaaugaagaccauugguucaguaggggcaauaguuuaucaggaguagaaggagaaggguugcaucguuuaggauacauacucagggacguagggaagaaagaagguggagcaauguacgccgaugacacggcaggaugggauacccgaaucacuuuagaggaccucaaaaaugaagaaaugguaacuaaucacaugaaaggagaacauaaaaaguuagccgaagcuauauuuaaacuaacauaucagaacaaaguaguacguguccaacguccaacacccagaggaacgguuauggauaucauaagccgacgggaccaacgaggaagcgggcagguaggcacauaugggcuuaauacguuuacaaacauggaagcacagcuuauaagacagauggagggugaaggaauauuuaggucaauacaacauuuaacggcuacagaggaaauugcagugcaaaauuggcuagcaagaguagggagagaaagauuaaguaggauggccauauccggagaugacuguguuguuaagccaauagacgauagauucgcaucugcuuuaacugcacuaaaugauaugggaaagguaagaaaggacauacaacaaugggagccaagcaggggcuggaacgacuggacgcaaguaccguuuugcagucaucauuuccacgaguuaguuaugaaagauggaagaguacuuguugugccauguagaaaucaagacgaacucauaggcagagcucguauaucccagggugcaggauggaguuuaaaggaaacagccugucucggaaagucguaugcacaaauguggacacucauguacuuccauaggagagaucuaagacuagccgcaaaugcaauaugcucugcaguaccaucucauuggguaccgacuucacgcacaacuugguccauacacgcaaagcacgaguggaugacaaccgaagacauguuggcagucuggaacagaguguggauccaggaaaauccguggauggaagauaaaacacccguagaaagcugggaagaaguaccauacuuggggaagcgagaagaccaguggugcgguaguuugauaggcuuaacgaguagggcaacaugggccaaaaacauucaaacugcaauuaaucagguacggagccuaauaggaaaugaagaauacacagacuauaugccaucuaugaagagguuucgccgagaagaggaagaggcgggaguacuaugguaa

SEQ ID NO: 22646 - RNA, 9876 nt, Artificial Sequence
  derived and/or modified CDS sequence (opt6) from DENV-2__FJ639732__SS-prME
acugcggguguaauaguuaugcucauucccacagcaauggcauuccaccugacaacaaggaauggugaaccucauaugaucguaggucgucaagaaaaaggaaaaucuuugcuuuuuaaaacagaagacgguguuaacauguguacuuuaauggcuauagacuuaggagaauuaugugaagauacaauaacuuacaaguguccauugcuacgucaaaaugaaccagaagauauagauuguugguguaauaguacaagcacauggguuacauaugggaccugcacaacaacuggugaacauagacgugaaaaacggucagucgcccuagugccccaugucgguaugggguuggaaacucgaacagaaacauggaugaguucugaaggagcauggaaacacguccaaagaauagaaacauggauauuaagacauccaggguuuacgauuauggcagcaauacuagcuuauaccauaggaacuacgcacuuccagcgcgcguuaauauucaucuuauugacagcaguagcucccucaaugaccaugagguguauugguauaucgaaccgagauuuuguggaaggaguaucaggcggaagcuggguggauauuguguuggaacauggaagcugcguaacaacaauggccaaaaauaaaccaacgcuagacuuugaacuaauaaaaacagaagcuaaacagccagcgacacuuagaaaauauugcauugaagccaaguuaacuaauaccacuacagaaucccguugucccacacaaggcgaaccuucccuuaaugaggaacaagauaaacgauucauauguaaacauaguaugguugacaggggguggggaaaugguugcggacuuuuuggcaaaggaggcauagucacaugugcaauguucacauguaagaaaaauauggagggaaagguagugcagcccgaaaauuuagaauauacaaucgucaucacaccucauucuggugaagaacaugcaguaggcaacgacacaggcaagcacgguaaagaaauuaaaauaacgccacaaaguucuaucacugaagcugaauuaacgggcuacgguacuguaacaauggaaugcagcccacgaacuggcuuagauuuuaaugaaauggucuuacuacaaauggaagacaaagcauggcuaguacacagacagugguuccuggaccucccuuuaccgugguuaccgggcgcagauacccagggaagcaauuggauacaaaaggaaacccuaguuacuuucaagaacccucaugcaaagaaacaggaugucguuguauuggguucucaagagggagcuaugcauaccgcacuaacuggcgcaacugaaauccaaaugaguucugguaaccuauuguuuaccggacaucuaaaaugcagacucagaauggauaaacuucagcuuaaagguauguccuacucgaugugcaccggaaaauuuaaaaucguaaaagaaauugcugaaacgcaacacggaacaauaguaaucagaguacaauacgaaggagauggaucuccuuguaaaauccccuuugaaauuacagacuuggaaaaacgacauguuuuggggagacuaauuacuguuaauccaauuguaauagaaaaagacucaccaguaaauaucgaagcagaaccaccauuuggggacaguuauauuauaauaggugucgaaccaggccaacuaaaacuuaauugguuuaagaaagguaguuccaucggacagauguuugagaccacgaugagaggggcaaaaagaauggcgaucuugggagauacagccugggauuucgggaguuuagggggaguuuuuaccaguauagguaaggcauugcaccaaguauuuggagccauuuauggugcagcuuucucuggugugaguuggacgaugaaaauacuaauuggaguugugaucacauggauaggcaugaacucuagaucaacaaguuuaucagucuccuugguguuggugggcgucguaacacuuuacuuaggugcaaugguucaagccgacuccggcugcguaguaucguggaaaaauaaagaacuuaaaugugguagcggcauuuucauaacagacaauguacacacauggacugaacaauauaaguuucagccggaaucaccaucuaaacuugcuucagcaauccaaaaagcgcacgaggaagguauaugugguauaagaucaguuacucgucucgagaaucuuauguggaaacaaauaacaccagaauuaaaucacauucuaucugaaaaugaaguuaaacuuaccauuaugacaggagauacaaagggcaucaugcaagccggcaaaaggagcuugcgcccgcaaccaacugaacuaaaauacucauggaaaacauggggaaaggcaaaaaugcuuucuacagaaucccauaaucaaacauucuuaauagacggcccagaaacagcugaguguccaaauacuaaucgagcauggaacucauuggaaguagaagauuacggguucgguguguuuacgacgaauauaugguuaaaauugagggagaagcaagacguauuuugcgauucaaaauuaaugucagcagcagugaaagacaaucgagcuguccaugccgauaugggauauuggaucgaauccgcauuaaaugacacguggaaaauggagaaggccucauucauagaagugaaaucuugucauuggccaaaaucacauacucucuggucuaauggcguccuugaaucugagaugauaauacccaaaaauuuugcuggaccugucucacaacauaauuaucgaccaggauaucacacccaaacggcgggaccuuggcaccuugguaaacucgagauggauuuugauuucugcgaaggaaccacaguaguagucacugaggauuguggaaaucgaggcccgucacugcgaacuacgacggcuaguggcaaauuaauaacagaaugguguuguaggucaugcaccuuaccgccccuacguuauagaggcgaagacggcuguugguaugggauggaaauaagacccuuaaaagagaaagaagaaaaucuaguaaacucauuaguaacugcaggucacgggcagauagacaauuucucccuaggagucuuagggauggcauuauuccuagaagaaaugcuuagaaccagaguaggaaccaaacaugcgauuuuacugguagcaguuucuuucguaacacuaauuaccgguaauaugagcuuuagggaccucggucggguuaugguaaugguaggugcaacgaugacagacgauaucggcaugggaguuacguaucuagcucuccuggcagcauucaagguacggccaacuuuugcggcuggacuccuacuaaggaaauuaaccucaaaggaacucaugauggccacuauaggcauuacacuauuaucacagagcacuaucccagaaacuauccuugaauuaaccgaugcacuagcacuuggcaugaugguacuuaaaauagucaggaacauggaaaaguaucaacuggcaguuacaauaauggcaauaagcugcguaccaaacgcugugauacuccgcaaugcauggaaggucucuugcacaauucuugcagcggugucggugagcccucuucuccuaaccucuucucaacagaaggcggacuggauuccgcuugcacuaacgauaaaaggacugaacccgacggcgaucuuucucacaacacuaagcagaacaucaaagaaacguuccuggccucuaaaugaagcaauaauggcaguuggaauggucaguaucuuggccucgagucuauugaaaaacgacaucccaaugacagggccauugguagccgguggguuacucaccguuugcuacgucuuaacaggacgaagugccgacuuagaacucgaaagggccgccgacguuaaaugggaagaucaagccgagauaagcgguucuucaccaauauugucuauuacuauaucggaggacgguucaauguccaucaaaaacgaggaagaagaacagacauugacaauacucauacgcacaggucuccucgugauuagcgggguuuuccccgugaguauuccuaucaccgcggcagcgugguaucuaugggaaguuaagaaacaacgagccggugugcugugggauguaccgucgcccccaccaguagguaaagcagagcuggaggacggagccuacagaaucaaacagagagguauucuuggguauucccagaucggugcaggaguuuacaaagagggaaccuuucacacaauguggcauguaacaagaggagcaguauuaaugcacagaggcaaaagaaucgaaccuucaugggcugacguuaagaaagauuuaauaaguuauggcggaggcuggaaauuagagggggaauggaaagaaggugaagaaguacaagucuuagcguuagagccuggcaaaaauccgagagccguacaaacgaagccagguaucuucaaaaccaacacugguacuaucggagcggucagcuuggacuuuucaccagguacaaguggaaguccuauuguagauagaaaagggaagguaguuggcuuauaugggaacgguguaguuacaaggaguggagcauaugugucagcuauagcucagacggaaaagucaauagaagauaauccggagauagaagaugauauauuucggaagaaaagacuuacuauuauggaccuucauccaggagcugggaagacaaaaagauaucucccagcuauagugcgcgaagcgauaaaaaggggguuaaggacuuuaauccuagcaccuaccagaguaguagcagcggaaauggaagaagcacuuagaggcuugccuauccgcuaucaaaccccggcuauaaaagcagagcauacaggacgagaaauuguagaucucaugugucacgcaacguuuacaaugagacuguuaucacccgucagagucccaaacuacaauuuaauaauuauggaugaggcccauuuuacagaccccgcgucaauugcggccagaggcuauauaucaacccgaguugagaugggcgaagccgcagguauuuucaugacugcuacacccccaggaucucgggaccccuuuccacagaguaaugcaccaauaauggaugaagaacgagagauccccgaacgaaguuggaacuccggacaugaauggguaaccgauuuuaaaggaaaaacggucugguuuguucccaguaucaaggcggggaaugacauagcugccugucuuaggaaaaaugguaagaaagucauacaacuuucgagaaagacauuugauuccgaguaugugaaaacaagagcuaaugauugggauuuuguagugacaacggacauuucagaaaugggagcaaauuuuaaagcagaacgcgucauugauccuagacguuguaugaaaccaguaauucuuacugacggagaagaaaggguuauacuggcgggaccuaugcccgucacacauuccagugcugcacaaagaagaggcagaauaggccgaaauccuaaaaaugaaaacgaccaauacauauauaugggagaaccccuagaaaacgaugaagacugugcucacuggaaggaggcuaaaauguugcuagacaauaucaacacaccagaaggaauaauaccgucaauguuugagccugagagggaaaaagucgacgcaauugacggagaauauagauuacgaggagaggcuaggaaaacauucgucgaucucaugagaaggggagacuuaccuguauggcucgcuuacaaagucgcagcggaaggaauaaauuaugcugaccggaaaugguguuucgauggaauuaaaaacaaccaaauacucgaagaaaauguugagguagaaaucuggaccaaggaaggugaaaggaagaagcuaaaaccgagaugguuagacgcgagaaucuauagugauccauuagcacuuaaggaauuuaaagaauuugcagccgguagaaaaucacucacacuuaaucuuauaacagaaaugggcagauuaccaacauucaugacacaaaaagcuaggaacgcccuagauaaucuggcuguuuuacacacugcggaggcuggagguagagcguacaaucaugcacuaucagagcuacccgaaacauuagaaacucucuuauuacuaacauuauuggcgacagucacagguggaauauuccucuuuuugaugucggguaaaggaauuggcaaaaugacccuuggaauguguuguauuauuacggcaagcguccuucuaugguaugcccaaauccagccacacuggaucgccgcaucgauaaucuuagaguucuuccucauaguauuauuaauuccugaaccugaaaagcaacggacuccacaagauaaucagcucacauacguagucauugccaucuuaacagucguugccgcuacaauggcaaaugaaaugggauuccuugagaaaaccaagaaagauuuaggcuuagguagcauaaccacacaagaaucagaaucuaacauacuagauauagauuugaggccggccagugcuuggacucuauaugcuguagcaacaacuuuuguaacucccaugcuaaggcauucgaucgagaacaguaguguaaacguaagucuuacggcgaucgcaaaucaagccacaguuuugaugggacuuggaaagggauggccacuuaguaagauggauauaggcguuccucuguuagcaaucgguugcuacucacaagucaauccgauuacauuaacagcagcauuacuucuauuaguagcgcacuacgcuauuauaggcccaggcuuacaagcuaaagcaacaagagaagcccagaagagagcggcagcaggaauaaugaagaacccaacuguagauggaauaacaguaauagacuuagagccgauacccuaugaccccaaauucgaaaaacaauugggacaagugauguuauugauccuaugugucacacaaguuuuaaugaugagaacgaccugggcucuaugcgaagcacugaccuuagcuacagggccaaucucuacccugugggaaggaaacccgggaagauuuuggaacacgacaauagcgguuaguauggcgaauauuuuuagagguucguaucuugcgggcgcuggccuauuauuuucaauaaugaagaauacaacuaacacaaggcgagguacggguaauaucggagagacgcuuggugagaaguggaaaucuagauuaaacgcauuagguaaaucugaauuucaaaucuauaagaaaagcggcauccaggaaguugauaggacacucgcaaaagaaggaauaaagcguggugaaacagaucaucacgccguaucuagagggucugcaaaauuacgaugguuuguugagcgaaauaugguaaccccugaaggaaagguuguggaucuagggugugggagaggaggguggaguuauuacugugggggccucaaaaauguccgagaaguaaagggccuaacaaaaggaggaccaggacaugaagaaccaauuccaaugucaaccuauggauggaaccucguuagacugcaaucggguguugacgucuuuuucacaccgccagagaaaugcgauacucuuuuaugugauaucggagaaucuuccccuaauccaacgaucgaagcaggucgaacccucagaguacuaaacuuagucgaaaauugguuaaauaauaauacacaauuuugcauaaaaguacuuaauccuuauaugccgucagucauagagaaaauggaaacacuucaacguaaauacggaggugcacuuguacguaauccauuguccagaaauaguacccacgaaauguauuggguuucaaaugcaacuggaaauaucguauccucuguaaauaugauaucacgaauguuaauuaacagauucacaaugaaacacaagaaggcaacuuaugaaccugauguagaccuugguucuggcacaaggaacauaggaauugagucagaaaucccaaauuuagacauuauagggaaacguauugagaaaauaaaacaggaacacgaaacaucauggcacuacgaucaagaucacccguauaagacgugggcguaccauggauccuacgaaacuaaacaaacaggcucggcuucgucuaugguaaacggaguagugcgauuacuuaccaaaccgugggacguagucccuauggucacacaaauggcuaugacugauacgacuccguuugggcaacaaagaguguuuaaagagaagguugacacccgaacacaagagccuaaagaaggaacgaagaaauuaaugcgcauaacagccgaauggcuauggaaagaacucgggaaaaagaaaacgcccaggaugugcacaagagaagaauuuacccguaagguacgaaguaacgcugcuuugggugcaauauuuacagaugaaaauaaauggaaaucagcgcgagaagcaguugaggauggaagauucugggaauuaguugaccgagaaagaaaucuucaucuggagggaaaaugugaaacuugcguauauaauaugaugggaaaacgugagaagaaauuaggggaauuuggaaaagcaaaaggaucuagagcuauaugguauauguggcuaggcgcuagauuucuagaguuugaagcguuaggcuuucuaaaugaagaccauugguucaguagaggaaauuccuuaaguggcguugaaggcgaaggacuacaucgacuaggauacauauuaagagauguagggaagaaggaaggaggcgcaauguaugcugaugacacagcgggaugggacacucgaauaacacuagaggaucucaaaaacgaagagaugguuaccaaucauaugaagggggagcacaagaaacuagcagaagccauuuuuaagcuaacuuaucaaaauaaaguaguucguguccaaaggccaaccccaagaggcacaguaauggauauaauaagccgucgcgaccaaaggggaucuggccaagugggcacauauggauuaaacacauuuacuaauauggaagcucaguuaauucgccaaauggagggugaagggauauuuaaaagcauucaacaucuaacggcuacagaagaaaucgcaguacaaaauugguuggcacggguagguagagaaagauuaucuagaauggcuaucucuggagaugauugugucguuaaaccuauagaugaucgcuuugcauccgcauugacagcccugaaugacauggggaaaguacguaaagauauacaacaaugggaaccuagcagaggauggaaugauuggacgcaagugccuuuuuguucacaucauuuccacgaacucgugaugaaagacggacgaguuuugguaguuccaugcagaaaccaggaugaauuaauaggccgagcacgcauaucacaaggggcaggaugguccuuaaaggaaacagcaugucuaggcaaaagcuacgcacaaauguggacacuaauguacuuccauaggagagacuuaagauuagcagccaaugcaauaugcagcgcugugccaagucacuggguacccacuucaagaacuacuuggagcauacaugcaaaacacgaauggaugacuacugaagacauguuagcaguguggaaccguguguggauccaagagaaucccuggauggaagacaaaacaccagucgaaucgugggaggaaguuccauaucuaggaaaacgggaagaucaauggugcgggagucuaaucggucucaccucgagagcaacaugggccaaaaauauacagacugcaauaaaucaaguaaggaguuuaaucgguaaugaagaauauacagacuauaugcccagcaugaaacgauuuaggagggaggaagaagaagccgggguguuaugguaa

SEQ ID NO: 22647 - RNA, 9876 nt, Artificial Sequence
  derived and/or modified CDS sequence (opt6) from DENV-2__FJ639733__SS-prME
acagcugguguaauaauaauguugauaccuaccgcuauggcguuucauuugacaacgagaaacggagaaccgcacaugauuguggggcggcaagaaaaaggcaaaucguuauuguuuaaaacugaagacggaguuaauaugugcacgcuuauggcaauagauuugggggaacuaugcgaagacacgauuacguacaaaugcccauuacuacgccaaaaugaaccggaagacaucgauugcugguguaauagcacaucuaccuggguaacuuauggaaccugcacaacaacaggugaacauagacgugaaaaacguuccguagccuugguaccacacgucgggauggguuuagaaacuagaacugaaacuuggaugaguucugaaggcgcuuggaaacauguccaacgcaucgaaacuuggauacugagacauccuggguuuaccauuauggcagcaauacuggcuuacacaauaggcacuacccacuuccagcgugcacuaaucuuuauauuauuaacggccguagcaccaagcaugacuaugcgaugcauagggauaucaaaucgggauuuuguugaagggguuuccggaggaucauggguagauaucguacuugaacacgguucuugcguaaccacaauggcuaaaaauaaaccaacacuugacuucgaacucauuaagacagaagcaaaacaaccggcaacacugagaaaauacuguaucgaggcaaaguuaacgaauacaaccacggaaucacguuguccaacccagggagagccaucgcuuaacgaagaacaggacaaacgauuuauauguaaacauuccaugguagaucgagguugggggaacggaugcgguuuauuuggcaaaggaggaauugucacaugugcuauguuuacauguaagaaaaauauggaagguaaaguuguacagccggaaaauuuggaauacacaaucguaauaacuccacacucuggugaagaacaugcaguugggaaugacacuggaaagcauggaaaggaaauuaaaauaacaccacagucuaguauaacggaggcagaacuaacuggcuaugguacugucaccauggaaugcagucccagaacaggguuagauuuuaaugaaaugguacucuuacaaauggaagauaaagcaugguuaguccaucggcaaugguuucuagauuugccauuacccugguuaccgggagccgacacucagggcucaaacuggauucagaaagagacucuagucacuuuuaaaaacccacacgcaaagaaacaagaugucguaguacuagguucacaggaaggggcaaugcacacggcauuaacuggcgcaaccgaaauacagaugucaucgggaaacuuacuauucaccggacauuuaaaaugccgauuaagaauggacaaacuccaguugaaagguaugucauauaguaugugcacuggaaaauuuaaaauuguaaaggaaaucgcagaaacgcaacacgguacuauuguaauccgcgugcaguacgaaggugacggaucaccuuguaaaauaccguuugaaaucacagaccuagaaaagcgccauguauuaggacgucucauuacgguaaauccaaucgugauagaaaaagauagcccuguaaacauagaggcggagccgccuuucggagacuccuauauuauuauaggagucgaaccaggccaacuuaaauuaaauugguucaaaaaggggagcucaaucgggcaaauguuugaggcaacuaugcgaggagcuaaacggauggccauuuuaggggauaccgcaugggauuucggaagccuggguggagccuucacaucuauaggaaaagcacuacaccagguauuuggagcaaucuauggggcagcauuuaguggagucucauggacaaugaaaauacuuaucggagucguaaucacuuggauugggaugaacucaagauccacaucacugucggugucgcuuguccuaguagguguuguuacuuuauaccuaggggcgaugguucaggcagauucagguuguguugugucuuggaaaaauaaggaacuaaagugugggagcggaauuuucauaacagauaacguucauacauggaccgaacaauacaaauuccaaccagaaaguccuucgaaacuagcaucagcaauucaaaaagcccacgaagaaggaauaugcggaaucagaucaguaacuagauuggaaaacuugauguggaagcaaauaacacccgaauuaaaucacauauuaucagagaacgagguaaaauuaacaauuaugaccggugacacaaaagguauaaugcaagcggguaaaaggucccuacgcccccaaccaacggagcuaaaauacucuuggaaaacuuggggaaaagcaaagauguuaucuacugagucacacaaucagacauuccugaucgacggaccagaaacagccgaauguccgaacacaaacagggcauggaacucgcucgagguugaagacuauggauuuggaguauuuacuaccaacauuugguugaaacuacgcgagaaacaggacguauuuugcgacagcaaacuaaugucagcagccaucaaagauaauagggcagugcaugcugauaugggauacuggauugaaucagcacuaaaugauacguggaaaauggaaaaagcaucguucauagaagugaaaucaugucauuggccgaaaucgcacacacuuugguccaacgguguguuagaaucagaaaugauuauucccaaaaacuucgcaggaccuguuagucaacauaauuaucgcccaggauaucauacacaaacugcuggcccguggcauuugggaaaauuagagauggacuuugacuuuugcgaagguacaacgguugucguaacagaagacugugggaaccgaggaccgagcuugagaaccacuacagcaaguggaaaacuaaucacagaguggugcugcagguccugcacccucccuccauuaagguaucgaggugaagacgguugcugguaugggauggagauacgaccgcucaaagaaaaagaagaaaaccugguaaacagucucguaacagcuggacacggucagaucgauaauuuuucucuaggcguguuaggaauggcacuuuucuuagaagaaaugcugcggacaagaguaggaacuaaacacgcaauacuucuuguagcaguaucauuugucacacucauaacaggaaacauguccuuccgagaucuaggucgcguaauggucauggucggugcgacuaugacagaugacauagguaugggaguaacauaccuagcacuauuagcggccuuuaaagugaggcccacauucgcugccggauuacuccucagaaaauuaaccucuaaggaauuaaugauggcaacaauaggaauaacguuauuaagucaauccacgauaccggagacuauacuagaacuuacggacgcuuuggcguuagggaugaugguauuaaagauuguuagaaaaauggaaaaauaccaacuggcagugacuaucauggcaauuuccuguguaccaaaugcugucauucuacgaaacgcauggaaggucaguuguacaauucuugcugcuguguccguuaguccucuucuuuuaacaucaucacaacaaaaggcagacuggauuccgcuagcauuaaccaucaagggcuuaaacccgacagcaauauuucuaacaacgcuaaguagaacuagcaagaaaagaagcuggccucuaaacgaggcaauaauggcuguagggaugguuucaauacuugcaaguucccuacucaaaaacgacauaccaaugacaggcccucuaguagcggguggauuauuaacaguauguuacguucucacagggcgcucugcagacuuagaauuggaacgagcggcagauguaaaaugggaagaucaagccgagauuaguggaaguagcccaauauuaucaaucacaauaucugaagacggaucaaugaguaucaaaaaugaagaagaagaacagacacuaaccauacuuaucagaacagguuuguuaguuaucucaggugucuucccaguaucuaucccaaucacagcagcugccugguauuuaugggaaguuaaaaagcagagagcggggguccugugggauguaccaagucccccgccgguaggaaaggcagaauuagaggauggagcauauagaauuaagcaaagaggcauacuuggauauagccaaauuggggcgggaguauacaaagaaggaaccuuucauacaauguggcacgucacuagaggagcaguucuuaugcaucgcggaaaacgcauugaaccaucaugggcugauguaaagaaggaccuaaucucauacggaggugguuggaaacuagaaggugaauggaaggaaggagaagaagugcaaguacuggcucuagaacccgggaaaaacccuagggcugugcaaacaaaaccaggaaucuuuaagacgaacacaggaaccauaggggccgucagccuagauuuuucaccaggaacgucgggcaguccgauaguggaccgaaaggggaaagucgugggauuguacgguaacggaguggucacuaggagcggcgcauacguaagugcgauugcucaaacugaaaaaucuauagaagauaaccccgagauagaagaugacaucuuccggaagaaacgacuaaccauuauggaucuacacccaggagcaggaaaaacaaagcguuauuugccagccaucguacgagaagcaauaaagagagguuugcgaacacugauauuagcaccaaccagagucguagcagcagagauggaggaggcuuuacgaggacuaccuauaagauaccaaacaccggcaauuaaagcggagcacacaggacgggaaauaguagauuuaaugugccaugcaacuuuuacaaugagacucuuaucuccaguaagagugccuaacuauaaucucaucauaauggaugaggcacauuuuaccgauccugcgucaauugcagcacgcgguuacauuaguacuagaguugagaugggugaagcagcaggcauuuucaugacagccacuccgccgggaucgcgagacccauucccacaaucaaacgccccaauuauggaugaagaaagggagauaccagaacgauccuggaauagcggccaugaguggguaacggauuuuaaagguaaaacuguuugguuuguuccuucgaucaaagccgguaaugacauugcugcaugccuuaggaaaaacggaaagaaaguaauucaauugucacguaaaacauuugacucagaauacguaaaaacgcgagccaacgacugggauuuuguuguaacaacagauaucagugagaugggcgcaaauuuuaaggccgaaagagugauugauccucguagguguaugaaaccugucaucuuaaccgacggugaagaacgcgucauucucgcaggcccgaugccuguaacacauagcucugccgcccaaagaagagguagaauaggaagaaaucccaaaaacgaaaacgaucaguauauauauaugggcgaaccauuggagaaugacgaagauugugcccacuggaaagaggcuaaaauguuauuagauaacauaaauacaccagaaggcauuauuccaucuauguuugagccagaaagggagaaagucgacgccaucgacggugaauaccgucuacgaggcgaagcuagaaaaacauuuguugaucuaaugaggagaggggaucuuccuguaugguuagcauauaaaguugcagccgaaggaaucaauuaugcggacaggaaaugguguuuugaugguaucaaaaacaaccagauucuagaggaaaacguagagguugaaauuuggaccaaagaaggggagaggaagaaauuaaaaccaagguggcucgaugcgaggauuuauuccgauccucucgccuuaaaagaauuuaaagaauuugcagcggguaggaagucacuuacacucaacuugaucacagaaauggguagacuucccaccuuuaugacgcagaaggccagaaacgcauuagauaaucuagcgguuuuacacacugccgaagcgggaggucgggccuacaaucaugccuuaagcgagcugccagaaacauuggaaacucucuuacugcuaacauuauuggcgacugugaccggaggcaucuuucuauuucuuaugucggguaaaggaauagguaaaaugacuuuaggcauguguugcauuauaacggcaagcgugcuuuuaugguaugcacagauccaaccgcacuggaucgccgcauccauuauuuuagaguucuuuuuaauaguuuuguuaauuccagaaccagagaaacaaagaaccccucaagauaaucaacugacguacgucguuauugccauuuuaaccguaguggcggcuaccauggcaaacgaaaugggauucuuagagaaaaccaaaaaggaucuaggacuaggcucaaucaccacgcaagaaucggaaucgaacaucuuagauauagaccugaggccggccucugcauggacauuauaugcuguggcgacuacuuuuguuacaccaaugcuacgacauuccauagaaaauucuuccguuaauguuucuuuaacagcgauagcaaaccaagcuacaguuuuaaugggccuuggaaaaggcuggccucucaguaagauggacaucggaguaccguuauuagcaaucggcuguuauagucaggugaaccccaucacauuaacagcugcccuauuacuauuagucgcccauuaugcgauaauuggcccuggucuucaggcuaaagcgacacgagaagcacagaaaagagcugcugcugguaucaugaaaaacccuacuguagacgggauaacggucauagacuuggaaccaauuccauacgacccaaaauucgagaaacaauuaggacaaguaaugcuuuugauuuuaugcgucacccaaguauugaugaugagaacaacgugggcacugugugaagcauuaacacuagcgacaggcccaauuaguacucucugggaagguaauccaggacgguucuggaauacaaccaucgcggucucaauggccaacaucuucagaggauccuacuuagcaggagcgggauuacuguuuaguaucaugaaaaauacaacgaauacaagaagagggacuggaaacaucggcgaaacacugggagagaaauggaagucuagauuaaacgcccugggaaaaagugaguuucaaauuuacaaaaagucaggcauucaagaaguagaucgaacuuuagcaaaagaagguauuaaacguggagaaaccgaucaccacgcaguaagccgcggaagugcuaaacugcgaugguuuguagaaaggaauauggugacaccagaggggaaaguaguugauuuaggcugugguagaggaggauggucuuacuacugcgguggacuuaaaaacguaagagaaguaaaggggcucaccaaaggaggucccggacacgaagaaccaauaccuaugaguaccuauggcuggaaccuaguucgcuuacaaucaggaguagauguuuucuuuacacccccagagaaaugcgacacacuacuaugugauauaggcgagucauccccaaauccuacgaucgaagcaggucguacccuaagaguacuuaauuugguugaaaauuggcuaaacaacaauacacaauucugcauaaaaguacugaauccauauaugccaucaguaauugaaaagauggaaacacuccaaagaaaauauggcggcgcguuaguaaggaauccucucucacgcaacucaacacaugagauguauugggucucaaaugcgacagguaauaucguaaguagcgugaacaugauuaguagaaugcuuauuaacagauuuaccaugaaacacaagaaagcaacuuacgaaccugauguagaucuagguaguggaacgaggaacauuggaauagagucggaaauuccgaacuuagauauuauuggaaaacggaucgagaagauaaaacaagagcaugaaaccucuuggcacuaugaccaagaccaccccuauaagacaugggcguaccacgguucauaugaaacgaagcaaacuggcucagcgaguucuaugguaaauggcguuguccgccuacuaacaaagcccugggacguggucccuauggugacacaaauggcuaugacagacacaacaccuuuugggcaacagagaguguucaaagaaaaaguagacacucguacccaagaaccaaaagaagguacaaagaaauuaaugagaauaacugccgaaugguuauggaaagaacuuggaaagaagaaaacaccuagaaugugcacucgcgaagaauuuacaaggaaaguaagaucgaaugcugccuuaggugcaauauuuacugaugaaaacaaauggaaauccgcaagagaggcuguggaagauggucguuuuugggagcuaguagauaaagagagaaauuugcauuuagagggaaaaugugagaccugcguuuacaacaugauggggaaaagagagaagaaauuaggagaauuuggaaaggcgaaaggaucuagagcaauaugguacauguggcucggugcuagauuccucgaguuugaggcuuuagguuuccucaacgaagaucauugguuuuccagagguaacucauuaucuggcguugaaggagagggacuacacagacuaggauauauauugagagacguggguaaaaaggaggguggggccauguacgcugaugacacugcaggaugggacacaaggauuacguuagaagaucucaaaaaugaggaaaugguaacaaaccacaugaaaggagaacauaagaaauuggcagaagcgauuuucaaauuaaccuaccaaaacaaaguagugcgcguucaacgaccuacaccuaggggaacagucauggacauaauaucacguagagaucaaaggggcucaggacaaguuggcacuuaugguuuaaauacauucaccaauauggaagcacaacucauccgccaaauggaaggcgaagguauuuucaaaucaauacagcacuuaacagcuacugaagagauugcggugcagaauuggcuagcucgaguagggcgcgagagacuaagcaggauggcaauuuccggggaugauugugucguaaagccaaucgaugauagauucgcgagcgcgcuaacagcauuaaaugacauggguaaggugagaaaagauauccaacaaugggagcccagccgagguuggaaugauuggacgcaagucccuuuuuguagccaucauuuucaugaacucgucaugaaagauggaaggguguugguaguuccgugucgaaaucaagaugaguugauuggccgagcucggauuucacaaggagcagguuggagccuaaaagaaacagcuugucucggaaaaucauaugcccaaauguggacacuaauguauuuccauagaagggaccugaggcucgcggcuaaugcuauaugcucagccguaccuucucacugggucccgacaucgcguaccacguggucaauacaugccaaacaugaauggaugacuacugaagacaugcuagcgguguggaauagaguauggauucaagaaaacccuuggauggaagauaaaacgccaguugaaucuugggaagaaguaccauaucuaggaaagcgagaggaucaauggugugggagccugauaggauuaacgucccgugccacgugggccaaaaacauacaaacagccauuaaucaaguuagaaguuuaauaggaaacgaagaguauacugacuacaugccuucuaugaagagauuuagacgcgaagaagaggaagccggagucuuaugguaa

SEQ ID NO: 22648 - RNA, 9876 nt, Artificial Sequence
  derived and/or modified CDS sequence (opt6) from DENV-2__FJ639734__SS-prME
acagcuggaguaauaguuaugcuuauaccuacugcuauagcauuucaucuaacaacaagaaacggugaaccacauaugauagugggaaggcaagaaaaaggaaagucgcuauuguucaaaacggaggacggaguaaauaugugcacgcugauggcaaucgacuuaggugaacuaugcgaagauacaauaacauauaaaugcccucuuuuacgacaaaaugaaccagaggacauagauuguugguguaauaguacaaguacguggguaacauacggaacgugcacgacaacgggcgaacaucgaagggagaaacgaucuguagccuuaguaccgcacguagguaugggauuagagacgagaacugaaacuuggauguccucugaaggcgcauggaaacacguacaacguaucgaaacuuggauauuacgucauccaggguucacaauuauggcagcaauucuagcuuauaccauagggacaacucauuuucagagagcgcuuaucuucauacuccuuacagcuguagccccaucaaugaccaugagauguauuggcauaucaaaucgcgacuuuguugaaggugugucaggcggaaguuggguggauauaguccuggaacaugguagcugcgugacgaccauggcuaagaacaagccuacacuagacuuugaacuuauaaaaaccgaagcaaaacagccagcgacauuaaggaaauauuguauugaggcaaaauugacaaauacaacuacagaaagucguugcccgacccaaggugaacccucacucaacgaagagcaagauaaaagguuuauauguaaacacucuaugguagaccggggauggggaaacggguguggauuauuugguaaaggagguauaguuacuugcgcaauguuuacauguaaaaaaaauauggaaggcaaaguuguccagccugagaaccucgaauacacuauaguaauuaccccacauagcggagaggaacaugcaguugggaaugauacggggaagcauggcaaggaaauuaagauuacgccgcaaucaucuauaacagaggcugaauugacaggauaugguacaguaacgauggaauguucaccacguacugguuuagacuucaaugaaauggugcuguuacaaauggaagauaaggcuuggcuggugcaccgccaaugguuuuuagaccuuccgcuaccauggcugccaggugcagauacucaaggcuccaacuggauacagaaagagacucugguaacauucaaaaacccacacgcaaaaaaacaagauguaguuguauugggcucccaagaaggagcaaugcacacugcgcuaacuggagcaacggaaauacaaaugucaucuggcaacuuacuauucaccggucaucucaaauguagacuacgaauggacaaguugcaacuaaaaggaaugagcuauuccaugugcacagggaaauuuaaaauaguaaaggagauugcggaaacucaacauggcacaauagucauaagaguccaauaugaaggggacggaucucccuguaagauuccauucgaaauuacagauuuagaaaaaagacauguccugggcagacuaauaacgguuaauccaauaguaacugaaaaagauagcccuguaaacauugaagcggaaccgccauuuggugauucguacauuauaauaggugucgagccaggacaacuaaaacuaaauugguuuaaaaaaggaucauccauuggacaaauguuugagaccacaaugagaggcgcaaaacgaauggcaauacugggagauacagcuugggauuucgggucacucggcggagucuuuacaagcauuggaaaggcguuacaucaaguguucggcgcuauauacggggcagcauuuuccgguguaucguggacaaugaagaucuuaauaggaguaguaauuacguggauagguaugaacaguagaaguacaucauuaagcguuagccuaguauuaguaggaguagugacacucuaccuuggcgcuauggugcaggcugacagcggauguguaguuucuuggaaaaauaaagagcuaaaaugugguaguggaaucuuuauuacagacaaugugcauacuuggacugaacaguacaaauuccaacccgagagcccaucaaaguuggcaagugccauucaaaaggcacacgaagaagguaucugcggaauacggucgguaacaagguuggagaaccugauguggaaacaaauuacuccggaguuaaaucacauucugagugagaacgaagucaaauuaacaauuaugacaggggacaccaaagguauaaugcaggcgggaaaacgaucccuaagaccacaaccuacggaauuaaaauauucauggaaaacauggggaaaagcgaaaaugcuuucuaccgaaucucacaaucagaccuuccuaauagacgguccagaaacagcagaauguccgaauacuaaccgagcuuggaauaguuuggaggucgaagacuacggauuugguguuuucaccacaaauauuugguuaaaacucagagaaaagcaggacguauucugugauagcaaacuaaugagugcagcuauuaaagacaaucgugcgguacacgccgauaugggauacuggauagaaagugcucuaaaugauacguggaaaauggaaaaagcaucguucauagaaguuaaaucaugccacuggccaaagucacauacacucuggucuaacggggucuuggaaucggagaugaucauccccaagaacuuugcggguccgguaagucagcacaauuauagaccaggauaccauacacaaacugcuggaccuuggcacuuaggaaaguuagagauggauuuugaucuaugugaagguacgaccguaguaguaacugaagacugcgguaaucgaggucccucacuacgaacuacgacggccucagggaagcuuauaacagaaugguguuguaggagcuguacacuacccccccuccgguacagaggcgaagaugguugcugguaugguauggaaauacgccccuugaaagaaaaagaagaaaaccugguaaacaguuugguuacagcaggccacggccaaauagacaauuucagccuagguguauuagggauggcacucuuucuagaagaaauguuacgaacgaggguagggacuaaacacgcuauucuccucguugcagucuccuuuguuacauuaaucacaggaaacaugucauuuagagacuuaggacguguaaugguaauggucggugcaacuaugaccgaugauauagguauggguguuacuuacuuagcacuucuugcagcuuucaaaguaagaccaacguucgcggcaggacucuuguuacguaaauuaacuucaaaagaauuaaugauggcuaccauagguauagcguuguuaucccaguccacaaucccagaaaccauuuuggaauugacagaugcguuagcacuagguaugaugguacucaaaauaguaagaaauauggagaaauaucaacuggcuguaacaaucauggcaauuaguuguguucccaacgcugucauucuacguaaugcuuggaaaguuagcuguacuauccucgcggcgguaucuguaaguccacuacuccucacuaguagucaacagaaggcagacuggauaccuuuagcucuaacaaucaaagguuugaauccuaccgcaauauuuuugacuacuuugaguagaaccucgaaaaaaaggaguuggccucuaaaugaagcuauaauggccgucggaaugguaagcauuuuagccucaucuuuacuaaagaaugauauacccaugaccgggccguuaguugccggaggucuuuuaacgguauguuacgucuuaacaggacgaagcgcugauuuggaauuagaacgugcggcugagguaaaaugggaagaucaggccgaaauuucuggaucuagcccuauauugucgauaacaauaucugaagauggaucaaugucgauuaaaaacgaagaggaagaacagacacuaacaauuuugauuagaacagggcuccuaguaauauccggaguuuuuccgguaagcauaccuauaacagcugcagcaugguauuuaugggaaguuaagaaacagagagccggagugcuaugggacguuccuucaccuccgccggucggaaaagcagaguuggaggauggagcauauagaauaaaacagcgcggaauccuaggauauucacaaaucggagcaggaguguacaaagagggcacauuucauacaauguggcauguaacccgaggugcaguacuaaugcauagaggaaaaagaauugaaccaucaugggcagacguuaaaaaggaccuaaucucauacggugggggguggaaauuagaaggagaguggaaagagggggaagaaguccaaguauuagcuuuagaacccgguaaaaacccaagagcgguccaaacuaaaccaggaauauuuaagaccaauacagggaccauaggagccguaucacuugauuuuucaccggguacaucgggaagcccgauaguggauagaaaagggaagguaguuggucuauauggaaacggugucguaacucgauccggagcuuauguaucggcuauugcgcaaacagaaaagucaauagaagauaacccagaaauugaagacgauauauuuagaaagaaacgauuaacaauuauggaucuccauccaggugcagguaaaacaaaacgauaccuccccgcaauuguaagagaagccauaaaaagggggcuucgaacauuaauacuagcucccacccgcguaguggccgcugagauggaggaagcacuacgagguuuaccuauacguuaucaaacgccagccauaaaagcggaacauacgggucgagaaauaguugacuuaaugugucacgcaacauuuacaaugagauuacuuucucccguaaggguuccgaauuauaaucuuauaauaauggaugaggcacacuuuacugacccagcuucaauagcggcaagaggauacauaucaacaagaguggaaaugggcgaggcagcuggaauauuuaugacugcaacuccaccugggagucgggacccauuuccccagucuaacgcaccaaucauggaugaggagagagagauuccugagcguucauggaacagcggccacgaauggguaaccgacuucaaagggaagacggugugguuugucccguccauaaaagcggguaacgacauagcagcgugcuugcgaaaaaauggaaaaaaagugauacaauuaucaagaaaaacuuuugauucugaguauguaaagacccgagcgaaugauugggacuucgugguuacgacagauauaucagagaugggagcgaauuuuaaagccgaaagaguuauugacccucgcagauguaugaaaccagugauucuaacugauggugaagagagaguuauacuagcgggucccaugccuguuacacauucaagcgcagcucaaagacgaggcagaauaggaagaaaccccaaaaaugagaacgaucaguauauuuacaugggagaaccucuugagaaugaugaagauugcgcucauuggaaagaagcaaaaaugcucuuggacaauauaaacacuccugaaggaauaauaccuucaauguuugagccagagagggagaaaguagaugcaauagacggggaguauagacuccgaggugaagcacgaaaaaccuuuguagauuuaaugaggagaggagaucugccuguauggcuagcuuauaaaguugcugcagagggcauuaacuaugccgaucgcaaaugguguuuugauggaauaaaaaacaaccagauuuuagaagaaaacguugaagucgagauauggacuaaagaaggagaacgaaagaaguuaaagcccagauggcuagacgcgagaauauauagcgauccguuagccuugaaagaauuuaaggaguuugcugccggcaggaagucacuaacucuuaacuuaauuacggaaaugggacgacuacccacauucaugacacaaaaagcaagaaaugcguuagauaaccuugcgguauuacauacagcugaagcgggcgguagagcauauaaccaugcauuaucagaacuaccugaaacauuagaaacacuuuugcuauugacguuacuagcgaccguaacagguggaaucuuccuguuucugaugucuggaaaaggaauuggcaaaaugaccuuaggaauguguuguauuauaaccgcaucuguauuauuaugguaugcccagauucaaccucacuggauagcagcgagcauuauccuugaguucuuucugauaguacuguugauucccgaaccugaaaaacaaagaacgccccaggauaaucagcuuacuuaugucguuauagccauauuaaccgugguagccgcgacaauggccaacgaaaugggcuucuuggagaaaacgaagaaagacuuaggacuugguucuaucaccacacaagaaucggaaucuaacauauuagacauagacuuacggcccgcgucagccuggacacuauaugcgguugcaacuaccuucguuacaccuaugcuucgacauucgauugaaaacucaagugucaacguaaguuuaacagcaauagcgaaucaagcuacagugcuuaugggccucggcaaaggguggccauuaucuaaaauggauauugguguaccauuacuagcgaucggauguuacucacaggugaacccaauaaccuugacugccgcauuauuacuucugguagcucacuaugcaauuaucggaccagguuuacaagcaaaagcaacuagagaagcucaaaaaagagcugcugcagguaucaugaaaaauccuacagucgaugggaucaccguaauugaucuugagccaauccccuaugacccuaaguucgaaaaacaauuaggucagguuauguuguuaauuuuaugcguaacccagguacugaugaugagaacaacgugggcguuaugugaagcucucacacuagcaaccggaccgaucaguacuuuaugggaggggaaucccggucgauuuuggaauacuacuaucgcaguaaguauggcgaauaucuuuagagguucauaucuagcaggagcugguuuauuguucucuauuaugaagaacaccacaaauacaagaagaggaacuggaaacaucggggaaacacuaggcgaaaaguggaaaucucgauuaaaugcucuuggaaaguccgaguuccaaaucuauaaaaagagcgguauacaagaaguagacagaacauuggcaaaggagggcauaaaaagaggugagacugaucaucaugcugucaguagaggcucugcaaaacuaaggugguucguagagagaaacaugguaaccccagaaggaaaaguaguggacuuaggguguggucgaggugguuggaguuauuauuguggaggauuaaagaacguacgcgaaguaaagggauugacaaaagguggacccggacaugaggaaccaauucccaugucaacuuaugguuggaaccucgucagacuucaaaguggaguagacguuuucuuuacacccccugaaaaaugugauacacuucuaugugauauaggugagaguagucccaauccaacuauagaggccgggaggacucuaagagucuuaaaccuaguagaaaauugguuaaauaauaauacacaauuuugcauaaaaguacuaaauccauacaugcccucuguaauagaaaaaauggaaacacuccaaagaaaauauggaggggcccuugucagaaauccacugucaagaaacucgacgcaugaaauguacuggguaaguaacgcaacggguaauauugucucauccguuaacaugauaucucgaauguuaaucaacagauuuacuaugaagcacaaaaaagcaacauacgaaccugauguugaccucggaucaggaacacgaaacauaggaaucgaaucagagaucccgaaccuugauauaauagguaagagaauagaaaaaauaaagcaagaacacgagaccucauggcacuaugaccaagaucauccauauaagacaugggcauaccacgggagcuacgaaacaaaacaaacagguagugcuaguaguauggucaacgguguaguuagauugcuaacuaaacccugggacgugguccccaugguaacacaaauggcgaugacagauaccacaccauuuggacaacaacguguuuuuaaagaaaaggucgacacccgaacgcaagagccgaaggaagguacuaagaaacugaugaaaauaaccgcggaaugguuauggaaggagcuuggaaaaaaaaaaacaccuagaauguguacuagggaggaauucaccagaaagguacgaagcaaugcggcauuaggugccauauucaccgacgaaaauaaauggaaaagugcucgagaggccguugaggauggacguuuuugggaacuaguagaucgcgaaagaaauuugcaucuggaagggaaaugugaaacaugcguuuauaacaugaugggaaaacgugaaaagaaacuuggcgaauuuggcaaagcuaaaggcaguagagcaauaugguauauguggcuuggugcucgauuucuggaauuugaagcguugggauuuuuaaacgaagaucauugguuuucucgaggaaacagucuuucggguguagagggugaaggucuacacagacucggauacauccuacgagacguguccaagaaagaagggggagcaauguaugcagaugauacugcaggcugggauacucgaauaacgcuagaagaucuuaaaaaugaagaaaugguaacaaaccauaugaaaggugaacauaagaaguuagcggaggcaauuuuuaaacugacuuaucaaaauaaaguuguucgggugcaacgaccgaccccgcgaggcacugucauggacaucauaucgcguagggaccagcgaggaagcggacaaguaggaacuuacggucugaacacauuuacaaacauggaggcgcaacuaauucgacaaauggaaggagaaggcauauuuaaaucuauucagcaucuuacagccacagaagaaauagcggugcagaauugguuagcuagggucgguagagagagauugucgcguauggcaauaagcggagacgauuguguaguuaaaccuauagaugauagauucgcaucagcucucacugcuuugaacgauauggguaagguacgaaaagacauucaacagugggaaccgaguagaggauggaaugauuggacccaggugccguuuugcagucaucauuuucaugaauuagugaugaaagauggucgagcucucgucgucccauguagaaaucaagaugagcugauaggccgcgcaagaacgucccaaggagccggauggucauuaaaagagacggcuugucuaggaaagucauaugcacaaauguggacacucauguacuuucauagacgcgauuuaagacucgcagcaaacgcaauuugcagugcaguacccagucacuggguccccacuucacggaccacauggucaauccaugccaaacaugaauggaugaccacugaggacaugcuagcggucuggaacagggucuggauucaggaaaauccuuggauggaagauaaaaccccaguagaaagcugggaggaagugcccuaccuuggcaaaagggaagaccaauggugcggaagucucauaggacugacaagccgagcaaccugggcaaaaaauauacaaacggccauuaaucaagugcgcuccuuaauaggcaaugaagaauauacggacuauaugccguccaugaaaagguucagacgagaggaggaagaggcggggguucugugguaa

SEQ ID NO: 22649 - RNA, 9876 nt, Artificial Sequence
  derived and/or modified CDS sequence (opt6) from DENV-2__JN819408__SS-prME
acugcugguguuauuguuaugcuuauuccaacggcuauggcguuccaccucacaacacgaaauggugaaccacauaugauaguaggaagacaagaaaaaggaaaaucuuuauuauuuaaaaccgaagaugggguuaauaugugcacacugauggcaauagauuugggggaauuaugcgaagauaccauuacauauaaaugcccucuucuacgacaaaaugaaccggaagauauagauuguugguguaacagcacaaguaccuggguuacauauggaacaugcacgaccacgggagaacacagaagggagaaaagaucgguagcgcucguuccacacguaggaaugggacuggaaacaagaacggaaacuuggaugagcucagaaggagcuuggaaacauguacaacgcauagaaacauggauacuuaggcaccccggauuuaccauaauggcagcuauauuggcuuacaccauagggacgacccauuuucaaagagcgcuaauauuuauccuauuaaccgccgucgcaccgaguaugacaaugcgaugcaucgggauuucgaauagagauuuuguagaaggaguuucuggagguucguggguugacauaguacuugaacacggaaguugcgugacuacaauggcuaaaaauaaaccuacacuugauuucgaacuuauuaaaacagaagcgaaacaaccugcgacccuacguaaauauuguauagaagcuaaauuaacaaacacaaccacagaaucuagauguccaacacaaggcgaaccgucuuuaaaugaagaacaagacaaaagauuuaucuguaaacacucuaugguggacagaggauggggaaacggaugcggcuuauucgggaaaggcgguauaguaaccugugcaauguuuacauguaagaaaaacauggaagguaaagucgugcagccagaaaauuuagaauauaccauaguuauuacuccucauucaggcgaagaacacgcaguuggaaacgauacgggaaaacaugguaaagaaauaaaaauaacaccgcaauccagcauaacagaagcggaauugacagguuaugguacuguaacaauggagugcucaccaaggaccggccucgacuuuaaugaaaugguccuccuacaaauggaggacaaagcaugguuaguucauagacagugguuuuuagauuugccauuaccauggcuucccggagccgauacucaagggucuaauuggauacaaaaagaaacucuaguaacauucaaaaacccacacgcgaagaaacaagaugucgucguacuagguucucaagaaggugcaaugcacacggcauugacaggagcaaccgaaauacaaaugucaucagguaacuugcuuuuuacaggacaucuaaaaugcagacugcgaauggauaaacuacaacuuaaaggcaugaguuauucgauguguacuggaaaguuuaaaauagugaaagaaauagcugagacucagcauggaacaauaguuaucaggguacaauaugagggagacggcaguccauguaaaauaccguucgagauaaccgaccuagagaaaaggcauguguuagguagauugauaacagucaauccaauaguuaccgaaaaagauucaccuguaaauauagaggcugaaccuccauucggagauucguauauaauaauugguguagaaccaggccaauugaaacuaaacugguuuaagaaagggagcaguaucggucaaauguuugaaacgacaaugaggggcgcgaagcgaauggcuauauugggggauacagcaugggauuuuggaucacuuggugguguauuuacauccauagguaaggcacuacaccaaguauucggugcaauauauggagccgccuucucaggagucagcuggacaaugaagauacuuaucgguguaaucaucaccuggauuggaaugaauagucgcucgacaucauuaagcgucagccuaguacugguaggcguuguuacacuuuacuuaggugccaugguacaggcugacagcggaugugucguauccuggaaaaacaaagaauugaaaugugggucgggaauauuuauuacggauaacguucauacuuggaccgagcaguauaaauuucaacccgagucuccaagcaaguuggcuucggcaauucaaaaagcucaugaagagggaauauguggaauaaggagcguaacuagacucgaaaaccuaauguggaaacaaauaacaccggaacugaaccauauucuauccgagaaugaggugaaacuaacaauuaugacgggagauacaaaaggcauaaugcaggcaggaaaacgaucacugcgaccgcaaccgaccgaacugaaauauuccuggaaaacaugggggaaagcaaaaaugcucagcaccgaaucgcacaaccaaacauuuuuaauagauggaccagaaacagcugaauguccaaauacaaaucgcgcuuggaauagccucgaaguagaggauuacggauuugguguguucacuacaaacauauggcuaaaauugcgggaaaaacaggacauauuuugcgauucuaaacuuaugagcgcugcgaucaaagauaacagagcugugcaugcugacaugggcuauuggaucgaaucagcucuaaacgauacuuggaaaauggagaaagcaaguuuuaucgaggugaaaucuugucauuggccaaaaucgcacacccuauggucuaacgggguacuugaaagugaaaugauuauacccaagaauuuugcaggaccuguuagucaacauaacuacaggcccggcuaucacacacagacagcuggaccauggcaccuaggaaaauuagagauggauuucgauuucugugaaggaaccaccguuguaguuacagaggacugcggcaauagaggaccgucauuacggaccaccacagcgucggguaagcucauaacggaauggugcugccgcagcuguacacuaccgcccuugcguuauagaggugaagaugggugcugguacgguauggaaauccguccacugaaggaaaaagaagaaaauuugguaaauagucugguaacugcuggacacggucagauagauaacuuuucuuuagguguccucgguauggccuuauuuuuagaagaaauguuaagaacgaggguggguacuaaacaugcuauuuuauuaguugcaguauccuuuguaacccuaaucacaggaaacaugucauuccgagauuuaggaagaguuaugguaaugguuggagccacaaugacagaugacauaggaauggggguaaccuaucuugcauugcuagcugcguucaagguacguccgacauuugcagccggacugcuuuuaagaaaacuuacaaguaaggagcugaugauggcaacaaucggaauugcccuacugagccagaguaccauuccggaaacaauauuagaauuaaccgaugccuuagcucuuggaaugauggcucuaaaaauuguaaggaauauggaaaaguaccaauuagcaguaacaauaauggcgauaaguuguguaccaaaugcuguaaucuuacagaaugcauggaaggugucaugcacaauucucgcugccgucaguguguccccgcuacuccuaacgaguucacaacaaaaagccgauuggaucccacuugcuuugacaauaaaagguuuaaauccgacggcgauauuccuaaccacccuauccaggacaucaaagaaaagaucauggccucuaaacgaagccaucauggcugucggaauggucagcauacuagcuaguucucuucucaaaaacgacauaccgaugacagguccacucguagccggcggacuucucacaguuuguuacguccuaacagguagaucggccgauuuagaacuagagagagcggcagacguuaaaugggaggaccaggcagaaauuucaggcucaucaccuaucuuaagcauuacuauuagcgaagacgggucaaugucuauuaaaaaugaggaggaagaacaaacucugacaauauuaauccgcacgggacuuuuggucauauccggaguauucccaguaaguauuccaauaacagcugcagccugguauuuaugggaagugaagaaacagcgagcaggaguguugugggacguaccaagcccuccgccuguaggaaaagccgaacuagaagacggugcauacaggauuaaacaacguggaauacugggguauucucaaaucggugccgguguguacaaagagggaaccuuucauacuauguggcauguaacgcguggugcaguauuaaugcacagagguaagagaauagagcccaguugggccgaugucaaaaaggaucuaaucucuuaugguggagguuggaaacuagaaggggaguggaaggaaggagaagaaguacaaguauuggcuuuagaacccggcaaaaacccacgagcaguucagaccaagcccgguauuuuuaggacaaauaccggaacaauaggagcagucagcuuagacuuuucaccaggaacauccggaaguccgauuguagaucgaaaagggaaaguagucggauuauauggaaacgggguuguaacuagaucaggggcuuacgucucagcuauugcucagacagaaaagucaaucgaggauaaccccgaaauugaagaugauauauucagaaagaaacgacuaacaauuauggaucuacaucccggcgcaggcaagacaaagagauauuuaccggcaauuguuagggaagcgauaaagcggggccucaggacauuaauuuuagcucccacacgcgucguggcugcagaaauggaggaggcuuugcgaggccuaccuaucagguaucaaacgccugccaucaaagcugaacauaccggccgugaaauuguugauuuaaugugucaugcaacauuuacuaugagauuauuaucaccgguacgugucccuaauuauaaccuaauuauaauggaugaagcacacuuuaccgacccagcgagcauagccgcuagaggcuauauaaguacacgaguagaaaugggugaagcggcaggaauauucaugacugcgacgccgccaggaucacgagauccguucccucaguccaacgcaccuauuauggacgaagaaagggagauaccagaacgaagcuggaacucaggucaugagugggucacggauuucaaagggaagacaguaugguuugucccgagcauuaaggccggaaaugacauagcugcaugccuacgcaaaaacgguaaaaagguaauucagcuaucucgaaaaacauuugauucugaguauguaaaaacgagagccaaugacugggauuuugugguuacgacggauauauccgaaaugggagcaaauuuuaaagcagaacguguaauagauccuagaaggugcaugaagccaguaauauugacagauggcgaagaaagaguaaucuuagcagguccuaugccggucacccacucuucagccgcacaacgucgaggucgcauuggaagaaaccccaaaaaugagaaugaucaauauauuuacaugggagaacccuuagagaaugacgaggacugcgcacacuggaaagaggcgaaaauguuauuggacaacauaaacacaccugaagguauaaucccgaguauguucgagccugaacgggagaaaguagaugcaauugauggugaauaccgacuaagaggggaagcacgcaaaacuuuuguagaucuuaugagaagaggagaucucccaguaugguuagccuauaaaguugcggcggagggaauuaauuaugcagauagaaaauggugcuuugacggaaucaaaaauaaucagauacuagaggaaaacgucgaaguagaaaucuggaccaaagaaggagaaaggaagaaacucaaaccaagaugguuagaugcucgcauuuacucagauccguuggcguuaaaagaauuuaaagaguucgcagcaggaagaaagagcuugacgcuaaaccuaauaaccgaaaugggacgauuacccacuuucaugacucagaaggcaaggaacgcauuagauaaucuagcaguauugcauacugcggaggcagggggucgcgccuacaaucaugcacuuuccgaacuaccagaaacacucgaaacacuuuuguuauuaacccuauuagcaacaguuaccgguggaaucuuuuuauuucucaugaguggaaagggcauaggcaagaugacuuuaggcauguguugcauaauaacggcguccaucuuauuaugguaugcucaaauacagccacauuggauugcggcaucaaucauacuggaguucuuucuaauaguacuacuaauaccagaaccagaaaaacaacguaccccucaagauaaucagcucacauauguuguaauugcuauacuuacagucguagcggcaaccauggccaacgaaauggguuuucuagaaaagaccaagaaagaccuaggauuagguucuauuaucacgcaggaaagcgaaaacaacauucuugauaucgaucuuagaccagcaucagccuggacauuauaugcagucgcaacaacuuuuguaacacccaugcuccgacacaguaucgaaaauagcucaguaaacguaucauuaaccgcaauagcgaaccaagcgaccgucuugaugggauuaggaaaaggauggccauugaguaaaauggacauaggaguaccccuauuagcgauuggauguuauucucaagugaacccaauaacacuaaccgcugcacuucuuuuauuaguugcucacuacgcuauaauugggccugguuuacaggccaaggcgaccagagaagcgcagaaaagggcggcagcagguauaaugaaaaacccuacuguugaugggaucaccgucauagauuuggaaccaauuccguacgauccuaaauucgaaaaacaacugggucaaguuaugcuucucauucugugcguuacccaaguuuuaaugaugcguacgacaugggcacuuugugaggcuuuaacuuuggcgacuggaccaauaucuaccuugugggaagggaacccaggaagguucuggaauacaacuauugcuguuagcauggcaaacauauucagaggaucuuauuuagcaggggcgggacucuuguuuucuauaaugaaaaauaccacgaauacgagacgaggcacaggaaacauaggggagacacuaggagaaaaauggaagucccgacuaaacgcguuagguaaaagugaauuucagauuuauaaaaaguccggcauccaggaaguagauaggacgcuagccaaggagggcauaaaaagaggagaaacagaucaccacgcugugagcagaggauccgcuaaauuacggugguucgucgaaagaaauauggugacaccggaggggaaggucgucgacuuaggaugcggaaggggaggcuggagcuauuacugugguggacugaaaaaugugagagaaguaaaaggauuaaccaaagguggacccggacaugaggagcccauacccaugucaacauacggcuggaaucucguacgccuacaaucagguguggaugucuucuuuacaccaccugaaaaaugugauacccuccucugcgacauaggugaaaguaguccgaauccaacaauagaagcuggaaggaccuuaaggguuuugaaucuuguugaaaauugguuaaacaauaacacacaauuuugcauuaagguacuuaacccuuauaugccgucaguuauagagaagauggaaacauugcagagaaaauacgguggggcauuaguaagaaaucccuuaagcagaaauaguacccaugagauguauugggugagcaaugcaacaggaaacauagugucaucuguaaauaugauaucaagaaugcuaauaaacagguuuacuaugaaacauaaaaaggcgacuuacgaacccgaugucgaccuuggaagugguacgagaaauauagggauagaaggugaaauuccaaacuuagacauaauuggaaaaagaauagaaaagauaaaacaagaacacgaaacaagcuggcauuaugaucaagaucauccauauaaaacuugggcguaccauggaagcuaugagacaaaacagacagguucggcuagcuccauggucaacggugucguucgucuucugacaaaaccuugggacguuguaccaaugguaacucagauggcaaugacagacacaacuccauucggacaacaacggguauucaaagagaaaguggacacacggacacaagaaccgaaggaaggaacuaagaaacugaugaagauaacagcagaaugguuauggaaagaauuaggcaaaaagaaaaccccgcgaaugugcacgagagaagaauuuacuaagaaaguuaggaguaaugccgcguugggagcuauauuuacugaugagaauaaguggaaaucugcccgggaagccgucgaagauggacgcuuuugggaacugguagacagagaaagaaaccugcaccuagaagguaaaugugaaacauguguauauaauaugauggggaaaagagagaagaaauuaggugaauuuggaaaagcaaaagguucacgcgcuauuugguauauguggcuuggcgcgcgauuucuugaguucgaggcacugggcuuuuugaaugaagaccacugguuuucaagaggaaauaguuuaucgggaguagaaggcgaaggucuacauagauuaggcuacauauuacgcgacguggggaagaaagaaggaggggcaauguaugcagaugacacugccggcugggauacccgaauaacgcuugaagaucuuaaaaaugaagagaugguaacaaaucacaugaaaggagaacauaagaaacuagcugaagccauuuucaaauugacauaucagaauaaagugguacgugugcaacguccaacgccaagagggacugugauggauauaauaagucgucgagaccaaagaggaagcggacaaguaggcacauacggauuaaauaccuuuacuaauauggaagcccaauuaauaaggcaaauggaaggugaaggaauauucaaaucuauccagcaccuaacggcgacugaagaaauagccgugcagaauuggcuagcgcgaguugguagggagcgauuaucgcgaauggcuauaaguggugacgauugcguaguuaaaccuauugaugauagguucgcgagcgcucuuacagcuuuaaaugacauggguaaagucaggaaggauauacaacaaugggaaccgucucgcggauggaaugauuggacucaaguuccauucuguucucaucacuuucacgagcugguaaugaaagauggucgaguuuuaguagugccauguagaaaucaagaugaauugauaggucgagccagaaucucacagggggcaggauggagcuuaaaagaaacagccugucuagguaagucauacgcacaaauguggacacuaauguacuuccacaggagagauuugcggcuagcugcaaaugcaauaugcagugcaguaccaucgcauugggugccaacaucacgcacuacauggaguauucaugcgaaacacgaguggaugacuacagaagacauguuagcagucuggaauaggguauggauacaagaaaauccauggauggaagauaagacaccuguggaguccugggaagagguaccuuauuuagggaaacgagaggaccaauggugcggauccuuaauaggauuaacgucuagggcaacgugggccaaaaauauucaaacugcgauuaaucaaguaagaucauugauuggaaaugaagaauauacagauuacaugccgaguaugaaaagauuuagacgugaagaggaggaagcaggggugcucugguag

SEQ ID NO: 22650 - RNA, 9876 nt, Artificial Sequence
  derived and/or modified CDS sequence (opt6) from DENV-2__FJ639783__SS-prME
acggcaggaguaauagucaugcugauaccaacagcaauggcauuucaccuuacuacaagaaauggagaaccacauaugauaguugguagacaagaaaaaggaaaaagucuucucuucaaaacagaagacgggguaaauauguguacucuaauggcaauagacuugggugaacuaugugaagauacgauaacguauaaauguccauuacuacgacaaaaugaacccgaagauaucgauuguuggugcaauucaacaaguacauggguuacauacgguacauguacaacaacaggcgaacaccgcagagagaaacgaucaguagcguugguaccacauguugggaugggccucgaaacuagaacggaaacauggaugucaagugaaggcgcguggaaacauguacaaagaaucgaaacauggauucugagacauccuggauucacgauuauggcugcgauacuugcauacacaaucggaaccacucauuuccaaagagcauuaauauuuauacuuuuaacagcaguagcaccgucaaugaccaugagauguaucggaguaagcaauagggauuucguagaagguguaagcggagggucauggguagauauagucuuagaacauggaucuugcguaacuacuauggcgaaaaacaaacccacccucgacuuugaacugauaaaaacagaagcaaaacaaccagcuacauuaagaaaguauuguauugaagcaaaacuaacgaauacaacgacugaaucaagguguccaacccaaggagaacccucgcucaacgaagaacaagacaaaagauuuauauguaaacauucgaugguggaucgcggguggggcaauggcugcggauuguucggcaaaggaggaauuguaacgugcgcaauguuuacuugcaagaaaaauauggaagguaaaguuguccagcccgaaaauuuagaauacaccaucgucauaacgccacacucgggugaagaacacgcaguagguaaugauaccgguaaacacggaaaggaaauaaaaauuacaccacaaucuucaaucacugaggcugaguuaaccggcuauggaaccguaacaauggaaugcucccccagaacugggcuagauuuuaaugaaaugguucugcuucaaauggaagauaaagcaugguuaguacauagacagugguuucucgauuuacccuuacccuggcuaccuggagcagauacacaagggucgaauuggauacaaaaagagacuuugguuacauuuaaaaacccucacgccaagaaacaagacguaguuguuuuaggcagccaagagggggcaaugcauacagcguuaacgggugcaacagaaauucagauguccucaggaaaucuccuauuuacaggacaccugaaauguagguuaagaauggauaaauuacaacuaaaaggaaugaguuauagcaugugcacaggcaaauucaaaauaguaaaagaaauagcugaaacucaacaugguaccaucguaauccguguacaauacgaaggugauggaagcccauguaaaauaccauucgaaaucacugaccucgaaaaacggcauguauuagggaggcuaauaaccguuaacccgauuguaacagaaaaagauagcccuguaaauauugaagcagaaccgccuuuuggugauaguuauauuauaauuggaguagaaccagggcaacuuaaauuaaacugguucaaaaagggaucaaguauaggacaaauguuugaaacgacaaugagaggagcaaaacguauggcuauccuaggagacacagcuugggauuucgguucguugggugggguuuuuacaucaauugggaaagcacuucaccaaguuuuuggcgcaauuuauggagcugcguuuagcggcguuaguuggacaaugaaaauauuaauuggcgugauuauaacauggaucgggaugaacucaagaaguacaagccuuucggucagucuggucuugguaggaguggucacccuauaucucggcgcaaugguacaagcagauuccggauguguaguaagcuggaaaaauaaagagcucaagugcggcagugggaucuucauaacagacaaugugcauacauggacagaacaauauaaauuccagccugagucgcccagcaaauuggcaucugcaauucaaaaagcccaugaagagggaauuugugggauuagaucagucacgcgauuagaaaacuuaauguggaaacaaauaacgccagaacuuaaccacauucuuagcgaaaacgaaguaaaguuaacaauaaugaccggugauauuaaagguauaaugcaagcuggcaagagaucguuaagaccacaaccaacggagcuaaaauauuccuggaaaacguggggcaaagccaaaaugcuaagcaccgaaagccauaaucaaacguucuuaauugacgguccugagacagcagaaugcccaaacacaaaucgcgcuuggaauagcuuagaaguagaagacuacggauuuggaguauuuacaacuaauauaugguugaaauuaagagaaaaacaggaugucuucugugauucuaaauuaaugucugcugcaauuaaagacaaucgugcgguucaugcagacaugggauauuggauugaauccgcguuaaaugacacauggaaaauggaaaaagcaucuuuuauagaaguaaagagcugccauuggccuaaaagucauaccuuauggucaaacggugucuuggaaucagaaaugauuaucccuaaaaacuuugccgggccgguaagccaacauaauuacagaccaggauaucacacacagacggccggaccguggcacuuaggaaaguuagagauggauuucgauuuuugcgaagguaccaccgucguggugacagaagauugugguaaucgaggcccuagccuacguacuacaacggcaaguggaaaguuaauaacagaaugguguugcagaaguuguacuuuaccgccucugcgcuauaggggagaagauggaugcugguacggcauggaaaucaggccacuuaaagaaaaagaagaaaauuuaguuaauagucuagucaccgcggggcaugggcaaauugauaauuucucacuugggguguuaggaauggcucuauuucucgaagaaauguuaagaacaaggguggggacaaaacaugcaauucuucuaguagcaguuaguuuuguaacguuaaucacaggaaauaugucauuuagagaccuugguagaguuaugguaauggugggagcaacaaugaccgaugacauugguaugggcguaacauaucuggcacugcuagcagccuucaaaguuaggcccacuuuugcugcaggccuucuacuuaggaaacuuacaucuaaggaauugaugauggcgacaauugguauugcauuacugagucagucaacgauuccugagaccauuuuagagcugacagaugcccuugcauuagguaugauggucuuaaaaauaguacguaauauggagaaauaccaauuggccgugacuguaauggcaauuucuuguguaccuaaugcaguuauauuacaaaacgcguggaaggucucgugcaccauacuugcagccgucucggugagccccuugcuacucacaucaucccaacaaaaggcugacuggaucccacuagcuuuaaccauaaaaggauugaacccuacugcgaucuuccuaacaacuuuguccagaaccucuaaaaagagaaguuggccucugaaugaagcgauaauggcaguagggaugguuaguauacuagccaguucacucuuaaagaacgauauaccaaugacaggaccucuagucgcagggggccuacuaacaguaugcuacguauugacaggaagaagcgcugauuuggaacuagaacgagcagcagaugucaaaugggaagaucaagcagaaauuucugguaguucgccuauacuaucuauaacaauauccgaagauggaucaaugucaaucaaaaaugaagaagaagaacagacauugaccauccugauccgcacaggacuauuggucauauccggaguauucccagucagcauuccaaucacugcagcagcaugguacuuaugggaaguaaagaaacaacgcgccgguguguugugggaugugccuucacccccaccaguggguaaggcagagcuagaagacggugcauaccgaauuaaacaaagaggaauuuuagguuacucccaaauaggagcggggguauauaaagaaggaacauuccauacuauguggcacguuacucguggggcagucuuaaugcaccggggaaagagaauagaaccaagcugggcugaugucaagaaagauuuaauuucuuauggugguggguggaaguuggagggagaauggaaagaaggugaagagguacaaguucuugcuuuggaacccggaaagaacccaagggcggugcaaacuaagcccggcaucuucaaaacaaauacagguaccauaggagcaguaucauuggauuuuucaccuggcaccucagggucuccaauaguagauagaaaaggcaagguugugggacucuauggaaauggcguaguaacgagaucaggagcuuacgugucugcgauagcgcaaaccgaaaagucgauagaagauaaucccgagauagaggaugauauuuuuagaaagaaacgauuaacaaucauggauuuacacccaggugccggaaaaacaaaaagauauuuaccagcgaucguaagggaagcaauaaaacgaggucuacgaaccuuaauauuagccccaacccguguaguagcagccgaaauggaagaagcucuacggggauugccaauuagauaucagacucccgcaaucaaagcagagcauaccggaagagagauaguagauuuaaugugccaugcaacauuuacuaugagacugcucagucccgugcggguaccgaacuauaaucuaauaaucauggaugaagcgcacuucacugauccagcuucaauagcagcccguggauacauaucaacucgaguagagaugggcgaagcagcgggcaucuucaugaccgcaacuccuccggguagucgugauccuuuuccgcagagcaaugcgccgauaauggaugaagaaagagaaauuccagaacgauccuggaacucaggacaugaauggguuacagauuuuaagggcaaaacagucugguucguaccaagcauuaaagcaggaaaugacauugcggccugucugaggaaaaaugggaagaaaguaauucaauuaagucgcaaaacauuugacucagaauacgugaagacuagagcaaaugacugggauuuugucguaacuaccgacaucucagaaaugggggcaaacuucaaagcugagagaguaauugauccacgucguuguaugaagccagugauauuaacggauggagaagaaagaguaauucuugcggguccuaugccggugacgcauaguagugccgcacagcggagagggcgaauaggaaggaaccccaaaaaugaaaaugaucaauauaucuauaugggagagccauuagaaaaugaugaagauugcgcacacuggaaagaggcaaaaauguuguuagauaacauaaauacgcccgaagguauuauaccgaguauguuugagccagagagggaaaaagucgaugcuauagauggagaauacagacuacggggagaggcaaggaaaacuuuuguagaucuaaugaggagaggugaucuaccuguaugguuagcguacaaagucgcugcagaaggcaucaacuaugcggauagaaaaugguguuuugauggaaucaaaaacaaccaaauucuugaagaaaacguggaagucgaaauauggaccaaagaaggugaacgcaagaaacucaaaccacgaugguuagaugcacguauauauagugauccauuggcacuuaaagaguucaaagaguucgcugcaggcagaaaaucacucacgcuuaaccuuaucacggagaugggccgacuaccgacuuuuaugacucaaaaagcgaggaaugcacuagacaacuuagcugugcuacacacagcggaagcugguggcagagcguacaaucacgccuugagugaauuaccugaaacguuggaaacauuauuacucuuaaccuuauuagcuaccguaaccggggguaucuucuuauucuuaaugagcgguaaagggaucggaaaaaugacucuagggaugugcugcaucauaacggcaucuguacuacucugguacgcccagauucaaccacauuggauagccgcaucuauaauuuuagaguucuuucuuauaguucuacuaauaccugaaccagaaaaacagagaacaccacaagauaaccagcuuaccuaugucgugauugcaauccuuacuguuguagcagcgacuauggcaaacgaaaugggauuucuugagaaaacuaagaaagauuuaggauugggguccaucacuacucaagaaagugagagcaauauacuagacauugauuugcguccagcaucugcuuggacucuuuaugcagucgcaacuaccuuuguaacgccuauguuaagacauucgaucgaaaacucgucagucaacguuucacugacggcgaucgcaaaucaagcaacgguuuuaaugggucugggcaaagguuggccuuuaucuaaaauggacauuggagucccacuccuagccauagguuguuauagccaaguaaauccaauaacacuaacggcagccuuauuacuguuaguagcccacuacgcuauaauagggcccggacugcaagcgaaagcaacacgugaggcacagaaaagagcggccgcgggcauaaugaaaaacccuacagucgacgguauaacugugauagaucuugagccaauaccguacgauccaaaauuugagaagcaacuugggcaaguuaugcuacuaauacucuguguuacacaaguucucaugaugagaacaacaugggcccuuugugaagcgcugacguuagcaacugguccaauuucaacacuuugggaaggaaacccaggccgauuuuggaauacuacuaucgcaguaagcauggcgaauaucuuccgagguagcuaucuggcaggagcgggacuccuguucucuauaaugaaaaauacuacaaacacuaggcgugguacaggaaauauaggugagacacuaggagagaaauggaaaucgagauuaaaugcauugggaaagagugaguuccaaauauauaagaagaguggcauccaggaaguagauaggacucuagcaaaagaagguaucaaacgaggugaaacagaucaucaugcggugucuagggguucggcgaagcucagaugguuuguugaaagaaauaugguuacaccggaaggaaagguaguagauuuagguugcgguagagguggauggucauacuauugugguggguugaaaaacgucagagaaguuaaaggauuaacuaagggagguccggggcaugaagaacccaucccaaugucgacauacggauggaacuugguaagacuucagagugguguagauguguucuuuacaccaccagagaaaugcgauaccuuacuuugcgauauaggagaaaguaguccuaauccuacaauugaagcgggacgaacacuaaggguccuuaaccuaguagaaaacugguugaacaauaauacacaauuuugcauaaaaguguuaaauccauacaugccaucgguaauagaaaagauggaaacacuacaacguaaguacggaggugccuuaguaagaaauccccuuucaagaaauucaacacaugaaauguacugggucagcaacgcgacuggcaauauaguaucguccgucaauaugauaucaagaauguuaauaaaccgauucaccaugaaacacaagaaagcgacguaugaaccagacguagaucucgguaguggaacuagaaauaucgguauagagucggaaauaccgaaucuagauauuaucggaaaacguauugagaaaauaaaacaagagcaugaaacgagcuggcauuaugaucaagaccacccuuacaaaaccugggcauaucauggaaguuacgaaaccaaacaaacgggaucggccaguaguauggucaacgggguagucagauuauuaacgaaaccaugggauguaguuccaauggugacccaaauggcaaugacagauacaaccccuuuuggacagcaaagggucuucaaagaaaaaguggacacaagaacacaggaacccaaagaaggcacuaagaaacuuaugaagauaacugcugaaugguuauggaaagaacuggggaagaagaaaacaccgcgaaugugcacaagagaagaguucacaagaaaaguaagauccaacgcugcacuuggagccauuuucacggacgagaacaaauggaaaagugcacgugaagcggucgaagacgggcgcuuuugggaauugguagauagagagcggaaccuucacuuagaagggaaaugugagacguguguauauaauaugaugggcaaacgagaaaagaaacugggggaguuugguaaagcgaaaggcucucgagcaaucugguauauguggcuuggagcaagguuuuuagaauuugaggcauuaggauuucuuaaugaggaccauugguuuucgcguggaaauucacuaucuggaguugagggugaaggauugcauagacuaggauauauuuuacgugacguuggcaagaaagaagguggggcaauguacgcagacgauacagcgggaugggauacacgaauaacuuuagaagaucucaaaaacgaggaaauggugacuaaucacaugaaaggggaacacaagaagcuagcugaggccauauucaagcugacuuaucagaauaaaguaguacgaguacaaaggccaaccccacgugggacaguaauggacauuauaagcagaagagaucaacgaggaagcggacaaguagggacauacggauuaaacaccuuuacgaacauggaagcccaauuaauuaggcaaauggagggagaagguaucuucaaaaguauccaacaucuuacggcaacagaagaaauagcuguacaaaacugguuggcaagaguagggcgagagaggcuaucuaggauggcaauaaguggggaugauugcgucgucaagcccauugaugauagauucgcgagugcucuaacagcucucaaugacaugggaaaggugcguaaagauauacagcaaugggagccuucgcgcggcuggaacgauuggacacaaguaccguuuuguucacaccacuuucacgaauuagucaugaaggacggaagaguguuaguaguuccuugcagaaaccaggacgaguuaauaggacgagcaagaauaagucaaggugcugguuggucacugaaggaaacagcaugucuggguaaguccuaugcgcaaauguggacauuaauguauuuucaccgaagagauuugcgucucgcggcuaaugcgauuugcucagcugugccgagucacuggguuccuacaucaagaaccacguggagcauucaugcaaagcacgaauggaugacaacagaagacauguuagcuguauggaauagaguuuggauacaggagaauccauggauggaagauaaaacaccuguugagaguugggaagaaguaccuuaucuagggaaaagggaagaucaguggugugggucucugauaggauuaacaucaagagcgacaugggccaagaauauccaaacugcaauaaaccaaguccggucccugauuggaaaugaagaauacacagacuacaugccaucaaugaagagguucagacgagaagaagaagaagccggaguauuaugguga

SEQ ID NO: 22651 - RNA, 9876 nt, Artificial Sequence
  derived and/or modified CDS sequence (opt6) from DENV-2__FJ639788__SS-prME
acugcugguguaauuguaaugcuaauaccaacugcaauggcauuucaccuuacuacccgcaauggagaaccgcauaugauaguagggcggcaagaaaaagguaaaucauugcuuuuuaaaacugaagauggaguuaauaugugcacuuuaauggcgaucgaucuuggagaacuaugugaagacacuauaacguacaaauguccguuauugagacaaaaugaaccagaagacauagauugcugguguaauucuaccaguacauggguaacguaugguacauguacaacagcuggagaacacagaagagagaaaagaucaguggcauuaguaccucacguggguaugggacuagaaacucguaccgaaacuuggaugucuagcgaaggggcauggaaacauguacagagaauagaaacauggauacuaaggcacccagguuuuacuauaauggcugcgauauuggcguacacgaucgggacaacacauuuccaacgggcgcuuauauuuauccuucuuacugcaguagccccaaguaugaccaugagauguauagguguuucaaacagagauuucguggaagggguuucaggaggaucaugggucgauauuguacuagaacauggaagcugcgucacgacaauggcgaaaaacaagccuacucuagauuucgagcuaauuaagaccgaagcaaaacaaccagcgacauuaaggaaguacugcauugaggcgaaacuaacuaacaccacuacugagagucgauguccaacucagggagaacccuccuuaaaugaggaacaagacaaaagauuuauauguaaacacaguaugguugaccguggauggggaaaugggugcggauuauuugggaaaggagggauuguaacuugcgcuauguuuacgugcaagaaaaauauggaaggaaagguaguucagccagagaauuuggaguauacaauaguuauaacaccccauucgggugaagaacaugcgguuggaaaugauacugguaaacacggcaaggaaaucaaaauuaccccucaaucgaguaucacagaagcugaauugacaggcuauggcaccgucaccauggaauguagcccuagaacuggcuuagauuucaaugaaaugguauuacuacagauggaagacaaggcuuggcugguccaucgccaaugguuuuuagaucuacccuuaccuugguuaccuggagcugacacccagggaucaaauuggauccagaaagaaacauuaguuacguucaagaacccacaugccaagaaacaggacguaguugugcucggaucacaagaaggcgcaaugcauacagcacucaccggagcgaccgaaauacaaauguccucagguaauuuauuguuuacaggucaucuaaaaugucgacuuaggauggauaaauuacaauugaaaggaaugaguuacucaaugugcacaggcaaauuuaagauaguaaaagaaauugcggaaacgcagcauggcacaauaguaauuagaguacaauaugaaggcgauggaucacccuguaaaauacccuuugaaauaacggacuuggaaaagcgacauguucuaggaagacuuaucacugugaauccaaucguaacagagaaagauucaccgguaaauauagaagccgagccgcccuucggagacucauauauaauuauagggguugagcccggacagcuaaaacuaaacugguuuaagaaaggcaguucuauaggucaaauguuugagacaacaaugaggggugcgaaaagaauggcaauucucggagauacagcaugggacuuuggaaguuuggguggcguauuuaccucuauaggaaaagcauuacaccaaguguuuggcgcaauuuacggggccgcauucucugggguuucauggaccaugaagauucuuauuggcgugauuaucaccuggaucggcaugaacucaagaucgacaucgcuaaguguaucauuaguguuaguaggaguugucacguuauaccugggugcaaugguacaagcagauucaggcuguguuguuucauggaaaaacaaagaacuaaaauguggaucuggaauauuuaucacagauaauguacauacuuggacagaacaguauaaauuucaaccugaauccccgucaaaacuugcuagcgcuauccaaaaagcacaugaagaggguauauguggaauccgaucagugacgagacuagagaauuuaauguggaaacagaucacuccggaauugaaucacauauuaucagaaaacgagguaaaauuaacgauuaugaccggggacauaaaaggcauaaugcaagccggcaaacgaagccugagaccacaaccaacagaauugaaauauucuuggaaaacgugggggaaagccaaaaugcuauccacagaaagccacaaccaaacuuuucuaauagaugguccugaaacugcggaauguccuaauacuaacagggcauggaauagccuugagguugaagauuacggauuuggcguguuuacgacgaacauuuggcuaaaguuacgagaaaagcaagacguuuucugcgacagcaaacucaugagugccgccaucaaagauaauagagcugugcaugccgacaugggauauuggauagaaagcgcccuaaaugauaccuggaaaauggaaaaagcaaguuuuauugaggucaaaucuugucacuggcccaaaagccauacguuguggucuaacggaguacuggaaagugaaaugauaauccccaaaaacuucgcaggacccgugucccaacauaauuaccgcccaggcuaucacacacaaacugcagguccauggcauuuaggcaaauuagaaauggauuucgauuuuugugaaggcacuacgguaguugucacagaagauugcgguaaucgaggacccucgcuaagaacuacuacagcaucggggaaauuaaucacugaauggugcuguagaaguugcacacuuccaccuuuaagauacagaggggaagauggaugcugguacggaauggagauuagaccacuuaaagaaaaagaagaaaauuuaguaaauucauugguuacggcuggacauggacagauagauaauuucucacucgguguauuaggcauggcacuauuucuagaggaaaugcuacgaacgaggguagggacgaagcacgccauucuuuuaguagcugucagcuuugucaccuuaauuacuggaaauaugaguuuucgugaucuaggccgaguaaugguaaugguaggagcgacgaugacggaugacauagggaugggcgugacguaucuagcacuauuggcggcauucaaaguuaggccaacauucgcagcuggccuccuacugagaaaauuaacaaguaaagagcucaugauggcaacuauagguauagcguuauuaagucaguccacuauaccggaaacgauucuagaauuaacugaugcauuggccuuaggaaugauggugcuuaaaauuguucgaaacauggaaaaauaucaauuagcuguaacaguaauggcaauaucuuguguaccuaacgcagucauacuacagaacgcauggaagguaucguguacgauauuggcagcgguaagcguuucuccucuauuacuuacaagcucacagcaaaaagccgauuggaucccauuagcccuaacuaucaaaggacugaauccgaccgcaauuuuccuuacaacacuaagucguaccaguaagaaaagaucguggccgcuaaaugaagcaauaauggcaguuggaauggucaguauauuggcuucgagucuuuugaaaaaugauauuccaaugacuggaccccuaguggcagggggccucuuaacaguaugcuauguacuaacaggccgaucugcggauuuagaacuagaacgagccgcggacgucaaaugggaagaccaagcugaaauuagugggagcucuccuauccuuucaauaacaaucagcgaggauggaucaaugucaaucaaaaaugaagaagaggagcaaacauugacuauucucauacgcacaggguuauuaguaauaucuggcguguuuccagucaguauuccuauaaccgcggccgccugguauuugugggaaguaaagaaacagagagcaggggugcuuugggauguuccuucuccacccccaguagguaaagcugaacuagaagacggcgcauacaggauaaaacaacggggcaucuugggguauucacaaauaggagccggaguuuauaaagaaggaacauuucauacgauguggcacgugacaaggggagccguauuaaugcauagagggaaacgcauugaaccaucaugggcggacgucaagaaagaccuuauaucuuauggaggcggcuggaaacuagagggugaguggaaagaaggugaagaaguucaaguucuagcauuagaacccggcaaaaacccaagagcaguccaaacgaagccuggaaucuuuaagacgaauacuggaacaauuggagccguuucucuagacuuuagcccuggaaccagugguucuccaauaguagacagaaaggguaaagucguagggcuuuacggcaauggcguggugacacgauccggugcauacgugucugccauugcacaaaccgagaaaagcauagaggauaauccagaaaucgaagaugacaucuuuagaaagaaacguuuaacaauuauggacuuacaccccggugcagguaaaacuaaacgguauuuaccugcuauuguucgggaggcaauuaaacgaggauuaagaacauuaauauuagcaccaacuagaguaguagcggcugaaauggaagaagcacuucgagggcucccaauaagauaccaaacgccagccauuaaagcagagcacacuggacgcgaaauaguagaccuaaugugucaugcaacuuucacuaugcgccuacuaucaccaguacgcgugccaaacuauaauuugaucauaauggacgaagcacauuucacggacccugccucaauagcugcacgcggauauauauccaccagaguugaaaugggugaggcagcuggaauauuuaugacagcgacucccccuggaagucgugacccuuuuccacagaguaaugcgccaauaauggaugaagaacgagagauaccugaacgcuccuggaacucuggacacgaguggguuacagacuucaaaggaaaaacagugugguuuguacccucaauuaaagccgguaaugauaucgcggcuugucuaaggaaaaacgguaagaagguuauucaauuaagucgcaagacuuuugacagugaguauguaaagacgagagccaaugauugggauuuugugguaacuacugacaucagcgaaaugggcgcgaacuucaaggccgaacgugugauagacccacgucgguguaugaaaccaguuauauugacugacggagaagagagggucauccuugcggguccaaugccuguaacucauucguccgcugcacaaagaagggguagaauaggaaggaauccgaagaaugagaaugaucaauacauauauaugggagagccucucgaaaaugacgaggauugugcccacuggaaagaagcuaaaauguuacuagacaacauaaauacaccagagggaauaauaccuucaauguuugaaccagaacgggaaaaagucgacgcuauagauggugaguauagauugcguggugaagcucgaaaaaccuuugucgacuuaaugcggcgaggagacuuaccgguuuggcuugcauauaaaguugcagcagaaggaauaaacuacgcggauagaaagugguguuuugacggcauuaaaaacaaccaaauauuggaggaaaauguagagguagagauuuggacaaaagaaggcgaacgaaagaaacucaaaccuagaugguuagaugcuaggauuuacucagacccacuggcauugaaagaauuuaaagaauuugcagcgggccggaagucgcuaacauuaaaccucauaaccgaaaugggccguuugcccacauuuaugacgcaaaaagcucguaaugcacuugacaacuuagcgguucuccauacggcugaagcugguggacgcgccuauaaucacgcuuuaucagaauuaccggaaacucuggaaacauuacuuuuauuaacuuugcucgcaacuguaaccgguggaauauucuuauucuuaauguccgggaagggaaucggaaaaaugacauuagguauguguuguaucauaacagcaagcguucuucugugguaugcacaaauccaaccucauuggaucgccgcauccauaauuuuggaauuuuucuuaauaguauugcuaauaccagaaccagaaaaacagagaacuccacaagacaaccaauuaacguacgugguaauagcgauacuaaccguuguagcugcaaccauggcuaaugaaaugggauucuuggagaaaacgaagaaggauuugggucugggaagcauuacaacgcaagaaagugaaaguaauauauuggacauagaucucagaccagcaucggccuggacuuuauacgcgguagcaaccacauuugucaccccgaugcuacgacauaguauagaaaauucauccguuaacguuagcuuaacagcuauagcuaaucaggcgacgguuuugaugggccuuggcaaagguuggccacuuaguaaaauggacauuggugucccgcuucuggcuaucggguguuacucacaaguuaacccaauaaccuuaacagcagcauuauuacuccuaguggcacauuacgccauuauuggcccggguuugcaggcuaaagcaacucgagaagcccagaaaagggcugccgcagggauaaugaaaaacccgacaguagauggcaucacuguaauagauuuagaacccauaccuuaugaccccaaguuugagaagcaauuaggucaaguaaugcuccuaauauuauguguuacccaaguccuaaugaugaggaccacuugggcgcuaugcgaggcguuaacccuagcuaccggacccauaaguacuuuaugggaagggaauccgggaagauuuuggaauacaacaaucgcuguuaguauggccaacauauuuagaggaucuuauuuagcuggugcuggacuguuauuuucgauaaugaaaaauacuacaaauacucgacguggaacaggaaacauaggcgaaacacuaggggaaaaauggaaaucaagauuaaaugcccucggaaaaagugaauuucaaauuuauaagaaaagcggaauacaagagguagaucgaacacucgccaaagagggcauaaaaagaggagaaaccgaucaccaugcgguauccagagggagcgcaaaauuaagaugguuuguagaacggaacauggucacgccggaaggaaagguaguagaucuaggaugugguagaggaggcuggaguuacuauugugggggacugaaaaauguucgugaggucaaaggauugacaaaagggggaccaggucaugaagaaccgauucccaugagcacauauggauggaauuugguacgacuacaaucagguguagaugucuucuuuacaccaccggaaaaaugcgauacacuguuaugugauauaggggaauccucaccaaaucccacgauagaagcuggaaggacacuucgagucuuaaacuuagucgaaaacuggcucaauuacaacacacaguuuuguauaaaaguuuuaaacccauauaugccaucuguaauagagaaaauggaaaccuuacaacgaaaauauggaggagcauuggucaggaacccacuuagcagaaauucuacccacgaaauguauuggguaucuaacgcuacuggaaauaucguaucgaguguaaacaugauuagccgaaugcuaauaaauagauuuacaaugaaacacaagaaagcuacuuacgaaccugaugucgauuuaggauccggaaccagaaacauaggaauugaaucagagauucccaaucuagacauuauagguaaaagaauagagaaaauaaaacaagagcacgaaacgaguuggcauuacgaucaagaucacccauauaaaacuugggcauaucauggaagcuacgaaacgaagcagacaggaagugccuccucuaugguaaauggcgugguaaggcuacuaacuaaaccaugggauguagugccuauggucacacaaauggcuaugacagauacaacaccuuucggucagcaaagaguuuuuaaggagaaaguggauacacgaacucaagaacccaaagaagguacgaagaaacuuaugaagauuaccgcagaguggcuauggaaagaguuggggaagaagaaaaccccacguaugugcacacgggaagaguuuacuagaaaaguaaggucuaaugcggcgcucggugcaauauuuacugacgaaaauaaauggaaauccgcccgcgaggcaguggaagauggccgauucugggaauuaguagauagagagagaaauuuacacuuagaaggcaaaugugagaccuguguauauaauaugaugggaaaaagggagaagaaacuuggagaguucggaaaggcaaaaggcaguagggccauaugguacaugugguuaggagcucgguuuuuagaguucgaggcauuaggauuucuuaaugaagaucacugguucaguagagguaauucacuaucgggaguugaaggagaaggccuccauagacuaggguacauuuuaagagaugugggaaagaaagaaggaggagcgauguaugcagacgacacugccggcugggauacaaggauaacucuugaagaucucaaaaaugaagagaugguuacuaaucauaugaaaggugaacauaagaaacuugcagaagcgauuuuuaaacuaaccuaucaaaacaaaguaguacgaguacagagacccacaccaagaggaacgguaauggacauaauaagucgccgggaccaaagaggaagcgggcagguugggacauauggccuaaacaccuuuacaaacauggaggcccaauuaauucggcaaauggaaggugaggguauuuuuaaaucaauacaacacuugacagcaacagaagaaauagcuguacagaauuggcuagccagaguggggcgagagagauuaucgagaauggcaauaucaggugaugauugcguggugaaaccaauugacgacagguuugcaucugcgcucaccgcacuuaaugauaugggaaaaguacggaaagauauucagcaaugggaaccaucgcgagguuggaacgauuggacacaggucccauucuguucacaccacuuccacgaguugguuaugaaggacggucgaguauuagugguaccuuguagaaaucaagacgagcucauaggucgagcgagaauuucucaaggugcaggauggucauugaaggagacggcuugcuuaggaaagucauacgcucagauguggacacuaauguauuuccaccggagggauuuaaggcucgcagcaaaugcaauauguagugcaguaccgagucacuggguaccuacgucccgcaccaccuggucaauacacgcgaaacaugaauggaugacgacagaagacauguuagcaguguggaauagaguauggauacaggaaaacccauggauggaggacaaaaccccaguagagucgugggaggagguaccauaucuuggcaaaagggaggaccaguggugcgguuccuugaucggauuaacaagucgagcaacaugggcgaaaaauauccaaacagcgauaaaucaaguuaggucgcuuauaggaaacgaagaauauacagacuauaugccgagcaugaaacgauuuagacgagaagaagaagaggccggaguacuaugguag

SEQ ID NO: 22652 - RNA, 9876 nt, Artificial Sequence
  derived and/or modified CDS sequence (opt6) from DENV-2__FJ639822__SS-prME
acugcggggguaauuguuaugcuaauuccaacagcaauggcuuuccacuugacuacaagaaauggugaaccacauaugauaguaggaagacaagaaaaaggaaaaagccuguuauuuaaaacagaagacgggguaaauaugugcacauuaauggcaauagaucuuggagaacuaugugaagacacaauaaccuacaaaugucccuuauugaggcaaaaugaaccagaagauauagauugcugguguaacucgacaaguaccugggucacguauggaacauguacaacaacaggagaacauaggagggagaaaagaucaguggcacucgugccucacguagguaugggucuggaaacgcgaacggaaacuuggaugaguucagaaggagcauggaaacauguccaaagaauugaaacuuggauacuucgccacccuggauucacaauaauggcagcuauauuagcuuauacuauuggaacuacccauuuucaacgagcgcuaauuuucauacuacuaacagcagucgcgccguccaugacgaugcgguguauaggaguuucuaacagggauuucgucgaagguguaucuggggguuccuggguagauauaguauuggaacacggguccuguguaaccacaauggccaaaaauaaaccaaccuuggauuucgaauuaauaaaaacagaagcaaaacagccagcaacuuuacgaaaauauuguauugaagcuaaacuaacgaauaccaccacggagagccgauguccaacucaaggcgaaccaucacuaaacgaagaacaagauaaacgguucaucugcaaacacagcaugguugauagaggauggggaaacgguuguggauuauuuggaaaaggagggauagugaccugcgcuauguuuaccugcaagaagaauauggaaggcaaaguaguucagccugaaaacuuagaauauacuauugucauaacaccucauucaggagaagaacaugcuguagggaaugauaccgguaagcacggcaaggaaauuaagauaacaccgcaaucuucgauaauugaggcagaacuuacaggguacgguacuguuacgauggaguguuccccaagaaccggguuagauuuuaaugaaaugguuuuacuucagauggaagauaaggcaugguuagugcacagacaaugguuuuuggaccuaccauuaccauggcucccgggagcagauacccaagggucuaauuggauacaaaaagaaacauuaguuacuuuuaagaacccacaugcgaagaaacaagacguuguggugcuagguagucaagaaggagcuaugcauacugcauuaaccggggcaacagaaauucaaaugucaaguggaaauuuauuguuuacuggccaccucaaaugccguuuacgaauggauaaacuccaacucaaaggaaugucauauucuauguguacagguaaguucaaaauaguaaaagaaauugcagagacacaacauggaacaauagucauuagaguacaauacgaaggugacgguucuccgugcaagauaccauuugagauuacugaccuagaaaaacgacacguacucggaaggcucauaacaguuaauccuauaguaacuggaaaagauagucccguaaauauagaggcggaaccacccuuuggugauucauauauaauaauuggaguagaaccaggucaauugaaauugaauugguuuaagaaagguagcucaaucggacaaauguuugaaacgacgaugcgaggagcuaaaaggauggcuauauuaggagauacggcaugggauuucgguagucugggaggggucuuuacuucuaucggaaaagcacuucaucaaguguuuggugcgauuuauggugcugccuucucuggcguaagcuggacaaugaaaauuuuaauagggguuauaauaacuuggauuggcaugaauagccgaucuacuucucugucuguuucuuuaguauuagugggugucguaacgcuguaucugggugcaaugguccaagcugauucgggaugcguuguaucuuggaaaaauaaggaacucaaauguggaaguggaauauucauaacagauaauguacacaccuggaccgaacaguauaaauuucagccagaaucccccaguaaauuagcaagugccauacagaaagcacaugaagaaggaauaugcgggauucgcuccguaacgcgacucgagaauuuaauguggaaacagauuacuccagaauugaaucauauacuaucggaaaacgaggucaaacuuacuauaaugacaggagacauuaaagguauaaugcaagcuggcaaaagauccuugagaccucaaccaacugaacucaaauacucauggaaaacaugggggaaagcgaaaauguuaucaaccgaaucucauaaucagacauucuuaauugacggaccagaaacagccgaguguccuaauacaaauagagccuggaauaguuuagaaguagaagauuauggauuugguguauucacaacaaacaucuggcucaagcucagggaaaagcaggacguauuuugugauaguaaacuaauguccgcagcaauaaaggauaauagggcagugcacgcagacaugggcuacuggauagagucggcguuaaaugauacauggaaaauggagaaagccucuuuuauagaagugaagaguugccauuggccgaaaagucauacacucuggucaaauggggugcuagaaucagagaugaucauccccaaaaauuucgcugguccgguuucacagcauaauuacagaccaggguaccauacucagaccgcuggcccguggcaucuaggcaaacuugaaauggacuuugauuuuugcgaagguaccacaguugucgucacugaagacuguggcaauagaggucccagcuuacgcacgacuaccgcaucugguaaacuuauuaccgaguggugcuguagaucguguacacuuccuccacuucgguaucgaggcgaagaugguuguugguacggcauggagauuagaccacugaaagaaaaagaggaaaauuuagugaacucccuaguaacagcuggucacggucaaauugacaauuuuucauugggugucuuaggcauggccuuauuucuugaagagaugcugaggacacguguugguacaaaacacgcaauccuuuuagucgccgucagcuucgucacguuaauuaccggcaauauguccuucagggaccucgggcgaguuaugguaauggugggcgccacaaugacagacgauauaggaaugggagugacauaccuagcacuccuugcagcuuuuaaagugagaccuacauuugcugcuggucucuugcucaggaaacuaacuagcaaagagcucaugauggccacuauugggauagcauuauuaucacaaucaacaauaccugaaacuauacuagaauugacugaugcacuagcucuagggaugaugguguugaaaauaguaaggaauauggaaaaauaucaauuagcuguuacaguuauggcaauuagcuguguaccgaaugcgguaauauugcagaacgcauggaaaguaucauguacaauacuugccgcaguauccgucagcccgcucuuauuaacaucgucgcagcaaaaggcagacuggaucccacuagcccucaccauaaaaggccuaaacccuacggcuauauuuuuaacgacauuaucucggacgaguaagaaacgaagcuggcccuuaaacgaagcgauuauggcaguugguaugguaagcauacucgcuagcaguuuauugaaaaaugacauuccuaugacagggccuuuaguagcuggaggacucuuaacaguuugcuauguauugacaggacgcagcgcagacuuagaguuggaaagggcugccgacguaaaaugggaggaucaagcagaaaucucugggucuucacccauacugucgauaacaaucagugaagacggcucaaugaguaucaaaaacgaggaagaagaacaaacgcugacgauauuaauuaggacggggcuuuuaguaauaagcgguguuuucccuguaucaauuccaauuaccgccgcggcaugguaucuaugggaaguuaagaaacaacgcgcuggaguuuugugggacguuccaaguccgccaccaguagggaaagcagaacuggaagauggugcauauagaaucaaacagcgcggcauucugggguacucccaaauaggcgccgguguuuacaaagaggggaccuuucauacaauguggcaugugacuagaggggcuguauuaaugcaucggggcaaacgaaucgagccaucaugggcagauguaaagaaggauuuaauaucuuauggaggaggauggaaacuagaaggugaguggaaagagggcgaagaaguucaagucuuagcauuagaaccaggcaaaaauccacgugccguccaaacaaaacccgguaucuucaaaacaaauaccggcacaauuggugcagucucccuugauuucaguccaggaacaucagguucgccgaucguagacaggaaaggaaaaguaguaggccucuacggaaacggaguaguaacacguucaggagcuuacgugucagcaauagcacagaccgaaaaauccauagaggauaacccagaaaucgaagacgacaucuuuaggaagaaaagacucacgauaauggaccuacacccuggagcagguaaaacuaagcguuauuugccugcaauaguucgggaggcaaucaaaaggggucuacgcacacuuauccuagcaccaacuaggguaguagcugcagaaauggaggaagcguugcgcggauuaccaauacgauaucaaacgccugcuauuaaggcagagcauacugguagagaaauugucgacuugaugugucacgcgacguuuacaaugagacuacuuucgccaguaagagucccaaauuauaauuugauaauaauggaugaagcacauuucacagauccggcaucuauagcagcccgaggguacaucucaaccaggguagaaaugggagaagcugcagguauuuuuaugacugcgacaccaccaggcagcagagaucccuucccucaaaguaaugcaccaauuauggacgaagaacgugaaauacccgaaagaucguggaacucuggucacgaauggguaaccgacuuuaaaggcaaaaccgugugguucguacccucgaucaaagcugggaaugacauagcagccugcuugagaaagaaugguaaaaagguaauccagcuuucuagaaaaacauuugacucagaguacguuaaaacacgggcuaacgacugggacuuuguagugacgacggacauaucagaaaugggugcuaacuucaaagcagagcgggucaucgacccaaggagguguaugaaaccaguuauuuuaacagacggagaagaacgagugauauuagcgggaccaaugccgguuacacacagcagugcagcucaaagaagaggcagaauaggaaggaauccgaaaaaugaaaaugaccaauauauuuauaugggcgaaccacuagagaacgacgaagauugcgcgcauuggaaggaagccaagauguugcuugauaacauuaacacaccagagggcauaauuccuucgauguuugagcccgaacgcgaaaaaguggaugcuauagauggcgaguauaggcuaagaggugaagcgagaaaaaccuuuguagacuuaaugaggcgaggagaucuccccguuuggcucgccuauaaggucgcagcggaaggaaucaauuaugcagacagaaaaugguguuucgauggaaucaaaaauaaucaaauucuagaagaaaacguagagguagagauuuggacaaaggaaggcgagcgaaagaagcucaaaccacgauggcuugaugcccgaauuuauucugauccucuugcauugaaagaauuuaaagaauuugcagcuggaagaaaaucguuagccuuaaauuuaauuacggaaauggguaggcuuccgacauucaugacucaaaaagccagaaacgcguuagauaaucuugcagugcugcauacagcagaagcgggugguagagcuuauaaccaugcuuugucagaauugccagaaacacuagaaacucuauuguuacuaacuuuacucgccacaguaaccggaggcauauuccucuuucuuaugucagggaaagguauagggaaaaugacucuuggcaugugcuguauaauaacagcuucuguacuauuaugguacgcgcaaauccaaccacacuggauagcagcaucaauaauuuuggaguucuuuuugauuguacuuuuaauacccgaaccggaaaaacaacggacuccucaagauaaucaacuaacauacguaguaauagcaauauuaaccguaguugccgcaacgauggcaaacgagaugggauucuuggagaaaaccaagaaagaucuagguuuaggaucgauuacgacucaagaaagcgaauccaauauucuugauauagaucucagaccggccucagcuuggaccuuauaugcgguagccacuacguuuguaacaccaaugcuacgccacaguauagaaaauuccucugugaacguuucauuaacagccauagccaaucaagccacuguacuaaugggucuaggaaaaggauggccccuaagcaagauggacauuggcgugccucuucucgcaauaggguguuacagucaagucaaccccauaacccuaacugccgcucuuuuacuccuaguagcgcacuacgcaauaauaggcccagguuuacaagcaaaagcaacaagagaagcucagaaaagggccgcugcuggaauaaugaaaaaucccacaguugacggaauuacggugaucgacuuagagccaauaccuuacgacccaaaauucgagaaacaacuuggucaggugaugcuucuaauacuuugcguaacucaaguauuaaugaugagaacaaccugggcauuaugugaggccuuaaccuuagcuacagggccaauaucuacccuaugggaaggaaauccgggaagauuuuggaacacgaccaucgcggugaguauggccaauaucuucagaggaucauaucuugcuggggcgggccuuuuauucagcauuaugaaaaauacuacgaacacaagaagaggaacgggaaacauuggagaaacguugggagaaaaguggaaaucuagauuaaaugcguuagguaaauccgaguuccaaauauauaagaaaaguggcauacaagaaguagaccgaacauuggcaaaggaaggaauaaaacgaggugaaacggaucaucaugcaguaucccgaggcucagcaaaacuucgcugguucgucgaaaggaauaugguuacaccagagggaaaagucguggauuuaggcuguggcagaggaggcuggucauauuauugugguggccucaaaaacguaagagaagugaaaggccuaacaaaagggggcccaggacaugaagaaccaauaccaaugaguaccuauggguggaauuugguaagacuccaaucaggaguagacguguucuuuacaccgccugaaaaaugcgauacauugcuuugugacauuggcgagagcucuccuaauccaacgauugaagccggcaggacgcugcguguauugaaucuuguugagaacugguugaacaacaacacacaguucugcauaaaagucuuaaauccauacaugccaucaguaauagagaaaauggagacccuacaaagaaaauacggaggcgcauuaguaagaaacccuuugagucgaaacaguacucaugaaauguauugggucagcaaugcgacagguaacaucguuaguucuguuaauaugauaagucgcaugcuuauuaaccgcuucacaaugaaacacaaaaaggcuacauaugaaccagauguagauuuagguaguggaacccguaauauagguauugaaagugagauacccaacuuggauauaaucggcaaaagaaucgagaaaauuaaacaagaacaugagaccagcuggcauuaugaccaggaucacccauacaaaaccugggcauaucauggauccuaugaaacaaaacaaacagggagugcaaguucgaugguaaauggaguaguaagacuucugacuaaaccuugggaugugguaccaauggucacgcaaauggcaaugacggacacuacuccauuuggccaacaaagaguauucaaagaaaagguagauacgagaacacaagaaccaaaagaagguacaaagaaauuaaugaaaauaacagcugaguggcuauggaaagaacuagggaaaaagaaaacgccuaggauguguacgcgagaagaguucacacgaaaaguaagaucaaacgcugcacuaggugcuauauucacggacgagaauaaauggaaauccgcucgagaagcaguggaagacgguagauuuugggaacuuguggaccgcgagcguaauuugcacuuagaagguaagugcgaaacuuguguauacaacaugaugggaaagagagagaagaaauuaggugaauuugguaaagcuaaagguucgagggcaauuugguauaugugguugggagcacgguuucuagaauuugaagcguuaggauuuuuaaaugaggaucauugguuuucaagagggaauagucugucagguguggaaggagaagggcuccacagacucggcuacauccugagagauguugguaagaaagaagggggagccauguaugcggaugacacagccggcugggauacacgcauaacacuggaagaccuuaaaaaugaggagauggugacuaaucauaugaaaggagaacacaagaaacuagcugaagcuauuuuuaaacuaacauaucaaaacaaaguaguccgaguccaaagaccaacaccccgaggaacaguaauggauauaauuagcagaaaagaccagcguggaucgggccaaguaggaacauaugggcucaacacuuucacaaauauggaagcacaauugauccgacaaauggaaggugaagguaucuuuaaaagcauccagcaucugacagccacugaagagauagcaguccaaaauugguugacuagaguaggaagagaacgauuaucgcgaauggcaauaucaggagacgauugcgucgugaaaccaauagaugaccguuucgcguccgcccucaccgccuuaaacgacauggggaaagugagaaaggauauacaacaaugggaaccaaguagaggauggaaugauuggacgcagguaccauucuguagucaccacuuucacgaauuaguaaugaaggacggcaggguuuugguugugccguguaggaaccaagaugagcugauagguagggcaagaaucagucaaggugcagguuggagccucaaagagacugcuuguuuagguaaaaguuacgcacaaauguggacucugauguauuuucaccguagagaccucagauuagcagcgaaugcaauaugcucagcaguuccaucucauugggugcccacuucaagaacaacauggucaauucaugccaaacaugaguggaugacgacagaagacauguuagcugucuggaauagagucuggauacaagagaauccauggauggaagauaaaacacccguagagagcugggaagaggugccguacuuggguaaacgugaagaucagugguguggaucccuaauaggauuaacgucucgcgccacaugggccaaaaauauacaaacagcgauuaaucaaguacgaagucuaauuggcaacgaagaguauacggacuauaugccauccaugaaaagguucaggagggaagaagaagaggcugguguccuuugguaa

SEQ ID NO: 22653 - RNA, 9876 nt, Artificial Sequence
  derived and/or modified CDS sequence (opt6) from DENV-2__FJ850112__SS-prME
acggcagggguaauaauaaugcuaauaccaacagcaauggcguuccaucuaacuacgcgcaauggggaaccgcauaugauaguagggaggcaagaaaaaggcaaaucgcuacuauucaaaacugaagacggagugaacaugugcacuuuaauggcgaucgaucuaggugaacuuugcgaagauacuauaacuuacaaaugcccccuacuuagacagaacgaaccagaggauauagauuguuggugcaacuccacaucuacauggguaacauauggaacuuguacaacaacaggugaacacagacgagaaaaacggagugucgcgcuuguuccgcauguagggaugggacuggaaacacgcacggaaaccuggaugucuucagaaggagcauggaaacacgugcaaagaauagaaacuuggaucuugcgacauccuggguuuaccauaauggcggcaauuuuagcuuauacgauagguacaacucauuuccagagagccuuaauauucauacuguuaacagcagucgccccaucaaugacgaugagaugcauaggaauuucaaaucgagauuucguugagggagugagugggggaaguuggguugauauuguauuagaacaugguucgugugugacaaccauggcuaaaaauaaaccuacgcuugauuuugaacuaaucaaaacggaggccaaacaaccagcaacuuuacgcaaauacuguauugaagccaaacugacaaacacaaccacagagucacgauguccuacccaaggcgaaccuucccuaaaugaggaacaggauaaaagguuuaucugcaaacacucuaugguggaucguggauggggaaacggguguggauuauucggcaaaggcgggauaguuaccugcgcgauguucacuugcaagaaaaauauggagggaaaaguagugcaacccgaaaauuuggaauauacgaucguaaucacaccacauucaggugaagaacaugcaguugguaaugauacagguaaacauggaaaagagaucaaaauaaccccacagucuucgauaacugaagccgaauugacugguuaugguacuguaacaauggaaugcaguccaaggaccggacuagacuuuaacgaaaugguauuacugcaaauggaagauaaagcguggcuuguacauagacagugguuccuugacuuaccgcuaccuuggcuaccaggagcugacacacaaggaucaaacuggauucaaaaagaaacccugguaacauucaaaaacccacaugccaagaaacaagauguuguaguacucggaucacaagagggcgcaaugcauacggcguuaaccggagcuaccgagauccaaaugucgucuggaaaucuacuauuuacagggcaccugaaauguaggcuucggauggauaaacuacaacuaaaagguauguccuacucuaugugcacgggcaaauucaaaauugugaaagaaauagcagaaacucaacacggaacgauaguaauucgaguacaauaugaaggagacgguucaccuugcaaaauuccauucgagauaacagauuuagaaaaacgucacguauuagguagacucauuacuguaaacccgaucgugauugaaaaagauucaccuguuaauauugaagcugaaccaccuuucggagauucuuacauaauaauagggguugaaccuggacaauugaaacuaaacugguuuaagaaagguuccagcauaggacaaauguuugagacaacaaugcguggagcgaaaagaauggcuauucugggagauacugcgugggauuuugguucauugggcggcgcauuuacuucuaucgguaaggcuuuacaucaaguauuuggagcuauauacggggcggcuuuuucagggguaaguuggacuaugaagauccuuauaggagucguaauaaccuggaucggcaugaacucgagaucuacgucauugaguguauccuuaguccuaguuggugucguaaccuuguaucugggggcaaugguucaagcugauaguggaugcguugugucauggaagaauaaagaauugaaauguggauccgggauauuuauaacugauaauguccauaccuggaccgagcaauacaaauuucagccugaaagcccgucaaagcuggcuucugccauacagaaagcccaugaagagggcauauguggaauaagaucagugacaagacuggaaaaucuaauguggaagcaaauaacuccagaacucaaucauauacuuucugaaaacgaagugaaauuaacaauaaugacuggagacacuaagggcauaaugcaagcaggaaaaaggucucuaaggccacaaccaacagaacuaaaguauucuuggaaaacuugggggaaagcuaaaauguugucaacagaaucacauaaccaaaccuuccugauagaugguccagaaacagcugaaugucccaauacgaauagagccuggaauagccuagaaguggaagacuacggauuugguguauuuacgaccaauauaugguugaaguuacgagaaaaacaagauguauucugugacucaaaacucauguccgccgcgauuaaagauaauagagcaguacaugcagauaugggcuauuggauugaauccgcauuaaaugauaccuggaagauggaaaaggccaguuucauagaagucaagucaugucauuggccuaaaucccauacauuguggucgaacgguguucuagaaucugaaaugauaauaccgaaaaacuucgcagggcccguaagucaacauaacuaccgacccggauaucacacucaaacugcaggaccauggcauuuggggaaacuugaaauggacuucgauuucugcgaagguacuacgguugugguaacagaggacuguggaaaucguggcccuucauuaaggacaacgacagcaagcggaaaauuaauaacagaauggugcugcagaucaugcacuuuaccaccguuacgauauaggggagaagacggaugcugguauggaauggaaaucagaccacuaaaggaaaaagaagaaaauuugguaaacagccuaguaacugccggucauggacaaauugacaauuucagucuuggaguacuaggaauggcacucuucuuggaggagaugcugcggacacgaguuggaacaaaacaugcuauccuauugguugccgucaguuuugugacacuuauaaccggaaacaugaguuuuagagaccuaggacgaguaaugguuaugguuggugcaacgaugaccgacgacauaggcauggguguuacauaccuagcccuacuagcagcauucaaaguaaggcccacauucgcagccggguuauuauuaaggaaacucacauccaaagagcuaaugauggccacgauugguaucacacuacuaucucaaaguacaauccccgaaaccauucucgagcuaacggacgccuuagcgcuugggaugaugguccuuaaaauuguucggaaaauggagaaauaccaacuugcaguuacuauuauggcaauaaguuguguaccuaaugcagugauccugcggaaugcuuggaaagucucguguacaauccuugcggcgguuagcguaagcccacuacuccucacaucaucucaacagaaagccgauuggaucccauuggcguuaacaaucaagggacucaaucccacagcuauuuuucugacaaccuugucgaggacaagcaagaaacgaaguuggccgcuaaacgaagcaauaauggcugucgggaugguuuccaucuuagccucaucguuauuaaagaaugauauaccgaugacaggaccauuaguggcgggagggcuucuaacgguauguuauguacuaacagggcguucagcagauuuagaauuagagagagccgcugacguaaaaugggaagaucaagccgaaaucaguggaaguucgccuauacuaaguauaacuauuagcgaggauggcucuaugagcauaaagaacgaagaagaggaacaaacucucacaauacuuauacggacgggacuuuuagucauaucagguguuuuuccaguuucaauaccgauuaccgcugcugcuugguacuuaugggaagucaagaaacaaagggccggaguccucugggaugugccaucacccccaccgguuggaaaggcagaacuagaagauggagcuuauagaauaaaacagagaggaauacuaggcuauucccaaauaggcgcggguguauauaaggaaggaacuuuucauacaauguggcaugugacuagaggagcagucuuaaugcacaggggaaaacgaauagagccuaguugggcggaugucaagaaagaccuaauuaguuacggaggugguuggaaacucgaaggugaauggaaagagggagaagaaguucaaguacuagcacuagagccagguaagaauccuagagccguucaaacaaaacccgguaucuucaagaccaacaccggaacgauaggagcagucagucuggauuucucaccaggaacauccggcaguccuaucguagauaggaaaggaaaaguaguaggauuguauggaaacggcguaguaacuagauccggagcauacguuucagcaaucgcccaaacggagaaaucaauagaagauaacccagaaauagaagacgauauuuuucguaaaaagagacuaaccauuauggauuugcauccuggggcugguaaaacaaaaagauaucuaccagcaaucgucagagaagcuauaaagaggggcuuacgaacccuaauucuugcacccacuagaguuguggcugcugaaauggaggaggccuuacgaggauuacccauccgauaucaaaccccugcaauaaaagcagaacacacaggccgagaaauuguagacuuaaugugucacgccacuuucacgaugagguugcugucaccgguucggguaccaaacuauaaucuaauaauuauggaugaagcccacuuuacagaccccgcaucaaucgcugcucgggguuauauaagcacacgagucgaaaugggggaagcugccgguauauucaugacggcaacaccacccgguucacgagauccguucccucaaucgaaugccccaauaauggaugaggaaagggagauaccggaaagaaguuggaacuccggacacgaguggguaacugauuuuaaaggcaagacggugugguuuguuccgagcauaaaagcuggaaaugauauugccgcaugcuuacggaagaaugggaagaaaguuauccaguuaaguaggaaaacauuugauucugaguacguaaaaacgagagcuaaugauugggauuuuguaguaacaacagacauaagcgaaaugggugcuaacuuuaaagcagaacgaguaauagauccuaggcgaugcaugaaaccugucauccuuacagacggugaagaaagaguuauuuuagcuggacccaugccaguuacucauucgagugcugcccaacguagaggucgaauagguagaaaucccaaaaaugaaaacgaccaauacauauauaugggugagccacuugagaaugacgaagauugugcacauuggaaggaagcaaaaaugcuauuagacaauauaaauacaccugaaggaaucauacccucuauguucgagccggaaagagaaaaaguugacgcaauugauggggaauacagauuaagaggagaagcucguaagaccuucgucgacuuaaugagacguggugaccuaccaguaugguuagcguauaagguggcugcggaagguauuaauuacgccgacagaaaaugguguuuugaugggaucaaaaacaaucaaauacuagaagaaaauguggaaguugaaauauggacuaaagaaggggaacggaagaagcuaaaacccagauggcuagaugcgcguauuuauagcgauccccuggcacuaaaagaauuuaaggaguucgcagcuggaaggaaaucguuaacguugaauuugauuacagaaauggggcgcuuaccuacauucaugacacaaaaggccagaaaugcguuagacaaucuagccgugcuacacacggcggaagcaggcggaagggcauauaaccaugcccuuucggaacuaccagaaacauuggagacacuuuuauuacucacacuacuagcaacaguuacuggcggaauuuuccuauuccuaaugucagggaagggaauaggcaagaugacacuaggcaugugcugcaucauuacugcaucuguauuacucugguacgcgcaaauccaaccgcacuggauagcugccuccaucauacuugaauuuuuccuaaucguuuuacucauuccugagccagaaaaacaacgaacuccgcaagauaaucaauuaacguauguaguuauagcuauucucacaguaguagccgcaacgauggcgaacgaaaugggcuuuuuagaaaagaccaagaaagaucuuggccuaggaucuaucacaacgcaagaaucagaaagcaauauucuugacauugaucugagaccugcgagugccuggacucuauaugccguugcaacuacauuuguaacccccaugcuucgucacaguauugaaaauaguagugucaauguaucacuuacagcaaucgcgaaucaagcaacaguauuaaugggacuagggaaaggauggccucuuaguaaaauggauauaggugugccguuacuagcuauaggauguuauagccaagugaaccccaucacacugaccgccgcauuacuccuauuaguagcccauuaugcaaucaucggccccggucuacaagcaaaagcaaccagagaagcacagaaaagagcggcugcaggaauaaugaaaaacccgacgguagaugguauuacaguaauagaucuugagccuauuccauacgauccaaaauucgagaaacagcuuggacaggugauguugcuaauacuaugcguaacacagguguugaugaugagaacaaccugggcccugugugaagcauugacguuagcgaccggcccaauuucaacuuugugggaagggaacccaggaagauucuggaauacgaccaucgcaguuucgauggcuaauaucuuuagaggaucuuaccuggccggugcaggcuuacuauuuaguauaaugaaaaauacgacaaauaccagaaggggcacagggaauauaggggagacgcuuggagaaaaauggaaauccaggcuuaacgcauuagggaaaagugaguuccaaauauacaagaaaucaggaauacaggagguugauagaacacuugcaaaagaaggcaucaagcgaggagaaacagaccaucaugcaguuucaagggggucagcgaaauuacgaugguuugucgaaagaaauaugguaaccccggaagguaaagugguugaucuagguugugggcgaggcggaugguccuauuacugcggggguuuaaagaacguaagggaaguaaaaggguuaacaaaaggagguccaggacaugaagaaccaauuccuaugucgacauauggguggaauuuaguacguuuacagaguggaguugauguguucuuuacaccgccggaaaagugugauacauugcuaugugauauaggagagucauccccaaaucccacaauagaagcaggccguacacuacgaguacuuaaucuaguugaaaauuggcuuaauaacaauacucaauuuugcauaaagguacuaaauccuuacaugccuagugucauagagaaaauggaaacacugcaacgaaaauacgguggagcgcuaguccggaauccucuuucacguaacaguacacacgaaauguauugggugucaaaugcaacagguaauauaguuucaaguguaaacaugaucucucgaaugcugauaaacagauuuacuaugaaacauaaaaaggccacguaugaacccgauguagauuugggaaguggaaccagaaauauaggcauagaaucagaaauaccuaacuuggauauaaucgggaaacggauagagaaaauuaaacaagaacacgagacaaguuggcauuaugaucaagaucaccccuauaaaacgugggccuaccaugguaguuaugaaaccaagcagacagggucagcaaguucgaugguuaauggaguaguacguuuacuaacgaaaccuugggacguaguaccaaugguuacccaaauggcaaugacugacacaaccccuuucggacaacagcguguauucaaagaaaagguugacacuagaacacaagaaccgaaagagggcacaaagaaauuaaugcguauuacugcagagugguuauggaaggaguuagguaagaagaaaacuccgagaaugugcacaagagaagaguucacccgaaagguaaggagcaaugcugcacucggagccaucuucacggaugaaaauaaauggaaaagcgccagagaagcuguugaagacggaagauuuugggaauuaguagacaaagaacgaaaucuacaccuugagggaaagugugaaacaugcguuuauaauaugaugggaaaaagagagaagaaacuuggagaguucggaaaagcaaaagguucacgggcgauuugguacauguggcuaggagcaagauucuuggaauuugaagcacuuggguucuugaacgaagaccauugguuuagucgagguaauucucuuaguggaguggaaggagagggucugcauagauugggauacauuuuaagagacgugggcaagaaagagggcggagcaauguaugcugacgacacagcaggaugggacacccguauaacgcuagaagacuugaagaaugaagagaugguaacaaaccauaugaaaggcgagcauaagaaauuagcagaagcgauauuuaaacuuacguaccaaaacaaaguaguacgcguucaacgaccgacaccacgugggacaguaauggauauuauuucucgucgcgaucaaagaggaaguggucaaguagguacguauggccuaaauacauuuacgaauauggaagcccaguugauucgccaaauggaaggugagggcauuuucaaaucgauccaacacuuaacagcaacugaggaaaucgcuguucaaaauugguuggcaagggugggaagagaaagauugagcaggauggcuauuagcggagaugauugcgucguuaaaccuauagacgauagauuugccucagcacuuacugcgcucaaugauaugggaaaaguaagaaaagacauccagcaaugggaaccuucucggggauggaacgauuggacacagguaccauuuugcucgcaucauuuucacgaauuagucaugaaggacgggaggguucugguugugccgugccgaaaccaagaugaauugauugggcgagcaagaauaagucaaggagcggguuggagccuaaaggaaacugcgugccuuggaaagagcuacgcgcaaauguggacuuuaauguauuuucacagacgugacuuacgcuuggcagcuaaugcuauauguagcgccgugccuagucauuggguucccacaucgaggaccacguggagcauucaugcaaaacaugaauggaugacgacggaagauauguuagccguuuggaaucgaguuuggauucaagagaacccauggauggaggauaagacucccguagaaucgugggaagagguuccguacuuagguaaaagggaagaucaauggugcggauccuuaaucggacuaacaucgagggcgaccugggccaaaaauauccaaacugcaauaaaucaaguacguucauuaauuggcaaugaagaguauaccgauuauaugccaaguaugaaacgcuuuaggcgcgaagaggaagaagcaggcguuuuaugguaa

SEQ ID NO: 22654 - RNA, 9876 nt, Artificial Sequence
  derived and/or modified CDS sequence (opt6) from DENV-2__FJ850105__SS-prME
acagcggguguaauaauaaugcuuauaccaaccgcaauggcauuucaccuaacaacacgaaauggugaaccgcauaugaucguaggucgccaagaaaaaggaaaaucacuuuuauuuaaaaccgaagacggaguaaauaugugcacccuaauggcaauagacuugggcgaauuaugugaagauacaauaacauauaaauguccccuacuuagacaaaaugaaccagaggacaucgauuguugguguaacagcaccucuacaugggugacuuacggaacauguacuacaacuggugaacauaggcgagagaaaagaucgguagcacucgugccacauguuggaaugggucuagaaacacgaacagaaacauggauguccagugagggcgcuuggaaacauguacaaagaaucgagacauggauucuacgacauccaggauuuacaauuauggcagcaauucuagcauacacgaucggaacuacccauuuucaacgcgcauuaauauucauuuuacuaacggcuguugcaccauccaugacaaugcgaugcauuggaauuucuaacagggacuuuguggaaggcgucuccgguggguccugggucgacauaguauuagaacauggaucgugcguaacaaccauggccaaaaauaaaccuacucuggacuucgaauugauaaaaacugaggcgaaacaaccugcaacgcuaagaaaauauuguauugaagcaaaacucacuaauacaacuacugaaucacguuguccaacucagggugaaccaucccuuaaugaagaacaagauaaaagguuuauauguaaacacucaauggucgacagagggugggggaauggcuguggucuuuuuggaaaaggaggcaucguaacaugcgcuauguuuacuugcaagaaaaauauggaagggaaaguaguccagccugaaaaccucgaauacacaauaguuauuacaccccauucaggagaagaacacgcugugggaaaugacacaggaaaacaugguaaagaaauuaaaauuaccccgcagucaucuauuacagaggcagaguugacuggauacggaacaguaacaauggaguguucaccccgaacgggacuugacuuuaacgaaauggucuuacugcaaauggaagauaaagcauggcuaguccacagacaaugguuccuggacuugccacuaccauggcuaccaggagcugacacucaaggcagcaauuggauucaaaaagaaacauuagucacauucaaaaauccacacgccaagaaacaagauguuguaguacucgggagccaagaaggagcaaugcacacugcacuuacaggggcuacagaaauccaaaugaguucaggaaacuuacuauuuacuggucaucuaaaauguagauugcguauggauaaauuacaguugaaaggcaugaguuauucaauguguacaggaaaauucaaaauaguaaaagagauugcagagacacaacauggcacaaucguaauacgcauucaguaugagggagacgggaguccguguaaaauacccuucgaaauuacugauuuagaaaaacggcacguuuuaggacgacugaucacaguaaauccaaucgugauagaaaaagacucucccguaaauauagaagccgaaccaccguuuggggauucuuauauaauuauaggagcagagccuggacagcuuaaacuaaauugguuuaagaaaggaagcagcauugggcagauguucgagacaacuaugcgaggagcaaaaagaauggcaauauuaggcgauacggccugggauuucggcagcuuaggugguguuuuuacgagcauagguaaagcacuucaccaggucuuuggagcuauauauggugcagcauucaguggaguaaguuggacaaugaaaauccuuaucggcguuguuaucacauggaucggaaugaauagccgcagcacuucuuuaucugucucuuuaguacuuguagguguugugacccuuuaucucggugcgaugguacaggccgacuccgguugcguagucucauggaaaaauaaagaacuuaaaugcggcucaggcauauuuauaacugauaauguacauacauggacggaacaauauaaauuccagccagaaucuccuucgaaauuagcgucggcaauccaaaaagcgcacgaagaagguauuugugguauccggucugugacccgccuagagaacuuaauguggaaacagaucacaccggaacuuaaucacauacuaucagaaaaugaaguuaaacuuacaauuaugaccggagacaccaaaggaauaaugcaggcggguaaacggaguuugagaccccaaccaacagaauuaaaauauucauggaaaaccuggggaaaagcaaaaauguuauccaccgagucacacaaucaaacuuucuuaauagauggaccugaaaccgcagaaugccccaauacuaauagagcauggaacucgcuagaaguagaagauuauggauuuggcguauucacaacaaauaucugguugaaauuaagagaaaaacaggauguguucugugauucgaaauuaaugucggcagcaauaaaagacaacagagccgugcaugcggacaugggauauuggauugaaagugcuuuaaaugauacuuggaaaauggaaaaggcaaguuuuaucgaagugaaaaguugucacuggccaaagagccauacacuuuggucuaacggggucuuggaaucagagaugauuauccccaagaauuucgccgggccagugucgcaacacaacuauagaccuggcuaccacacacaaaccgccggucccuggcaucucggcaaguuagagauggacuucgacuuuugcgaaggaacgacaguaguggucacagaagacuguggaaacaggggucccuccuuacgcacaaccaccgcguccggcaaguuaauaacagaauggugcuguaggagcuguacacuaccaccucuucgguaccguggagaagaugguuguugguacggcauggagauacggccacuaaaagagaaagaagaaaaucuuguuaacucacugguaacagcaggccacggacagauagauaauuuuucccuugguguacuagguauggcccucuuccucgaggagaugcuuagaacccgaguugggacuaaacacgccauacuucuaguagccguguccuuuguaacccuaaucacugguaacaugaguuucagagauuuaggucgcguuaugguaaugguaggagccacaaugaccgacgacaucggaaugggcguuaccuauuuagcgcuacuagcagcguucaaaguuaggccaacguucgcagcaggccuucuacuaagaaaauuaaccuccaaggaauugaugauggcuaccauaggaauaacgcuauuaucucaaucgaccauaccagaaaccauacuagaauuaacugacgcucuagcauuagguaugauggucuuaaaaaucguacguaacauggagaaauaccaauuagcugucacgauaauggccauuaguuguguaccaaacgcuguaauccuuagaaacgcuuggaagguuucaugcacaauuuuggcugcaguaucaguaucaccauugcuucugaccagcucgcaacagaaggccgacuggauacccuuagcacucacuauaaaagguuuaaauccaacagcaauauucuuaacgaccuuaucacguacaucaaagaagcgcagcuggcccuuaaaugaggcuauuauggccguugggaugguaagcauccucgcauccuccuuauuaaagaacgacauuccaaugacaggaccccuaguugcaggcggauugcuuacaguauguuauguuuuaaccggaagaagcgcugauuuggaguuagaacgcgcggcugaugucaaaugggaggaccaagccgaaauuuccgguaguaguccaauuuuaucgauaacuaucagugaggacgguucaaugaguauuaagaacgaagaagaagaacaaacguuaacaauuuuaauaagaacgggguuauuggucauaagcggcguuuuuccagugagcauaccuauaacggccgcagcaugguaucugugggaagucaagaaacaacgugcaggagugcucugggaugugccgagcccaccgccuguagguaaggcugagcuagaagauggagcauaucgaauaaaacaaagagggaucuugggcuacucccagauaggagcaggaguuuauaaagaaggaacguuccauacuauguggcauguaacaagaggggcagucuuaaugcauagaggcaagagaauugagccaucaugggcagacguaaagaaagaccugauaucguacggcggcggguggaaauuagaaggugaauggaaagagggggaagagguacaaguacuugcgcuagaaccugguaaaaacccaagagccguacaaacgaaaccaggcauuuucaaaacaaauacuggaacuauuggggccguuucacuagacuuuucuccgggaacguccggaucaccgauugucgauagaaagggaaaggugguaggccuguauggaaaugggguagucacucgaucgggagcauauguuucagcgauagcgcaaacggagaaaaguauagaggauaauccagagauagaagacgacaucuuuaggaagaaaagauuaacuauuauggaucuacauccaggagcuggaaaaacaaaacgauauuuaccugcaauugugcgggaagccauaaagagaggccuaagaacacucauucuugccccuacuagagugguagcagcagaaauggaagaagcacuucgagguuuaccaauaagauaucaaacuccagcaauaaaagcugagcauaccggucgagagauagucgaucuaaugugucaugcuaccuucacaaugagguugcugucucccgugcgaguaccaaacuauaaucuuaucaucauggacgaagcacauuuuacagauccugcauccauagcggcacggggguacauuucuacacgcguagaaaugggagaagcagcuggaauauucaugacugccaccccuccuggcucacgggauccuuuuccccaaucaaaugcgccuauaauggaugaagagagggaaauacccgaaagaucauggaacucagggcaugaauggguaacagacuuuaaagguaaaacggucugguuuguaccgaguauaaaagcagggaaugacauugcggccugcuuacguaaaaaugguaagaaagucauccaacugagucgcaaaacauucgauagugaguaugucaaaacccgugcgaacgacugggacuuuguugucacuacugacaucuccgaaaugggugcuaauuuuaaagcugagagaguaauagauccacgucguugcaugaaaccuguaauauuaacagacggugaagaaagagucauccuagcaggcccgaugccaguaacccacuccucagcagcccagagacguggacgaauagguagaaauccaaagaaugagaaugaccaauacauauauaugggggaacccuuagaaaaugacgaagauugcgcgcauuggaaagaagccaaaauguuauuagauaauauaaacaccccagaaggaauuauaccuucaauguucgaaccugagagagagaaaguagacgccaucgacggagaguauagacuaagaggugaagcaagaaaaacauuugucgaucuuaugcgaagaggugaucuaccgguauggcuggcauauaaaguagcugccgaagguauaaacuacgcggauagaaaaugguguuuugaugggaucaaaaacaaucaaauacuagaagaaaauguugaagucgaaauauggacuaaggaaggugaacgcaaaaagcugaaaccacgauggcucgacgcuagaauuuauucagauccgcucgcuuugaaagaguucaaagaauuugccgcaggacgaaaaaguuuaacucugaauuuaaucacagaaaugggucgucugcccacuuuuaugacucaaaaagcccgaaacgcgcuagauaacuuggcagugcuccacacagcagaagccggaggccgagcuuauaaccaugcauuaagugaauuaccagagacccuggaaacuuuacuacuucuaacucuauuagccacggugacagguggaauuuuccuauuucuaaugagugguaaaggaauuggaaaaaugacucugggaaugugcugcaucauuaccgccucuguacuccuuugguaugcucagauacagccccauuggauugcagcgucaaucauccuugaguucuuuuuaaucguccucuuaauaccugaaccugaaaaacaaaggaccccgcaggauaaucaguuaacauacguagugauagccauucuuaccguaguggcugcaacuauggcaaaugaaaugggauuccuggaaaagaccaagaaagauuugggacuggguucgauuacaacacaagagagcgaaucuaauauuuuggauauugaccuacgaccugccagugccuggacucucuaugcaguagcuacaacuuucgucacuccuaugcuaagacauucgauagaaaauaguuccguuaacgugaguuugacugcgauagccaaucaggccacaguucucauggggcuagggaagggcuggccgcuaagcaaaauggauauugggguaccucuauuagccauaggaugcuauagccaagugaauccgauaacauuaacggccgcucuauuacuucuugucgcacauuaugcuauuaucgguccgggacuucaagcaaaagcaacuagagaagcccagaaaagggcagcggcaggaauuaugaagaauccuacaguugauggaaucacaguaauugaccuagagccaauaccauacgacccgaaauuugaaaagcaacuuggacaggugauguuauuaauacuaugugucacucagguauuaaugaugaggaccaccugggcguuaugcgaagcucuaaccuuggcuacaggcccaauaucaacgcugugggaagguaacccuggacguuuuuggaacacgaccauagcagucagcauggcuaacaucuuuagaggaucauaccuugcaggcgcaggucuacuauuuucuauaaugaaaaauacaacgaacacgagaagggguacuggaaacauaggugaaacccucggugaaaaauggaaaucgcgccuaaaugccuugggaaaaucagaauuucaaauuuacaagaaaucaggaauccaagagguugaccgcacccuagcgaaagaggguauuaaaaggggcgagacugaucaucaugcaguauccagaggaagcgcaaaauugaggugguucgucgagagaaauaugguaacucccgaaggcaaaguuguagacuuagguuguggccguggaggguggucguacuauugcgguggucucaaaaaugucagagaaguuaaaggauugacuaaaggcgguccuggacaugaagaaccgaucccuaugucaacauauggcuggaaccuagugagacugcaaagcggaguagacguauuuuucacuccuccagagaaaugugauacacuauugugugacauuggagaauccagcccuaauccgaccauugaagccggcagaacucuacggguccucaaucuaguggagaauugguuaaacaacaauacgcaauuuuguauaaaaguauugaauccauacaugccuagcguuauugagaaaauggaaacuuuacaaagaaaauauggaggcgcauuaguacgcaauccgcuaucacgaaauaguacacaugagauguauugggugagcaaugccacaggaaauauaguaagcucaguuaauaugaucucacgcaugcuaauaaauagauuuacaaugaagcauaagaaagcaacauaugaaccugauguggaccuaggaucaggaacaaggaauauaggaauagaaucugaaauucccaauuuagacauuaucggaaagagaauagagaaaauaaaacaagaacacgagacaucuuggcauuacgaccaagaccauccauauaagacaugggcauaccacggaucuuaugaaacuaaacaaacgggaagugccagcucuaugguaaauggcgucguuagauuguuaacuaagcccugggauguugugccaauggugacucaaauggccaugacugauacaacuccuuuuggacaacaaagggucuuuaaagagaagguagacacacggacucaggagccuaaggaggguacgaagaaauugaugagaaucacggccgaauggcuauggaaagaacucgguaagaagaaaaccccuagaaugugcacaagggaagaauuuacccgaaaaguucggagcaacgcagcacuaggugccauuuuuaccgacgaaaacaaauggaaauccgcuagagaagccguagaggaugggagguucugggaauuaguggauaaggaacgcaacuugcauuuggagggaaaaugcgaaacaugcguguauaauaugaugggaaagagagagaagaaacuaggagaguucggcaaggcaaaaggaucgagggcgaucugguauauguggcuaggcgcucgauucuuggaauuugaagcacuugguuuccuuaaugaggaucauugguucagcaggggaaauagucugucugguguugaaggagaaggguuacaccgacuuggauacauucuuagagacguagggaagaaggaggguggagcaauguaugccgacgauaccgcagguugggauacuagaauaacguuagaggaucuaaagaaugaggaaauggucacuaaucacaugaaaggagaacauaagaaauuagccgaggccauauucaaacuaacauaucaaaauaaaguugucagaguacagaggccaacacccagagguacagucauggauauaauaagucgaagagaccaaagagggagcgggcaagucggaaccuacggacuaaacaccuuuaccaauauggaagcacaacugauucgucaaauggaaggcgaaggaauauucaagucaauccaacauuuaacggcaacagaagagauugcgguucaaaauuggcuugcaagagugggcagagaaagacuuagccguauggcaauuaguggggaugauuguguuguaaaaccgauugaugauagauuugcaagcgcccugacugcauugaacgacaugggaaaagugaggaaagauauccagcaaugggaacccucaagaggauggaacgauuggacccaagugccauuuuguucacaucauuuucaugaguuaguuaugaaggaugguaggguacuugugguuccuugccgaaaucaagaugaacuaauuggcagagcgcgcauaucacaaggugcagguuggucacuaaaagagacagcuugcuuaggaaagucuuaugcacaaauguggacacuaauguauuuucaucguagagauuugagguuagcggcuaaugcaauauguagugcaguaccgagucauugggugcccacuagcaggaccaccuggaguauucaugcuaaacaugaauggaugacgacagaggauauguuggcaguauggaaucgaguauggauccaggaaaauccauggauggaggauaaaacaccagucgaauccugggaggaaguaccauaucuugguaagagagaagaucaaugguguggcaguuuaauuggauuaacuucaagagcaacaugggcuaaaaauauucaaacagcaauuaaccaggugcguucauuaaucgggaaugaagaguacacagacuauaugccaaguaugaaaagauuucgaagagaagaagaagaagcgggcguauugugguaa

SEQ ID NO: 22655 - RNA, 9876 nt, Artificial Sequence
  derived and/or modified CDS sequence (opt6) from DENV-2__FJ850106__SS-prME
acagcaggggugauaauuaugcucauacccacugcuauggcguuccaucuaaccacgaggaacggggaaccacacaugauaguuggacggcaagaaaaaggaaaaagccuucuuuuuaaaacagaagacggaguaaauaugugcacccucauggcaauagaucugggagaacuaugugaagauaccauaacuuauaaaugcccauuacuuaggcaaaacgaaccugaagauauagauugcugguguaacucuaccucaacguggguaacguauggaacaugcacuacuacgggagaacauagacgcgaaaaacgaucuguagcauugguaccucacgugggaaugggucuggaaacuagaacugaaacuuggauguccucugaaggugcauggaaacacguacagcgaaucgaaacauggauauugcggcauccuggauucacaauaauggcagcuauacuagcuuacacgauaggcacaacucacuuccaacgggcauuaauauuuauucuguuaacagcgguagcaccaucuaugacaaugagauguauaggcauaagcaauagagacuuugucgaaggaguaagcggagguagcuggguagauaucguauuagaacaugggucuuguguaaccacaauggccaaaaauaaaccaacacuagauuucgaacuaauaaaaacugaagcaaaacaaccugcaacgcuaagaaaauacugcauagaagcaaaauugacgaauacaacaaccgaaucacgcugccccacacagggcgagccuucguuaaacgaagaacaagacaaacgauuuauaugcaaacauaguaugguggaucgcggaugggguaauggauguggauuguuuggaaaaggaggcauugugaccugcgcaauguuuacaugcaagaaaaauauggaaggcaaagugguacagccagagaauuuagaauacacgauuguaauuaccccgcauucuggggaagaacaugcagucgguaacgauacaggcaaacaugggaaagaaaucaaaauuacaccccaaaguucgauuacggaagccgagcuaacaggguacgggacugucacgauggaaugcucaccaagaacaggucuagauuucaacgaaauggugcuacuccaaauggaagauaaagcaugguugguacauaggcagugguuuuuagacuugccacucccuugguuaccaggugccgauacacaaggaaguaacuggauccagaaggaaacauuaguaacauuuaagaauccccacgcuaaaaagcaagauguugucgugcuuggaagccaggagggggcgaugcacacggcguugacgggagcgacugaaauacaaaugaguagcggaaaccuacuguucacgggccaucuaaaaugcagacuaaggauggauaaacuccaauuaaaagggaugucauacaguauguguacaggcaaguuuaaaauuguaaaagagaucgcagaaacacaacacggaacaauaguaauaaggauacaguaugaaggggauggcagcccgugcaaaauaccuuuugaaauuaccgauuuagaaaagcggcauguacucggccggcucauuacagucaaccccauaguaauagaaaaagacagccccgucaauauagaagccgaaccaccauuuggagauaguuauauaauuauaggaguugaaccuggacaauuaaaauuaaacugguucaaaaaggguucgucuauaggucagauguucgaaacaacuaugaggggcgcuaaacgcauggcuaucuuaggagacacggcaugggauuuuggcagucuuggcggcguuuuuacguccauaggaaaggcccugcaccaagucuuuggcgccauauacggagcagcauucucaggcgugaguuggaccaugaaaauacuaauaggaguagucauuacguggauagggaugaacucaagaucuacgucucuaucaguaucacucguccuaguaggugucguaacgcuauauuuaggagcaaugguacaagcggauucuggauguguaguuagcuggaaaaauaaagaguugaaaugugguagugggaucuuuaucacagauaauguacauacauggacugaacaauauaaauuucaacccgagucgccuuccaaacuagcuucggcaauacaaaaagcccaugaagagggcauuugugggauacguagcguuacuagacuugaaaaccuaauguggaaacagauaacacccgaacugaaccauauuuuaagugaaaaugagguuaaacuaacaauaaugacaggagacacgaagggaauuaugcaggcaggcaagcguucacuccgaccacagcccaccgaacuaaaguacucguggaagacguggggaaaagcaaagaugcucagcacugagucacacaaucaaacauuccugauagaugggccagaaaccgccgaauguccaaacacuaauagagcauggaauaguuuagagguagaagauuaugguuuugguguuuucacuacaaauaucugguugaagcuaagggaaaagcaagauguguuuugugauuccaaacuaaugagcgcugccauuaaagacaaucgagcgguccacgcggauaugggauauuggaucgaaucagcauugaaugacacauggaaaauggaaaaggcgaguuuuaucgaaguaaaaaguugucauuggccaaagagccauacguuguggucaaauggaguacuugaaagcgagaugauaauccccaaaaauuucgcuggaccaguaucgcagcacaauuauagaccaggguaucacacccaaaccgcagggccguggcaucucggaaaacuagaaauggauuuugacuuuugugaaggaacaacugucguaguuacggaagauugcggaaacagaggaccaagucugcgcacuacaacagcauccgguaaauugauaacugaaugguguugcagaucguguacgcugccgccauuaagauauaggggagaggauggaugcugguacggaauggagauuagaccacuuaaagaaaaagaagaaaaccuuguaaacucucuagugacugcaggacauggucaaauagauaauuuuagccuaggaguauugggcauggcucucuuucucgaagaaaugcucaggacacgcguaggaacgaaacacgcaacuuuacuuguagcugcuagcuuuguaacacuaauaacuggcaacaugucuuuccgagaucuaggaagagucauggucauggugggcgcgacaaugacugacgauaucggaaugggagucacauaucuggcccuacucgccgcauucaaggucaggccgacauuugcagcaggguuacuucugaggaagcuaaccucaaaagaacucaugauggcaacaaucgguauaacccuauugucucaaucaacaaucccagaaaccauacuggaacuuacugacgcucuugcguuagggaugauggucuuaaaaauaguuagaaacauggaaaaauaccaacuagcagugacaauuauggcgaucucguguguacccaaugcaguaauucuacguaaugcuuggaagguaucaugcacaauauuagcugcuguuucaguuucgccucuacucuugacauccagucaacaaaaagcagauuggauuccguuggcacuaaccaucaaaggccugaacccaaccgcaauuuuucucaccacucugagccgaacgucuaagaaacggagcuggccguuaaacgaagcuauaauggcgguagguauggugucuauauuggcaucuagccuuuuaaagaaugauauuccuaugacaggaccucuuguugccggcggccuucuaacuguauguuauguucugacuggaagauccgcugaccuagaguuagagcgugcugcagaugugaaaugggaggaccaagcagaaauuucaggaaguucucccauuuuaucaauaacuaucucagaagacggaaguaugaguauaaagaaugaagaggaagaacaaacucuaacuauucucauuaggaccggauuauuaguuaucucuggcguuuucccaguaagcauuccaauuaccgcggcugcuugguacuuaugggaaguaaagaaacaaagggccgguguuuuaugggaugucccuucuccgcccccaguugguaaagcugaacuugaagacggagcguaucggauaaaacagagaggaauacuagguuacucgcaaauaggagcgggaguauauaaagaaggcaccuuccacacaauguggcaugugacucgaggagcuguacuuaugcauagaggaaagaggauagaaccgagcugggccgaugucaagaaagaccuaauaagcuauggggguggauggaaacuggagggagaauggaaagaaggugaagaggugcagguccuagcgcuugaaccaggcaaaaauccgagggcuguacaaacaaaaccagguauuuucaaaacaaauacgggcacgauuggagcagucagccucgauuuuucuccugggacauccggcucacccauuguagaucgaaaaggaaagguugugggucuguacggaaauggagugguaacgagaaguggagcauauguaagugcaaucgcacaaaccgagaaaaguauagaagauaauccagaaauagaggacgacauauuuaggaaaaagagguuaacuaucauggaucuccauccaggagccggaaaaacaaaaagauaucuaccggcaauugugagagaggcgauaaaaagaggguuacggacgcucauccuugcuccgacuagaguaguagcugcggaaauggaagaagcacuaagaggucuccccauuagguaccagacaccagcaaucaaggcagagcacacuggaagagaaaucguagaccuuaugugucacgcaaccuuuacaaugagauuacuaucuccaguacgaguacccaauuauaacuugauaaucauggacgaagcacacuucacagauccagcaucuauugcugcgagagguuauauaucgacccguguggaaaugggugaagcugccggaauauuuaugacagccaccccaccaggcagcagagauccuuucccacagagcaaugcaccaauaauggaugaggagcgcgagauucccgagagauccuggaauaguggccaugaaugggugacagauuucaaaggaaaaacagugugguucgugccaucgaucaaagcgggcaaugacauugcugcauguuuaaggaaaaacgggaagaaagucauacagcuuucucgcaaaaccuuugauuccgaguaugucaaaacacgugcuaacgauugggauuucguaguuacgacagauauaucugagaugggggccaauuuuaaagcagaaagaguaauagacccgagaagguguaugaaaccugucauucugacagauggagaagaaagaguaauacucgcagguccaaugccagugacucauagcagugcggcacaaaggcgaggucguauaggacgcaauccuaaaaacgaaaaugaucaauauauauacaugggugaaccccuagaaaacgaugaagacugugcucauuggaaagaagcuaaaauguuauuagauaauauuaauacgccggaagguaucauaccgucaauguuugaaccugagcgggaaaagguagaugcaauagauggcgaauaccgccuaagaggcgaagcuagaaaaacguucguggauuuaaugcgacgaggggacuuaccaguaugguuagcauauaaaguagcagcugaagggauuaacuacgcagauagaaaaugguguuucgacggaaucaagaacaaccaaauacuugaagaaaacguagagguggaaauauggacaaaagaaggagagagaaagaaauugaaaccaaggugguuagaugcgcgaauauacuccgauccacuugcauugaaagaauuuaaggaguucgcagcgggcagaaagucgcuaacauugaauuugauuacagaaaugggaagacucccaacuuucaugacacaaaaagcgagaaaugcauuggauaaccuagcgguuuugcauacggcagaagcgggagguagagcguacaaccacgccuuaucugaauuaccagagacacucgagacccuccucuugcugacccuccuugccacuguaaccggcgguaucuuuuuauucuuaaugagugguaagggcaucggaaaaaugacucucgggaugugcuguauaauaacagcaucgguacuuuuaugguacgcacaaauacagccacauuggauagcagcaagcauaauuuuagaguucuuucuaauuguacuucugaucccggaaccugagaaacagagaaccccacaagauaaucaauuaacauacguuguaauugcuauacugaccguaguagcugcaacuauggcuaacgagaugggauuucuagagaaaaccaaaaaggacuuaggauuggguucuaucaccacucaagaguccgaguccaacauucuugauauugacuuaaggcccgcgucggccuggacuuuauacgccguagcaaccacguuuguaacuccaauguuaagacauaguauagaaaacucuucaguaaauguuagccuaacggcuauagccaaccaggccacaguacuuaugggcuugggaaaaggguggccacucuccaaaauggauauaggugucccccuguuggccauuggcuguuauucgcaaguaaacccgauuacccucacagccgcauuacugcuauuaguagcccauuaugcuaucauagguccaggccuucaggcgaaagcgacucgggaagcccaaaaacgagcagcagcaggaauuaugaagaacccgacggucgacgguauaaccgucauagaucucgagcccauacccuacgauccuaaguucgaaaaacaacuaggucaggugaugcuucuuaucuuguguguuacacaaguccugaugaugagaacuacuugggcucuaugugaggcuuuaacccuugcaacagggccaaucucuacccuuugggaagguaauccugguagauuuuggaauacaacgaucgcggucucuauggcaaacauauuccguggcucguaccucgcuggcgcuggucuauuauucucgauaaugaaaaacacgaccaauacaagacgaggaacaggcaacauuggugaaacuuuaggagagaaauggaaaucuagacucaaugcuuuagggaaaagcgaauuucaaauauauaagaaauccgguauccaggaagucgauagaacccuagcaaaagaaggaauaaagagaggugagacagaucaccacgcggucagucgagguucggcaaaauugagaugguucguagaaagaaacaugguuacuccagaaggcaaaguagucgaccucgguuguggcagaggaggguggucauauuacuguggcggucuuaaaaauguuagagaaguaaagggacuaacaaagggaggaccaggacacgaagaaccuaucccgaugaguacguacggcuggaaucuaguaagacuccagucaggaguagacguauuuuucacuccaccugagaagugcgacacgcuauuaugugauaucggagaaucguccccaaacccgacuaucgaagccgggcguacacuaagaguguugaacuuaguagaaaacugguuaaauaauaauacacaauucuguauaaaaguuuuaaaccccuauaugccaucagucauagagaaaauggaaacacuccaacggaaauaugguggagcacuuguacggaaccccuuaucccgaaauagcacucaugaaauguacuggguuagcaacgcuacugggaauaucguuucaucuguaaauaugauaaguaggauguuaaucaaucgcuucacaaugaagcacaagaaagcaacguacgaaccggacguagaucuugguuccggcacaaggaauauuggcauagaaagcgaaauaccaaaccuugauaucauuggaaagcguauagagaaaaucaagcaagaacaugaaacauccuggcacuacgaucaggaucauccauauaaaacgugggccuaucauggaucauacgaaacuaaacaaacagguagugcauccucgaugguaaaugguguagugagacuucucacgaaaccaugggauguugucccaauggugacucagauggcaaugacggacacuacaccauucggccaacagcguguguucaaagaaaaaguagauacuaggacgcaggaaccaaaggaggggacuaagaaacuaaugcggauaacagcagagugguuauggaaagaguuaggcaagaagaaaacgccuagaauguguaccagagaagaauuuacacgaaaaguacgaucuaaugcagcauugggagcuauauuuacugaugaaaauaaauggaaaagugcacgagaagcuguagaagaugggcgauuuugggagcuuguggauaaagagcguaaccuccacuuagaaggaaaaugugaaacuuguguauacaacaugauggguaaaagagagaagaaauugggagaguucggcaaagcgaaaggcagcagagccauuugguauauguggcuaggggcuagauucuuggaguuugaggcuuuagguuucuuaaaugaagaucacugguucaguaggggaaacuccuuaagcggaguagaaggagaaggacugcacagauuaggauacauauuaagagacgucggcaagaaagaagguggagcaauguaugcggaugacacggcaggaugggauacucgaauuacacuugaggacuuaaagaaugaagaaauggugaccaaccacaugaaaggugaacacaaaaagcuagcagaagcaaucuuuaaauuaaccuaccagaacaaaguaguaagaguacagagaccuacgccucguggaacaguuauggauauaauaucaagaagggaccaaagaggcucaggccaggugggaaccuaugguuugaauacuuucacaaauauggaagcacaauugauacgucaaauggaaggagagggcauauuuaagucgauccagcaccuuacagcuacagaagaaauagcaguccaaaauuggcuugcuagaguaggaagagaaagacuuucuagaauggcgaucucaggugacgauuguguagucaaaccgauagaugaccguuuugccucugcacuaacugcucuaaaugacaugggaaaaguuagaaaagacauacaacaaugggagccuucccggggguggaacgauuggacacaaguaccuuucuguucacaucauuuccaugaauuaguuaugaaagacgguagagugcuggucguacccuguagaaaucaggaugaguugaucgguagagcgcgaauuagucaaggagcgggcuggucauuaaaagaaacugcaugcuuagggaaauccuacgcucagauguggacauuaauguacuuucauagaagggauuuacgguuagcagcaaaugcuauauguagugcaguaccuagucauuggguuccgacaagucguaccacauggucaauccaugcuaaacaugaauggaugacaacugaagauauguuagcuguauggaauagaguauggauucaagaaaaccccuggauggaagauaaaacuccgguugaaagcugggaagaaguaccuuaccucgggaagcgugaagaucaguggugcggaucacuaaucggguugacaucucgugcuacgugggcgaagaacauccaaaccgcaauaaaucaaguccggucgcuaauuggaaacgaagaauauacagauuacaugccaagcaugaaacgauuuaggagagaggaggaagaggcuggaguacuuugguaa

SEQ ID NO: 22656 - RNA, 9876 nt, Artificial Sequence
  derived and/or modified CDS sequence (opt6) from DENV-2__FJ850107__SS-prME
acagccggagucauuauuauguuaauaccaacugcaauggcguuucacuuaacuacacgaaauggagaaccacacaugauugucggucgacaagaaaaagguaaaucccuauuauucaagaccgaagacgggguuaauauguguaccuuaauggcuauagaccuaggagaacugugcgaagacacaauaacuuacaagugccccuuauuacgucaaaacgaaccagaagauauagauuguuggugcaauucaacgucgaccugggucacauauggaaccugcacaacuacaggugaacacagaagagagaaaaggucaguugcgcuaguaccccacgugggaaugggacuagaaacuaggacagaaacuuggaugucaagugaaggcgcauggaagcauguacaaaggauagaaacauggauacuacggcacccgggguucacgauuauggcugcaauacuggcauauacaauaggaacgacacauuuccaaagagcauuaauuuucauacuacuaacggccguugcuccaucuaugacaaugcgauguauagguauauccaaucgcgauuuuguggaagguguaaguggcggaagcuggguagacauuguauuagaacacgguaguugugugacuacgauggcuaaaaauaaaccgacgcuagauuucgaauuaauaaagacggaagcaaagcaacccgccacacuacgcaaauauuguauagaagcuaaguuaacaaauacaaccacagaaaguagaugcccgacucaaggugaaccgaguuuaaaugaagaacaggauaaaagauucauuuguaaacauucgaugguagauagggggugggguaauggcugcggcuuauuuggaaaaggaggaauagucacaugugcuauguuuaccuguaaaaagaauauggaaggaaaagucguacaaccagaaaauuuggaauauacgaucguaauuacgccacauucuggcgaagaacaugcuguuggaaaugauacuggaaaacacggaaaagaaauaaagauuacaccacaaucaucgaucacugaagccgagcuaaccgguuauggaaccguuacaauggaauguuccccacgcacggguuuagauuuuaacgaaaugguucuacuacaaauggaagauaaagcauggcuaguacauagacaaugguucuuggaucuuccccuaccuuggcuuccaggagcggacacacaaggaucuaacuggauccagaaggaaaccuuggugacuuuuaaaaauccgcaugcaaagaaacaagaugugguuguuuuagguucucaagaaggugcgaugcauacagcauugacaggugcaacugaaauacaaaugaguucaggcaacuuacuauucacuggccauuuaaaaugcagauuaagaauggacaaacuacaacuaaaagggaugucuuauagcauguguacaggcaaauuuaaaauaguaaaggaaauagcggaaacgcagcacggaacaaucguaauucgcauacaguaugaaggggacgguucaccaugcaaaaucccguuugaaauaacagauuuagagaaacgccacguacuuggucgccuaauaacgguuaauccgauaguaauagaaaaagauagcccaguuaauauugaggcugagccaccauucggagauagcuacauaauuaucggagucgaaccaggacaauugaagcuaaauugguuuaagaaaggaucuaguauaggacagauguuugaaacaacaaugaggggcgcuaagagaauggcaauucuaggagacaccgcaugggacuuugguucccuuggagguguauuuacgaguauuggcaaagcauuacaucaaguguuuggugcuauuuacggagcagcuuuuaguggagucagcuggacuaugaagauacuuauaggcgugguuauaacuuggauuggcaugaacucuagaagcacuucccuauccgugucucuuguucuagucggagugguaacacuauauuugggagcaaugguucaagccgauucagguugcguaguauccuggaagaacaaagaacuaaagugcggauccggcaucuuuauuacagacaaugugcacacauggacagagcaauacaaauuucaaccggaaucgccgaguaaauuagcaagugcaauucaaaaggcccacgaagaaggaauauguggcauaagaucaguaacuaggcuggagaaucuuauguggaaacagauuacgccggagcuaaaccauauucuaucagaaaaugaggugaaacuuaccauuaugacaggagacacaaaaggcauaaugcaagcuggaaaaagaucacuaagaccgcagccaacggaauuaaaauauaguuggaagacaugggggaaagcuaagaugcugucgaccgaaucgcacaaccaaacauuuuugauagacggaccggagaccgccgagugcccuaauacgaaucgcgcauggaacucacuagaagucgaagacuacggguucggcguuuuuacuacgaauauauggcuaaagcugagggaaaaacaggacguguucugugacaguaaacuaaugucagcagcaauaaaagacaauagagcuguacacgcggauauggguuacuggauugaaucagcacuaaaugacaccuggaagauggagaaagcuaguuuuauagaaguaaaaucgugucacuggccaaagucacauacucugugguccaacggcguacuagaaagugagaugauaauccccaaaaauuucgcagguccagucagucaacacaauuaccguccaggguaccacacucagacggcggggccguggcaucuggggaaacuggaaauggacuucgauuuuugcgaaggcacgacggucguagucacugaggacuguggaaaccggggcccgucacuuagaacgacuacggcaucuggaaaguuaauaacagaaugguguuguaggaguuguacuuugcccccgcucagauaucgaggagaagauggaugcugguaugguauggaaauaagaccuuuaaaggagaaggaagaaaauuuaguuaauagccuaguaacagcgggacauggacagaucgauaacuucaguuuaggaguguuaggaauggcguuguuccuagaagaaauguuaagaacucgggugggaacaaaacaugccauauuacugguggcagucagcuuuguuacgcuuaucacaggaaauaugagcuuuagggaccugggacguguuaugguaaugguaggcgcaaccaugacugaugacauaggaaugggaguuacauaucuugcguugcucgcagcauucaaagugagaccaacauuugcagcgggacuauuacuaagaaaacuaaccucuaaagaauugaugauggcaacuauaggaauaacucuguuaucacagaguacaauaccugagacaauucuagaacugacagaugcauuagccuuaggaaugaugguucuuaaaaucguacgaaauauggaaaaauaucaacuagcugucaccaucauggccauuagcugcgugccaaaugcaguuauacugagaaacgcauggaagguaaguugcacuauucuagcagcuguaucgguuuuuccucuucuacuaacaaguucccaacaaaaggcggauuggauaccguuagcucucacuaucaaagggcucaauccuacugcuauauuccucacuacauuguccagaacaucaaagaagagaaguuggccacuaaaugaggcuauaauggccguaggaauggugagcauauuagcaagcucgcuacucaaaaaugauauaccuaugacgggaccccuuguagcagggggacucuuaacgguuuguuacgugcuaacuggacguuccgcagauuuagaauuggaaagggcagcagauguaaagugggaagaucaggcagaaaucaguggaaguagcccgauauuaaguaucacaauuagcgaagacgggucgaugagcaucaaaaaugaagaagaggaacaaacccucacgauauuaauaagaacggggcuacucguaauaucgggaguuuuuccaguaucgauuccaauuacugcagcugcaugguauuuaugggaaguaaagaaacaaagggccgguguacuaugggacgucccuagcccaccgccgguuggcaaagcagaacuagaagauggugccuaucguauaaagcaaagaggcauacuuggauauucacaaauuggagcuggaguuuacaaggaaggaaccuuccacaccauguggcacgucacaagaggagcaguacuaaugcauagagggaaacgaaucgagccuaguugggcugaugugaagaaagaucuuauaucauauggagguggauggaaauuagaaggggaguggaaggaaggagaagagguucaagucuuagcuuuggagccgggcaaaaauccgagggcaguacaaaccaaaccggggauuuuuaagacaaacacgggcacuauuggcgccguaucacuagacuucagcccagguacaucugguaguccaauugucgaucguaaagguaaaguaguaggccuuuauggaaauggagucgucacuagguccggagcguauguauccgcuaucgcacagaccgagaaaucuauagaagacaacccagaaaucgaggaugacauauucagaaagaaacgacugacaauaauggaucuacauccuggagcgggaaaaaccaaacgauaccugccugcaaucguucgggaggccauaaaaagaggauugagaacauugauucuagcgcccacaaggguugucgcugcagagauggaagaagcgcuaagaggauugccuauuagauaccaaacuccggcaaucaaagccgagcauacgggucgcgaaauaguggaccugaugugucacgccacauuuacuaugcgacuucucucuccggugaggguuccaaauuacaauuuaauaauuauggaugaggcccacuucacagauccagccaguauagccgcucguggguauauaucuacaaggguugagaugggcgaggccgcugggauauuuaugacugcgacaccacccggaaguagagacccuuuuccccaaagcaaugcuccgauuauggacgaagaacgagaaauaccagagagaucauggaacucgggacaugaguggguuacugacuuuaaaggcaagacagugugguucguuccaucaauuaaagcagggaacgauauagccgccugucuaagaaagaaugguaaaaaggugauacaacuaagucgcaaaacauucgauagugaguacgucaaaacccgggcuaacgauugggacuuuguugugacaacugauauaucagaaaugggagcuaauuuuaaggcugagaggguaauagaccccagacgguguaugaaaccgguaauauuaacagacggagaggaaagagucauccuagcaggaccaaugccagugacccauagcagcgcugcccaaaggagagguaggauuggaaggaaucccaaaaacgaaaaugaucaguacaucuauaugggggagccauuggagaaugaugaggacugugcccauuggaaagaggcgaaaauguuauuagauaacaucaauacuccggaagguauaauucccucaauguucgagccagagcgggaaaaaguugaugcaauagauggggaauaccgccugcguggugaggcuagaaaaacauuuguugacuuaaugaggcgaggggaucugcccgugugguuagccuacaaaguugcugccgaaggaaucaauuacgcagauagaaagugguguuucgauggaauaaagaauaaucagauccuugaggaaaauguugaaguggaaaucuggacaaaggagggcgaaagaaagaaauuaaaaccgagguggcuagaugcccgcauuuacagcgauccccuugcccuaaaagaauuuaaagaguuugcagcagggagaaaaagucuuacacuaaaucuaauaacagagauggggaaacucccgacuuuuaugacucaaaaggcccgaaaugcauuagacaaccuagcuguacuacauacagccgaggcaggaggaagggccuauaaucaugcacuaucagaacugccagaaacucuagaaaccuuauuauuguugacacuguuagcaacgguuacuggaggaaucuuucuauuuuuaauguccgggaaagguauagguaaaaugacuuuagguauguguugcauaauaacagcaucuguacucuuaugguacgcacaaauccaaccacacuggauagccgcaaguauaauucuagaauuuuuccucaucgucuuacuuauuccugagcccgagaagcaacgaacaccgcaagauaaccaauuaacauacgucguaaucgcgauauuaacugucguagcagcaacaauggcgaaugaaaugggauuucucgaaaagacuaagaaagaucucggcuuaggaagcauaacaacacaagagagugagagcaacauuuuagacaucgaucuaagaccagcaucagcauggacauuguaugcuguugcaacuacauuugugacgcccauguuaaggcauucaauagaaaauucuuccgucaacguaucauuaacggcuauugcaaaucaggcuacaguacuaaugggcuuagguaagggauggccccuaucuaaaauggauaucgggguaccauuacuggcuauagguuguuauagccaagugaacccuauaacacuaacggcagcucugcugcuccuaguugcccauuaugccaucaucgguccgggauugcaggcaaaagcgacgagagaagcucagaaaagggcugcagcuggcauaaugaaaaaccccacgguugaugggauuacagugauagauuuagagccgauuccuuacgauccaaaauuugaaaaacaauuagggcaaguaaugcuacuuauacuauguguaacgcaaguuuuaaugaugagaacaacgugggcacugugcgaggcuuugaccuuagcuacaggaccuauuucaacucuaugggaaggaaauccuggcagguuuuggaauacuacaauagcaguguccauggccaacauauucaggggauccuauuuggcaggagcuggacuguuauucagcauuaugaaaaacacuacgaauacgcgacgagguacgggaaauauuggugaaacgcugggggaaaaauggaaaaguagauuaaacgcuuuaggcaaaagugaguuccaaaucuacaagaaaucugggauacaggagguggaccgaacucuugcaaaggaagguaucaaaagaggagagaccgaucaccacgcaguuagccgaggaagcgcaaaauugagaugguucguagaacgaaauauggugacuccggaaggaaaagugguugaucuaggaugcgggcgcggaggauggaguuauuauugugguggucucaaaaaugucagagaggucaaaggacuuacaaaaggaggaccgggccacgaagaaccgauucccaugagcacauauggguggaauuuaguaaggcuccaaagcggugucgauguauucuuuaccccaccagaaaaaugugacacauuacucugugauauaggggaaaguucaccaaaucccaccauagaagcagggagaacacuuagaguacucaaccuaguagagaauuggcuuaacaauaacacccaauucuguauuaaaguccuuaauccuuacaugccaucugucauugagaaaauggaaacacuucaaagaaaauauggaggagcacugguucgaaauccauugucaagaaauagcacucaugaaauguauuggguaucgaaugcaacagggaacauaguuuccucuguuaauaugauaagcagaaugcugauuaacagauucacaaugaaacacaaaaaggcaacauaugaaccggauguagauuugggaaguggaaccagaaauaucggaauagaaagcgagauuccgaaccuagauauaauuggcaagcgaauagagaaaauacgacaagagcaugagacaaguuggcacuaugaucaagaucauccuuacaaaaccugggccuaccauggaaguuaugagacaaaacaaacaggcucagcaaguuccaugguuaauggaguuguuagacuauuaacuaaacccugggaugucguacccaugguuacacaaauggcgaugaccgacaccacaccguucggccaacaacgaguguucaaagaaaaagucgacacgagaacacaagaacccaaagaaggaacaaagaaacuaaugcgaauuacagcugagugguuauggaaggaauuagggaaaaagaaaacaccacguauguguacucgagaagaguuuacuagaaaaguaagaucaaaugcagcacuaggagcaauuuuuacagaugaaaacaaauggaaaucggcuagagaggccguggaagauggcagguucugggaacuuguugacaaagagcgaaaccuacaccucgagggaaaaugugaaacgugcguauauaauaugauggguaaacgagagaagaaauuaggggaguuugguaaagcuaaaggaagucgugcaauuugguauaugugguuaggcgcccgguuuuuagaguucgaagcauuaggguuuuuaaaugaggaucauugguucaguaggggaaauucguugaguggcguugagggggaagggcuccacagauuaggauacauucuaagggauguagggaagaaggaaggaggagccauguaugcugacgacacagccggaugggauacuagaaucacccuugaagaucuaaagaaugaagaaauggucacaaaccauaugaaaggagagcacaagaaacuugcggaagcaauauucaaauugacauaucaaaauaaaguaguacggguacaaaggcccacccccagaggcacaguuauggauauuauaagcaggagggaucaaagagggucuggucagguuggaacauacgggcuaaauacguuuacaaauauggaggcacaauuaauucgacaaauggaaggagaaggcauuuucaaaucuauucagcacuugacugcaaccgaagaaaucgcggugcagaacuggcuagcgcgaguuggaagggaacgauuaucaagaauggcuauuucaggggaugacugcguaguaaaaccgauugaugaucguuucgcaucugcuuuaacagcccuaaaugacauggguaaaguuagaaaagauauccaacagugggaaccgucccggggcuggaacgacuggacgcaaguaccauucuguucacaccauuuccacgaauuagucaugaaagaugggagaguacugguggucccaugucgaaaccaagacgaacuaaucggccgggcgcgaauaagccagggagcuggauggucacuaaaagagacagccugccucggaaaauccuaugcacaaauguggacacuaauguacuuccauaggcgagaccuuagacucgcagcaaaugcgaucuguucggcgguuccuucacacuggguuccaacaagucguacgacguggucuauccacgcaaaacacgaauggaugacaaccgaagacaugcuggcuguguggaaucgcguauggauccaagaaaacccauggauggaggauaaaacgccgguagaaagcugggaagagguaccguaucucggcaagagagaggaccaguggugcgguuccuuaaucggccucacaucacgcgcaaccugggccaagaauauccagacagcuauaaaucagguaaggucauugauagggaaugaggaauauacggauuacaugcccucaaugaaaagguucagaagagaagaagaagaagcaggaguacuuugguaa

SEQ ID NO: 22657 - RNA, 9876 nt, Artificial Sequence
  derived and/or modified CDS sequence (opt6) from DENV-2__FJ850108__SS-prME
acugcuggcgugauagugaugcuaauucccaccgcaauggcauuccauuuaacuacaaggaauggcgaaccucauaugauaguagguaggcaagaaaaagggaaaucacugcuguuuaaaacggaagacggaguaaauaugugcacccuaauggcgauugaucucggagaauuaugcgaagacacuauaacguacaaaugccccuugcuaaggcagaaugaaccagaagauauagacugcuggugcaauucuacauccacuuggguaacuuauggcacguguacaacgacgggggaacaccggagagagaaaagaucaguagcauugguaccacauguggguauggguuuggaaacuaggacggaaacauggauguccagugaaggcgcuuggaaacauguacaaagaauugaaacauggauacuccgucauccggguuucacaauuauggcagcuauucuugcauauacaauuggaacaacacauuuccaaagagcacuaauauucauauugcuaacagcuguagcaccauccaugacaaugagauguauaggcauuucaaaucgagacuucguggaagguguuaguggagguucauggguagauauuguacuugagcauggaaguugugugacuacaauggcuaaaaacaaacccacacucgauuuugagcuaauaaaaacggaagcaaaacaaccagcaacuuuaagaaaauauugcauagaggcuaaauuaacaaacacuacaacagagucacguugcccaacucaaggcgagccaucucuuaaugaagaacaagacaaaagauuuauauguaaacauagcauggucgauagagguuggggaaauggauguggccuguuuggaaaaggcggcaucguaacaugugcuauguuuacuugcaagaaaaacauggaagggaaagucgugcaaccugaaaaucuugaauacacaauuguuauuacaccucauucgggagaggaacaugcaguggguaaugacaccgguaaacauggcaaagaaauaaaaaucacgccacaaucuucaauaacagaagcagaacuaacgggauacgggacggugacuauggaguguagcccacgcaccggauuagauuuuaacgaaaugguacugcuacaaauggaggauaaagcauggcuaguacacaggcaaugguuucuggaccuuccacuaccgugguuaccaggugcugacacucaaggaucaaacuggauccaaaaagaaacgcucguuacuuucaaaaauccacaugccaagaaacaagacguaguugucuuagguagucaagaaggcgcgaugcauacugcucugacaggugcaacagaaauccaaaugucuucaggcaaucugcuuuucacaggacacuuaaaauguagauuaaggauggauaaauuacagcuaaagggcaugagcuauaguauguguacggguaaauuuaaaauugucaaagagauagcagaaacacaacaugggaccauuguaauaagaguucaauaugagggagauggcuccccaugcaaaauuccauucgagauuaccgaucuugagaaaaggcacguauuaggaagauuaauaacaguaaauccuaucguuauugagaaagauucaccagucaauauagaagcagaaccacccuuuggcgauucauauauaauuauagggguagaaccuggacaacuaaaauuaaacugguuuaagaaagguucaaguauuggacagauguuugaaacuacaaugaggggcgcaaagcggauggcuauacugggagacaccgccugggacuuuggaagccugggugggguuuuuacaaguauagguaaggcucuccaucaaguauuuggagcaauauacggggcugcauuuucaggaguaagcuggacuaugaaaauuuuaaucggaguaguaauuacauggaucggaaugaacucaagauccaccucucuaucuguuagccugguuuuaguaggaguagugacuuuauacuuaggggccaugguacaagcagauucgggauguguugugucuuggaaaaauaaggaauuaaagugcggcucuggaaucuuuaucacagauaauguucauaccuggacagaacaguacaaguuucagccugagucaccuaguaagcuagcgucggcgauccagaaagcacaugaagaaggaaucuguggaaucagaucugugacuagacuggaaaauuuaauguggaaacaaauaacaccagaauugaaccauauucuaagugaaaaugaggugaaauugacaauaaugaccggagacacuaaagguauuaugcaagcaggaaaaaggucgcuuagaccccaaccaacagaauugaaauauagcuggaaaacuuggggaaaagcuaaaauguugaguacagaaagucacaaucaaaccuuccuuaucgacggaccugagacggcugaaugucccaauaccaauagagcauggaacucccuggaaguagaagauuacggguuuggaguguuuacgaccaacauuugguugaaacugagagaaaagcaagacguauuuugugacuccaaacuuaugucagcggccauuaaagacaacagagcaguacaugcagacaugggauacuggauugaaucagcguuaaaugacacguggaaaauggaaaaagccucuuuuauugaagugaaaucgugucacuggccaaaaucacacacguuauggucaaaugguguacuugaaagcgagaugauaaucccaaagaauuuugcaggaccaguaucacagcacaacuaucgcccaggauaccauacucaaauagcaggcccuuggcaucuugggaaacucgaaauggauuucgauuucugugaaggcacgacugucguuguaacagaggauugcgguaaucggggaccgucgcugcguacaacgacugcaagcgguaaauuaauuacagaauggugcugucguagcuguacucugccgccccuuagauaucguggcgaagacgggugcugguauggaauggaaauaagaccauuaaaagaaaaagaggaaaaccuaguaaacucauuggugacggcaggacauggucaaauagacaauuucagucucgggguccuugggauggcacuguuccucgaggaaauguugaggacuagaguugggacaaagcaugcaauacuacucguagccguaaguuucgucacuuugauaaccggaaauaugaguuuuagagauuuggguaggaugauggugaugguuggugcaacgaugacagacgauaucgguaugggaguaacuuaccuagcgcucuuagcagccuuuaaaguaaggccaacauucguagcuggccuauuacuuagaaaacuuacaucgaaagaguuaaugauggccacuauuggaauaacauugcuaucucaauccacuauucccgaaacaaucuuagaauuaacggaugcguuagcuuuaggaaugaugguccugaaaauaguacgaaauauggagaaauaucaacuagcugucacuauaauggccauuaguugcgugccaaaugcaguaauccuaagaaaugcauggaaagugagcuguaccauacuagcagccgugagcguuaguccacuacuauuaacaucaucucaacaaaaagcagauuggauuccauuagcguuaacaaucaagggauuaaaccccaccgccauauucuuaacaacucucucacguacgucuaagaaacgaagcuggccuuuaaacgaagccauuauggcaguagguaugguaaguauacuagcgagcagcuuauugaaaaaugauauaccaaugacagguccguuaguggccggggguuuacuaaccguauguuacguucuaacagggagaucagcggaucuugaguuagaaagagcagcagauguaaagugggaagaucaggcugagauuucaggaaguucuccgauuuuaucaauuaccauuagcgaggacggaucgaugucaaucaaaaaugaggaagaggaacagacacuuaccauuuuaauuagaacaggguuacuuguaauaagugguguauuuccagugucgauaccuauaacugcugccgcaugguaccucugggaagugaagaaacaaagagccggcguccucugggauguaccaucaccaccaccagugggaaaggcugaacucgaagauggugcuuauagaaucaagcagcgcggaaucuuggguuacucacaaauuggagcuggagucuauaaggagggaaccuuccacaccauguggcauguaacacgaggugcagucuuaaugcacagagguaaaaggauugaaccaucgugggcagacgucaagaaagaccuuauauccuacggugguggauggaaguuggaaggggaguggaaagaaggggaggaaguacaaguauuggcacuggaaccggguaaaaauccuagagccguccaaacaaaaccaggaauuuuuaagacgaauacaggcacuauaggugcaguuucacucgacuucucaccuggaacaucaggguccccuauaguagacaggaaaggcaaagugguaggucuuuauggcaauggugucguaacaaggucaggggcauacguaagugcuauagcacaaacagaaaagaguauagaagauaauccagaaauagaagacgacaucuuuagaaagaaaagguugacaauaauggaucuacauccuggugcagguaagaccaaacgcuaucucccugcuauuguucgcgaagcgaucaaaagaggacuccgaacauuaauucuggcaccgacacgagucgucgcugccgaaauggaagaagcgcuacgcggacuuccaauucgguaucaaacuccagcgauuaaagcagaacauacuggacgugagauagucgauuuaaugugucaugcaaccuuuacuaugcguuuacuaagcccuguacgagucccaaacuacaacuuaauaauaauggacgaagcccauuuuacagaccccgcuucgauagcagcacggggcuacauaucuacacgcgucgagaugggugaagcggcaggcauauuuaugacugcaaccccgccaggaagccgagacccauucccucagucuaacgcgccaauaauggaugaagagagagaaauaccagaacgaagcuggaauagugggcaugaguggguuacugauuuuaaaggaaagaccguuugguucgucccuucaauuaaagcagguaacgauauagcagcguguuuaagaaagaacggaaagaagguaauacagcuuucccguaaaacuuucgauucagaguauguuaaaacaagggcaaacgauugggauuucguaguaacuacagauauaucagaaaugggagcuaauuuuaaagcagaacggguuauagacccaagaagguguaugaaaccugugauuuuaacugacggagaggagcgaguaauccucgcagguccaaugccgguaacgcauucuucggcagcucaaagacgagggaggauaggucguaaucccaaaaaugaaaaugaucaauacauauauaugggggaaccacuggaaaacgaugaggauugugcucauuggaaagaggcgaaaaugcuccucgauaacauaaacaccccagaagguauuauaccaagcauguuugagccagaacgagagaagguugaugcuauagauggggaguauagauuacggggagaagcaaggaagacguuuguugaccugaugaggaggggagacuuaccuguaugguuggcuuauaaaguggccgcagaagggauaaauuacgcugauaggaaguggugcuuugauggcauaaagaauaaccagauccuagaagagaauguggaaguugaaauauggacaaaagaaggagaacguaaaaaguuaaaaccaagaugguuagaugcaaggauuuacucggauccauuagcuuuaaaagaguucaaagaguuugccgccggccguaaaucuuuaacuuuaaacuuaauaaccgaaauggggagacugcccacuuucaugacacaaaaagcaagaaaugcuuuagacaacuuagcuguuuuacacacagcagaggcuggcggacgcgcuuauaaccacgcucugucagaacugcccgaaacgcucgagacccuacuuuuauuaacuuuacuggcaacaguaaccgggggaauauuucuauucuuaaugucgggaaaagguauaggaaaaaugacuuuaggcauguguugcauaauuacggcuucuguguuacugugguacgcacaaauacaaccacacuggaucgcagcgaguaucauacucgaauuuuucuuaauaguucuacugaucccugaaccugagaaacaacgcaccccgcaagacaaucaacuaacguauguaguuauugcaauacuaacgguaguagcagcaacaauggcaaacgagaugggguucuuagagaaaacgaagaaagaccugggauuaggaucaauuacuacccaagagcccgagucaaacauacucgauaucgaucuccgaccagcaagcgcuuggacgcucuaugcuguagcgacuacuuuuguaacaccgaugcugagacacagcauagaaaauucaucugucaacguaucauugacagcaauugccaaccaagccaccguguugaugggauugggcaaggguuggccauugaguaaaauggauauagguguuccacugcuagcaauagggugcuauucucaagucaauccaauaacacuuacagcagcucucuuacuauuaguggcacacuaugcuauuauaggcccuggacugcaggcgaaagcuacaagggaagcgcaaaaacgggccgcagccgguauaaugaaaaacccaacgguagauggaauaaccgucauugaccuagaaccgaucccuuaugacccuaaauucgaaaaacagcuugggcaggucaugcuacuuauauuguguguuacgcaagucuuaaugaugcguacaaccugggcauugugugaggcauugacacuagcaacggggccaauaucaacccuuugggagggaaacccaggaagauuuuggaauaccacaauugcuguaucuauggcaaacaucuucagagguuccuauuuagccggugcuggguugcuguucucaauaaugaaaaauacaacaaacacgagaagaggcacgggaaauaucggugagacacugggagagaaauggaagucaagacuuaaugcucucgguaaaagugaguuccaaauuuauaagaaaagugguauacaggaagucgaucgaaccuuggccaaagaaggaaucaaaaggggugagacagaucaucaugcagucucacgcggguccgcaaaacuaagaugguucguagaacgaaacaugguaacaccugaaggcaaaguaguagaucucggauguggccgaggaggguggaguuacuauuguggaggacuaaagaaugucagggagguaaagggauuaacgaaagguggcccuggccaugaagaaccuauaccaaugaguacuuacgguuggaaccuagugagacuccaaucgggaguagauguauucuuuacaccacccgaaaaaugugacacacuacuuugugacauaggugaaagcucaccaaauccaaccauagaggcggguagaacgcugagaguuuuaaaccuuguagaaaauugguuaaacaauaauacacaauuuugcauuaaaguauugaacccuuacaugccuucagucauugagaaaauggaaacguugcaacgcaaauauggaggggcccuaguucgaaacccuuugagcagaaauaguacucacgaaauguacugggugucaaacgccacaggaaacauugucaguucaguaaauaugauaucccgaauguuaauaaauagguuuacgaugaagcauaagaaagcuacauaugaacccgauguagaucucgguaguggcaccagaaauauuggcauugagagcgaaaucccaaaucuagauauaaucgguaagcggauagagaaaauaaaacaagaacacgagacgaguuggcauuacgaccaagaccacccauacaaaacgugggcauaccacgguucuuacgaaacaaaacaaacgggaucagcaucaucuaugguuaaugguguagugcgacuguugacaaaaccgugggacguagucccuauggugacucagauggccaugaccgacacaaccccauuuggucaacaaagaguauuuaaagaaaaaguagacacaagaacucaagaacccaaagaaggaacuaagaaauuaaugaggauaacagcggaauggcuauggaaagaauuggggaaaaagaaaacgccacguaugugcacacgcgaagaauuuacaagaaaagugagaucuaacgccgcguuaggagcgauuuuuacagaugaaaauaaauggaaaucugcuagggaggcaguagaggauggaagauucugggaacuggucgaucgcgaacgcaaccuacauuuagaggggaaaugugaaacauguguuuauaauaugaugggaaaaagagagaagaaauuaggugaguucggcaaagccaaggggucacgcgcuaucugguacaugugguuaggagccagguuuuuagaauuugaagcauuaggguuuuuaaacgaagaccauugguucagccgaggaaauaguuugucagggguggaaggagaaggacuucauaggcuuggauacauuuuacgagacguaggaaagaaagaaggaggagcgauguacgcggaugacacugcgggaugggauacacguaucacauuagaagaccuuaaaaaugaagagauggugacaaaccauaugaagggugaacacaagaaauuagcggaagcgauauuuaaacugacauaucaaaauaaaguagugcgaguucaacguccgacgccgcgaggaacugugauggauaucaucucgcgaagagaucaaagagguagcgggcaaguaggaacauacgguuuaaauacauucacgaauauggaggcccaacuaauucgccaaauggaaggcgaggggaucuucaaaaguauucaacacuugacaguaacggaggaaauagcuguucaaaauugguuagcgaggguaggacgagagagguugucaaggauggcaauaagcggagaugauuguguaguaaaaccaaucgacgaccgauucgcaucagcccuuacagcguuaaaugacaugggaaaagugcgcaaggauauucaacagugggaacccucacgugguuggaaugauuggacccaagugccguuuugcagucaucauuuucaugaauuaguaaugaaagauggaaggguauuagucguacccuguaggaaccaagaugaauuaauuggacgcgcgagaauaagccaaggagcagguuggucccuuaaggagacagccugcuuaggcaaaucuuaugcacaaauguggacauugauguauuuccaccgcagagauuuaagacuugcggcuaaugcaauuugcucagcggucccaucccacuggguaccaacaagucgaacaacuuggucaauacaugccaaacacgaauggaugacaacagaagacauguuagcaguauggaaccgaguguggauucaagagaaucccuggauggaggacaagacgcccgucgagagcugggaagaaguaccuuacuuaggaaaaagagaagaucaaugguguggcucgcuaauagguuuaacauccagggcuacaugggccaaaaauauacagacagccauuaaccaagucaggagcuuaaucgguaaugaagaauauacagacuauaugcccucaaugaaaagguuccgcagagaagaggaagaagccgggguccuaugguaa

SEQ ID NO: 22658 - RNA, 9876 nt, Artificial Sequence
  derived and/or modified CDS sequence (opt6) from DENV-2__JN819407__SS-prME
acugcaggaguuauaguaauguugaucccaaccgcgauggcauuccaccuaacuacacguaauggagaaccucauaugauagucggaagacaggaaaaaggaaaaucacugcuuuuuaaaacagaagacggggucaacauguguacacuaauggcaauugaucucggugaacuuugugaagacacaaucacauauaaauguccacuacuccgacaaaaugaaccagaagauauagacuguugguguaauaguacuucaacuuggguuaccuaugguacaugcaccacuaccggugaacauaggagagagaaaagauccgucgcuuuagucccucacguugguaugggucuggaaacucgaacggaaacauggaugucaucugaaggggcauggaaacacgugcaaagaauagagacuuggauuuuacgacacccaggauucacaauaauggcagcgauauuagcguauacgauaggcacuacacauuuccagcgugcgcuaauauuuauauugcuaacagcgguagccccguccaugacaaugagaugcauaggaauaucgaaucgugacuucguagaagguguaucaggaggaucuuggguugacauaguacucgaacacggaagcuguguuacuacaauggccaaaaauaaaccgacgcuagauuuugaauuaauaaaaacggaggcgaaacagccagcaaccuuacggaaauauugcauagaagcuaaauuaacuaauacaacaacagaaaguagauguccgacacaaggugaaccuucacugaacgaagaacaagauaaaagguuuauuuguaaacacucgauggucgacagaggauggggcaauggcugugguuuauuugguaaaggaggaauugugacuugugcgauguuuaccugcaagaaaaauauggaggggaaaguaguucagcccgaaaaucuugaguauacuaucguaauuacgccucauucaggggaggagcacgcgguagguaacgauacugguaaacauggaaaggaaauuaaaauaacaccucagaguucgaucacugaggcugaacuaacaggauacgguacaguuaccauggaguguucaccuagaacuggguuagauuuuaaugagaugguucuacugcaaauggaagacaaggccugguuaguacauagacaaugguuucuugacuuaccuuuaccuuggcuaccuggagcagauacacaggguagcaacuggauccaaaaagaaacucuugucaccuucaagaauccucaugcgaaaaagcaagauguaguuguguuaggaagucaagaaggugcgaugcauaccgcucuaacaggagccacagaaauucaaaugagucucggaaaucucuuauucacuggacaccugaaauguagauuaaggauggauaaauugcaauuaaaagggaugucuuacagcauguguaccgguaaauucaaaaucguaaaagaaauugcggaaacacagcauggaacuaucgucaucagaguucaauaugagggugauggaagcccuuguaaaauaccauucgaaauaacagaccucgagaaacgacaugugcugggcagguuaaucacuguuaaucccaucguaaucgaaaaagacucaccagucaauauugaagcugagccaccguuuggcgauuccuacauuauaauugggguggaaccgggucaauugaaacuuaacugguucaagaaagguagcagcauaggacaaauguuugaaaccacaaugcguggugccaaacgcauggcaauuuuaggggacacagcuugggacuuuggcaguuuagguggaguguuuacuagcaucggaaaggcacuacaucaaguuuuuggcgcaauuuauggagcggcauuuucaggagucaguuggacgaugaaaauacucauugggguuguaauuacguggauagguaugaacucucgaaguaccaguuugaguguaucuuuaguuuuaguaggaguaguaacucucuaucucggagccaugguacaagcggauucaggauguguagugagcuggaaaaauaaagaacuaaaaugugggaguggaauauucauaacagauaacguacauacuuggaccgaacaguacaaauuucaaccggagaguccgucgaaacuugcuagcgcuauucagaaagcccacgaagaagggaucugugguauaagaagcguuacccgccuugaaaaucuuauguggaaacagaucacacccgaauugaaucacaucuuaagcgagaaugaaguaaaacuuacaauaaugacgggcgauacuaaaggaauuaugcaagcuggaaaaaggagcuuaagaccucaaccaacugaauugaaauacagcuggaagacgugggguaaagcaaaaauguuguuuacagagucucauaaucaaacauuuuugaucgacggaccagagaccgcagaauguccaaacacaaaccgcgcauggaacucuuuagagguagaggacuauggguucggaguuuucagcacuaauauaugguugaaguugcgcgaaaaacaagacgucuuuugugauagcaaacuaauguccgccgcaaucaaagauaacagagcuguacaugcagauauggguuauuggauagaaagugcacuuaacgacaccuggaaaauggaaaaagccucuuuuauagaagucaaauccugccacuggccuaaaucacacacgcucuggucuaacggcgugcuagaaagcgaaaugauuauacccaaaaacuucgccggcccaguaagucaacacaacuauaggccaggauaucauacucaaacagcagguccuuggcaccuugguaaacuggaaauggacuuugauuuuugugagggcacaaccgucguugugacggaagauuguggaaauagagguccauccuuacgaacgacuacagcaucaggaaaauuaaucacugaaugguguugucgcucauguacccuaccgccucuacgauaccguggagaagauggguguugguacggaauggagauuagaccauuaaaagaaaaagaagaaaacuuaguuaauucacugguaacagcgggucauggucaaauagauaauuuuagucuaggugucuuagggauggcauuauuucuugaggagaugcuaagaacacgugucggaacaaagcacgcaauuuuacugguugcuguaucauuugugacgcuaaucacgggaaauaugaguuuucgcgaccugggucgaguaaugguuaugguuggagcaacaaugacugaugauauaggaauggguguaacuuauuuggcgcuucuggccgccuuuaaagugagaccaacuuucgccgcugggcucuuguuacggaaacuuacauccaaggaauugaugauggcaacgauuggaauaacauuauuaagucaaucuacaauaccugaaacaauuuuagaauugacugacgcauuagcauuagguaugaugguacucaaaauagucagaaauauggaaaaauaccagcuagcaguuacaauuauggcgauuuccugcgucccaaaugcaguaauacuacgaaaugcuuggaaggucuccuguacaauauuggccgcaguuaguguaucuccccugcuauuaaccaguucacagcaaaaagcagauuggauaccauuagccuuaacaauuaaagggcuaaacccuacagcaaucuuucugacaacacuuagcagaacaagcaagaaaaggagcuggccucugaaugaagcuauaauggcuguggguauggugagcauucuagcuucuagcuuacuaaagaaugauauaccgaugacgggacccuugguggcaggagguuuauuaaccgucuguuauguguuaacgggaagauccgccgaccuagaauuggagagagcggccgauguaaagugggaagaucaagccgagauaagcggaucaucuccaauccucucaauaacaauaucggaagacggaaguaugucuaucaagaaugaggaggaagaacagacacuaacgauauuaauucgaacagguuugcuagucauaucaggaguguuccccguuagcauaccaauaacagcugcagcaugguaucuaugggaagugaagaaacaaagggcaggaguacuuugggacgucccaucgccaccuccuguuggaaaagcagaacuagaagauggugcguaucgaauaaaacaaagagggauacuaggauauagucaaauuggagccggaguauauaaagaagggaccuuucacacaauguggcacgucacgcgcggagcuguuuuaaugcaucgcgguaagcggaucgaaccaucaugggcugaugugaagaaagaccuuauaucauauggugggggauggaaauuagaaggugaauggaaggaaggcgaagaaguucaaguucuugcauuggaaccgggcaagaacccaagagcuguacagacuaaaccggguauauucaaaacaaacaccgguacuauuggcgcgguuagcuuagauuuuagcccagguaccucagguucaccgauaguggaccggaaaggcaaaguuguagguuuguaugggaacgguguagucacuagaagcggugcauauguaucagcuauagcgcaaacagaaaaaucgaucgaagauaauccagaaauagaagacgauauauucagaaagaaacgguuaacgauaauggaccuacauccaggggcaggcaaaacaaaaagauaucuacccgcaauaguuagagaggcaauaaagagaggauuacgaacccuuauccuagcacccacccgugugguagcugcugaaauggaagaggcuuuacgcggauuaccuauacguuaucaaacuccagcaauaaaagccgagcauaccgggagagaaauuguugaucugaugugucaugcuacuuucacaaugcgguuguuaucaccaguaagaguucccaauuacaaccuuauaaucauggaugaagcucauuucacugacccugcaucaauagcagcucgaggauauauaucaacuagaguggaaaugggagaagcagcuggcauauucaugacugccacgccuccaggaucacgcgacccguuuccccaaaguaaugcaccaaucauggacgaagaaagggagauucccgaaagaagcuggaacucaggucacgaauggguuacagacuuuaaagguaagacaguaugguuugucccguccauaaaagcugguaaugacaucgcagccugucuccgcaaaaaugggaagaaagugauacagcucucgagaaaaaccuucgauuccgaauacguaaaaacuagagcaaacgacugggauuucguugugacaacagauauuucagagaugggugcuaacuuuaaagcugagcgagucauagauccucgucggugcaugaaacccguaauccucacugauggcgaagaaagagugauccuagccggaccaaugccugugacacauucaagugcagcacaacguaggggccgaauuggccgaaacccuaaaaaugaaaaugaucaguacaucuauaugggagaaccauuagagaaugaugaagauugcgcacauuggaaagaagcaaaaauguuauuagauaauauaaauacaccagaagggauuauaccaucaauguucgagccagaaagagaaaagguggacgcuauugauggugaauacagacuuaggggagaggcacguaaaacuuucguugauuuaaugagaagaggcgauuuaccaguuugguuagccuacaaagucgcggcagaagguauaaauuaugcagauaggaaaugguguuuugaugggauuaagaauaaccaaaucuuagaagaaaauguugaaguagaaauuuggacgaaagaaggggaacgcaagaaguugaaaccacgcuggcuugaugcucgcauauacagugacccauuggcacuaaaggaguucaaagaauuugcagcuggaagaaaaagucugacacugaaucugauaaccgaaauggggcgguuaccaacguuuaugacucaaaaagccaggaaugcacuugauaauuuggcaguuuugcauacagcugaggccgguggaagggcauauaaccaugcguuaagugaacuaccggagacacuagaaacacuauuacugcuaacgcuccuagccacuguuaccggagguauuuucuuauucuuaaugagcggaaagggaaucggaaaaaugaccuuaggaauguguugcauuauuaccgcaagcguucuacugugguaugcacaaauacagccucauuggauugcggcguccauaauacuggaguuuuuccugaucguucuauugauacccgagccugaaaagcaacgaacaccacaggauaaucaguuaacuuacgugguaaucgcaauacuuacgguuguagcagcgacgauggcuaaugaaaugggauucuuggagaaaacuaagaaggacuuaggguuaggaaguauaacaacacaggaaccagagucuaacauuuuagauauugaucuucguccugcaucagcguggacgcuauacgcagucgcaacaacuuuugugacacccaugcuacgacauucuauagagaauaguagugugaauguaucgcuaacagcaauagcaaaucaagcaaccguguugaugggauugggaaaggguuggccacuuagcaaaauggacauaggaguuccauuacuagcuauaggauguuauucacagguaaacccaauaacguuaacggcugcacucuuacuacucguagcucauuacgccauuauaggaccaggucuccaggcuaaagcgacccgagaagcacaaaaacgagcggcggcaggaauaaugaaaaauccuacgguggacggaauaacaguuaucgauuuagaaccaauccccuacgauccaaaauuugaaaaacaacuagggcaaguuaugcucuuaauacuuugcgucacacaaguucuuaugaugcgcacaacaugggcuuuaugcgaagccuugacacucgcaacugguccaauaagcacacuaugggaaggaaacccugggagauuuuggaacacaacaauugccguaucuauggcaaacauauuuagaggaaguuaucuagcuggagcaggucuacucuucucaauuaugaagaacacgacuaauacuagaagagguacggggaacaucggagaaacgcuuggagaaaaauggaaaaguagauuaaacgcacuugguaaauccgaauuucagauauauaagaaaucagggauacaagaggucgaucgaacacucgcgaaagaaggcauaaaacguggagaaacagaccaccaugcaguaucuagagguuccgcaaaacugcgaugguucguggaacguaauaugguuacaccagaaggaaaggucguagaccuagguuguggaaggggcgguuggaguuauuacuguggagguuugaaaaacguacgagagguaaaaggcuugacaaaaggaggcccaggacaugaagaaccaauaccuaugucuacguauggauggaacuuaguacggcuucaaucaggcguugauguauucuuuacgcccccagaaaaaugugacaccuuacuaugcgacauaggagaauccucacccaacccuacuauugaagcaggucguaccuuaagaguccuuaaccuaguagaaaauugguuaaauaauaauacucaauucuguaucaaaguguuaaacccguacaugcccagcguuauagagaaaauggagacgcuucagcguaaauacggaggagcauuaguucgaaacccacuaucaagaaauucaacucacgaaauguauuggguaucuaaugcaaccgguaauauuguauccucggugaauaugauaucgaggaugcuaauaaaccgauuuaccaugaaacacaaaaaggcgaccuaugaaccggacguagauuuaggaucagguacuaggaauauuggaaucgaauccgaaauuccuaaucuugacauaauaggcaaaagaauagagaaaaucaaacaagaacaugaaaccucuuggcauuaugaucaagaucacccuuacaaaacuugggcuuaccauggauccuacgagacgaaacaaaccggaagugcaagcucaauggugaacggaguuguacgacuacuaacuaagcccugggauguugugccaaugguaacucagauggcaaugacagauacaacaccauuuggacaacaaagaguuuuuaaagaaaaaguugacacuagaacccaagaaccuaaagaaggcacaaagaaacucaugcgcauaacagcagaauggcuuuggaaagagcuaggaaagaagaaaacaccaagaauguguacaagagaagaauuuacaagaaaagucagaucgaaugccgcguuaggggccaucuucaccgacgagaauaaauggaaaucugcaagggaagcaguugaggauggaagauucugggaacuuguugauagggaaagaaaccuacaucuugaagguaaaugcgaaacaugcguauauaacaugauggguaaaagagagaagaaacugggagaauuugguaaagcaaaaggaucaagagcaaucugguauauguggcuuggagcgagguuucuggaauuugaagccuuggguuucuuaaacgaggaccacugguucucuagagguaauagucuuucaggaguagaaggugaaggauuacauagguugggcuauauauugagagaugucgguaaaaaggaaggaggggccauguacgcggacgacaccgcagggugggauacccgaauaacauuagaagaucucaaaaaugaagaaauggugacgaaucauaugaaaggcgaacauaagaaacuagccgaagcgauauucaaauugaccuaucagaauaaagugguaaggguacaaagaccgacaccaagagguacaguuauggacauaauaagcaggagagaccagaggggaucaggccaaguagguacauacgguuuaaauacuuucaccaauauggaggcacaauuaauuagacagauggaaggagaggguauauuuaaaucuauucagcaccugacaguaaccgaagaaaucgcaguacaaaacuggcuggcccgaguagguagggaacgacuaucuagaauggcuauauccggugaugacugcguuguaaaaccaauugaugauagguuugcaucagcguuaacagcauugaacgacaugggaaaaguacgcaaagauauacaacaaugggagcccucucguggcuggaaugauuggacacaagugcccuucugcucucaucauuuucaugagcucguuaugaaagacgggcgaguccuaguagugccuugcagaaaccaggacgaauuaauuggcagagcgcggauaucacaaggugccgguuggaguuuaaaagaaacagcaugucuaggaaaaagcuaugcucagauguggacauuaauguacuuucaucgaagagauuuacguuuggcugccaaugcgauauguucggcuguaccaagucacuggguaccaaccucccggacaaccuggaguauucaugcuaagcaugaauggaugacaacagaagacauguuagcugucuggaaccggguauggauacaagaaaaccccuggauggaagacaagacuccaguugaauccugggaagaaguaccauaccuugggaaacgagaagaccaguggugcgguucauuaauaggauuaaccucucgugcaacaugggccaaaaauauacaaacagccauuaaccaaguucgaucacucauugggaaugaagaauauacagauuauaugccaucaaugaaaagauuucgccgagaagaagaagaggccgguguacuaugguga

SEQ ID NO: 22659 - RNA, 9876 nt, Artificial Sequence
  derived and/or modified CDS sequence (opt6) from DENV-2__FJ898465__SS-prME
acggcuggggucauuauaaugcuuauaccuacugccauggcguuccaccucacuaccagaaacggagaaccccauaugauuguuggacgacaagaaaaaggaaaaucuuuacuuuucaaaacugaagacggagugaacauguguaccuuaauggcaauagauuuaggagaacucugugaagauacaauaacguacaaaugcccccuauuacggcaaaacgaaccagaagauauagacugcuggugcaauucgaccucuaccugggucacuuaugggacaugcacaaccacaggagaacauaggcgugaaaaacggaguguagcauuagugccucacguugguaugggcuuagaaacgcgcacagaaacauggaugagcagcgaaggggcauggaaacacgugcagcgaaucgaaacuuggauauuacgacacccugguuucgccauaauggcugccauacuagcauauacuauugguacuacucacuuucaaaaagcccuaauuuucaucuuacuaacagccguagcgccguccaugacaaugagauguauagggauaaguaauagagauuuuguugaaggagucucaggaggaucauggguugauauagucuuagaacacgggucguguguaacaacgauggcuaaaaauaaacccacccucgauuuugaacuuauuaaaacugaagcaaaacaaccagcgacacucaggaaauacuguaucgaagcaaaauugacuaauacaacuacagaaucucgaugcccuacacaaggcgaaccaagucugaaugaagaacaagauaaaagguucaucugcaaacacucuaugguagaucgagguuggggaaaugguugcggauuguuuggaaaaggcgggauugucacgugcgccauguuuacauguaagaaaaauauggaagggaaaguuguccuaccggaaaaucuagaauauacaauugucauaacuccccauucaggagaagaacacgcuguuggaaacgauacaggcaaacaugguaaagaaauaaaaaucacuccacaaucauccauuaccgaagcagaacuaaccgguuaugggacaguaaccauggaauguucaccaagaacaggacuagacuucaacgaaaugguacuccuucagauggaagaaaaagccuggcuaguacauagacagugguuuuuagaccucccgcuuccauggcuaccgggugcggauacacaaggaaguaacuggauccaaaaagaaacauuagucacauuuaaaaacccucaugcaaagaaacaagacguuguaguacuaggaagccaggaaggugccaugcacaccgcccuaacaggagcgacagaaauccagaugucgagcgguaauuuauuauuuacaggccaccuaaaaugccgauuaagaauggauaaacuccaauuaaaaggaaugucguauaguaugugcacggggaaauucaaaauuguaaaagaaauagccgaaacacaacaugggacuaucguaaucagggugcaauacgaaggcgacggcagcccuuguaaaauuccuuucgaaaucauggauuuagagaaaagacauguacucgggcgacuuauaacgguuaacccaauuguuacagagaaagacagcccagucaauauugaagccgaaccacccuuuggugauucuuauauaauaaucggaguagaacccggacaacucaaauugaacugguucaagaaaggaucaagcauugggcagauguuugaaacuacaaugaggggagcgaaacgaauggcuauauuaggagauacagcgugggacuuuggcaguuuagggggcguguuuacaaguauugggaaagcacugcaucagguuuuuggggcgauuuacggagcagcuuucucaggaguaucguggacuaugaaaauauugauagggguaauuauaacguggauuggaaugaauaguagaucaaccucccugucugugucucuaguucuagugggagugguaacccucuaucuuggagcuaugguacaagcugauucaggaugcguaguaagcuggaaaaacaaagaguugaaaugugguagcggcauauucaucacugauaacguccauacauggacagaacaauacaaguuucaaccggagucaccuucgaaacuugccagugcaauacaaaaagcgcaugaagaaggcauauguggcauaagaucgguaacgagauuagaaaacuuaauguggaaacaaauuaccccagaauugaaccacauacuaagcgaaaaugaaguuaaauuaaccauuaugacuggagacauuaaggggaucaugcaggcuggaaagcgcucucuacgcccgcaaccgacagaacuaaaguacucuuggaaaacgugggggaaagcaaagaugcugagcacugaaucucacaaccaaacauuuuuaauugacggaccugagaccgcagaauguccgaauacaaaucgggcuuggaacucguuggaaguggaggacuauggguucggaguguuuaguacgaacaucuggcucaaauuaagagaaaaacaagauguauuuugugacucuaaacuuaugucggcugcuauaaaagauaauagggcugugcaugcugauauggguuacuggauugaaagugcacuaaacgacacauggaagauggaaaaagcgucguucauagaaguuaaaucuugucauuggccaaaaucucauacccuauggucgaacggaguucucgaaucagaaaugauaauccccaaaaacuucgcggguccaguaagucagcacaauuaucgaccgggcuaccauacacaaaccgcagguccuuggcauuugggaaaauuagaaauggacuuugacuucugcgaaggcacgacagugguuguaacagaagauugcggaaacaggggcccaucacuucguacgacuacagcaucggguaaacucaucacugaauggugcuguagaaguuguacgcuaccacccuuacgguauagaggcgaagauggaugcugguaugguauggaaauucgcccuuuaaaagaaaaagaagaaaaucugguaaacucccuggucaccgcggggcauggacaaauugacaacuucagccucggaguauuagguauggcccuauuccuugaggagaugcugaggacccgaguaggaacgaaacacgccauguuacuuguggcuguuucauucgucacacuaaucacaggcaauaugucauuccgggauuuaggucgaguuauggucaugguaggcgcaacuaugaccgaugauauagggaugggaguaacuuacuuagcacuauuagcagcauuuaaaguaagaccaacuuucgcagcaggacugcuucuacguaagcuaacauccaaagaacuaaugauggcaacaauaggcauagcucuuuuaucucagaguacaauuccugaaacaaucuuggaacuaaccgacgcacuagcccuagguaugaugguucugaaaauugucagaaauauggaaaacuaucagcuugcuguaacaauaauggccauaucaugcgucccgaaugcaguuaucuuauuaaaugccuggaaagucagcuguaccauauuagcggcuguaucagucucucccuugcuuuuaacgucaucucaacaaaaagcugacuggauaccacuggcgcuaacaauuaagggacuuaaccccaccgcgaucuuccuaacuacuuugucgcguacgucgaagaaaagaucguggcccuugaacgaagcuguuauggcaguggguaugguauccauucuagcuaguagcuuacuuaaaaaugacauacccaugacuggaccucuaguagccggcggucuacucacugugugcuacguacuuacugggagaucagcugauuuggaacuagaaagagcagcugauguaaaaugggaggaccacgcugagaucagcgguucuucgccaauacuuucaauuacaauaucggaagauggauccaugucuaucaaaaacgaagaagaggaacagacacuaacaauccuuauccgcacuggccuauugguuaucucgggaguauuucccgucagcauaccgauaaccgccgcugcuugguaucuaugggaagucaagaaacaacgcgcaggcguuuuaugggacgucccaaguccaccacccguggggaaggccgagcuagaagauggagcauaucggauaaaacaaagggguauccuaggauacucucaaauaggagcaggcguauacaaagagggaacauuccauacgauguggcacguuaccagaggagccguucuaaugcaccgcgguaaaagaauugaaccgucaugggcggacgucaagaaagauuuaauuucuuacggaggaggcuggaaauuagaaggugaauggaaagaaggagaggaagugcaaguauuggcacuagaaccaggcaaaaaucccagagcagugcaaacuaagccaggacuauucaaaaccaauacgggaacaauaggcgcgguaucauuagauuuuaguccgggaacaucuggaucgccaaucguagauagaaaaggaaaagucguggguuuauaugggaacgggguaguaacgcggaguggugcauacguaucagcuauagcacaaacagagaaaagcauugaagauaacccugaaaucgaggacgacauauuucgaaagaaaagauuaaccauuauggauuuacauccaggagcggggaaaacaaaacgguauuuaccggcuauagucagggaggccauaaaaagagguuugcguacauugauauuagcgccaaccagagugguagcugcagaaauggaagaggcucucagaggauuaccaauucgguaccaaacuccagccauucgagcggaacacacugguagagaaaucgucgaucuaaugugucaugcuaccuucacaaugagacuauuaagcccagugagagucccaaauuacaaucuaauaauaauggaugaagcacauuuuacggauccagcuucaauagcagcaagaggcuacauauccacucgggucgaaaugggggaggcugcugguauauuuaugacggcaacuccuccggggucacgugauccguuuccucaaucgaacgcaccuaucauggaugaagaacgcgaaauccccgaaaggagcuggaacuccgggcaugaauggguaaccgacuucaaaggaaaaacagucugguuuguucccucaauaaaagcagggaaugacauagcggcuuguuuaaggaaaaacgguaagaaaguaauacaauuaagcaggaaaacauuugauucagaauaugucaaaacaagagcaaaugacugggacuuugucguaacgacugacauuagugaaaugggagcaaacuucagggcagagaggguaaucgauccgagacgcugcaugaaaccuguuauucuaacugauggagaagaacgaguaaucuuggccgguccaaugccaguuacucauaguuccgccgcccaacgccguggacggaucggacgaaauccgaaaaaugaaaaugaucaguacauuuauaugggagaaccguuagaaaaugaugaagauugcgcucauuggaaagaagcaaaaauguuauuggauaauauuaacacucccgaaggaauuauaccuucgauguuugagccagaaagagaaaaaguagaugccauagauggugaauaccgguugagaggcgaggcccggaaaacauucguugauuuaaugagacguggagaucuucccguauggcuagcauauaggguggcggccgaaggaauuaauuacgcagacagaagaugguguuuugacgguauuaagaacaaucaaauacucgaagagaauguagaaguggaaauauggacaaaagaaggagaacgaaagaagcuaaaacccagauggcuugaugcaagaauauauagcgauccucuagcguugaaagaguucaaagaguucgcagcaggucguaaaagucuuacguugaaucuaauaacggaaaugggucgcuugcccacuuuuaugacccagaaagcgcgagacgcgcucgacaaccucgccguccuucauacugcggaagcaggaggucgcgcguauaaucaugcacucagugaacuaccugagacacuggaaacccuccuguuacuuacauuacuagcuaccgugacuggagggauauuccucuuccuuaugucgggaaaggguauugguaaaaugacauuagguauguguuguauaauaacugcuuccauucuccucugguacgcccaaauucagccacauuggauugcagcuuccauaauccucgaguucuucuuaaucguacuucucauacccgaaccggagaaacagcguacaccccaagacaaccaauuaacuuacguaguaauagcgauucucacagugguagcugcgacaauggcaaacgaaaugggauuucuagagaaaacuaaaaaggaucucggccuuggaucuauaacaacacaggaaucagaaucaaacauucuggacauugauuugagaccagcaucagcuuggacgcuauaugccguagcaacuacauucguaacaccuaugcuuagacauagcauugaaaauagcuccguuaacguaagucuaacagcaauugcuaaucaagccacaguuuuaaugggauuggggaaaggguggcccuuauccaaaauggauauaggagucccuuuauuagccauaggauguuauucucaagucaauccgauaacacucacugcagcucuacuacuccuuguagcacauuacgccauuauugggccaggacuccaagcgaaggcuacaagagaagcacaaaagcgcgcagcagcggggauuaugaaaaaccccacaguagacgguauaacaguaaucgauuuggagccaauuccguacgacccuaaauucgaaaaacaauuaggucaaguaaugcuacuaauuuuaugcguaacucaagugcuaaugaugcggacaaccugggcauugugcgaagcccuuacguuggcgacaggaccaauaucuacacuaugggaaggaaauccgggccgguucuggaacacaacaauugcaguauccauggccaauaucuuucgagggaguuaucuugcaggagcgggucuacuuuuuagcauaaugaaaaacacaacuaauacacgccgaggcaccggaaacauaggagaaacacuaggugaaaaguggaaaucacgcuuaaacgcucuagggaaaucggaguuccaaauauacaagaaaucagguauccaggaaguagacaggacccucgcgaaagaagggauuaaaagaggugagaccgaucaccaugcagucucucgaggaagugcgaaauuacgaugguuuguagaacgaaauaugguuacgccagaggguaagguaguagaucuuggcuguggacgcggugguuggucauauuauugcggcggucuuaaaaauguacgugagguaaagggccuaacuaagggagguccgggucaugaagaaccaaucccuauguccacuuacggauggaaccuaguaagacuacaaagugggguugacguguuuuucacaccacccgagaagugugauacacuauuaugcgacauaggugaaagcucccccaaucccacuaucgaagcaggaaggacguuacgaguuuuaaauuuaguggaaaauuggcuaaauaauaauacgcaauuuuguauuaaaguacucaaccccuauaugccaucuguuauugagaaaauggagacgcuccaacgaaaguauggaggggcucuaguaagaaauccuuugucccgcaauucuacacacgagauguauuggguauccaaugcaacugguaauauagucaguucuguaaauaugaucucacgcaugcuaauuaauagauuuacuaugaaacacaagaaagcaacauacgaaccugauguggacuuagguagugguacgcgcaauauaggaauagaaagugagaucccaaaucuggacauaaucgguaaaaggaucgagaaaauaaaacaagaacacgaaacaucuuggcacuaugaucaagaucacccauauaaaacaugggcguaccauggaaguuaugaaacaaaacagacuggaagcgcgagcucaaugguaaauggcguuguuagauuacucaccaaaccuugggauguaguccccauggugacacaaauggcaaugacugauacaacuccauucggacaacaaagaguauucaaggaaaaaguagauacgaggacucaggaaccaaaggaagggacuaagaaauuaaugcgaauuacagcagaaugguuauggaaagaauuagggaaaaagaaaacaccccgaaugugcacgcgcgaagaguucacacgaaaggugagauccaacgcagccuugggugcuaucuuuacagacgagaauaaauggaaaucagcucgagaagcaguggaagauuccagguuuugggaacugguagaucgagagcgaaaccuacaucuggaggggaagugcgaaacuugcguauauaauaugauggguaaaagagagaagaaauuaggugaauuuggaaaagcaaaaggcaguagagcaauaugguauauguggcuuggugcgagguuucuagaauuugaggcuuugggcuucuuaaaugaagaccacugguuuucacguggaaauucacuaaguggugucgagggggaaggacuucacagacuaggauacauacuacgcgauguuaguaagaaagaaggaggugccauguaugcugaugacacagcaggaugggacacucgaauaacccuugaagaccuaaagaacgaggagauggugacaaaucauaugaaaggcgaacauaagaaauuagcagaagcaaucuucaaacuaacguaccaaaacaaaguaguaagaguccaaaggccaacgcccagagguacagugauggacauaauaaguaggcgugaccaacgcggcucuggacaaguagggacauaugggcuaaauacauucacaaauauggaggcacaacuuauacgacaaauggaaggagaaggaauauucaaaagcauacaacacuugacaguaaccgaagaaauagcaguucaaaacugguuagcaagagucgggagagaacgauuaaguagaauggcuaucaguggcgaugauuguguaguaaaaccauuagacgacagauucgcaucugcacuaacugcguuaaaugauaugggcaaggugcggaaggacauccaacaaugggaaccaucaagaggauggaaugacuggacccagguacccuuuuguucucaucacuuccacgaguuggucaugaaagauggaagaguucugguugucccuugucgcaaucaagacgaacuaauagguagagcgcgcauuagccagggggcugguuggagcuuaaaagaaacagccugucuggggaagucguacgcccagauguggacacuaauguacuuccaccgucgagaccuaagacuagcugccaacgcgaucugcuccgcuguaccaucucauuggguaccaacaucaagaacuacauggucuauacaugcaaaacaugaguggaugacaacagaagauaugcuggcuguuuggaaccguguauggauacaagaaaauccuuggauggaagauaaaacaccagucgaaucaugggaagaaguuccuuaucuaggaaagagagaagaucaaugguguggaagucuaaucggacuuacaaguagggccaccugggcaaagaauauccaaacagcaauaaaucagguuaggucccugauaggcaacgaggaauacacagacuacaugccaucgaugaaaagauuccgcagggaggaagaggaggcugguguauuaugguaa

SEQ ID NO: 22660 - RNA, 9876 nt, Artificial Sequence
  derived and/or modified CDS sequence (opt6) from DENV-2__FJ898466__SS-prME
accgcaggaguuauaguaauguuaauaccaacugcaauggcauuucaucuaaccacuagaaauggugaaccgcauaugaucguugggagacaagaaaaaggaaaaucacuccuuuucaaaacggaagacgggguaaauauguguacacuaauggcaauugauuuaggcgaacuaugcgaagauaccauaaccuauaaaugcccauuacuaagacagaaugaaccugaagauauagacuguugguguaauucgacaaguacuugggucacguaugguacaugcacgacaacuggggaacacagacgagagaaaaggucaguagcauugguuccccacgugggaaugggcuuagaaaccagaacagaaacauggaugucgagcgaaggcgcauggaaacauguacaacgaauagaaacuuggauacugcggcacccaggauucacaaucauggcugcaauacuugcauacacaauagguacuacucacuuccaaagagcuuuaauauucauccuauuaacggcaguagcccccucaaugacaaugagauguaucggaauuuccaaccgcgacuuugucgaagggguaucuggaggcucauggguugauauuguauuagaacacggaucaugugugacuacgauggcuaaaaauaaaccaacucuugauuuugaauuaauuaaaacugaagcaaaacaaccggcgacauuaagaaaauacugcauugaagcgaaauuaacaaacaccacuacggaaucaagauguccuacucaaggagagccuucucuuaaugaagaacaggauaaaagguuuauaugcaaacacuccaugguggacagggguuggggaaaugggugcggauuauucgggaaaggaggaauuguuacaugugcgauguuuacauguaagaaaaauauggaggguaaaguagugcagccagaaaaccuggaauacacaaucguaauuacaccgcacaguggagaagaacacgcuguuggaaaugacacaggcaaacaugggaaagaaauaaaaauuacaccucaaaguaguauuacagaggcagagcucacaggauauggaacagucacaauggaauguucaccacgaacaggacucgauuuuaaugaaaugguacuacuacaaauggaagacaaagcgugguugguacauagacagugguuucuagaccuaccccuaccauggcuacccggggcagauacccaaggauccaauuggauacaaaaagaaacauuaguaacauuuaaaaauccacaugcgaagaaacaagacguaguuguguuaggaagucaagaaggagcgaugcacacggcuuugaccggugcuacagagauacaaaugaguagugguaauuuacuuuucacaggccacuuaaaauguagacuaaggauggauaaauuacaguuaaaaggaaugucauauucuauguguaccgguaaauucaagauaguaaaagaaauagcugaaacgcaacacggaacaauuguaauuagagugcaauaugagggcgaugguaguccauguaagauaccuuucgaaauaacugaccuagagaaaaggcauguguugggcagacuuaucaccguuaauccaauaguaaccgaaaaagauuccccaguaaacaucgaggcugaaccaccauuuggagauuccuauauaauaaucggcguugagccuggucaacuaaaacucaauugguuuaagaaagguucaucaauuggacaaauguucgaaacaacaaugagaggggcaaaacgcauggcgauacuuggagacaccgcaugggauuucgguucucuaggagguguuuuuacaucuaucggaaaagccuuacaccaagucuuuggugccauuuauggagcagcauucucaggaguaucauggaccaugaagaucuuaauuggggucauaauuacauggauagguaugaacucucggaguacuucucuaagugugucuuuaguucuaguagguguuguaacguuauauuuaggugcaauggugcaggcagauucagguuguguagugaguuggaaaaacaaagaguuaaaaugcggaucagggauuuuuauuacugauaauguacacacauggacagagcaauacaaauuccaaccugaaucgccgucuaaacuugccucagcgauccagcgagcucaugaagaagggauauguggaauaagaucgguaaccagacuagaaaacuuaauguggaaacagauuacaccagaacucaaccauauacuaagugaaaaugaggugaaacuaacaauaaugacaggugauacgaaagguauaaugcaggcagguaaacgaucacugagaccucaaccuacugaacuuaaguauucauggaagacuuggggaaaggcaaaaauguugucgacugaaagucacaaucaaacuuuucuuaucgacggccccgagaccgcagaaugcccuaauacaaauagagcauggaacucacuugaaguagaagacuauggauucggaguauucacgaccaacauuuggcuuaaauugagagagaagcaggauauauucugcgauagcaaacucauguccgcagccauaaaggacaacagggcaguccacgcagacauggguuauuggaucgagucagccuugaaugacacguggaaaauggaaaaggcuucauucauugaagugaaaucuugucacuggccaaaaagucauacacuuugguccaacggggucuuagagagcgaaaugauaauaccuaagaacuuugcagguccugucucucaacacaacuacaggccuggauaucauacgcagaccgccggaccguggcaucuaggaaagcuagaaauggacuuugauuucugcgaagguacaaccgucguaguaacugaagauuguggcaacaggggcccaucucuucgaaccacuacugcuucaggaaagcucauaacggaauggugcuguaggagcugcacauuacccccacuucgauaccggggcgaggaugguugcugguacgguauggaaauucgaccauugaaggagaaagaagaaaauuugguaaauucauuaguaacugcaggucauggucaaauagauaauuucaguuuagguguguugggaauggcacucuuuuuagaggagauguuaaggacacgugugggaacuaaacacgcaauacuauuaguugccguaaguuuuguaacucuuaucacaggaaauauguccuuuagggaucuggguaggguuaugguaaugguuggcgcuacgaugacugacgacauuggaaugggagugacauauuuagcuuugcucgcugcguucaaggugaggcccacguuugcugcugggcuauuauuacgaaagcugacaaguaaagaacuaaugauggccacaauugggauagcacuacucagucaaaguacuauacccgaaacuauccucgaacuaacggaugcauuagcguuggggaugauggcacuaaagauaguaaggaacauggaaaaauaucaacuagcaguuacaauuauggcuauuaguugcgugccgaaugcagucauucuucaaaacgcauggaaaguuucuugcacaauucuugcagcuguaaguguuucuccacugcuauugacaucgucgcaacaaaaagccgauuggauuccgcuugcuuuaacuauaaaagguuugaaucccacagcaaucuuucugacuacacuuucgcgcacgucaaagaaacguaguuggccacugaaugaagcaauuauggccgugggaaugguguccauuuuagcuucgucacugcuaaagaacgacauccccaugaccgggccguuaguggcaggcgguuuacuuacgguaugcuauguucuaacaggacguucagcugaucuugagcuagaaagagcugcagauguuaaaugggaagaucaggcagagauuaguggaaguucgccaauacugaguauuacuauaagcgaagauggaucaaugucaaucaaaaaugaagaagaagaacaaacacucaccauucugauaagaacugggcuucuaguuauaucuggcguguuuccgguuucaauuccuauaacagcugccgcaugguaccuuugggaggucaagaaacaacgugcgggaguuuuaugggacgugccaucacccccuccagucgguaaagcagaacuugaagauggcgcauauagaauaaaacagcgugguaucuuaggguauagucaaauuggagccgggguuuauaaagaggguacauuccauacaauguggcacguaacgagaggcgccguucuaaugcacaggggaaaacggauagaaccgagcugggccgauguaaagaaagaccuaauuagcuauggaggcggauggaaauuagaaggggaguggaaagaaggggaagaagugcaaguauuggcacucgaacccggaaagaauccucgagcagugcagacuaaaccggguauauuuagaacaaauacagggaccauaggugcagugucuuuagauuuuaguccaggaaccagcgggucaccaaucguagaucgcaaaggaaaaguaguuggucuuuacgggaaugguguaguaacccggucuggggcuuacgucagugcuauugcccaaacagaaaaaucaauagaagacaacccagaaauagaagaugacauauucagaaagaaacgacuaacaaucauggaucuacacccgggggcaggaaaaacuaaaagauacuuacccgcaauagugcgagaagcaauaaagcgaggauugcggacauuaaucuuggcaccuacuagaguaguggcggcugaaauggaagaagcauuaaggggacucccuaucagauaucaaacuccggcgauuaaagcggaacacacgggaagagaaauaguugaucuuaugugucaugcuacauuuacaaugagguuacuaaguccaguaagagugccaaauuauaauuuaauaaucauggaugaagcccacuucacagacccagcgucaauugcggcaagaggauauauuucuacaagaguugagaugggcgaagcagcagguauauuuaugacggcgacucccccuggaucuagagauccauuuccucaaucuaacgccccgauaauggaugaagaacgugagauacccgagcgaucauggaacucagggcacgagugggucacugacuuuaaagguaaaacagugugguucgucccaucgauaaaggcaggcaacgacauagcggcaugcuugaggaaaaaugggaagaaaguuauucagcugaguagaaagacauuugacagcgaauacguaaagaccagagcaaacgauugggauuuuguaguaaccacagauauuagcgaaaugggagcaaauuuuaaggcugaacguguuauugauccacggcguuguaugaaaccaguaauucuaaccgacggagaagaaagaguaauacuggcagguccgaugccaguaacacauucaagcgcugcacagaggagggggagaauugguagaaaccccaaaaacgaaaaugaucaauauauauauaugggagaaccacuugaaaaugaugaagacugugcucauuggaaagaggcuaaaaugcuauuagacaacauaaauacacccgaaggaauaauuccuucaauguuugaacccgaaagagagaaaguagaugcaauagacggcgaauauagacugcggggugaggcuaggaaaaccuuuguugaccuaaugagaagaggugauuugcccguauggcuagcauauaaaguagcagcagaggguauaaauuaugcggaucguaaauggugcuuugacgguaucaaaaauaaccagauacuagaagagaacguagagguggaaauauggaccaaagagggcgagaggaagaaacucaagccaagaugguuagaugcacgaauauauagugauccgcuagcacuuaaggaauuuaaagaguucgcggcagggagaaaaucauuaacgcuaaaucuaauaacugaaaugggccgguugccaacauuuaugacacagaaagcuaggaaugccuuagauaaccuugcaguccuacacacagcagaagcuggaggcagagcauauaaucacgcccucagugagcuacccgaaacgcuugagacgcugcuguuacuaacacuuuuggcuaccguaacaggaggaauauuccuauuuuugaugagugggaaggggauuggaaaaaugacauuagggauguguuguaucauaacagcuaguaucuuacuaugguaugcacaaauucaaccccauuggauagccgcuaguauuauacuagaguucuuccuaauaguguugcuaauaccagaaccagaaaaacaacgaacaccacaagauaaccaauugacauauguuguuauugcaauuuuaacagugguagcagcaacaauggcaaacgagaugggauuucuagagaaaacuaaaaaggaccuaggguugggaucaauuacuacucaagagagcgagaguaacauccuggacaucgaccuccguccagccucagccuggacauuguaugcaguagcuaccaccuuuauaacgccaaugcuuagacauucuauugagaacaguucaguaaaugucucccuaaccgcaauugcgaaccaggccaccguuuuaaugggauuagggaaaggauggccccuaaguaaaauggacauuggaguaccauuacuagcuauagguuguuacagucaagucaacccuauuacacuaaccgcugccuuguuacugcuuguagcacauuaugcaauuauuggaccagguuuacaagcaaaagcaacgcgugaagcccaaaagcgugcugcagcaggaauuaugaaaaauccaacaguagauggaauaacugugauugacuuagaaccuauccccuaugacccuaaauuugaaaaacaacuaggucaagucauguuauuaauccugugcguaacccaaguucucaugaugcguacaacuugggcauuaugugaggcauuaaccuuagcuacagguccuauuuccacccuuugggaaggaaacccaggucguuucuggaauacuaccauugcuguauccauggcuaacauuuuuagaggcucauaccuggcgggagccggucuauuauucucuauaaugaaaaauacaacaaacacuagacgaggaacgggcaauauuggagaaacauugggggagaaauggaaaagcagguuaaaugcucuuggaaaaucagaguuccagauauacaaaaagaguggcauucaagaaguagacagaacauuagccaaagaagguaucaaaagaggggaaacugaucaccaugccgucagucgcggaucugcaaaauugagaugguuuguggaaagaaacaugguaacaccagaagguaaggucguggauuuaggcugugggagagggggauggagcuauuauugcggaggucuuaagaacguaagggaaguaaaggggcuaacaaagggagggcccggucaugaggaaccaauccccaugucuaccuacggauggaacuuaguaagauuacagaguggagucgauguguucuuuacacccccagagaaaugugauacucuccuaugugauauaggagagucuagcccaaacccaacaauagaagccggucggacguuaaggguauugaaucuuguagagaacuggcugaacaacaacacacaauuuuguauaaaaguuuuaaauccauacaugcccucaguaauugaaaagauggagacauuacagaggaaauacggcggcgcccuagugaggaauccacuuucacgaaacuccacccacgagauguacuggguuucgaacgcuacagggaauaucgucucaucgguaaauaugauaucgagaaugcuaauaaauagguucacaaugaaacauaagaaagcaaccuaugaaccagaugucgaucugggcucagggacaagaaacauagggauagagucagagauaccaaaucucgauauaaucggaaaacgaaucgagaaaauaaaacaagagcacgaaaccuccuggcauuacgaucaagaccaucccuacaaaaccugggcauaucacgguagcuaugaaacgaagcaaacaggaagugcuagcagcauggugaacggugugguaaggcuguuaacgaagccuugggauguaguacccaugguaacucaaauggcaaugacagauacuaccccguuugggcagcagagaguauuuaaagagaaagucgauacuagaacgcaagagccaaaagaagggaccaagaaauuaaugaaaaucaccgcagaauggcucuggaaagaguugggaaagaggaaaacaccacgaaugugcaccagagaagaauuuacuaaaaagguaagaucaaacgcugcacuaggagccaucuucacagaugagaauaaauggaaaagcgcaagagaagcgguagaagacggaagauuuugggaauuaguugauagagaaaggaaucuucaccuggaagguaaaugugaaaccugcguauauaauaugaugggaaaaagagagaagaaacuaggugaguuugguaaagcgaaaggaagucgagcuauuugguauauguggcucggagccagauuuuuggaguucgaggcucugggauuucugaacgaggaucacugguucucaagagguaacucccucucaggaguugaaggggaaggacugcaucgacuaggcuacauccuuagggauguugggaagaaagaaggaggggcgauguaugccgaugacaccgccgguugggauacacgaauuacacuugaggaucucaaaaaugaagagaugguaacaaaucacaugaaaggcgagcacaagaaauuagcugaagcaauauucaaauuaacuuaccagaauaagguaguaagggugcagaggcccacaccacguggaacaguaauggacaucauaagcagacgagaccaaagaggaucaggccaaguaggcaccuacgggcuuaauaccuuuacaaacauggaggcgcaacugauaagacagauggaaggagagggaauauucaaaaguauucagcaccugacggcuaccgaagagaucgcuguucagaauuggcuggcuagaguagggagagagagauuaucaaggauggcaaucuccggagaugauuguguugucaaaccgauagacgauagguuugcaagcgccuuaacagcauuaaacgacauggguaaaguacgaaaagauauccaacaaugggaacccucaagaggauggaacgacuggacucaaguacccuuuugcucacaucauuuucaugaauugguaaugaaagacggacggguauugguaguacccugcagaagccaagaugagcuaauuggacgugcacgcauaucucaaggggcggguugguccuuaaaggaaaccgccugucuggggaaaucguacgcccaaauguggacuuuaauguacuuccaccgaagagauuuaagguuagcggcuaaugcgauaugcucagcuguuccaagccacuggguaccaaccucgaggacgaccuggucgauacacgcgaaacacgaauggaugaccacagaagauaugcuagcaguuuggaaucggguguggauucaagaaaauccguggauggaggacaagaccccaguggaaucgugggaagaagucccuuaccucggaaaacgugaagaccaauggugcggcucacuaauaggucuaacaagccgggcaacuugggccaaaaauauccagacugcaauaaaucaagucagauccuuaauaggaaaugaagaauacacagacuauaugcccagcaugaaacguuucagaagggaagaagaagaagccggaguacuuugguga

SEQ ID NO: 22661 - RNA, 9876 nt, Artificial Sequence
  derived and/or modified CDS sequence (opt6) from DENV-2__FJ898467__SS-prME
acugcggggguaauaauuauguuaauaccgacugcaauggcauuccaucuaacuacacgaaauggggaaccucauaugauagucggacgccaagaaaaagggaaaucucuacuauucaaaacggaagacggggugaauauguguacacuuauggccauagaucucggagaacuaugcgaagauacgauaacuuauaaauguccuuuacucaggcaaaaugaaccugaagacauagauugcugguguaauaguacaucuacaugggugacuuauggaacaugcacaacuacaggugaacacagaagagaaaaacgaucaguggcauuagugccucauguagggauggguuuagaaacacgcacugaaaccuggaugucaucagaaggcgcauggaaacacgugcaacguauagaaaccuggauccuccgacacccaggcuucacaauaauggcagccauacucgcauauacaauaggaaccacacauuuucaacgggcccugauauucaucuuacuaaccgcagucgcaccaucuaugacaaugcgaugcauuggcaucucaaaccgggauuucguugaaggcguuagcggaggaucuuggguugauauuguucuugaacauggaaguuguguaacaacaauggccaaaaauaaacccacacuugacuuugaacuuaucaaaacugaagcaaaacaaccagcaacauuaaggaaauauuguauagaagccaaacuaacaaacacaacaacggaauccaggugcccaacucaaggcgaaccaucacuaaaugaagaacaagauaaaagauuuauaugcaaacauagcaugguagacagagguuggggaaauggaugcggcuuauuuggcaaaggaggaauaguuacaugcgcaauguuuacgugcaagaaaaauauggaaggcaaaguaguccagccggaaaaucuugaguacacuauuguuauaacaccucacaguggcgaagaacacgccgugggaaaugacacaggcaaacaugguaaggaaauuaaaauuacaccucaaagcucgaucacagaagcugaauuaacaggauacggcacuguaacaauggaaugcuccccuaggacgggucuagauuuuaacgaaauggugcuacuacagauggaagauaaagcgugguuaguacaccggcagugguuucuagauuuaccucucccguggcugcccggagcugacacacagggaucuaauuggauacaaaaagaaacauuaguuacuuuuaaaaauccccacgccaagaagcaagaugugguaguauuaggaagucaggaaggugcaaugcauaccgcauuaaccggggccacagaaauucaaaugaguucaggaaauuugcuuuuuacaggucaccuaaagugucgauuacgaauggauaagcuccaguuaaaggggaugucguauagcaugugcacgggcaaauuuaaaauagucaaagaaauagcugaaacucaacauggaacaauugugauuagaauacaauacgaaggcgauggaucucccugcaagauaccauuugaaauuacagaucuggaaaaacgacauguucuaggccgcuuaaucacaguaaaccccauaguaaucgagaaagauucuccgguaaauauagaagcagaacccccauucggcgauagcuacauaauuauugguguagaaccaggacaauugaagcucaauugguuuaagaaagggucgucaaucgggcaaauguuugaaacuacuaugagaggcgcaaaacgaauggcaauauuaggagauacagcaugggacuucggaagccucggagggguuuuuacaucgauagggaaagcucuccaccaagucuuuggagcuauuuauggcgcagcauuuucgggaguaucauggacuaugaaaauccuaauuggcguuguaauuacuuggauugguaugaauagcagaaguacaagucuuucagucucuuuggugcucgugggaguaguaacccuguacuuaggcgcaauggugcaagcagauuccggaugcgugguaucauggaaaaauaaagaacucaaaugcggaucagguaucuucauuacugauaauguacacaccuggacagaacaauauaaguuucagccugaguccccuucgaaacuggcaucagcaauucaaaaggcgcaugaagagggaauuuguggaauaagaagugucacacgauuggaaaacuuaauguggaaacaaaucaccccggagcugaaccacauucuaucggaaaaugaaguaaaguuaacaauaaugaccggagacacuaaagguauaaugcaagcagggaagcgcagccuaagaccucaaccaacggagcugaaauauaguuggaaaacaugggguaaggcaaaaaugcuaaguacugagagccacaaucaaacauuuuuaauugacggcccugaaacagcggaaugccccaauaccaaucgugcauggaacucuuuggaaguugaggauuacgguuucgggguguucacuacaaauaucuggcuuaaacuuagggaaaagcaagacguauuuugugacuccaaacugauguccgcagcaauuaaggauaacagagcugugcaugcugacaugggauauuggauagaaucagcucucaaugauacauggaaaauggaaaaagccaguuuuauagaaguaaagucuugucacuggccaaagucucauacuuuguggaguaauggaguauuggaaucugagaugauuauccccaaaaacuuugccggaccagugucacaacacaauuaccgaccgggauaccacacacaaacggcaggaccuuggcaucuuggcaaacuugaaauggacuuugauuucugugaaggaacaacaguaguuguuacggaggacugugguaauagggguccaucacuacggacuacgacugccucgggcaaacucauaacagaaugguguugucgcagcugcacucuaccaccccuaagauaccgaggagaagauggauguugguauggaauggagauuaggccacugaaagagaaggaagaaaauuuaguaaacuccuugguaacagccggacacggacagauugauaauuucucacuagggguauuaggaauggcacuauuucucgaagagauguuacgaacuaggguaggaacgaaacaugcaauauuauuggucgccguaucauucguuaccuuaauuacugggaauaugucauuucgcgauuuaggucgggugaugguaauggugggagcuacuaugacagaugauauagguaugggagugacauaucuugcuuuacuugcagcguuuaaaguaaggccgacauuugccgcuggauuacuguugaggaaauugacuuccaaagaacugaugauggcuacuauaggcauaacacugcuaucccaaaguacaaucccagaaacuauacuagaacuuacagaugcacuugcauuaggaaugaugguucuaaagaucgucagaaacauggaaaaguaucagcuagcggucaccauuauggcaauuucguguguccccaacgcuguuaucuuacggaaugccuggaagguaucaugcacaauacucgcugcuguaucuguaucaccacuauuauuaacguccagucaacaaaaagcggauuggauuccacuggcacuaaccauaaaaggacugaaccccacugcaaucuuucuuacuacguuaagccguaccagcaagaaaagaagcuggccuuuaaacgaagcuaucauggcaguugguaugguaucaauccuagcgaguucacuucucaaaaaugauauucccaugacggguccauuaguagcaggagguuugcuuacugucugcuaugugcuuacaggucguagugcugaucuagagcucgagcgugcagcugauguaaagugggaagaccaagcagaaauuucaggcucaagcccgauacucucaauuacuauaucggaagauggaucaaugaguaucaaaaaugaagaagaagaacaaacuuugacuaucuugauccggacaggacuccuagucauaagcggcguauuuccagugaguauaccuauaacugcggcagcuugguaucuaugggaggucaagaaacaacgcgcagggguauuaugggacgugccgaguccuccaccuguaggaaaagcagaauuagaagacggagccuacagaauaaagcaaagggggauucuuggauacagccaaauuggagccggcgucuauaaagagggaaccuuucacacaauguggcacgucacacggggugcaguguuaaugcacagaggaaaaaggauagagccuucuugggcggacguuaagaaagacuuaauaucuuauggcgguggguggaaauuagaaggggaguggaaagagggagaagaaguacagguauuagccuuagaaccggguaaaaacccccgagcgguucagacaaaaccuggaauuuuuaagacaaauacaggaacuauuggcgccgucaguuuggauuucucgcccggaaccucagguagccccauuguagaucgcaaggguaaaguaguaggauuauaugguaacggagugguaaccagaagcggagcuuaugugagcgccauagcacaaaccgagaaaaguauagaggauaacccugaaauagaagaugauauauuccggaaaaagcgacucacgauaauggacuuacauccaggugcugguaaaacaaagagguaccugccagcaaucguaagggaagcuaucaagagaggauugcgaacacuuauauuggcacccaccaggguuguggcagcggaaauggaagaagcauuacggggucuucccauacgcuaccaaacuccugcuauuaaagccgagcauacuggcagagaaaucguagaucuuaugugucaugcgaccuuuaccaugcgguuacuaagcccuguaagagucccuaauuacaaucuaauaauaauggaugaagcccacuuuacugaccccgcgagcauagcugcacguggguauauauccaccaggguugaaaugggagaggcagcaggaauauuuaugacugcuacaccaccaggaagccgugaucccuuuccacaaagcaacgcuccgaucauggacgaggagcgggaaauaccugagagaucauggaauaguggacacgaauggguaacagacuucaaaggcaaaacaguuugguucguuccaucaauuaaagcuggaaacgauaucgcagcgugcuuaagaaagaacggaaagaaaguuauacagcuuuccagaaaaacguuugacucagaauaugugaaaacacgagcgaaugacugggauuuugugguuacuacagauauuucggaaaugggugcuaauuucaaagcagaaagaguuaucgacccaagacgaugcaugaaacccguuauacuuacugauggcgaagaacguguaauacucgcuggcccaaugccgguaacucacucaucagcagcacagagaaggggacgcauaggucgaaaucccaaaaaugaaaaugaucaauacauuuacaugggggagccuuuggagaaugacgaagauugcgcucauuggaaagaggcgaaaauguuauuggacaacauuaauacaccagaaggaauuauccccucgauguucgagccagaacgugagaaaguugaugcaauugauggagaauauagguuaagaggagaagcaagaaaaacauucguugaucuaaugagaagaggagacuuacccguauggcuugcguauaaaguagcagcagaagggauaaauuacgccgacagaaaaugguguuuugacggaaucaaaaacaaucagauucuagaagaaaacguagagguagaaauuuggacaaaagaaggugaaagaaagaaacucaaaccacgcugguuagaugccagaauauauucggaccccuuggcgcucaaggaauuuaaagaguucgcggcagguaggaaaucuuugacgcugaaccuaauaacggaaauggggaggcugccuacuuuuaugacacaaaaggcacguaaugcccuagacaaccucgcugucuuacauacagccgaggccggagguaaagcauacaaccaugcguuaucugaacuacccgaaacccuugaaaccuuauugcuauuaacacuucuagcaacugucacaggaggaauuuucuuguuuuugaugucgggaaaagguauagguaaaaugacuuuagguaugugcugcauaaucacagcaucugugcugcucugguacgcgcagauacaaccccauuggaucgcugcgagcauaauucucgaauuuuucuugauaguauuacuuaucccugagccagaaaagcagagaacaccgcaagauaaucaauuaacuuaugucgucauugcaauuuuaacagucguugcggcuacaauggcgaacgaaauggguuuccuugagaaaaccaagaaagauuuagguuuaggauccauuacuacucaagagucagaaucaaauauccuagacauagaucuaagacccgcaucugcuuggacacucuaugcugucgcaacaaccuucgugaccccaaugcugaggcauucaauagagaauagcuccguuaauguuaguuuaacagcuauagcaaaucaagcaacagucuuaaugggauuagguaaaggauggccauuaaguaaaauggacaucggugugccacuauuagccauagggugcuacucacaaguaaauccgaucacacuaacggcugcuuuauuauuacucguggcacauuacgcuauaauaggacccggccuucaggcgaaagcuacaagggaggcgcagaaaagagcagcagcgggaauuaugaaaaacccuacaguggauggcauaacaguaauagaccuagaacccauccccuacgaccccaaauuugaaaaacaguugggacaaguuaugcucuugauacuaugcguaacgcaaguccuaaugaugagaaccacgugggcuuugugugaggcuuugacgcuagcuaccgggccaauauccacccuaugggaagguaacccugguagauuuuggaauacgaccauagcuguaucgauggccaauauauuucggggaucuuaucucgcaggcgcgggacuccuguucucuauaaugaaaaauacaacuaacacacguaggggaacuggaaacauaggugagacuuuaggugaaaaguggaagucccguuuaaacgcauuagguaaaucagaauuucagauuuauaagaaaucagggauucaggaaguagauaggaccuuggccaaagaagguauaaaacguggggaaacugaccaucacgcgguuucacgcggaucugcgaaauuacguugguucguagaaagaaauaugguaacgccagaggguaaaguuguggaucuuggcuguggucguggcggauggucauacuauugcggcggguugaaaaauguccgagagguuaaggggcucacuaaaggugguccaggacacgaggagccgauaccuaugaguaccuaugguuggaaucuaguccggcuacaaaguggagucgacguguuuuucacgccuccagaaaagugcgauacuuuauugugugauauuggugaaucaucaccuaacccgacaauugaggccggacgaacguuacgcguauuaaacuuaguugagaacuggcucaauaacaacacacaauucugcauuaagguucucaaccccuauaugccuagcgugauugagaagauggaaacacuacaaagaaaauauggaggugcacucgucagaaacccacuaucucguaauaguacucaugaaauguacugggucagcaaugccaccggcaauauagugagcagugucaacaugauaagucguaugcucauaaauagauuuacuaugaaacauaaaaaggcaaccuacgaaccugacguugaucucggaucagguacaagaaauauaggaauagaaucagaaauaccaaauuuagacauuauagggaagcgcaucgagaaaauaaaacaggaacaugagacuucauggcacuacgaccaagaccaucccuacaagacaugggcauaucauggaaguuacgagacaaaacaaaccgggucugcauccucaauggugaacggaguaguuagauuacuuacgaagccaugggaugucguaccaaugguaacccaaauggcaaugacagacacuaccccauuuggacaacagagaguauuuaaagaaaaaguagauacaagaacucaagagccaaaggaagggaccaagaaauugaugagaauaacagcagaaugguuauggaaggaacuuggcaaaaagaaaacaccccggauguguacacgugaggaguucacaagaaaaguaagaucaaacgcggcacuaggggcaauuuucacggaugaaaauaaauggaagucagcucgggaggcaguagaggaugggagauucugggagcuaguagauaaggaaagaaaucuacauuuagaggguaaaugcgaaacaugcguauauaacaugaugggcaagcgggagaagaaauugggagaguucggaaaagcaaaaggaagccgagcgaucugguacauguggcucggagcuagguuucuagaauuugaagcacuggguuucuugaaugaagaccacugguuuaguagaggaaacuccuuaagcggaguagagggugaaggauuacaucgucugggguauaucuuaagagauguagggaagaaagaaggaggggcgauguaugcugaugauacggcuggaugggauacaagaaucacacuagaggaccuuaaaaaugaagagauggugacaaaccauaugaaaggcgaacauaagaaacuagcugaagcaauuuucaaacugacauaucagaauaaaguuguuagaguacaacgaccuacaccaagaggaacagugauggauauuauaucucgaagagaucagcgaggcagcggacaaguaggaaccuacggacuaaauacauuuacaaauauggaagcucaauugauaagacaaauggaaggagaagguauauucaaauccauucaacaucuaacugcuacagaggagaucgcgguacagaauugguuagcuagaguuggcagagaacgucuuagcagaauggcaauaaguggcgaugauugugugguuaaacccaucgacgauagauucgcuucggcacugacagcauuaaacgauaugggaaaaguacguaaggauauacagcagugggaaccgucuaggggauggaaugauuggacucagguaccuuuuugcucacaucacuuucaugagcuaguaaugaaagaugguagaguucuuguggucccgugucgaaaucaagaugagcugauugggcgagcgagaauuucucaaggagcugguuggucauuaaaagaaacugcaugucuuggcaagagcuaugcucagauguggacccuuauguacuuccauagacgagauuuacgauuagcugccaaugcuauauguagugcaguuccaucgcauuggguaccaacaucacggacaacuuggucaauucaugcuaagcacgaauggaugacaacagaagauaugcucgcaguauggaauagaguuuggauucaagaaaacccuuggauggaagauaaaacaccaguagagagcugggaagaggugccuuacuuagguaaaagagaagaucaauggugugggucauuaauuggacuaaccagcagagccacuugggccaaaaacauccaaacggcuaucaaccaaguccgaagccuuauaggcaacgaagaauauacugacuacaugccaucaaugaagcguuucagaagagaagaagaagaagcugggguacuaugguaa

SEQ ID NO: 22662 - RNA, 9876 nt, Artificial Sequence
  derived and/or modified CDS sequence (opt6) from DENV-2__GQ868595__SS-prME
acagcgggaguaauaauaauguuaaucccgacggcuauggcauuucaccucacuaccaggaauggcgagccacauaugauaguuucacgacaggaaaagggaaaaucucucuuguuuaaaacagaggauggagucaauaugugcacacucauggcgaucgacuuaggagaauuaugugaggacacaaucacauauaaaugcccauuguuaagacagaacgaaccugaggacauagacugcuggugcaauucuacuuccacgugggugacauacggaacauguacaacaacaggugagcaucgucgggagaaacgaagugucgcacucguuccacacgucgguaugggacucgaaaccagaaccgaaacauggaugucaagugaaggcgcauggaaacacguacaaagaauagaaacauggauacucaggcaccccggcuuugcaauuauggcagccauucuugcuuacacgauuggaacaacucacuuucagagggcccuaauuuucauauuauuaaccgcuguagcucccuccaugacuaugcguuguaucgggauaucuaaccgagacuuugucgaaggaguauccgggggaucaugggucgauauaguacuagaacacggaaguugcgugacuacgauggcaaaaaauaaaccuacgcuagacuucgagcuaauaaagaccgaagcaaaacagccggccacacugcggaaauauuguauagaagcuaaauugaccaacacgaccacggagagcagaugcccaacacaaggagaaccauccuuaaaugaggaacaggauaagagauuuauauguaagcauucaaugguggauagaggauggggcaauggcuguggguuguucggaaaggguggaauaguuaccugugcaauguucacuuguaaaaaaaacauggagggaaaagucguguuaccagaaaaucuugaauacacaauugucauuacgccacacucaggcgaggagcaugcaguaggcaacgacacagggaaacacggaaaggaaauuaaaauaacaccgcaaucaucaauuacugaagcggaacuaaccgguuacggaacaguaacaauggaauguagcccuaggacaggauuagacuuuaacgaaaugguacuuuuacaaauggaagaaaaagcauggcuaguacaccgacaaugguucuuagaccucccuuuaccuuggcugccgggcgcagauacacaaggcaguaacuggauccaaaaggagacacuaguuacauucaaaaauccccaugcaaaaaaacaggauguaguuguauuagggagccaagagggagcaaugcauacagcccuaacuggggcaacagagauacagaugaguuccgguaaccuucucuuuacuggacaccuuaaaugccgacuaagaauggauaaauuacaacuaaaaggaaugagcuauagcaugugcacuggaaaauuuaagaucguaaaagagauagcagaaacacaacacggcacuaucgugauacgcguccaauaugaaggagauggaucaccaugcaaaauaccauuugaaaucauggaucucgaaaaacgacacgugcuuggaagacuaauaaccgugaacccaauaguaacggaaaaagacaguccaguuaauauagaagcugaacccccguucggugacuccuacauaauaaucggaguggaaccgggacaguuaaaacuaaauugguucaagaaagguagcagcauaggccaaauguucgaaaccacaaugcggggagcgaagagaauggcaauauuaggcgauaccgcaugggacuucgguucgcuagguggcguauucacgucuaucggaaaagcauugcaccaaguuuuuggggcaauauacggugcagccuucucaggagugucuuggaccaugaaaauacucaucgguguaauaauaaccuggauaggaaugaauaguagauccacuucgcuuagugucucucucguuuuaguaggagucgugacacuuuauuuaggagcuaugguccaagccgauaguggauguguaguaucuuggaaaaacaaagaacuaaaaugugguucagggaucuucauaaccgacaauguacacacauggacugaacaauacaaauuccagcccgagucgccgucuaagcuagcaucggcaauucagaaggcgcacgaagaagguauaugcgggauucgauccguaacacgucucgaaaaucuaauguggaaacagauuacaccagaacuaaaccacauauuaagcgaaaaugaagugaaacugacuaucaugacaggagacauaaaaggaauaaugcaagcuggaaaaaggagucucaggccucagccuacugaauugaaauacucauggaaaacuuggggaaaagcaaagaugcucucgacggaaagucauaaccagacuuuucuuauagacgguccagaaacagcugaaugcccuaauacaaaccgugcauggaauagucuagaagucgaagacuauggauuuggaguauucacgacaaauaucuggcuaaaacuaagagagaagcaagauguguuuugugauagcaaguugaugagugcagcaauaaaagacaacagggcaguccacgcggacaugggguauuggauagaaucugcauuaaacgauaccuggaagauggaaaaggcauccuuuauugaagucaaaucaugucacuggccgaaaagccauacacuuuggucuaacgggguuuuagaaagugaaaugauaauaccaaaaaauuuugcaggaccaguaagucaacauaacuacaggccaggauaccauacacaaacagcaggaccauggcaccucggaaaacuagagauggauuuugauuuuugcgagggcacuacgguuguaguaaccgaagauugugggaaucgugguccaaguuuaagaacgacgacagcuucaggcaaauuaauaacagaauggugcugccguagcugcacauugccaccgcuaagguaucggggagaggauggcuguugguacggaauggaaauacgaccuuugaaagaaaaagaagaaaauuuaguuaauucacuaguaacagcuggacauggacaaauugauaacuuuucucuagguguguugggaauggcccuauuucuggaagaaauguuacguacgcgaguaggaaccaagcacgcuauucuauugguagcggucagcuuugugacccuaauuaccggaaauaugagcuuucgagauuuaggaaggguaaugguuaugguaggcgccacaaugacagacgauauagggaugggugugacuuacuuagcccuucuggcggcauucaagguuaggccuacauuugccgcuggacuuuuauuaagaaaauugaccucaaaggaacuuaugauggcaacaauugggauagcacuuuugucccaaucuacaauaccggaaaccauucuggaacuuacggaugcauuagcccucgguaugaugguccuuaagauaguucguaauauggaaaaguaccaauuagcaguaacgauuauggcuauaucuugugugccaaacgcagucauauuacuuaaugcuuggaaaguuagcuguaccauacuagcagcugucucagucaguccccuacuacuuaccucaucccaacaaaaagcugauuggauccccuuagcacuaaccauuaaagguuuaaaucccacagccauuuuucucacaaccuugagcagaacaaguaagaagagaagcuggccucuuaaugaagccguaauggcaguaggaaugguaucuauucuagccucaagucuccucaaaaacgacauuccuaugacaggaccacuaguagcagguggguuacuuacuguauguuacguucuaacaggcagaucugcagauuuagaacuugaaagggcggcagauguaaaaugggaggaucaagcagaaauuuccggaagcaguccgauucuaaguaucacaauauccgaagauggaucuaugucgaucaaaaaugaagaggaagaacaaacuuuaacaauacuaauacguacaggucuacuagugaucucuggaguauucccgguuagcauucccauaacggcagccgcaugguaccucugggaaguaaaaaaacaaagagccgguguuuuaugggacguuccgagcccgccaccagucggaaaagcugaauuagaagauggagcauacagaauuaaacaaagaggaauacugggauauucucaaauaggagccggaguguacaaggaagguaccuuucacaccauguggcacguuacuaggggggcgguccuaaugcauaggggaaagaggauugaaccuaguugggcugauguuaaaaaggacuuaauuucuuacggcggggguuggaaacucgagggugaauggaaggaaggagaagaaguccaaguacucgcacuagagccagggaaaaacccucgagcaguccaaacaaaaccaggauuauucaaaacgaacaccggaacgauaggugcaguaucauuagauuuuagcccuggaaccucugguuccccgauuguggaucgcaagggcaaaguuguaggucuguacggaaaugggguugucacacguuccggagcauacguaucggcaauugcacaaacagaaaaaucuauugaagauaauccggaaauugaagaugauauuuuucgcaagaaacgcuuaacaaucauggauuuacacccaggggcaggaaagacuaaaagguauuuaccugcuauuguacgcgaggccauuaaaaggggacuacguacuuuaauauuggcaccuacccgaguaguagcugcagagauggaagaagcacuaagaggucuaccaauucgguaucaaacgccagcaauuagagcugaacacaccggaagggaaaucguugaccuuaugugccaugcuacuuucacuaugaggcuacuaucgccaguaagagucccuaacuauaaccuuauaauaauggaugaggcacauuuuacugauccugcaucuauagcagcaagagguuauauaucgacgcgcguugaaaugggugaagcggcaggaaucuuuaugacggcgaccccaccuggcagccgagauccauucccacaaagcaacgccccgauuauggaugaagagagagaaauacccgagaggucguggaauucaggacacgaaugggugacugacuuuaaagguaagacugucugguuuguuccuagcauuaaagcagggaacgauaucgcggcuuguuugaggaagaaugguaagaaagugauucaacuaucuaggaaaacauuugacagcgaauaugucaaaacucgugcuaacgauugggacuuuguuguuacaacugauaucucggaaaugggcgccaauuuucgagcagagagggugaucgauccacggcgcuguaugaaaccuguaauucuuaccgacggggaagaaagagucauacuugcugggccaaugccuguaacacauaguagcgccgcucagcgccguggaaggauagggcgcaacccgaaaaaugaaaaugaucaauacauuuacaugggugagccguuggaaaaugaugaggacugugcucauuggaaagaagcgaagauguuacuugauaauauuaauacgccggaagguauuauacccucaauguucgagcccgagcgggaaaaaguugacgcaaucgauggagaauauagauuacguggugaagcaagaaaaacuuuuguagacuuaaugagaagaggugacuuaccaguaugguuagcguauagaguagcagcagaaggaaucaauuaugccgacagaagaugguguuucgacgggaucaagaacaaucaaauacuagaagaaaacguggagguagaaauauggacgaaggaaggcgaacggaaaaagcucaagccaagaugguuagaugcaaggauauacuccgacccucuugcgcuuaaagaauucaaagaguucgcagcaggcaggaaaucucuaacucucaacuuaauuacagaaauggguagauuacccacauucaugacgcagaaggcacgcgacgcauuagacaauuuggccgugcuacauacagcugaagcgggaggccgagccuacaaucaugcacuaucggagcuaccugaaacucuagagacuuugcuacuguuaacccuacuugcgacaguaacaggaggcauauuuuuauuucuuaugucugguaaggggauaggaaaaaugacccuagggaugugcugcauaauuacugccucaauccuacuaugguacgcacagauacagccucauuggauugcggcaagcauuauucuagaguuuuucuugauaguccuacucauacccgaaccagaaaaacaaaggacaccucaagauaaccaacuaacuuauguuguuauagcuauucuaacugucguggccgccaccauggcuaaugaaauggguuuccucgagaaaacuaaaaaagauuuaggcuuaggaucaauuacaacacaagagagcgaaucuaauauacuugauaucgacuugagaccugcuucagcuuggacucucuaugccguagcaacaacuuuugucacacccauguugcgacacagcauagaaaauuccaguguuaauguaagcuugaccgccauagcaaaucaagcaacaguuuuaaugggacucggcaaaggauggccauuaagcaaaauggauauaggaguaccauuacuggcuauaggaugcuauagccaaguaaacccaauaacucugacugcggcccuauuguuauuaguggcacauuaugcaauaauaggcccgggauugcaggcuaaggcaacuagggaagcacaaaagcgcgcagcugcuggaaucaugaaaaaccccacaguggauggaauuacaguuauugaucuagagccaaucccuuaugacccaaaauuugagaagcaauuaggucaggucauguuacuaauucugugugugacccaaguacucaugaugaggacaacaugggcauuaugugaagcacuaacguuagcaacuggaccaauuucaacguuaugggaaggcaauccaggucgauuuuggaauacaacaauagccguaagcauggcgaacaucuuccgaggcaguuacuuggcaggagccggccuacuuuuuucaauaaugaaaaauacaacuaauacacgacgaggaacaggaaauauaggcgaaacauuaggcgagaaguggaaaucuagguugaacgcacuuggaaaaagugaauuucaaauauauaaaaagucaggaauacaagaaguagaccgcacucuagcaaaggaaggaauuaagcguggugaaaccgaucaccaugcagucucaagaggaagugccaaauuaaggugguuugucgaaaggaauaugguaacaccagaggguaaaguagucgacuuagguugcgguagagguggauggagcuauuacugcggaggauuaaaaaauguucgcgaaguaaaaggauuaacaaaaggaggaccgggucacgaagagccaaucccaaugucuacguacggauggaaccuuguucgcuugcaaucuggagucgauguauuuuuuacaccuccugaaaaaugugacacguuacugugcgauauaggugaaucuaguccaaauccaacgauugaagcaggacguaccuuaagaguacugaaccuuguggaaaauugguugaauaacaauacccaauuuugcauaaaagucuuaaaucccuacaugccuaguguaauagaaaaaauggaaacuuuacaacgaaaauacggaggagcacuugugcgaaauccucucucacgaaauagcacacaugaaauguacugggucaguaaugcaacaggcaauauaguaucuucaguuaacaugauuucacggauguuaauaaauagguuuacgaugaaacauaaaaaagcuacauaugaaccugacguagacuugggcaguggaacaagaaacaucggaauagaaucagaaauucccaaucucgacauaaucggaaaaagaauagaaaaaauaaaacaggaacaugaaacuucuuggcauuaugaccaagaccauccauauaaaacuugggccuaucacggaagcuacgaaacaaaacagacaggcucugcgucaucgaugguuaacggugucguacgguuacuuacaaaacccugggacguaguuccuaugguaacacaaauggcgaugacggauacaacuccguuuggacaacagaggguguuuaaagagaaaguagacacgagaacacaagagccaaaagagggaacuaaaaaauuaaugcguauaaccgcagaaugguuauggaaagaacuaggaaaaaaaaaaacuccacguauguguacacgagaagaauucacacguaaaguacgaaguaaugccgcucuaggugccauuuucacggaugaaaauaaguggaagagugcacgcgaagccgucgaagauaguagauucugggaauuaguugaccgagaacguaauuuacaucuagaagguaaaugcgaaaccugcguauauaacaugaugggaaagcgagaaaagaaauuaggggaauuuggaaaagccaaggggucuagggccauaugguauauguggcugggagcuagguuuuuagaguuugaggcuuuggguuuucuuaacgaagaccauugguucucaagggguaauucuuugagcggaguagaaggggagggacugcaucgucugggcuacauccuacgagacguaucaaaaaaagaaggcggagcaauguaugcggacgauacugcaggaugggauacgagaauaacacuugaggauuugaagaaugaagaaaugguuacuaaucauaugagaggagaacauaaaaaacuagcagaagcaauauuuaaacuaacguaucaaaacaaaguagugagaguacaaaggccaacgccacggggcacgguaauggauauuauaaguagacgagaucaaagggggucaggucaaguagggacuuacgguuuaaauacguuuacuaauauggaggcccaauuaauuagacaaauggaaggagaaggcauauucaaaucaauaaaacaucugacaguaaccgaagagaucgccguucaaaacuggcuagcuagaguuggaagggagaggcuaagccgaauggcgauaaguggcgacgauugcgugguaaagccauuagaugaccguuuugcuagugccuuaacugcucugaaugacauggggaagguucguaaagacauucaacaaugggaaccaagucguggguggaaugauuggacucagguuccuuuuugcucacaccacuuucaugaacuaguuaugaaggauggucguguauugguggugccaugcaggaaucaagacgaauuaauugguagggcacguauuucgcaaggugcuggauggagucucaaagaaacagcuugcuuggguaaaagcuacgcacaaauguggaccuugauguacuuccauagacgugauuugagacuugcagcaaacgcgauuuguuccgcaguuccaucacauuggguacccacaagucguacuacauggucaauccacgcaaaacaugaguggaugaccacagaagauaugcuggccguuuggaacagaguauggauacaagaaaacccuuggauggaggauaaaacgccaguagaauccugggaagaaguuccuuaucuaggaaaacgcgaagaucaauggugugggaguuugauuggauuaaccuccagggcaacgugggccaaaaacauccagacugcaauuaaccaaguaagauccuuaaucgguaacgaagaguauacagacuauaugccuagcaugaaacgauuuagaagagaagaagaagaggcaggaguacuaugguaa

SEQ ID NO: 22663 - RNA, 9876 nt, Artificial Sequence
  derived and/or modified CDS sequence (opt6) from DENV-2__GQ868540__SS-prME
acggcagggguaauuauaauguuaauaccaacugcaauggcauuucaucucaccacuagaaauggggaaccccacaugauaguagguaggcaggaaaaaggcaaaucgcuccuuuuuaaaacagaggacggaguaaauauguguacguugauggcaauagacuuaggggaauuaugugaagacaccaucacuuacaaauguccguuacucagacaaaaugaaccugaagauauugacuguugguguaacaguacaagcacuuggguuacauauggaacuuguacaacaacaggugagcauaggcgugagaaacguucaguugcguuagugccacauguaggaaugggcuuagaaacaaggacugaaacauggaugaguucugaaggggcauggaaacauguucaaaggauagaaacuuggauucugaggcauccaggauucgcaauaauggcugcaauauuagcauacacuauaggaaccacccacuuccaacgagcauugauauucauacucuugacagcaguagcucccucaaugacaaugcgcuguauaggaauaagcaacagggauuucguugaaggaguuaguggcggcuccuggguggauauaguauuggaacaugguuccugcgugacuacaauggcuaaaaauaagcccacuuuagauuuugaauugauuaaaacugaggcaaaacaaccggcgacauuaaggaaauauugcauugaagccaaacuaaccaauacuacgacugaaagcagaugcccuacacaaggagaaccuucacuaaacgaagaacaggauaaaagauuuauaugcaaacauucaaugguagaucgaggguggggcaauggcuguggccuuuuugggaagggcggaauagugaccugcgccauguuuacauguaaaaagaauauggagggaaaaguaguauugccagaaaaccuagaauacacaauaguaauuacaccccacucuggagaagaacacgcaguuggaaaugauacaggaaagcacggaaaggaaauaaagauuaccccucagucaucuauaacugaagcggaauuaacugguuauggaacggugacaauggaaugcaguccaagaaccggccuggauuuuaaugaaaugguccuacuccagauggaggagaaggcaugguuaguucacagacagugguuccuagaucucccccuacccugguugccgggagccgauacacaagguagcaacuggauccaaaaggaaacguuggugacuuuuaaaaauccccacgcgaagaaacaggaugugguaguacuggggucucaggaaggggcuaugcauacggccuugaccggagcgacugagauacaaaugucuucagguaacuuacucuuuacaggucaucuaaaaugucgccuuagaauggauaaacuucaauuaaaaggcauguccuacucaauguguacaggcaaguuuaaaauuguuaaagaaauugcagaaacacagcacgguacaauugucauaaggguucaauaugagggcgauggaaguccaugcaaaaucccuuucgaaaucauggaccucgagaaaagacacguauuaggcagacugaucaccguuaauccuaucgucacagagaaggacucgccugugaacaucgaagcagaaccaccauucggagauucguacauaauuaucggaguggaaccuggacaauuaaaacuuaacugguuuaagaaggguucaaguauagggcagauguucgaaaccacaaugcgaggcgcaaagaggauggcgauacuuggagauaccgcuugggacuucggaucucuuggaggugucuuuacaucaaucggcaaagcguuacaccaagucuuuggagcaauauauggggcggcuuuuucgggaguauccuggacaaugaagauauuaaucggaguuauaaucacuuggauuggaaugaauucaagauccacaagcuuaucaguaaguuuagugcugguuggagucgugacacucuacuugggggcaaugguacaggccgacaguggauguguagugagcuggaagaacaaggaacucaaaugugguucaggcauauucauaaccgauaacguacacacauggacagagcaauacaaauuucagccugaaagcccuucgaaacuagcuagcgcaauucaaaaagcacaugaagaaggcaucugcgguaucaggucgguaacucgucuagagaaucugauguggaaacagauaacaccagaacuuaaucauauauuaagcgagaaugaaguuaaacucacaauaaugacaggagacauaaaagggauaaugcaagccggaaaacguagcuuaaggccacaaccaacagaacucaaauauucauggaaaacauggggaaaagcgaaaaugcuaaguacggaaagccacaaucagacauuccugguugaugguccagagacagccgaaugcccuaacacuaaucgggcguggaauucauuagaaguugaggauuacggauuuggcguuuucacaacaaacauauggcuaaaacuacgggaaaaacaagacguauuuugugauucaaaguugaugucugcagccauuaaggacaacagggcaguacacgcagauaugggcuacuggauugagagugcauugaaugacacuuggaagauggaaaaagcaucauuuauugagguaaaguccugucacuggccuaagagccauacacuuuggucaaacgguguacuagaaucagaaaugauaaucccaaaaaauuucgcgggaccaguuagccagcauaauuacaggccgggguaucauacucaaacugcaggcccguggcauuugggcaaauuagaaauggauuuugauuucugcgaaggaacgacuguuguuguaaccgaagauugcggaaauagagguccaucguuacguaccacaacugcuagcgguaaguugauaacagaauggugcugucgaaguugcaccuuaccaccucuaagguaccguggagaggacggaugcugguauggaauggaaauaaggccacucaaagaaaaggaggaaaacuuaguaaacucacucguaacagccggacacggccaaaucgauaauuucagccuuggagucuuaggaauggccuuauuccuugaagaaauguuaagaacacguguaggaaccaaacacgcgauccuauugguugcaguaagcuuugugacauuaauuaccggaaacaugucguuucgugaucuugggaggguuaugguuauggucggggcuacaaugacggacgacauuggaaugggagugacauauuuagcauuauuagcagccuucaagguucgaccaacuuucgccgcgggucuacuucugcguaaguuaacgagcaaagaacuaaugauggccacaauagguauugcacuauuaucccaaucgacgauaccagaaacaauacuggaacuuacagaugcacucgcgcugggaaugaugguacuaaaaauagugcgaaauauggaaaaauaccagcuugcaguaacaauaauggcgauaaguugcguuccaaacgccguaauauuauuaaacgcuuggaaaguaucguguacuauauuggccgcagucucugugaguccauuauugcuaacuaguucccaacaaaaagcggauuggauaccuuuggcauuaaccaucaaaggauuaaacccuacugcaauauuucucacaacauuaucaagaacaucuaagaaacgaaguuggcccuuaaacgaagcuguaauggcaguagguaugguuucaauacuagcgagcucuuuacucaagaaugauauccccaugaccgggccguugguugcuggaggccuucucacugugugcuacguccucacgggaagaucagccgaucuugaguuagagagagcagccgauguuaagugggaagaucaagcugaaauauccgggucuucaccaauacuuaguaucacaauuucagaagauggaucaaugucaauuaaaaaugaggaggaagagcaaacucuaacaauacuuauuaggacuggguuauuaguuauuucagguguauuuccgguaucaauacccauaacagcagcggcaugguaccuaugggaagucaagaaacagagagcaggaguacugugggauguaccuagccccccacccguggggaaagccgaacuagaagacggugccuacagaauaaaacaaagaggcauauuagguuauagucagauuggggcggggguauauaaggaagguaccuuucauacuauguggcacgugacucgaggagcagugcucaugcacagagguaaacgaauugaaccgagcugggcagauguuaagaaagaccucauuucauauggagguggguggaaacuagaaggcgaauggaaagagggagaagaaguucaaguauuagcauuagagccaggcaagaauccucgcgcaguacagacuaagccaggauuguucaaaacaaacacaggcacgauaggggccgugucauuagacuucucgccagguacuucuggcagcccuauuguagacagaaaaggcaagguagucggccuuuacgggaaugguguaguaacuagaaguggcgcauaugugucugccauagcucaaacggaaaaaaguauagaagacaauccugagauagaagacgauauuuuuagaaagaagcgacuaacuauaauggauuugcauccaggagcggguaagacgaaaagauaccuacccgcuauugucagagaagcaaucaaacgcggcuugcgaaccuugauacuagcaccaaccagaguuguagcagcagaaauggaagaagcauuaagaggguuaccaauuagguaucaaaccccugcuauacgagccgaacacacaggcagggagauaguagacuugaugugucaugcgaccuucaccaugcgauuacuuucgccugucaggguaccaaauuauaaucuaaucaucauggacgaagcccacuucacugacccggcaucgaucgcagcgcgaggguacauaagcacgaggguagagaugggcgaagcugcgggaauauucaugacagcuacuccuccagguucuagagauccuuuuccucaaucuaaugcaccaauaauggacgaagaacgagagauaccagaaagaaguuggaacucgggccacgaauggguuacugauuucaaagguaaaacaguuugguuuguaccaaguauaaaggcaggaaaugauauugcagcauguuuaagaaagaacgggaaaaagguuauucaacuaucacguaaaaccuucgauuccgaguauguaaaaacucgagcaaacgauugggacuucgucguaacuacagauauaagugagaugggcgcuaauuuccgagcggaacgagugaucgauccaagacgauguaugaaaccugugauucuaacagacggagaggaaagggucauccucgcuggcccaaugccaguaacacacaguagugcugcucaaagaagaggcagaauaggacguaaccccaagaacgaaaacgaucaauacauauauaugggugaaccacuggaaaaugacgaggauugcgcucauuggaaagaagcuaaaaugcugcuugauaacauaaacaccccagaaggaauaauaccuucgauguucgaaccagaacgagaaaaaguugacgcaauagacggagaguacagacuacguggagaggcaaggaagacauuuguggaccuaaugaggagaggcgacuuaccggucuggcucgcauauagaguagcggcagaagggauaaauuacgcggaucggcguuggugcuucgauggcauaaagaauaaucaaauacuugaagagaauauggaaguagaaauuuggacuaaagagggagaacgcaaaaagcugaagccacgauggcuugacgccagaauauauagcgaccccuuagccuuaaaagaauuuaaggaauuugcugcaggucgcaaaucgcuaacauuaaaucucauaacagaaauggggagauugcccacauuuaugacucaaaaagcacgggaugccuuggauaauuuagccgucuugcauaccgcugaagcaggcgggcgugcguauaaucacgcgcuuagcgagcuaccagaaacccuggagacacuauuacuuuuaacauuauuagcuacaguaacgggugguauauuccuuuuuuugaugaguggaaaggguauagggaaaaugacacuagguauguguuguaucauaacggcgagcauacuccugugguacgcucagauacagccucacuggauagcagcuuccaucauauuagaguuuuuuuugaucguuuuacucauuccagaaccagaaaagcaaagaaccccccaagacaaccagcugacuuacguagugauagcgauccuaacggugguggcagcuacuauggccaaugaaaugggcuuuuuggaaaagacuaaaaaagaucucggccucggcagcauaacaacccaagaaagugaaucgaauauauuggauauugauuuaaggcccgcgagcgcuuggacguuauaugccguagccacgacauuuguaacgcccaugcuccgacacucaauugaaaauucuaguguaaauguaagccugacagcuauagccaaucaagccaccguccuaaugggacuagggaagggguggccacuaucgaaaauggacauagguguaccccuacuggcuauugggugcuauucccaaguaaacccgauaacccugacggcagcauuguuacuacuaguagcgcacuaugcaauuauagguccaggauuacaggcuaaagcgacacgagaggcucagaaacgugcugcugcaggaaucaugaaaaauccaaccguagacgggauaaccguaauagauuuggaaccuauaccauaugauccaaaauuugagaaacaauuaggucaagugaugcuucuaauucuauguguaacacaagucuuaaugaugagaaccacuugggcgcuaugcgaagcacuaacacuagcaacgggaccaauuucgacucuaugggaagguaacccgggaagauuuuggaauacuacaauagcaguuagcauggcuaacauauucagagguaguuaucuagcuggagcgggucugcuuuuuucaauaaugaaaaacacaacuaauacuagacgagggaccggaaauaucggagaaacgcuuggagaaaaauggaaaucccgauuaaaugcucucgguaaaagcgaauuucaaauauauaagaaaucugggauacaagaaguugauagaacccuugcuaaagagggaauaaaaagaggagaaaccgaccaucacgccgucucuaggggaucugcuaaauuaagaugguuuguugagagaaauauggugacaccagagggaaaaguuguugauuuggguuguggaagagguggauggucuuacuauugcggaggucuuaaaaauguccgcgaaguaaaaggacuaacaaaaggaggucccggacaugaagaaccuauacccaugucaacauacggcuggaauuuaguacgguuacagucuggcguagauguguucuucacaccuccagaaaagugugauacucuacuuugugacauuggagaaaguucaccuaacccgacaauagaagcaggucguacucuccgcguccugaauuuaguagagaauuggcugaacaauaauacccaauuuuguauuaaaguauugaauccauauaugccuuccguuauagaaaaaauggaaacauugcaacgcaaguacgguggcgcucucguuagaaacccacugucucgaaacucuacacacgaaauguauugggugagcaaugcaaccgggaauaucguuaguuccguaaauaugauuagccggauguuaauuaacagauuuacaaugaaacauaagaaagcaacauacgaaccagaugucgacuuggguagugggacgcgaaauauaggaauagaaucagaaaucccuaaucuagauaucaucggaaagagaauugaaaaaauaaagcaggagcaugagaccucauggcacuaugaccaggaccauccuuacaaaacgugggcauaucacggaucuuaugaaacgaaacaaacaggaucggcuucgucaauggucaaugguguugugaggcugcucacaaagccuugggaugucgugccaaugguaacucaaauggcuaugacggauacaacacccuuuggacaacagagaguauucaaggaaaaggucgauaccagaacacaagaaccuaaggaaggaacaaaaaaacuaaugagaauaacagcugaauggcucuggaaagagcuaggaaagaaaaaaaccccccguauguguacuagagaagaauucacaagaaaaguccgaucuaaugcugcguuaggagcaauauuuaccgacgagaauaaguggaaaucugcacgagaagccguggaggauucuagauuuugggagcuaguugaccgggaaagaaauuugcaucuggaggguaaaugugagacuugcguuuacaacaugaugggaaaacgagaaaagaaauuaggggaauucggaaaagcaaaaggcagucgagcuauaugguauauguggcuaggggcuagauuccuagaguuugaagcauuagguuuucuuaacgaagaucauugguuuucccggggcaauucucucucuggugucgaaggggagggacuacaucgguugggauauauacugcgcgacgucucuaagaaagaagguggugcuauguaugcggaugauacagccggaugggauacaagaauuacucuagaagacuuaaaaaaugaggaaaugguaaccaaccauaugaaaggagaacauaagaaauuagcagaagcaauauucaaauuaacuuaccaaaauaaaguagugcgaguccagcgcccaacuccucgaggaacagugauggacaucaucucucgaagagaccagagaggaaguggccaaguaggcacauauggucuaaacacuuuuacgaauauggaagcacaacuaauuagacagauggagggagaagggauauuuaagucaauucaacacuugaccguaacggaagaaauugcgguacaaaauugguuagcaagaguaggaagagaaagauugaguagaauggcgauaucuggagaugauugcguggucaagccacucgaugacagauuugcaucggccuuaacagcucuuaaugacaugggaaaaguuaggaaggacauucaacaaugggaaccgucaagaggguggaacgauuggacucaaguaccauuuugcucucaucauuuucaugaacuaguaaugaaggacgggaggguauuaguagucccaugcaggaaucaggacgaacuaauuggaagggccagaauuucgcaaggagccgguuggagccucaaagaaacugcuugcuuaggaaagaguuaugcacaaauguggacguugauguauuuucaccgacgggacuuaagauuagccgcuaaugcaauuugcucagccguaccaagccacuggguaccuacaucgagaaccacaugguccauacacgcaaaacacgaauggaugacgacagaggauaugcuugcgguauggaaccggguauggauacaagaaaaucccuggauggaagauaaaacaccaguugaaagcugggaagagauuccauacuuaggaaagcgagaagaucaauggugugggucuuuaauaggguuaacaucccgggcuacgugggccaaaaacauacaaaccgcaauuaaucaaguaagaaguuuaauuggcaaugaggaauacacagauuacaugcccucuaugaaaagguuuagacgggaagaagaagaagcaggcguuuuaugguaa

SEQ ID NO: 22664 - RNA, 9876 nt, Artificial Sequence
  derived and/or modified CDS sequence (opt6) from DENV-2__GQ868541__SS-prME
acugcaggagucauaauaaugcuaauuccaacagcaauggcauuucaccugacuacgagaaauggggaaccucauaugaucgucggaagacaagaaaaagguaaaucgcugcuguucaaaaccgaggauggagugaauaugugcacucuuauggcaaucgauuuaggagagcuuugugaagacacuauaaccuacaaauguccauuguugcgacaaaaugaaccugaggauauagauuguugguguaauagcacaucaacauggguuacauaugggacuuguacgacgacgggugaacauagacgagagaaaaggucaguagcucuaguuccacaugugggaaugggguuagaaacgagaacggaaacauggaugagcucugaaggggcauggaaacaugugcaaaggauugagacauggauuuuacgucacccgggcuuugcaauaauggcagcaauuuuggcauauacaauaggaacaacacauuuccaacgcgcacuuauauuuauuuuauuaacugcaguggcaccuagcaugacuaugcgcugcaucggcauaucgaauagggauuuuguagaaggggucucaggaggcagcuggguugacauuguacuugaacaugguaguuguguaacaacuauggcgaaaaauaaaccaacuuuagauuucgaauugauaaaaacagaggccaaacaaccagcaacacuaagaaaauacuguauagaagcaaaacuaaccaacacaacgacagaguccagauguccaacucaaggagaaccgucacucaacgaagaacaagauaaaagguuuauauguaaacauucaaugguagaccgcggcuggggaaacgguuguggauuauuugguaaaggaggaaucguaacaugcgcgauguuuacgugcaagaaaaacauggaaggaaaaguaguuuuaccagaaaacuuggaguauacuauugucauaacaccacacaguggggaagaacacgcugugggcaacgauacaggcaaacacggaaaagagaucaaaauaacaccgcaaucuucaauuacagaagcagaacuaacugguuacggaacagucacuauggaauguucaccucgcacaggccuagauuucaaugagaugguucuauuacaaauggaagaaaaagcgugguuaguacaucgacagugguucuuagaucuuccuuuaccgugguuaccuggcgcugacacacagggaucuaauuggauacaaaaagaaacguuagucacuuuuaaaaauccacacgccaagaaacaagacgugguaguucuaggaagccaagaaggagcaaugcauacagcacuaaccggagcuacugagauucaaaugucaucuggaaaucuucuguucaccggccaccuaaaaugccgccucagaauggacaaacugcaauugaaagguauguccuacucaaugugcacuggcaaauuuaaaauuguaaaagagauugcggaaacacaacaugguacuaucguuauuaggguacaauacgagggagacgguucaccuugcaaaauaccauuugaaauuauggaucuagagaaaagacacguauuaggcagguuaauuacaguaaacccgauuguaaccgagaaagacucaccagugaauauagaagcagagccaccuuuuggagauaguuauauaaucaucggaguugaaccaggucagcuaaaauugaauugguuuaagaaaggaucuaguauuggacaaauguuugaaacaacuaugagaggagcuaaacgaauggcgauuuuaggagauacugccugggauuucggaagucucggcggaguauuuacguccauaggaaaggcguugcaucaaguauucggggcuauauauggugcagcauuuucgggagugucauggaccaugaagauacuaauagguguuauaauuacuuggauagguaugaacucuagaaguacgucauuaucaguuagccuaguccuugugggagugguaacucuuuauuuaggcgcgaugguucaggcugacagugguugcguugucaguuggaaaaauaaagaguuaaaguguggauccggaauuuuuauuaccgacaacguacauacguggacggaacaguauaaauuucaaccagagagcccuucaaaauuagcauccgcuauccaaaaagcgcacgaagagggaauuugcgguauccgaucuguaacaagauuagaaaaccucauguggaaacagauuacuccagaauuaaaccauauacugagugaaaacgaaguuaaacuaacuaucaugacgggagacauaaaaggaauaaugcaagccgguaaacgauccuuacggccucaacccacagaauuaaaauauaguuggaaaacaugggguaaagcaaaaauguuaagcacagaaagccauaaccaaacauuccuaauugauggucccgaaaccgcggaauguccgaacacaaauagggcauggaacucucucgaaguagaagacuauggguuuggagucuucacaacaaauauaugguugaaacucagagaaaagcaagaugucuuuugugauagcaaacuaaugucugcugcaaucaaggauaaucgugcaguacaugcugacaugggcuauuggauugaaagcgccuuaaacgauacuuggaaaauggagaaagcaucauuuaucgagguuaagaguugucacuggccgaaaucgcauacgcuauggaguaauggaguacuagaaucagaaaugauaauccccaaaaauuucgccgguccaguaagccaacacaauuauagaccaggcuaucauacgcagacugcugguccauggcaucuggggaaauuggaaauggacuucgacuucugugaggguacgacagucguaguaacugaggacugcgguaauagggggccauccuugaggaccaccacagcgagcggaaaacugauuacagaauggugcuguaggaguugcacacuaccgccgcuccgguauagaggggaagauggaugcugguacgggauggaaauccgaccauuaaaagaaaaggaagaaaaucuuguuaauucguugguaacagcaggucacgggcaaauagauaacuuuagucuaggcguguuaggaauggcgcucuuuuuagaagagaugcugagaacgagagucgggacaaaacaugcuauacuucuuguggcgguauccuuuguaacauuaauaacuggcaacauguccuuuagagaccuuggacggguaauggugaugguaggggcaacaaugacugacgauauugggaugggugucacauaucuugcucugcuagcugcauucaagguucguccaacguuugccgccgguuuacuacuuagaaaauuaacaaguaaagaacuaaugauggccacuaucggaauagcguuguuaucucaguccacgauuccugaaacuauacuugaacuaacugaugcccuggcucuagguaugaugguccuaaaaauuguaagaaauauggaaaaguaucaauuggcgguaacuauuauggcgauaucuuguguaccaaaugcagugauacucuuaaacgcauggaaaguaucuuguacuauccuagcagcagugagcguuucgccauuauuacuaacaucaucacagcagaaagcagauuggauaccacucgcacuuacaauaaagggacuaaaccccacagcaauauuucugacaacucuaagcaggacgucuaaaaagcgcaguuggccuuuaaaugaggcagugauggcaguuggcaugguauccauuuuagcaaguucauuguuaaagaacgauauuccaaugacgggaccucucgucgcuggugguuuacuaacgguaugcuacgugcugacaggaaggucagcagaucuugaauuagaacgggcagcagacguuaagugggaagaccacgccgaaauaucuggaagcucaccaauuuuaucaauaaccauauccgaagauggaucuaugagcauuaaaaacgaggaggaagaacaaaccuuaacuauauuaauacgaacaggucuccuaguaauaucugggguguucccaguuucaauacccaucacagcggcagcaugguaucuuugggaagucaagaaacaacgggcaggaguccuaugggauguucccagcccaccuccaguggggaaagcagaacuggaagauggugccuacagaauuaaacaaagagguauucuaggcuauucucaaaucggagcaggaguauauaaggaagguacguuucacacgauguggcaugucacccgaggggcaguacuaaugcauagaggcaaaaggauugagccaucuugggccgauguaaagaaagaucuaauuaguuauggagguggcuggaaauuagagggcgaauggaaggagggcgaagaagugcaaguuuuagcucucgaaccagguaagaacccgagggcaguacaaaccaaaccaggcuuauuuaaaaccaauaccgguacaauaggagcuguaucacuagacuuuagucccgggacgucaggcucgccgauuguagauagaaaaggaaaggucguaggacucuacggcaaugguguaguaacucgcaguggagccuaugucuccgcaauagcacagaccgagaaaaguauagaagauaaccccgaaauagaagacgauauauuucgaaagaaacgucuaacaauaauggaccuccauccuggagcaggaaaaacaaagagguaucuaccagcgauuguaagagaagccauaaagagaggacuccgaacacuaauucuagcccccacaagagucguugccgcagagauggaggaagcauuacgaggucuuccaauaagauaucaaacaccagccauaagagcggaacacacaggaagagagauaguagaucucaugugucaugccacauuuaccaugagacuacuguccccaguucggguaccaaauuauaaucuaauuauaauggaugaagcgcauuuuacagauccagcgucuauagcggcgcgagguuacauuucaacacgcguagaaaugggagaagcugcagguaucuucaugacggcaacaccaccagguucuagggaucccuuuccucaaucaaacgcgccgauaauggacgaagaaagagagauucccgagaggucuuggaauaguggacacgaauggguaacagacuuuaaagggaaaacaguuugguuugucccaagcauaaaagcggggaaugauauagccgcuugucuacguaaaaacgguaagaaaguaauccaacugucucgaaaaacauucgacuccgaauauguuaaaacccgcgcaaaugacugggauuucguagugaccacagacauuagugagaugggugcaaauuucagggcagaaagaguaauagaucccaggcgguguaugaaaccagugauucuaacagauggagaagaaaggguuauacuagcaggucccaugccgguaacccacucaagcgccgcgcaaagaagaggacgcauagggcgcaauccgaaaaacgagaacgaucaauacauuuauaugggagaaccccucgaaaacgacgaagacugugcacauuggaaagaagccaaaauguuacuagacaacauaaauacacccgaagggaucauuccaagcauguuugaaccugaacgagagaaaguugacgcaauugauggagaguaccgauuaagaggugaagcaaggaaaacauucguagaucuaaugagacguggugaccuaccagucuggcuagccuacagaguugcugcugaagguauaaauuacgcagauagaaggugguguuuugauggcaucaaaaacaaccaaaucuuagaagagaaugucgaaguagaaauauggacuaaggaaggggaacggaagaaauuaaaaccaagauggcuugaugcgcguaucuacucagacccuuuagcccuaaaggaguuuaaagaauuugcagcagggagaaagagucuuacacugaaucuuaucaccgagaugggaagacuucccaccuuuaugacacaaaaagcucgugaugcccucgauaauuuagcaguuuugcauacugcugaagcgggagguagagccuacaaucaugcacucucugaguuaccagaaacuuuagaaacgcucuuacuacuaacgcuccuagcgacagugacgggaggaauauuucuauucuuaaugucuggcaaggggauaggaaaaaugacucucgggaugugcuguauaauaacugcgucaauuuugcugugguacgcccaaauccaaccacacuggauugcagcaaguauaauccuugaguucuuuuugauuguauuacucauccccgaacccgaaaagcaacgaacaccucaagauaaucagcugaccuauguuguuaucgcgauacuaaccgucguugcggccacaauggcuaacgaaaugggauuccuagagaagaccaaaaaggauuuggguuugggaagcauuaccacacaggaaucugaaucaaauaucuuagauauagauuuaagaccagcaagcgcuuggacacuauaugcgguagccacaacguuuguaacaccuaugcuccgucauucaauagaaaauucuaguguuaacguuucacuaacugcgauugcaaaucaagcuacaguacugaugggucuugguaaagguuggccauuaucaaaaauggauauuggaguaccgcuuuuagccaucggaugcuacagucagguaaaccccauuacacucacggcagcucuccuguugcuaguagcucauuaugcuauaauaggaccaggguuacaggcgaaagccacuagagaagcacagaaaagggccgccgcugguauaaugaagaauccaacuguagaugguauaacuguaauagaucuugaaccgauuccauaugacccuaaauuugagaaacaauuaggucaggucauguuacuaauucuuugcguaacccagguacuaaugaugagaaccacgugggcucugugugaagcacuaacgcuagcaacagggccuauuucuacgcugugggaggguaauccagggcgauuuuggaacacuaccauugcaguauccauggccaacaucuuucggggaaguuauuuagccggggcaggauuacuguuuucaaucaugaaaaacaccaccaauacucgaagagguaccggaaacauuggcgaaaccuuaggcgaaaaauggaaaucaagacuuaaugcauuaggaaaaucagaauuucaaauauauaagaaaaguggcauucaagaaguugauagaacauuggcgaaagaagguauuaaaagaggggagacagaucaccacgcuguuaguagggguuccgcaaaguuaagaugguucgucgagagaaauaugguaacuccugagggaaaaguggucgauuuggggugugggagaggcggguggucguacuacugcggaggccugaaaaaugucagggagguuaaaggguuaaccaagggagguccgggucacgaggaaccuauaccgaugucuacuuacggauggaacuuaguaagauugcagucgggcguagauguuuucuucacgccucccgaaaaaugugauacauuauuaugugauauaggugaaaguuccccgaauccuaccaucgaagcaggacggacccuucgcguauuaaaucuugucgaaaacugguugaauaacaauacgcaguucuguauaaaaguuuugaacccguacaugccguccgugauugagaagauggaaacucuucaaagaaaauaugggggagcccuaguaagaaauccauugagcagaaauucaacacaugagauguacuggguuagcaacgcaacggguaacauaguuuccucagucaauaugauaucacguaugcucauaaaucgguucacgaugaaacauaagaaagccaccuaugagcccgacguggaucugggauccggaacuagaaacauagguaucgagagcgaaauaccaaaccuagacauuaucggaaaaagaauagagaaaaucaagcaagaacaugaaaccucauggcaucaugaccaagaucauccauauaaaacgugggcuuaucacgggaguuaugaaacaaaacaaacgggaucggccucauccauggucaaugguguugucaggcuguugaccaagcccugggaugucguaccaaugguaacacagauggcuaugaccgacacgacgccguuuggacaacaaaggguguuuaaggaaaaaguagauacuagaacucaggagcccaaagaaggcacaaagaaauuaaugagaauaacagccgaauggcuauggaaagaauuagggaagaagaaaacccccaggaugugcacgagagaggaauuuaccaggaaaguucgaaguaaugccgcauugggggcaauuuuuacagaugaaaacaaauggaagucugcacgagaagcuguugaagauucgcgcuuuugggaauugguagaucgggaaagaaauuuacacuuagagggaaaaugugagacauguguuuacaauaugaugggaaagcgagagaagaaauuaggagaauuuggaaaggcaaaagguucaagagcaauuugguauaugugguuaggggcaagguuuuuagaauuugaagcucuuggauucuuaaacgaagaccacugguuuaguagaggaaauucucuguccggcguggaaggggaaggucuacauagacugggauacauacuucgagacguguccaagaaagagggaggcgcaauguacgcugaugauacugcuggaugggacacuagaauuacauuagaagaucuuaaaaacgaagaaaugguaacaaaccauaugaaaggcgaacacaagaaacuggccgaggcaauauuuaaacucacauaucaaaauaaagucgugagaguucaaaggccaacuccacggggaacagucauggacaucauuagucgaagagaucaacgagguuccggacaaguuggcacguauggucucaauacuuuuaccaauauggaagcacaacuuauucggcagauggaaggugaagggauauucaaaucaauucaacaccugaccguuacggaagaaauagcuguccaaaauugguuggcuaggguuggacgagaacgacugagucgcauggcaauaucaggagacgauugcgucguaaagccucuugaugauagauucgcaagugcacuaacagcguuaaacgauauggggaaagugcgaaaggacauacaacagugggaaccaucgagaggauggaacgacuggacacaaguaccuuuuuguagccaucauuuucaugagcugguuaugaaagaugggagaguccuaguugucccuugucgaaaucaagaugaacuaaucggacgcgcacguauaucacagggggcaggguggucacuaaaagaaacggcguguuuggggaaaucauaugcucagauguggacgcuuauguauuuccaccgacgagacuuaagauuagcagccaaugcaaucuguucugcagugcccagccacugggugccaacuucuaggaccaccugguccauucacgcgaaacaugaauggaugacuacagaagacaugcuagcuguauggaauagaguuuggauccaagaaaacccguggauggaagauaagacaccaguagaaucuugggaagaaguaccauaucucggaaaaagggaagaucaauggugugggucauuaauaggccuaacaucccgagcaacaugggccaagaauauacaaacagcgauaaaucagguaagaagccugauagguaacgaagaauauaccgacuauaugccuuccaugaaaagguucagaagagaagaagaagaagccgguguucuaugguaa

SEQ ID NO: 22665 - RNA, 9876 nt, Artificial Sequence
  derived and/or modified CDS sequence (opt6) from DENV-2__GQ868603__SS-prME
acagcugguguaauuauaauguuaauuccaacagcaauggccuuucaucuuacaacaagaaauggagaaccucacaugauaguagggcgacaagaaaaagggaaaucucuacuauucaaaacagaagacggcgucaauauguguacucuaauggcaauagaccugggggaacuaugcgaagauacaauuaccuauaaaugcccgcuacuaagacaaaaugaaccagaagacauugacugcuggugcaauuccacaaguacuuggguuacauacggaacuugcacaaccacaggagaacauagacgagagaaacgaucaguugcguugguaccgcauguugguauggguuuagaaacaagaacggaaacuuggaugaguucggaaggugcuuggaaacaugugcagaggauugaaaccuggauucuacgacauccaggguucacgauuauggcagcuauauuagcauauacuauaggaacaacacacuuucagagagcauuaauuuuuauacuccuuacugccguugcgccaucgaugacaaugagaugcauaggaauuucaaauagagauuuuguagaaggagugagcggagggucauggguagauauaguguuagaacacgguagcugcgugacaacaauggcuaaaaauaaacccacguuggauuuugaauuaauaaaaacggaagcgaaacaaccagccacgcuuagaaaauauugcauagaagcaaaacuaacgaauacuacaacagaaagucgauguccaacacaaggugaaccaucauuaaaugaagaacaagauaaacgauucuuaugcaaacauucuaugguagacagggguuggggaaaugguuguggucuuuucggaaaaggaggaauaguaacaugcgcuauguuuaccuguaagaaaaauauggaaggaaaaguaguguuaccagagaaucuggaguauaccauugugauaacaccccacucgggugaggaacacgcaguggguaaugauacuggaaaacacgguaaagaaauaaaaauaaccccacagaguucuauaacagaggcugaacuaacugguuauggcacugucacuauggagugcagcccgagaacaggacuagauuucaaugaaaugguacuucugcaaauggaagauaaagcguggcugguacaccgacaaugguuucuggacuuaccgcuaccaugguuaccuggagcagauacucagggauccaauuggauccaaaaggaaacgcuugucacguucaagaacccacaugccaagaaacaagacguaguaguguuagguagccaagaaggagcaaugcauacagcacuuacuggagcaacagaaauacaaaugaguaguggcaauuuauuguucacaggacaucuaaaauguagauuacggauggacaaacuccagcuuaaaggaaugucguauaguaugugcacaggcaaauucaaaauagucaaagaaauagcugaaacacaacauggaaccauaguuauuagaguacaguaugagggcgauggaucaccuugcaaaauuccauuugaaauaauggauuuagagaaaagacacguauuggguagacuaauaacugugaaucccauuguaacagaaaaggauucaccggucaacaucgaagcagagccaccguuuggcgacaguuauauaauuauaggcguagaaccaggccaacugaaguugaacugguuuaaaaagggaucaaguauuggacaaauguuugaaacuacaaugagaggggcaaaaagaauggcgaucuuaggggacaccgcgugggauuuuggaucgcugggcggagucuucaccucgauaggaaaagcucuacaucaagucuuuggcgcuauuuauggagcugcauucagcggaguuucguggaccaugaaaauccucauaggggucaucauaaccuggauagggaugaacucaaggagcaccucacuaagcguaagccuaguccuaguggggguuguuacgcuauauuuaggagcaaugguucaggcugauucgggcugcgugguaucauggaaaaacaaggaacucaaauguggaaguggaauauucauaacugacaacguucauacuuggacugaacaauauaaguuucagccagaaucuccaucuaagcuggcgucugcaauccaaaaagcccaugaagaagggauaugcgguaucaggagcgucacuagauuagaaaauuuaauguggaaacagaucacaccggaacuaaaucauauacuauccgaaaaugaaguaaaacuuacgauaaugacaggugauauaaaaggaaucaugcaagcgggaaaaagaucauuacgaccucaaccuacagaguugaaauacucguggaaaacauggggcaaagccaaaaugcugucaacugaaagucacaaucaaaccuuccugauagauggaccagaaacagcggaauguccaaauaccaaucgugcuuggaacucccuggaaguggaagacuacgguuuuggcgucuuuacaacaaauauuugguuaaaauuaagagagaagcaagacguauugugugacaguaaacucaugagcgcagccauuaaagauaacagagccguacaugcagauauggguuauuggauagaaagugcauuaaacgauaccuggaagauggaaaaggcuaguuucaucgaaguaaagagcugucauuggccaaagucgcauacucucuggucaaacggcguuuuagaaucggaaaugauaauucccaaaaauuuugcuggaccuguuucgcaacauaauuaccguccaggauaccauacucagacggcaggcccguggcaucuaggaaaacuagaaauggacuucgauuucugugaggguacgacaguaguuguuacugaggacugcggaaauagggggccuucuuuaagaacuacaacagcgagugggaaguuaauuacagagugguguuguaggagcugcacauugccuccuuugagauacagaggagaagacggguguugguauggaauggaaauacguccuuugaaagagaaggaagaaaaccuuguuaacucuuuggugacugcgggacacggucaaauugauaauuucucccuaggcguucugggaauggcauuauucuuagaggaaaugcuacguacgcgagucggaacaaaacacgcuauacuauuagcagcuguuaguuucguuacacuaaucacagguaauaugucguuuagagaucuaggaaggguaauggugaugguuggggcaacaaugacugaugacauuggaaugggggugacuuauuuagcucuuuuagcggcauucaaaguacgcccgacuuucgccgcuggauuacugcugaggaaauuaacaagcaaggaguuaaugauggcgacaaucgguauagcacuacuuagccaaaguacaaucccugaaacgauacuggaacuaacagaugcccuugcacuugggaugaugguucuuaaaaucguucguaauauggaaaaauaccagcuuguagugacaauaauggcuauauccuguguaccuaacgcggugauccuacaaaaugcauggaaaguaucuugcacaauacuagcggcugugagcguauccccguuauuacucaccucaagcagacaaaaagcagacuggauaccacuagcacugacaauaaaaggacuaaacccgacggcaauauucuuaacaacauuaucacguacaagcaagaaaagaaguuggccguugaacgaggccauuauggcaguaggaaugguaaguauacuagcgucgucacuauugaaaaaugauauaccaaugacaggaccguuagucgcaggaggacuacuaacaguauguuacguccuaacugggcguucugccgaucuggagcuugaacgagcugcagacgucaaaugggaagaccaagccgaaaucucaggcucaagccccauauugaguauuacuaucucagaagacgguaguaugucaaucaaaaaugaagaagaagaacaaacauuaacgauuuuaauacguacugggcuucuaguuauuucuggcgucuucccugucaguauccccaucacagcagcugcgugguauuuaugggaagucaagaaacaaagagcuggugugcuaugggauguaccgagcccucccccaguuggaaaagcagaacuagaagacggugccuacagaauaaagcaaagagggauuuugggguacucacaaauuggcgcgggaguguauaaggaagguaccuuccauacgauguggcauguuacgagaggugcaguacuaaugcacaggggaaaaagaauugaaccaucuugggcagauguaaagaaagaccucauaucauauggaggaggcuggaaacuagaaggugaauggaaagaaggagaggaagugcaaguuuuagcacuagaaccggguaaaaauccaagagcuguacagacuaaaccagguuuauucaaaacgaacacaggaacuauaggcgcagucucguuggacuucucgccagggaccagcggcagcccuauuguugauaggaaagguaaaguuguuggacucuaugguaacggugugguaacgcgaaguggagcauaugugagugcaauagcucaaacugaaaaauccauagaggauaacccugaaauugaagaugacauauuucggaagaaaaggcuaacaaucauggauuugcauccuggcgcuggaaaaaccaaaagauaccucccugcaauuguacgagaggcgauaaaacgaggacuucgcacauuaaucuuagcuccuacacgugugguagcagcagaaauggaggaagcauuaagaggauugccaauaagauaccaaacgccugcaauucgugcagagcauacaggcagagagauuguggaccuaaugugucaugcaacguuuacaaugaggcugcugucuccaguucgugugccgaacuacaauuugauaauaauggaugaagcgcacuuuacagauccagcaucaauagcagccaggggauacauaaguacucggguagagaugggugaagcagccggaauauuuaugacggcgacaccaccggguucaagagaccccuuuccacaaaguaaugcuccuauaauggaugaggagcgugaaauuccggaaagaucauggaacuccgggcacgaauggguuacugacuucaaagggaaaacagucugguucguaccauccauuaaagcaggaaaugauaucgcggcaugucuaaggaaaaacgguaagaaaguaauacaacucucuagaaaaaccuucgauagcgaguauguaaaaacccgggcuaacgacugggauuuuguagugacuacugauaucagugaaaugggcgccaacuuuaaggcugagcguguuauagauccgagaagauguaugaagccugucauuuugacugacggggaggaacgaguuauauuagcaggucccaugccaguuacgcauuccagugcugcgcagcgacgcggccguauaggccguaaccccaaaaaugaaaacgaucaauauaucuauaugggcgaaccgcuggaaaacgacgaagacugcgcacauuggaaagaggcgaagauguuacuagauaauauuaacaccccagaaggaauuaucccaaguauguucgagccagagcgagagaaaguagacgcaauagacggugaguauaggcuaagaggugaagcccguaaaacauucguugauuuaaugcggcgaggagauuuaccugugugguuagcauacagaguggcagcagaaggaaucaauuaugcugauaggagaugguguuuugacgggauaaagaauaaucagauacuagaagaaaacgucgaggucgaaauuuggacuaaagaaggggagagaaagaaacuuaaaccuagauggcuagaugcaagaauauacucagacccauuagcucugaaggaauuuaaagaauuugcagcgggacgaaaaagucucacgcuuaaucugaucacggaaaugggucgacuucccacuuuuaugacacaaaaagcgagagacgcccuagauaaccuggccguuuuacacacugcagaagcggguggccgggcguauaaucacgcuuuaagugaacuuccagaaacuuuggaaacuuuauuauuacuaaccuuguuagcaacugucacuggaggaaucuucuuguuccucauguccgguaaaggggugggcaagaugaccuuaggaauguguuguauaauaacggcauccauccuacuuugguaugcucagauccaaccucacuggauugcggccucaauuauacucgaguucuuucuaauagugcuccuaauacccgaaccagaaaaacaacgcacuccacaggauaaucaacuuacuuauguuguuaucgcaauacuaacuguuguugcugccacgauggcgaacgagauggguuucuuggagaaaacgaagaaagaucucggauugggcaguauuacgacacaagaaucggaaucuaacauuuuagacauugacuugcgaccggccucagcauggacccuguaugccguagcaacuacguucuuuacacccaugcuuagacauaguauagaaaacuccucagugaacguuucucuuacagcaauagccaaucaagcuaccguucucaugggccuuggaaagggauggccucugucaaagauggauauaggaguucccuuacuagcaauaggauguuauagccagguaaacccaauuacccuuacugcagcccuacugcuauuaguggcacauuaugcaauuauugguccaggcuugcaggcaaaagcuacccgagaagcucaaaaacgugcagcagcagguaucaugaaaaauccaaccgucgacggaaucaccgugauugaucucgaacccauccccuacgacccgaaauuugaaaaacaacuaggacagguuauguugcuaauacucugcguuacucaaguauugaugaugagaacaaccugggcccuuugcgaagcgcuaacccucgcuacagguccaauaaguacgcuaugggaagguaauccagguagauuuuggaacacuacuauagcaguaagcauggcaaacauuuucagggguaguuaucuugccggagcgggguuacucuuuaguauuaugaagaacaccacuaacacccguaggggaaccggaaauauuggagaaacauuaggagaaaaauggaagucacgucuaaaugcacucgguaagagugaguuccaaauauauaagaaaaguggcauucaagaaguugauagaacauuagcuaaagaaggaaucaaacgaggcgaaacagaucaucacgcaguuagcagaggaagugcuaaauuaagaugguucguggaacguaauauggugacuccugaaggcaagguuguagaccuaggauguggacgugggggcuggucauacuacugugguggauugaaaaauguaagggagguaaagggauuaacaaaaggugguccuggacacgaggagccuauaccaaugagcacauacggcuggaaucugguaagacuacaguccggaguugacguguucuucacgccucccgaaaaaugcgauacacucuugugugacauuggcgaaucgaguccaaacccuacuauagaggcuggaagaacacucagagucuuaaaucuaguagaaaacugguugaauaauaauacucaauuuuguauaaaagugcucaaccccuacaugccaucgguuaucgagaaaauggaaacucuucagcgcaaauacggaggggcccugguuaggaaucccuuaucaagaaauucgacacacgaaauguacuggguauccaacgcgacuggaaauauagucaguaguguaaacaugauuucgagaaugcugaucaauagguuuacaaugaaacacaagaaagccacauacgaaccagacgucgauuuaggaagugguaccagaaauaucggaauagaaucagaaauaccaaaccuagauauaauuggaaagagaauugaaaagauuaaacaagaacaugaaacaaguuggcacuaugaccaagaucauccauacaaaacaugggcguaucauggcaguuaugagacgaaacaaacaggcucggcuuccucuauggucaacggagucguuagacuucugacuaagccgugggauguuguaccaaugguaacacaaauggcgaugacugauacgacgccauuugggcaacaaagggucuucaaagaaaaagucgauacacguacacaggaaccaaaagaagggacaaagaaauuaaugaaaauaacugcugaguggcuuuggaaagaacuaggcaagaagaaaaucccaaggaugugcacuagagaggaauuuacucgaaaaguuaggaguaacgcggcgcucggagccaucuucacagaugaaaacaaauggaaaucagcacgcgaagcuguggaggauaguagauuuugggaguuaguagaucgagaacgaaaucuucacuuagaagggaaaugcgagaccuguguuuauaacaugauggggaaacgcgagaagaaacucggggaauuugguaaagcaaaagguucacgagccauaugguauaugugguuaggggcacguuuccuagaauuugaagcauugggguuucugaaugaagaccacugguuuucuaggggaaauucacugaguggaguugaaggggagggacuucacagacuaggcuauauacuaagagaugucagcaagaaagaagguggagcuauguaugcugaugacacugcaggaugggauacuaggauaacucucgaagaccucaaaaaugaagaaaugguaacaaaccacaugaagggugagcauaaaaagcuagcagaagcuauauucaaacuuacuuaccaaaacaagguaguacguguucaaaggcccacuccuagaggaacagugauggauauaauaucuaggcgggaccaaagaggcagcggacaagucggaacguacggauuaaacacuuucacaaacauggaagcacaacuuauaagacaaauggaaggugaaggaauauucaaaaguauacaacauuugaccguuacagaagaaaucgccguucaaaauuggcuugcccgaguaggcagagagagacuuucgaggauggcgauauccggagaugauuguguggucaagcccuuggacgauagguucgcuuccgccuuaaccgcgcuaaaugauaugggcaaaguuagaaaagacauacaacaaugggagcccuccaggggauggaacgauuggacccagguaccuuuuugcagucaucacuuucacgaguuagucaugaaagauggacgcguuuuaguaguuccuugcaggaaucaagaugaauuaauuggcagggcccggaucucccaaggagcagguuggucgcuuaaggaaacagcuugucucggcaaaaguuaugcacaaauguggacuuuaauguauuuucacagaagagauuuaagacucgcagcaaaugcaauauguucugcuguuccaagccauugggucccaacuagcagaaccaccuggagcauacaugcaaaacacgaauggaugaccacagaagacaugcuggcgguuuggaaucguguuuggauacaagaaaauccuuggauggaagauaagacgcccguagagucaugggaggaagucccuuaccugggaaaaagagaagaucaauggugugggagucuuauaggacuaacaaguagggcaacuugggcuaaaaacauucaaacugcaauaaaucagguaagaagucuuauaggcaacgaggaguacacggauuauaugccgagcaugaagcgguuuaggagagaagaggaggaagcaggcguacuaugguag

SEQ ID NO: 22666 - RNA, 9876 nt, Artificial Sequence
  derived and/or modified CDS sequence (opt6) from DENV-2__FJ898450__SS-prME
acugcugguguaauuauaauguuaauuccaacagcgauggcuuuucaccuaacaacucgaaauggugaaccacacaugauaguuggccgacaggaaaaagggaaaaguuuauuauuuaaaacugaagauggcguuaauauguguacuuuaauggcgauagacuuaggagaacucugugaagauacuauaacauacaaauguccuuuacugagacaaaaugaaccagaagauaucgacuguugguguaauucaacaucuacauggguaacauauggaacauguacuacgacuggugagcaucgacgagaaaaacgaucuguugcacugguaccucauguugguaugggauuagaaacuagaacugaaacauggaugucaagcgaaggagcauggaaacauguacaacguauugaaaccuggaucuuaaggcauccaggauuuacuauuauggcagcuauccuagcguauacgaucggcacaacgcauuuucaaagagcauugauauuuauucuuuugacagcaguagcucccaguaugacaaugcgauguauagguaucucgaaucgcgauuuuguggaaggaguaagcggggguaguuggguggauauuguccucgagcaugggaguugugugacaacuauggccaaaaauaaaccgacccuugacuuugaguugauuaaaacagaagcaaaacaaccagcuacauuaagaaaauauuguaucgaagcuaaguuaaccaacacuacgacagaaucgagguguccuacucaaggugagcccucgcucaaugaagaacaagacaagcgauuuauuuguaaacauucuauggucgauaggggauggggcaacgguuguggacucuucgguaaagggggaauugugacaugcgcuauguuuacguguaagaaaaauauggaagggaaagugguacugccugagaaccuagaguauacaaucgugauaaccccgcauucgggugaagaacacgcaguugguaaugauacagggaaacauggaaaagagauuaaaauaacuccacagucaaguauuacggaagcugagcuaacaggauacgguacggugacuauggagugcaguccuaggacaggacuggacuuuaacgaaaugguauuacuccaaauggaagauaaagcauggcuaguucacagacaaugguuuuuagaccuaccacucccuugguuaccaggugcagauacccaagguucuaauuggauccaaaaagagacucuaguuaccuuuaaaaauccacaugcaaagaaacaggauguuguuguucuaggaagccaagagggcgcaaugcacacagcccuaacaggcgcuacagaaauucaaaugucuagcggaaaucuucuauucacaggucaucuuaaaugucgccugagaauggacaaacuccaacuaaaaggaaugucuuacuccaugugcacaggcaaauuuaagauuguuaaagaaauagcagaaacccagcacggcacgaucgugauacgaguacaauaugaaggugacggaucuccaugcaagaucccauuugagauaauggaucuagaaaagaggcauguauuaggacgacuuauaacuguaaauccgauaguaacagaaaaagauagcccuguuaauauugaggcagaaccacccuucggagacucauauauaauuauaggagucgaaccgggacaauugaaauuaaacugguucaaaaagggcaguaguauaggacaaauguucgaaacaacgaugagaggugcuaaaagaauggcuauacucggagacacggcuugggauuuuggaucucuuggaggcguguucacaucaauaggcaaggcuuuacaccaaguauuuggugcaauuuacggcgcggccuucagcgggguuaguuggacaaugaagauacugauaggaguaaucaucacguggauaggcaugaacucaagaucaacaucuuugucagucagcuuaguucucguaggcgucguaacgcuuuaccucggagcaaugguucaggccgauaguggaugugucgucucuuggaaaaauaaagaauuaaaaugcggaucagggauauucauuacggauaauguccacacauggacagaacaauauaaauuccaaccugaaagcccuucuaaacuugcaucagcaauacaaaaagcucacgaggaaggaauaugugguauuagaucgguuacaagacucgagaaucuuauguggaaacaaauaacuccggagcugaaccauauuuuaagcgaaaaugaaguuaaauuaacaauuaugacuggggacauaaaagggauuaugcaggccgguaaacggucacuaaggccgcagccaacagaacuaaaauacucuuggaaaacgugggguaaggcgaaaauguuaagcacugaaucgcauaaccaaaccuuucuaauagacggaccugaaacugcugaaugcccaaauacgaauagggcuuggaacucacuugaaguugaagacuaugguuucgguguauucacaaccaauauaugguuaaaacuuagagaaaaacaagaugccuuuugugacagcaaguuaaugagugcggcaaucaaagauaacagagcaguacaugcggauauggguuacuggauugagucugcucuaaaugauacguggaagauggaaaaggcaucuuucauugaagucaagucgugucauuggccgaaaagccauacccuauggucgaaugguguuuuggaaucugaaaugauaauacccaagaauuucgcggguccggugagccaacauaauuaucgaccuggcuaucauacacaaacugcgggaccguggcaccuagguaaauuggaaauggauuucgauuucugugaagguaccaccguuguaguaaccgaagacugcgggaaucgaggucccagcuuaagaacaacuacggcaaguggaaaauugauaacagaauggugcugccgaaguugcacauugccuccguuacgcuaccgaggugaagaugggugcugguauggaauggagauaagaccauuaaaagagaaagaagaaaauuuagucaauagcuugguuacagccggacacggacaaauagacaauuucaguuuaggagucuuaggaauggcucuauuccucgaagaaaugcuaagaacuagaguggguacgaaacacgccauacuauuaguagcgguaucauuuguaacccucauaacaggaaauaugucuuuucgugaucuaggacgcgucaugguaaugguaggagcaacuaugacagaugauauuggaaugggcguaacguaucuggcucuacucgcagcuuuuaaaguuagacccacuuuugcagcuggucuccucuuaagaaaacuuacauccaaggaacuaaugauggcaacuauagguauagcacuucucucacaaucuacuauaccugagacaauacuggaacuaacggacgcccuggcucuaggcaugaugguguuaaaaauuguacgaaauauggaaaaauaccaacuagcuguaacgauaauggcaaucucaugcguaccaaaugcaguuauauuacagaaugcauggaaaguaucauguacgauauuagcagcaguaucuguaucgccauuguugcuuacaucaucacaacaaaaagcagauuggauccccuuagcgcuaacaauuaaaggacugaauccaacagcgauauuuuuaaccacguugucaagaacaucgaagaaaaggucauggccauuaaacgaggcaguaauggcgguaggaauggugucuauauuagcaucgucucuauugaaaaacgacauuccaaugacaggcccauuaguagcgggagguuuacuuaccguuuguuauguauuaacgggacgauccgcagaccuagaguuagaacgggcagcugacguaaaaugggaagaucaagcagagauaagugguagcaguccgauacuuaguauuacaauaagugaagauggaucaaugucaauuaaaaaugaagaagaagaacaaacuuuaacaauacuaauacgaaccggacuuuuaguuaucagcgggguuuucccgguaucaauaccaauaaccgcagcugcaugguaucuaugggaagucaagaaacaaagagcagggguucugugggaugugccaucaccaccucccguagggaaagcggaacuagaagacggagcuuaccggauuaaacaaagaggaauccugggauacucucaaaucggagcugggguauacaaagaagguacauuccauacuauguggcauguaaccagaggggcaguucucaugcaucgcgguaagcggaucgaaccuuccugggcagauguuaagaaagaucugauuucguauggcgguggauggaaauuagagggagaauggaaagagggagaagagguccaagucuuagcauuagaaccagggaaaaaccccagggcaguacaaacuaagcccgguuuguuuaaaacuaauacaggaacuauaggagcuguuucacuagauuuuucaccagggacgucagguucaccgauuguggaccgaaaaggaaagguaguaggacuguauggaaacggaguagucacacguucgggggcauauguuucagcgaucgcacagacagaaaaaucaauagaagacaacccagaaauagaagaugauauauucagaaagaaacgucucaccauaauggauuuacaucccggggcugggaaaacuaaacgcuaccugccugcuauuguuagagaagcuaucaaacguggauuacguacccuuauuuuagcgccaacacgaguaguugcagcagagauggaagaagcacuuagaggacuacccauacgauaucaaaccccugcuauacgagcagaacauacuggccgagaaauugucgaccuaaugugucaugcaacauucacaaugcgguuauuaucgccaguaagaguaccaaauuacaaccucauuauaauggacgaagcucauuuuaccgauccagcuucaaucgcagcucgcggguauauauccacacgagucgaaaugggggaggccgcgggcauuuucaugacagcaacgcccccggggucuagagacccauuuccccaaagcaacgccccuauaauggaugaagagagggagauaccagaaagaagcuggaacucgggacacgaaugggugacagacuucaaaggaaaaacaguaugguucguaccaagcaucaaagcggguaacgauauugccgcaugccuuaggaagaacggcaagaaagucauucaauugaguagaaaaacauuugauagcgaauauguaaaaacaagagcaaacgacugggauuuuguaguaacaacagauauaagcgaaaugggugcuaauuucagagcugagcguguaaucgauccacguagguguaugaaaccaguaauacucacagacggcgaggaaaggguaauucuugcaggcccuaugcccguaacucauucuuccgcagcgcagcgacgcggacgaauagguagaaacccgaaaaaugaaaaugaccaauauauuuauaugggugagccucuagagaaugaugaggacugugcucacuggaaagaagcuaaaauguuauuagacaauauuaacacgccggagggcaucauaccauccauguucgaaccagaacgggaaaagguugacgcaauagauggugaauaccggcuuagaggcgaagcacguaagaccuuuguagacuuaaugagaagaggagauuuaccuguaugguuagcguaccgaguugccgcagaggguauuaacuacgcggaucguagaugguguuuugacggaaucaaaaauaaccaaauauuagaggaaaaugucgaaguugaaauuuggaccaaggaaggagaaaggaagaagcuaaagcccagaugguuagaugcuagaauauacagugacccucuugcacuaaaagaauuuaaagaguuugcagcagguagaaaaagucucaccuugaacuuaauuaccgaaaugggacgacuaccaacauucaugacacaaaaggcucgcgaugcccuggacaaccuagcuguuuuacauacugcggaagcugggggacgagcauauaaccaugcgcuuucugaguugccagaaacuuuagaaacccuacugcuacugacguuacuagccacaguuacaggaggaauauuuuuauuccucaugucaggaaagggaauugggaaaaugacuuuaggaauguguuguauaauaacagcaucuauauuacuaugguaugcacaaauacagccacauuggauagccgccuccauaauacuugaauuuuucuugauuguacuucucauuccggaacccgaaaagcaacgaacuccucaggauaaccaguuaacuuauguaguaauugccauauugacgguaguagcagccacaauggcaaaugaaaugggauuuuuagagaaaaccaagaaagaucucggucuugguaguauuacuacucaagaaucugaaagcaauauauuagauauagaucuacgcccugccagugcuuggacacuauacgcgguugcuacaacauucguuacgccaauguuacgucacuccauagaaaauucaucagucaacguaucgcuaacggcuauugcuaaucaagcuaccguauugaugggccucggaaaaggauggccuuuaucaaagauggauauaggcgucccauuauuggcuauuggguguuauucucaagugaauccaauuacccuaacugcagcgcuucuucucuuaguagcacauuaugcaaucauagguccgggauuacaagcaaaagccacuagagaagcacaaaagcgagcugcagcugguauaaugaaaaauccaacuguggacggaauuacaguuauugaccuagaaccgauuccauacgacccaaaauuugaaaagcaauuaggacaaguuaugcuuuuaaucuuaugcguaacucaaguacuuaugaugaggacgacuugggcguuaugugaggcuuuaacuuuagcgaccgguccaauaaguacucuaugggaaggcaacccaggaagauuuuggaauacuacaauagcaguaucuauggcaaacauauuucgcggcucuuaucuagccggggccggguuauuguucagcauaaugaagaauacuaccaauacacgacgaggcacugguaauauaggagaaacacuuggggaaaaauggaagaguagguuaaacgcccucggaaaaagcgaauuucaaauauacaagaaaagcggaauacaggaaguagauagaacuuuggcgaaggaagggauuaaacgaggugagaccgaucaucacgcaguaucgaggggguccgcuaaauugaggugguuuguugaaagaaacaugguaaccccugaaggaaaaguaguugacuuaggauguggaaggggaggauggaguuacuacuguggaggacuaaagaauguacgagagguaaaaggacuaaccaaaggaggacccggucaugaagaaccaauaccaauguccacauauggauggaacuuagucaggcuacaguccggaguggacguguucuuuacaccuccugaaaaaugugacacacuccuaugcgauauaggggagaguucucccaacccaacuauugaagcagggaggacgcugagaguucuuaaccuuguugagaauugguugaauaauaacacccaauuuuguauuaaaguccuaaauccauacaugcccaguguaauagagaaaauggaaaccuuacagcgaaaauaugggggcgccuuaguaagaaacccauuaucuagaaacucaacgcaugaaauguauuggguaagcaaugcuacgggaaacauaguaucuucagucaauaugauuaguaggaugcugauaaaucgauuuacgaugaaacauaagaaggcaacauaugaaccugacgucgauuuaggaucagggacccgaaacauaggaaucgaaucggagauuccuaaucuugacauuauaggaaagagaauagagaaaauaaaacaagaacaugaaacaagcuggcauuacgaccaagaccauccguaccguaccugggcauaucacggaucauaugaaaccaagcaaacggguucugcgagcaguaugguaaauggugucgugaggcuauuaacaaaaccaugggacgucgugcccaugguuacgcaaauggcuaugacagauacuacgccguucggacagcaaagaguguuuaaagaaaaagucgacacacggacacaagagccuaaggaagguacuaagaaacugaugaggauaacagcggaaugguuauggaaggaacuuggcaagaagaaaacuccucgaauguguacucgcgaagaauuuaccagaaaagugcgcagcaacgcugccuugggggcgauuuuuacagaugaaaauaaauggaaaucagcuagagaggccguggaggacagcagguuuugggaauugguagaucgggagcgcaaccuucacuuagagggaaagugugaaacaugcgucuacaauaugaugggaaagcgagagaagaaacuuggugaguucggaaaggccaaagguucgcgagccauaugguacauguggcucggggcuagauuccucgaguucgaggcucucggauuuuuaaacgaagaccacugguuuaguagagggaauagccucagugguguugagggagaaggcuugcaucgccucggcuauauccuaagagacguauccaaaaaggaaggaggggcaauguaugcagacgacacagcgggaugggauacaagaaucacacuagaagauuugaaaaacgaggagaugguaaccaaccauaugaaaggggaacauaagaaacuagcagaagccauauucaaacucacuuaccaaaacaaagucguaagagugcaacgaccaacaccccgaggaacaguuauggacauuauaucaagacgugaucaacgaggaucagggcaagucgguacauacggauuaaacaccuuuacaaauauggaagcucaacuuauucgacagauggaaggggaagguauauucaagaguauacagcacuuaacgguaaccgaggagauagcuguucaaaacugguuagcaagagucggaagagaaaggcuaucuaggauggcuauuagcggggaugauugugucgucaagccacuggaugaucgauuugcaucugcauugaccgcauugaaugacauggggaagguuagaaaagacauacaacaaugggaaccuucucgagguuggaaugauuggacacagguccccuuuuguucccaucacuuucaugagcuaguuaugaaggauggaagaguauuagucguucccugcaggaaucaggacgaacucaucggacgagcucggauaucucagggugcgggauggagcuuaaaagaaacagccugucugggaaaguccuaugcacaaauguggacacuaauguacuuucaucguagagaccuaagacuagcggcaaaugccauaugcucagcgguuccaagccacuggguaccaacauccaggaccacuuggaguauacacgcaaaacaugaguggaugaccacugaagacauguuagcaguuuggaacagaguuuggauacaagagaacccauggauggaagauaagacaccaguagaaucgugggaggaggucccuuacuuagguaagagggaggaccagugguguggcagcuuaauaggauuaaccucaagggccacaugggccaaaaauauucaaaccgcaauaaaucaagugagaucauuaaucgggaacgaggaauauacugacuauaugcccucaaugaaacguuuucggagagaggaggaagaagcggguguuuuaugguaa

SEQ ID NO: 22667 - RNA, 9876 nt, Artificial Sequence
  derived and/or modified CDS sequence (opt6) from DENV-2__FJ898453__SS-prME
acggccggaguuauaguuaugcucauaccuacagcaauggcuuuccaucucacuacccgaaauggugaaccccauaugauaguuggaagacaagaaaaaggaaaauccuuauuguuuaaaaccgaagaugguguaaauaugugcacacucauggcaauagauuuaggggaacugugugaagacacuaucacuuacaaauguccguuauuaaggcagaaugaaccagaagauauugauuguuggugcaauuccacaucuacgugggucacauacggaacguguacaacgacaggagaacauaggcgagagaaaagaaguguagccuuggucccucauguagguaugggguuagaaacucgaaccgaaacauggaugagcucagaaggcgcauggaaacacguacaaagaaucgaaacauggauuuugcgacacccaggauuuacaauuauggcagcaauauuagccuacacgauaggaacaacacacuuccaaagagcauuaauauucauuuuauuaacugccgucgcaccgucaaugacaaugagaugcaucggaauuaguaaucgugauuuuguagaaggagucagcggcggauccuggguagacauaguccuugaacauggcucuuguguaacaacuauggccaaaaauaaaccaacauuagacuuugaacuuauuaaaacugaagcgaaacaaccagcuacucuacggaaauauuguauagaagcaaaacugacaaauaccacuacugaaucuagauguccuacacagggcgaaccgucguugaacgaagaacaagacaaaagauucauuuguaaacauucgauggucgauagaggcuggggcaacggauguggucuguuugguaaaggcggcauaguaaccugcgcaauguuuacaugcaagaaaaauauggaaggcaaaauugugcaaccggaaaaucuugaauacacuaucguaauaacuccccacucuggagaagaacaugcaguaggcaacgacaccgggaaacacgggaaagaaauaaaaauaacaccacaaucuucgacuacggaagcugaacuuaccggcuaugguacaguuacuauggaauguagcccccguaccggcuuagauuuuaacgaaaugguacuguuacaaauggaagauaaggcuuggcuaguucaucgacagugguuuuuggaucucccucuaccauggcugccaggugcggauacacaagguucgaauuggauacaaaaagagacguuaguuacuuucaaaaauccacacgcuaagaaacaggauguagugguuuuaggaagccaagaaggagcaaugcacacagcauuaacaggcgcgacugaaauucagaugucaagcggaaaccuauuguuuacgggacacuugaagugucgucuccgaauggauaaauuacaauugaaaggcaugucauacaguaugugcacuggaaaauuuaagaucguuaaagaaauagcagaaacacaacacggaacaaucguaauucgcguucaauaugaaggcgaugguucgccgugcaaaauaccuuuugaaaucaccgauuuggagaaaagacacguacuaggucgccuaaucacaguaaacccuauaguaacagaaaaagauucgccugucaauauugaagcagagccaccuuuuggggauaguuacauaauaguagguguggagccaggccagcuaaaacuuaacugguuuaaaaaggguucuagcauuggucaaauguuugaaaccacaaugcgcggcgcgaagagaauggcaauucugggagauacggcuugggacuucgggucacuagggggaguuuuuacaucaauagguaaggcuuuacaucaagucuucggagcaaucuacggugcugcguuuuccgguguuagcuggacuaugaaaauacuuauaggggucauaaucacguggauaggaaugaauagccgaagcacuagcuuaucaguaucucuuguauuaguaggaguaguaaccuuauaucugggagcaaugguucaagcagauagcggaugcauaguuucguggaagaauaaagaacuaaaauguggaucuggaauauuuauaacugauaaugugcacacuuggacagaacaauauaaauuccaaccagagucgccaaguaaauuagcaagcgccauacagaaagcacacgaagaagggauaugcgguaucagaagugugacucgguuggaaaauuuaauguggaagcaaauaaccccagagcuuaaccacauacuaagugaaaaugaaguaaaacuaacaauaaugacaggcgacauuaagggcauaaugcaagcaggaaagcgaagucuaagaccacagccgacugagcugaaauauucuuggaagacauggggcaaggcgaaaaugcuauccacagaaucccacaaucaaacauuuuuaauagaugguccagagacagcggaauguccaaauacaaaucgcgcguggaacucauuggaaguugaagauuauggauuuggaguguucuccacuaauauauggcuuaaacuccgagagcgacaagauguauuuugugauucuaaauugaugagcgcagcaauuaaagacaacagagcaguucaugccgauauggguuauuggauugagucagcacuaaaugacaccuggaagauggaaaaagcuaguuuuauagaaguuaaaucgugccauuggccaaaaucucacacacuauggagcaauggcguucuagaaucagaaaugauaauuccgaagaacuuugcuggaccaguuucucaacacaauuacagaccaggguaucacacacaaacagcagggccauggcauuugggaaaacuugaaauggauuuugacuucugugaaggcacaacagucgugguaacggaagauugcggaaacaggggcccaucccuacguacaacaacagcaucgggaaaauuaauuaccgaaugguguugucguucuuguacgcucccgccucuuagauauagaggagaagauggauguugguaugguauggaaauacgaccuuuaaaagaaaaagaagaaaacuuaguaaacucuuugguaacugcgggucauggucaaauagacaacuuuagccuagguguucuaggaauggcuuuauuuuuagaagagauguuacgaacacgggugggaacaaaacacgcuauauuacuuguagcacuuucguuuguuacacuuauuaccgguaauaugucauuucgggaccuagggagggugauggucaugguuggggcaacaaugacggaugacauugggaugggugucacauaucuagcucuacuagcggccuuuaaaguucgaccaacuuucgcggcaggcuuacuucuuaggaaauuaacuucaaaggaacuaaugauggcaacaauaggcauagcucuacuuagucagucaacguuaccugagacaauucuggaacuaacggacgcacuugcguuggguaugaugguauuaaaaauaguuagaaauauggagaaauaucaacuugcgguuacgauuauggccauuucuugcguaccaaaugcugucauauuacaaaacgcuuggaaagugaguugcacaauacuagccgcaguuagugucagucccuugcuacugacaaguucucaacaaaaggcugacuggauaccuuuagcgcucaccauaaaaggucuaaaucccaccgcuaucuucuugacaacguugucucguacaaguaagaaacggucuuggccucuuaacgaggcuauaauggcaguuggaaugguuaguauauuggcaucuucguuacuaaagaaugauauuccuaugacagggccauuaguagcugguggccuucucaccguguguuacguucuuacuggccgcuccgcagacuuagaguuagaacgagcagcagauguaaaaugggaggaucaggcagagauaucaggaaguucuccaaucuuaagcauuacaauaucugaagaugggucaaugagcauuaaaaacgaggaagaagaacaaacacugaccauacuuauacgaacuggucuucuaguuauuucagggguuuuuccaguuuccauaccgauaacugccgcugcaugguacuuaugggaaguaaagaagcaaagggcggguguauuaugggaugucccgucaccaccaccuguagggaaggcagaacuagaagacgguguuuauaggauaaaacagcgagguauuuuaggauauucucaaauaggagcgggcgucuauaaggaagguacguuucacacaauguggcauguuacaagaggugcugugcuuaugcaucgagguaaaagaauugaaccuucaugggcagauguaaagaaggaucuuauuucauauggagguggauggaaauuggaaggagaguggaaagaaggagaagagguacaaguccuugcacuugaaccaggaaagaauccuagggccguacaaaccaagccggguauuuuuaagacgaauacuggaacaauaggugcaguaagucuugacuuuagcccugguacaucugguagcccaauaguagaccgcaaaggaaaaguuguuggacucuacgggaauggcguagugacaagaucaggugcuuauguaagugccaucgcacaaacggagaaaagcaucgaggauaauccagagauagaagacgacaucuucaggaaaaagaggcuaacaauuauggaccuccaccccggcgcuggcaaaacaaagagguauuugccggcuauagugagggaggcuauaaagaggggacuaaggacgcuuauccuagcgccaacgcgagugguggcagcugaaauggaggaggcuuuaaggggacucccaauaagauaucaaacgccagccauccgagccgaacacacuggacgagaaauuguagaccuaaugugucacgcaacauuuacgaugcgacuucucaguccaguucgugugcccaauuacaauuugauaauuauggaugaagcucauuucacagaucccgcuucaauagcugcuagaggcuacauaaguacacgcguggaaaugggagaagcggcagggauuuuuaugaccgccacuccaccuggaagucgagaucccuucccgcaaucaaaugccccuauuauggaugaagaacgugagauuccugagagaagcuggaacagcggucaugaauggguuacugacuuuaaagggaagacagugugguuuguuccgucuauaaaagcuggaaacgacauagcagcaugucuaaggaagaauggaaagaaggucauccagcuaucacguaaaaccuucgauagcgaguauguaaaaacacgugcgaaugauugggacuucguggugacaacggacaucuccgaaaugggugcgaauuuuaaagcagaaagaguuaucgacccaaggcgguguaugaaaccggucauccuuacagauggugaggaaagaguaauacuagcagguccaaugccaguaacccauaguuccgcugcgcaacgaagaggccgcaucggucgaaauccuaaaaaugagaacgaucaauauauuuauaugggcgagccacuugagaaugaugaagacugugcacauuggaaagaggcuaagaugcuucuagacaauauaaacacuccagaaggcauaaucccguccauguucgaacccgagagagaaaagguugacgcaaucgacggagaauaccgacuaagaggagaagcaaggaagaccuuugucgaccucaugcgacgcggugacuuacccguaugguuagcauauaaagucgcugcugaagguauaaauuacgcggacagaaaauggugcuucgaugguauuaaaaauaaucagauauuagaagaaaauguggaaguugaaauauggacuaaggaaggugaacgaaagaaauuaaaaccacgguggcuugacgcucgcaucuauucagauccacuugcauugaaagaauuuaaagaguuugcagcaggacgcaaaagccucacuuuaaauuuaauuaccgaaaugggacgcuuaccaacauucaugacacaaaaggcaagaaaugcguuagacaaucuagcaguauuacauacugcugaaguaggaggccgagcauauaaucaugcccuaucugaguuaccagagacacuagagacgcuccuacugcuaacauuacucgcuaccguaacaggcgguauauuucucuuucucaugucgggcaaagggauaggaaaaaugacacucggaaugugcuguauaauaacagcguccauacugcuaugguaugcucagauucaaccacacuggauagcagccucuauaauacuugaguucuuuuuaauaguucuacucaucccggaaccggaaaaacaaagaacgccucaggauaaccaauuaacuuacguagucauugcaauacuuacaguuguagcagcgaccauggcuaacgaaaugggcuuucucgagaaaacuaagaaagauuuagguuuugguaguauuacuacacaggaaucagagagcaauauccuagacauagaccuucgaccugcaucugcuuggacucuauaugcaguagccacaacuuucgucaccccuauguuacgccacagcauugaaaauagcuccgucaaugucagucuaacugccauugcuaaucaagcuacaguguugaugggacuggguaagggauggccuuuaucuaaaauggauauaggaguaccacuauuagcuauagguuguuauucgcagguaaacccuauuacuuuaacagcggcacuauuauuacucgucgcucauuaugcaauaauaggaccagggcugcaggcgaaggcaaccagagaagcucaaaagagagcugccgcaggaauuaugaagaaccccacggucgacgggauaacaguaaucgaucuagaaccuauaccauaugauccaaaguuugagaaacaguuaggccaagucaugcuuuuaauauuaugcgucacacaaguacucaugaugcgaacaacuugggcgcuuugugaggcuuuaacguuagcuacaggaccuaucaguacacuaugggagggaaaccccgggcgauuuuggaauacgacgauagcuguaagcauggcaaauauuuuccgaggaucauacuuggccggagcaggacuacucuucuccauaaugaaaaauacaacgaauaccagaagagguacaggaaauguuggggaaacacuuggagaaaaauggaagucaaggcuaaaugcacuaggaaaaagcgaauuucaaauauacaagaaauccgggauacaagaggucgacaggacuuuagcuaaagagggaauaaaacguggagaaacagaucaucaugccgucagucgaggcagugcgaagcuaaggugguucgucgaacggaauauggucgcaccagaagggaaagucguagaucuaggaugcggaagagguggaugguccuauuauuguggugggcugaaaaaugugagagaagugaaaggacuaacaaaagggggcccuggccaugaagaaccuauacccaugucaacauauggguggaaucuaguacgacuacagucgggagucgauguguuuuucacacccccggagaagugcgacacacuacucugcgacauaggggagucaagcccgaacccuacgauugaggcuggaaggacguuacguguucuaaauuuaguugagaacuggcuuaauaauaacacucaauucuguauaaaaguacuaaacccauauaugccaucgguuauagaaaagauggagacacugcagagaaaauacgguggcgccuuagugcgaaauccuuuaucucgaaacucgacccaugaaauguauugggucaguaacgccaccgggaauauugucaguucaguuaauaugauuucucguaugcuaauaaacagauuuacgaugaagcacaagaaagcuaccuaugaaccggauguggaucucgguucugggacacgcaauauagggaucgaaucagaaauaccgaacuuggauauaauuggaaaacguauagagaagaucaagcaagagcacgaaacuucguggcauuaugaccaagaucauccauacaaaacaugggcguaucacggaagcuaugagacaaagcagacuggaagcgccucaaguauggugaauggcgucguaagacuuuugacuaaacccugggauguaguccccaugguaacacaaauggcuaugacagauacaacuccuuuugggcagcaacguguuuuuaaagaaaaagucgauacacguacacaagagccgaaagaaggaacaaagaagcucaugaaaauuacagccgaauggcucuggaaagagcuuggcaaagaaaagacuccgagaaugugcacgagggaggaauuuaccagaaaagucagaagcaaugcagcgcuaggcgccauauucacugacgaaaauaaauggaagucagcccgugaggcggucgaagaugguagauuuugggaguuaguagauagggaaagaaaucuacaucuggaagguaaaugugaaacuugcgucuacaauaugaugggaaagagagagaagaaauuaggcgaauuuggaaaggccaagggaaguagagccauaugguauaugugguugggggcacguuuucuugaguucgaagcauugggauuccuuaaugaagaucauugguuuucaagagggaauagccucucuggcgucgagggcgagggucuacauagauugggauacauucuuagagaaguagggaaaaaggaaggaggugcaauguacgcggaugauaccgcagggugggacacaagaauuacauuggaagauuugaaaaaugaagaaaugguaacaaaccauaugaaaggagaacauaagaaacuagccgaagccauauucaaacuuacuuaccaaaauaaaguaguucggguacagagacccacuccaagaggcacaguuauggauauaauaucuagaaaagaccaaagaggaucaggucaagugggaaccuauggacuaaacacguuuacaaacauggaagcacaacuaauucgucaaauggaaggggaagggauauuuaaaagcauacaacacuuaacagucacugaagaaauugcggugcaaaauuggcuugcucguguaggaagagaacgucucucaaggauggcaauuagcggugacgauuguguuguuaagccgauagaugaucgauucgcaagcgcuuuaaccgcacugaaugauauggggaaagucagaaaggacauucagcaaugggagccaucacgcgguuggaaugauuggacccaaguucccuucuguagucaucauuuucaugaacuugugaugaaagauggcagaguucuaguagugccgugcagaaaccaagaugaacuaauaggcagagcacgaauaucacaaggggccgguuggaguuuaaaggaaacagcuugccuaggaaagucuuacgcgcaaauguggacacuuauguauuuucauagacgugacuuaaggcuugcggcuaaugcaaucuguucugcgguaccuucccauuggguuccuacaagccgaacuacuuggucaauccaugcaaagcacgaguggaugacuacagaagacaugcucgcuguauggaauagggucuggauacaagaaaauccguggauggaagauaagacgccuguggaaaguugggaggaaguuccuuauuuaggaaaaagagaggaucaaugguguggaucgcuuauuggucuuacaucucgagcuacaugggcuaaaaauauacaaacagcaauaaaucaaguaagaucuuugauagguaaugaagaauauacagacuacaugcccuccaugaagagauucagacgagaggaagaagaagcagggguauugugguag

SEQ ID NO: 22668 - RNA, 9876 nt, Artificial Sequence
  derived and/or modified CDS sequence (opt6) from DENV-2__EU482445__SS-prME
agugcagggaugauaauaauguuaauuccgacuguaauggcauuccauuugacaacaagaaauggggaaccucacaugauaguaggaauacaagaaaaaggaaaaucacuccuuuucaaaacagaagauggugugaauauguguacgcuuauggcuauggauuugggagaauuaugcgaagauacuauaacuuacaaaugccccuuguuacgacaaaacgaaccagaagacauugauuguugguguaauagcacaucaaccuggguaacuuauggaacuugcacgacgaccggagagcaucgacgggagaaaagaaguguagcauuaguaccccacgucgguauggguuuagaaaccagaacagaaacauggaugagcucugaaggagcuuggaaacaugcacagagaaucgagacauggauccuucgacauccaggauuuacaaucauggcugccauauuagcuuauacuauugguaccacacacuuccaaagaguucuaauauuuauacuccuaacggccguagcaccaucgaugacaaugagauguauaggaauuaguaauagagauuuuguagaaggcgugucuggggguucuugggucgauauuguucuagaacacgguucuuguguaacuaccauggcuaaaaauaaaccaacuuuagacuuugagcuuauaaaaacggaagcaaaacaaccugcgacguugcguaaauauugcauagaagcuaaacuaacaaauacuacuacagagagccgaugcccaacccaaggcgagccaucauugaaagaagaacaagauaaaagguucguauguaaacacucaaugguugaccguggguggggcaauggauguggccuguuuggaaaaggugggauaguaacaugcgcaauguucaccuguaagaaaaacauggagggcaaaauuguacagccagaaaaucucgaauacacaauaguagucacaccucauaguggagaagaacacgcaguggguaaugauacagguaaacacgggaaagaaauaaaaguuacaccgcaaaguagcauaacugaagcugaacuaacgggauaugguacagugacuauggagugcucuccuagaacaggcuuggauuucaaugaaauggucuugcuacaaauggaaaacaaggcuugguuaguucauagacaaugguucuuagaucuaccccuacccuggcugccgggagcggacaaacaagaaaguaacuggauccaaaaagaaacgcuaguaacauuuaaaaauccacacgcgaagaaacaagauguaguuguucuggggucccaagaaggcgcaaugcacacagcccuuacaggagcuacggaaauucaaaugagcucagguaaucuguuauuuaccgggcaccuaaaaugccgucuaagaauggauaaacuccaauugaaaggcaugagcuauagcauguguacggguaaauucaaaguaguaaaagagauagcugaaacgcaacacgguacaaucguuauacgaguacaguaugaaggagacggcuccccgugcaagauaccauuugaaauaauggaccuggaaaaacgauauguuuuggggaggcuaauaacaguuaauccaaucguaaccgaaaaagauucaccgguuaauaucgaagcggagcccccguuuggagacaguuacaucaucaucggaguggaaccgggacaauugaaacuuaacugguuuaagaaaggauccagcauaggacaaauguucgagacaacgaugaggggagcaaagcgaauggcaauacucggggauacagcaugggauuucggcucauuagggggcguauuuacaagcauuggaaaagcccuacaccaaguuuucggagcgauuuauggagcggcauuuucggguguaucguggacauuaaaaauacuuauuggagucauaauuacauggauugguaugaacucgagaucuacgaguuuaucuguaucucuuguuuuaguaggcaucguaacguuguaucuagggguaaugguacaagcagauuccggauguguaguauccuggaaaaacaaagaauuaaaaugcggaucagggauuuucauaacagacaauguacauacguggacagagcaauacaaauuucagcccgaaaguccgucgaaacucgcuucugcgauucaaaaggcucaagaagaaggaauuugugguauuaggaguguuacccgguuagaaaacuuaauguggaaacaaauaacacccgaauuaaaucauauucuggcugaaaaugaaguaaaacuaaccauaaugacuggcgacauaaagggaauuaugcaggcgggaaagcggucuuuacgcccacaaccgacagaacugaaauauagcuggaagacgugggggaaggcaaaaaugcugucaacggagucauacaaucagacauuccuuauugauggaccugaaacuacggaauguccaaacacaaacagagcuuggaacucguuagaaguagaagauuauggguucggugucuuuacaacuaacauuuggcugaaguuaaaggagaaacaagaugcauucugcgauaguaagcuaaugucugcggcaauaaaagacaaucgagcaguccaugcugacaugggcuacuggauugaaagugccuuaaaugauaccuggaaaauugaaaaagcgaguuuuauagaggucaaaaacugccauuggccgaaaucacauacacuuugguccaauggaguauuagaauccgaaaugaucauaccuaaaaaucucgcaggcccaguaucacagcacaauuaucgaccaggguaccacacccagauugcgggaccauggcacuuaggaaaacucgaaauggacuucgauuucugugaugguacaacaguuauaguaaccgaggauugugggaauaggggaccuucacuuaggacgacaacagcaucggggaaauuaauaacagaguggugcuguagaagcugcacgcuuccaccuuuaagauaucguggagaggacggaugcugguaugggauggaaauucgaccguugaaagaaaaggaagagaaucuagugaauagucuagucacugcgggucaugggcaaguugacaacuuuuccuuaggcguacuaggaauggcauuguucuuggaagaaaugcuacgcacuagagucggaacaaagcacgcaauacuucucguagccgucagcuuuguaacacuuauaaccggaaauauguccuuuaaagaucuggguagagucguagugauggucggggcaacuauggcagacgauauagguaugggaguaacauacuuagcacuuuuagcagcauuuaagguacggccuaccuuugcagcaggucuacuccuaaggaaauuaacaucgaaagaguuaaugaugacaacgaucggaauaguacuauugagccagucaacgauacccgagacuguauuggaguuaacggaugcgcuagcgcucgguaugaugguuuuaaaaauaguacguaacauggagaaauaccagcuggcagugacaaucauggcuauauuaugcguuccaaacgcaguuauacuacagaaugcauggaaaguuagcuguacuauacuagcuguaguaucgguauccccuuuauugcuaaccucaagucaacagaaaacagauuggauuccguuagcuuuaaccauuaaaggcuuaaauccaacagcuauauuccucacaacguugagccgaaccaacaagaaaagaucauggccguugaacgaagcaauuauggccgugggaauggugucuauacuagccuccucacuacugaaaaaugacauaccgaugacuggaccucuaguagcaggagggcuuuuaacagucugcuauguacuaacuggaaggucagcggaucuggagcuggaacgagccacggaugugaaaugggaggaucaagcagaaaucagcggcucuagcccgaucuuaaguauaacuaucucagaggacggauccaugucuaucaaaaaugaagaggaggaacaaacuuuaaccauauuaauaaggacaggucuguuggugauaucgggacuauucccaaucaguauuccuauuacagcagccgccugguaucugugggaggugaaaaagcaacgagcugguguguuaugggacguaccaagcccuccuccaaugggaaaggcagaauuggaagacggagcauauagaauaaaacagaaaggaauccuuggauauucacaaauaggugcugggguuuacaaagaggguacauuccacacuauguggcacguuacgagaggggccguacucaugcauaaagguaaaagaauugaaccaaguugggcagaugucaagaaagaccuuauaucauaugggggaggauggaagcucgaaggugaguggaaagagggcgaagagguccaagugcuggcauuagagccaggcaaaaacccgagggcaguacagacaaagcccgggcuauuuaaaacaaacaccgguacaauaggugcaguaucgcucgauuuuucacccggcaccucgggcucgccgauaauugauaagaaaggcaagguaguaggacucuauggcaaugguguaguuacacgcucaggagccuauguaagugccauagcacaaaccgagaaaaguauagaggauaauccagaaauagaagaugauauauuuagaaagagaagacuuaccauuauggaucuucacccaggggcugguaagacaaagcguuaucuaccagccauuguccgagaagcuaucaaacgagguuugcgaacguuaauucuugcacccacaagaguugucgcagcggaaauggaagaagcacuucgagguuuaccaauaagauaucagaccccagcaauuagggccgaacauaccggcagggaaauuguagacuuaaugugucacgcuacauucacaaugagacuauuaucaccagucagaguuccaaauuauaacuuaauaaucauggacgaagcccauuucacagacccagcuucaauugcggcucgaggauauauaaguacuaggguagagaugggagaagcggcaggaauuuucaugacagcgacaccaccaggaucacgagaucccuuuccacaaagcaaugcaccuauaauagaugaagaaagagaaauaccugagaggaguuggaauacaggacacgaauggguuaccgauuucaaaggcaaaacaguaugguuuguccccucgauuaaagcaggaaacgacaucgcugcauguuuacgcaaaaacgguaagaaaguaauucaacuuagcagaaaaacauuugacucagaauauguaaaaacccgaaccaaugauugggauuucguagugacuacagauauaucagaaaugggagcuaauuucaaagcagagcgaguuauagauccacgcagauguaugaaaccagucauucuaacggauggagaagaaagagucauacuagcugggccuaugcccguuacccacucaagugcagcucaaaggagagggagaauuggucggaauccgaaaaaugaaaaugaccaauacaucuacaugggagaaccacucgaaaacgaugaagauugcgcucacuggaaagaagcgaaaaugcuauuagacaacaucaacacaccagaaggaaucauaccaaguauguucgaaccggagagagagaagguagacgcaaucgacggagaauaccgcuugcguggagaggcaagaaagaccuucguagaucuuaugcgcagaggagauuuaccgguauggcuagcauauaaaguagcagccgaaggaauaaauuaugcugaucgucgauggugcuucgaugguaucaaaaacaaccagauacuagaagaaaacgucgagguagaaauauggaccaaagaaggagaaaggaagaaacuaaagccuagauggcuggaugcaagaauuuacucagauccauuggcauuaaaagaguuuaaagaauuugcagcaggaagaaaaucuuuaaccuuaaauuuaauaaccgaaaugggacgacuaccaacauucaugacucagaaaacaagagaugcauuagacaauuuagccguauuacauaccgcagaagcgggugggcgagcguacaaucaugcuuuaucagaacuuccagaaacuuuagaaacccuccuacuacugacacugcuagcuacggugacaggggguauauuucuauuccuaaugagcgggagaggaaucggaaagaugacauuaggcauguguuguaucauaacggcuaguaucuuguuaugguacgcucagauacagccucacuggauagcagcaagcauuauccucgaguucuuuuuaauaguacuauugaucccagaaccagaaaaacaaaggaccccucaggauaaccaacucacuuacguuguaauugcuauacucacaguaguagcagcgacgauggccaaugaaaugggauuuuuagaaaagaccaagaaagaucugggcuuaggcuccaucgcuacccaacaaccugaaucaaauauucucgauaucgacuugagaccagccucagcuuggacacuguacgcagucgcuacgacuuucguaacaccaauguugagacauucgaucgagaauaguaguguuaacguaucacuuacagcaaucgcaaaucaagcuacaguuuuaaugggacuagguaaggguuggccauuaucaaagauggacauugguguaccccugcuagcgaucggcuguuauucacaaguaaaccccauaacacucacugccgcucuauuacuauuaguggcucauuaugcaauuauaggaccuggacuacaagccaaagcaacaagagaagcacaaaaacgagcagcggcuggaauaaugaaaaaccccacuguagaugguauaacuguuaucgauuuagauccaaucccguaugauccaaaauuugaaaaacaacuaggccagguaauguuacuuauacugugugugacccagguauuaaugaugagaaccaccugggcuuuaugugaagcauugacgcuagcaacaggacccauaucaacucuuugggaagggaacccaggucgauucuggaacacuacaauagcaguaagcauggccaacauauuuagagggucauaucuagccggagccggucuauuguucuccaucaugaaaaacacgacaaauacuagaagggguacagguaauauuggugaaacauuaggggaaaaguggaaauccagguuaaacgcucugggcaaaucagaauuucagauauacaaaaaguccgguauucaagaagucgaucggacacuggcaaaggaaggaauaaaacgaggggaaacugaucaucaugcaguuucucgggguucagcaaaacuaaggugguucguugaacguaauauggugacuccagaaggaaagguuguagaucuggguuguggaagaggaggguggaguuauuacugugggggacuuaagaaugucagagaagugaaaggucuaacgaaagggggaccgggccacgaagaaccaaucccgaugucaacauacggcuggaaucugguaagacuccaaagcggaguggacguauucuuuauuccuccggaaaagugugacacucuccuaugcgacauaggcgaaucgaguccaaacccaacuguagaagccggacguacuuuacgaguccucaaccucgucgaaaauuggcugaacaacaauacccaauuuugcauaaaaguacuuaauccguacaugccgaguguuaucgagaaaauggaggcauuacaaagaaaguacggaggggcucuuguaagaaauccacuaagucgcaacuccacccaugagauguauugggugucgaaugcaaguggaaacauuguuaguucaguaaacaugauuagcagaaugcugaucaauagauuuacuaugcgacacaagaaagcuacauacgaaccggauguggaccuagguagcgguacaaggaauauugguauagaaucagaaaucccuaauuuagauauaauagguaaaagaauagagaaaauaaaacaagaacaugaaacuucauggcauuaugaccaagaccauccguacaaaacgugggcuuaucauggaaguuacgagaccaaacagacggguagcgccagcucaauggugaaugguguggucagauugcucacaaaaccaugggauguacuuccuaccguuacgcagauggcaaugacugauacaacgccauuuggacagcaacgcguuuuuaaggaaaaagucgauacgcgaacccaggaaccaaaggaaggaacgaaaaaguuaaugaaaauaacugcagagugguuauggaaagaauuaggcaagaagaaaacaccacggaugugcacuagggaggaauuuacccgaaagguucgaagcaaugcagcauugggugcuauauucacugaugaaaacaaguggaaaagcgcgcgcgaagcugucgaggacagcagguuuugggaacuuguagauaaagaacguaaccuacaucuggaggggaaaugcgaaacaugcguauauaacaugauggguaaaagagaaaagaaauuaggcgaauuugguaaggcaaaaggaucacgugcgauuugguacauguggcugggcgcacgguuccuugaguuugaggcacucggguuucugaaugaggaucacugguucagccgagaaaauucguuaaguggagucgaaggcgaagggcuacauaaacuuggcuauaucuuacgagaugugagcaagaaagaaggcggugcgauguacgcugacgauacagccggcugggauacacgcauaacgcuugaagaccuaaagaaugaggagaugguaacuaaucauauggagggagagcauaaaaaguuagcggaggcaauauuuaaacuaacauaucagaauaaggucgugagaguacaaagaccaacuccuaggggaacggugauggacauuaucucacgccgcgaccaaagaggaucagggcaaguaggcacauauggauugaauacauucacaaauauggaagcccaacuaauccggcagauggaaggagaaggaguauuuaagaacauacagcacuugacagucacggaagagguugcuguucaaaacuggcuugcgagaguugguagagaaagacugucgagaauggcgauaaguggcgaugacugugucguuaaaccccuggaugauagauucgcgaacgcccucacugcauuaaaugauauggggaagauacguaaagauauacagcaaugggagccaucgaaggguuggaacgauuggacucaaguuccuuucuguagucaccauuuccaugaacuaauaaugaaagauggaagaguucugguaguaccauguagaaaucaagaugaguuaauuggucgugcaagaaucucacagggugcaggguggucauuacgugaaacagcaugcuuggguaaaagcuaugcucaaauguggucauuaauguauuuucaucguagagauuugcguuuggcagccaaugcuauaugcagcgcaguuccaucacauuggguaccuacuagccgaacaacauggaguauucaugcaaaacaugaauggaugaccacugaagauaugcuuacuguguggaaucguguauggauaagagaaaauccauggauggaagacaaaaccccuguagagaguugggaagaaauaccuuaccugggaaaacgagaagaucaauggugcggaucacucaucggccuaacaucuagagcaacuugggcaaagaacauucaagcagccauaaaucaaguucggagccucauagguaaugaagaguauacagacuauaugccaucaaugaaacguuuuagaagagaagaagaggaagcuggaguucugugguaa

SEQ ID NO: 22669 - RNA, 9876 nt, Artificial Sequence
  derived and/or modified CDS sequence (opt6) from DENV-2__EU482446__SS-prME
agugcagggaugauaauaaugcugauacccacuguuauggcuuuccaucuaacuaccaggaacggagaaccucacaugauaguagguauacaagaaaaaggaaaaucacuacuauuuaaaacagaagauggagucaauauguguacguugauggcaauggacuuaggugaacucugcgaagacacuauaacauacaaaugcccucuucuacgacaaaaugaaccggaagauauagacugcuggugcaauagcacuucgacguggguaacauaugguacguguacgacaaccggagaacaucgaagggaaaaacgauccguugcauuagugccacaugucggaaugggucuagaaacccgaacagaaacauggaugaguucugaaggugcuuggaaacaugcacaacgaaucgaaacauggauucuaaggcauccaggauuuacgauuauggcggcaauccucgcuuacacuauugggacaacacauuuucagagaguauuaauuuucaucuuacugacugcagucgcaccuucaaugacaaugagauguauaggaauuaguaaucgagauuuugucgaaggagugucaggaggaagcuggguggauauuguauuagaacacggcucguguguaacaacgauggcuaaaaacaaaccgacucucgacuuugaguuaauuaaaaccgaagcaaaacagccggcuacccugagaaaauauugcauugaagcuaaacuuaccaauacaacuaccgaaucuagauguccuacacaaggcgaaccuucacugaaagaggaacaagacaaaagauucguuugcaaacauaguauggucgaucggggcuggggaaauggcugcggauuauuuggaaaaggcggcaucguaacaugugcuauguucacauguaagaaaaauauggaaggaaaaauaguucagccagaaaauuuggaguauacuaucguagucacuccccauucaggagaagaacacgcuguuggcaaugauacaggaaaacauggaaaagaaauaaaaguaacaccacaaucgaguauuacagaggcugaacucacagguuacggaacaguuacaauggaauguucgccaaggacagguuuagacuuuaacgaaaugguuuuauuacaaauggaaaauaaggcuuggcuaguacauaggcaaugguuccuggaucuaccguugccaugguugccaggagcagacaaacaggagaguaauuggauucaaaaagaaacgcuuguuacauuuaaaaacccucacgcaaagaaacaagacguugugguccucggcagccaagaaggagccaugcauacggcauugacgggagcaacugagauccaaaugagcucuggaaauuuauuauucacgggacaccugaaaugucgacuuagaauggauaaauuacaauuaaaagggauguccuacucaauguguacaggcaaauucaaaguuguuaaagaaauagccgagacacaacaugguacuauugucauucguguucaauaugaaggcgauggauccccgugcaaaaucccuuuugagaucauggauuuagaaaaacgguauguccuaggucgacucauuacugugaauccaauugucacagagaaagacucucccguaaauauagaggcagaacccccuuuuggggacagcuacauaaucauaggcgucgaaccuggucaauugaaacugaacugguuuaagaagggaagcaguauuggucaaauguucgaaaccacaaugcguggagccaaacgaauggcaauauuaggugauacggcaugggauuucggaagccucgguggaguauuuacuucgauugguaaggcuuuacaucagguauuuggugcuauauacggcgccgccuucaguggcguauccuggacgaugaaaauucuaauugggguaauuauaacuuggaucgguaugaauagucgcaguacaucucuuucgguaucucuggucuuaguugggauagucacucuauaucuaggaguuaugguacaagcagacaguggcuguguuguaagcuggaagaacaaagaacucaaguguggaagcgguaucuuuaucacagauaauguacacacauggacagaacaauauaaguuucaaccggaaagcccaucuaaauuagcgagugcuauacaaaaagcucaagaagaaggaaucugugguauaagaucagugacaagauuggagaauuuaauguggaaacagaucacaccugagcuaaaucauauacucgcagagaaugaaguaaaacucacaauaaugacaggagauauuaaaggaauaaugcaggcuggaaaacggagcuuacggccgcaaccaacugaacugaaauacuccuggaaaacaugggguaaagcaaaaaugcuaucaacagaaucuuauaaccaaaccuuucucauagacgggccugaaaccacggaaugcccuaacacaaacagagcauggaacucccuggaaguagaagauuauggcuuugguguauuuacaacuaacauuugguugaagcuaaaagagaaacaggacgccuuuugcgacagcaaacuuaugucagccgcuauaaaagauaauagagcuguacaugcugauaugggcuauuggauagaaagcgcacuaaaugauacuuggaaaauagagaaagcaucauuuauagaagucaaaaauugccacuggccgaaaagccacacucuguggaguaacgguguacucgaaucggaaaugauuaucccuaaaaauuuagcagggcccguaucccaacauaauuauaggcccggauaccauacccaaauugcgggaccauggcauuuggguaaacuagaaauggauuucgacuuuugcgaugguacuacugucauuguuacagaagacuguggaaacagagggcccucgcuacguacuacgacggcgucagguaaauugauuaccgaauggugcugcagaagcuguacguuaccacccuuaagauacagaggcgaagauggauguugguauggcauggaaauuagaccccuuaaagaaaaggaagaaaauuugguaaauagucugguaacggcuggucacggacaaguagacaacuucaguuugggaguccucggaauggcuuuauucuuagaggaaaugcuaagaaccagaguaggcacuaaacaugcaauacucuuaguagcaguaucauuuguuacacuuaucaccggcaacaugucauucaaggaucuaggaaggguuguggugaugguuggggcuacuauggcggaugauauaggaaugggcguuaccuaucuagcuuuacuagcagcguucaaggugcggcccacuuucgccgcggguuuguuacuaagaaaacuaacaaguaaggagcuuaugaugacgacaauuggaaucguguuacugucacaaucaaccaucccagagacugucuuggaacucaccgacgcguuagcacucggaaugaugguacugaagauaguucgaaacauggaaaaauaucaacuagcuguaacuauaauggcaauucuaugcgugccaaaugcuguaauacugcaaaacgccuggaaagugagcuguacuauucuggcaguugugagugugucgccguuacuauuaaccagcagccaacaaaagacugacuggauaccucucgcuuuaacaaucaaaggcuuaaauccaaccgcaauuuuucuuaccacauuaucgcgcacaaacaagaagaggucauggccucuaaaugaggccauaauggcuguugguauggugucgauucuggcuucaucauuacucaaaaaugacauaccaaugaccggaccuuuagucgccggcggauuacugacgguauguuauguacugacgggucgauccgcagaccucgaacuagaacgggcuacggauguaaaaugggaagaucaagcagaaauuagugguucaucaccuauauuaucuaucacaauuucggaagacggaucuaugucgaucaaaaaugaagaggaggaacaaacauuaacuauuuuaauaagaacuggguuauuaguaaucucuggucuguuuccuaucuccauuccuauuaccgcagcagccugguaucugugggaagucaagaaacaacgagccgguguacuuugggauguacccucgccgccaccaauggguaaagcagaauuagaagauggggccuaucgaauuaaacagaaagguauacugggguauucccaaauaggagcugguguauauaaggagggaacguuccauacuauguggcauguaacacgcggugcagucuuaaugcauaaaggaaaaagaauagaaccuaguugggcagacgugaagaaagauuugauaagcuacggcggaggauggaaauuggaaggagaauggaaagaaggagaagaaguucaaguucuugcauuagaaccaggcaaaaacccacgcgccguacaaacuaaaccuggauuauucaaaacuaauacaggaacaauuggugcgguaucucuugacuuuagcccggguacaagugggucuccgauaauugauaagaaagguaaaguagucggacuauacgggaauggagucguuacuagaucuggagcuuaugucucagcuauugcacaaacggaaaaaucgauagaagacaaccccgaaauugaagaugacaucuuccgcaaacggcgucugacuaucauggauuuacacccaggagcgggaaagacuaaaagauauuugccugccaucgucagagaggcaauaaaaaggggcuuaagaacauuaaucuuagcaccaacacgaguuguugcggcggaaauggaagaggcuuuaagaggauuacccauacguuaccaaaccccagccauacgugcggaacacacugggagagagaucguagauuuaaugugucacgcuacuuucacaaugcguuuauuaucuccuguacgaguuccaaauuauaacuuaauaauuauggacgaagcccauuuuacugauccagcaagcauugcggcaaggggauauauaagcacccguguagagaugggugaagcugcaggcauauuuaugacugccacaccacccgggucuagggaucccuuuccacaaaguaaugccccaauaauagaugaagaacgcgaaauaccagagaggagcuggaacacaggucaugaauggguaacagauuuuaaagguaaaacaguaugguucgugccaucaaucaaagcagguaacgauauugcagcuugcuuaaggaaaaauggcaagaaaguaauucaauuaaguagaaagacguuugacucggaguauguuaaaacuagaacgaaugauugggacuuuguuguuacgacggauauaucugaaaugggagcaaauuucaaagcagagaggguaauugacccacggcgcuguaugaaaccuguaauacuuacagauggggaagaaagaguaauccuagcagguccuaugccugucacccauucaucugcggcgcaacguaggggccggauaggacgaaaucccaaaaacgaaaaugaucaauauauauacaugggugaacccuuagagaaugaugaggacugugcacacuggaaagaggcaaaaaugcuacuggauaauauaaauacaccagaggguauaauaccgaguauguuugaaccagaacgagaaaaaguggacgcgauagacggagaauaucgcuuaagaggagaagcgagaaagacguuuguagaucugaugcgcagaggugacuuaccuguguggcuggcauauaaaguagcagccgaagguauuaacuaugcggacaggaggugguguuuugauggaauuaaaaauaaucaaauauuagaagaaaauguagaaguagaaauuuggacaaaggagggugaacggaagaaguuaaagccaagauggcuugaugcaagaauauauagcgauccacuagcucucaaagaauuuaaagaauuugccgcaggcagaaagagcuuaacucuaaaucuaauuacugagaugggucgauuaccuacguuuaugacucaaaagacacgugaugcucuagacaauuuagcaguauugcacacggcagaagccggcggaagggcuuauaaucacgcuuugagugaacugccagaaacucuggaaacauuauuacuucucacucuauuagcuacaguaacaggaggaaucuuucuauuuuuaaugagcggacgagggauuggaaaaaugacucuagguauguguuguauaauaacagccagcauucuucugugguaugcucaaauucaaccacauuggauagcagcaucuaucauucuagaguucuuuuuaauaguucuccuaaucccugaaccugaaaaacagagaacaccccaggacaaccaacuaacauaugucgucauugcuauucugacaguuguugcagccacaauggcaaacgaaaugggguuucuagaaaagacuaagaaagaccuagguuuaggaucaauagccacucaacaaccagagagcaauauuuuagauaucgaucuacgaccugcaagcgcuuggacauuauacgccguggcaacuaccuucguuacuccgauguuacgacauucaauugaaaacagcaguguuaauguaaguuuaacugcaaucgcuaaccaagcuacuguacucaugggucuaggaaaggguuggccucucuccaaaauggauauugguguuccguugcuagcgauugguugcuauucgcaaguaaauccaaucacacucacggccgccuugcucuuauugguggcucauuaugccauaauuggaccgggacuucaggcgaaagcgacuagagaagcacagaaaagggcagcugcagguaucaugaaaaauccaaccgucgacggaauuacaguaauugacuuagaccccauuccguaugacccuaaguuugaaaaacaacuaggucaggucaugcuuuugauccuaugugugacucagguccuuaugaugcgaacaaccugggcuuuaugugaagcgcuaacacuagcaacggguccaauaaguacauuaugggagggaaauccuggaagauucuggaauacaacaauagcagucuccauggcgaauauuuucagaggcucuuauuuagcuggcgcaggucuguuauucuccauuaugaaaaauacaacuaacacccgacgaggaacuggcaauauuggagaaacauugggugaaaaguggaagagucgacuaaaugcccucgguaaaagcgaauuucaaauauacaagaaaucaggaauccaagaaguugacaggacuuuggcaaaagaaggaauaaagcguggagaaacugaucaucaugcugucucacgaggcagcgcaaaacugcggugguuugucgaacgaaacaugguaacgcccgaaggaaaaguuguagaucugggauguggacguggcgguuggucauauuacugugguggucuaaagaauguaagggaaguaaaaggucuaacaaaagguggaccaggacacgaagaaccaaucccgauguccaccuauggcuggaacuuaguaagauuacaaagcgguguagacguuuucuucauaccaccugaaaaaugcgauacauugcugugugauauuggagaaaguucaccgaacccaaccguagaggcgggaaggacacuacguguucuuaauuuaguagaaaacuggcucaacaacaauacucaguucuguauaaaaguacuuaacccuuauaugccuagcguaaucgagaagauggaagcacuacaaaggaaguacggcggcgcacuuguuagaaauccacuaagucgaaacagcacgcacgaaauguacuggguaucuaacgcgagugguaauauagucaguagcgugaacaugauaucgcggaugcuaauuaaucgauuuacuaugagacacaagaaggcaacuuaugaaccggauguugacuugggaucaggaacaagaaauauaggaauugaaucugaaauaccuaauuuggauauaauuggaaaaaggauagagaaaauaaaacaagaacacgagacaucguggcacuacgaucaagaucauccauacaagacaugggcauaucacgguaguuaugagacaaaacaaacugguucagcaaguagcauggugaacggugucguacguuuacugacaaagccaugggacgucuuaccaacaguuacucagauggccaugacagauacuacgcccuuuggacaacaaagaguuuuuaaggagaaaguggauacacggacccaagaacccaaagaagguacuaagaaacuaaugaaaauuacggcagaaugguuauggaaagaauuaggcaagaagaaaacuccccgaauguguacuagagaggaguuuacacggaaaguaagaucaaacgccgcacugggcgcaaucuucacugacgaaaauaaauggaaaagcgcuagagaggcuguugaagacagccgauuuugggaacugguagauaaagaaaggaauuuacaucucgaagggaaaugugaaacguguguuuauaauaugaugggaaaacgagagaagaaacugggagaguucggaaaggcuaaagguagccgugcuauaugguauauguggcuaggagccagauuucuagaauuugaagcguuaggauuucuaaacgaagaucauugguucagccgugaaaacucauuauccggcgucgaaggagaaggacugcauaaacuaggguauauauuaagagauguuaguaagaaagaagguggugcaauguacgcggaugacacagccggcugggacacaagaauaacacuagaagacuugaaaaaugaagaaaugguaacgaaucauauggaaggagaacacaagaaauuagccgaagcuaucuucaaacuuacguaucaaaauaagguuguaagaguccagcgcccuacaccaaggggaacaguaauggacauaauaagcaggagagaccaacgaggcucaggccaaguuggaacuuauggauuaaauacauuuacgaacauggaagcacaguuaauuaggcagauggagggggaaggcguguuuaaaaauauacaacaccucaccguaacagaagaaguugcugugcagaacugguuagcaagaguagguagagaacguuugucacgaauggcuaucucaggggaugauugcguaguaaaaccccuagacgacagguucgcaaaugcccuaacagcacuuaaugauaugggaaagauucguaaggauauucagcagugggaaccaucgaaaggauggaacgauuggacgcaagugccguucuguagucaucacuuucaugaacuaauaaugaaagacgggagaguauuaguugucccaugcagaaaccaagacgagcuuauuggucgagcacgaauaagucaaggagccggguggucacuuagggaaaccgcauguuuagggaaaucuuacgcucaaauguggaguuuaauguacuuucacaggcgggaccuacgacuagccgcaaaugcuaucugcagcgcuguaccaucgcauuggguaccaacaucaagaacaacuuggagcauucaugccaaacaugaauggaugacuacugaagauaugcuuacaguguggaaucgagucuggauaagagaaaacccguggauggaagauaagacgccagucgaguccugggaagaaauucccuaucucgguaaaagagaagaccaauggugcggaucacuaauaggccuaacaagucgagcaacgugggcgaaaaauauacaggcagcgaucaaucaaguacgcucauugauaggaaaugaggaauauacugauuauaugccaaguaugaaacgauuuagacgggaagaagaagaagccgguguccucugguag

SEQ ID NO: 22670 - RNA, 9876 nt, Artificial Sequence
  derived and/or modified CDS sequence (opt6) from DENV-2__EU482448__SS-prME
ucggcugguaugauuauaauguugauuccaacuguuauggcuuuucacuugacaacccguaauggagaaccacauaugaucguugguauacaagaaaaagguaaaucacuauuauucaaaacugaagacggaguuaauaugugcacacuuauggcaauggacuugggagaacugugugaagauaccaucacauauaaauguccacuacuuagacaaaacgaaccggaagacauagauugcugguguaauucuaccaguacauggguuaccuauggaaccuguaccacgacaggagaacauagacgagaaaaacguagcguugcucuagucccacacgucgguaugggccuagaaacaaggacagaaacauggaugucaagcgaaggggcauggaaacaugcucaaaggauugagacauggauauugcggcauccaggguuuaccauuauggcugcuauauuggcguacacaauaggaaccacccauuuucaacgagucuugauuuucauuuuacuaacagcaguugcaccgucgaugacuaugcguuguauaggaaucucaaaucgagauuuugucgaaggagugaguggaggaagcuggguugacauaguuuuggaacacggcagcuguguuacuacaauggccaaaaauaaacccacguuagauuucgaauugauaaaaacagaagcuaaacaaccugcuacacuaagaaaauauugcauugaagccaaauugacaaauacaacgacagagucuagaugcccaacgcaaggugaaccuucacuuaaagaagaacaagauaaaagguucguaugcaaacacaguauggucgaccgcggauggggaaaugguugcggacuauuugguaagggugggaucguaaccugugcgauguucacuuguaagaaaaauauggaagggaaaauaguucagccagaaaacuuagaauacaccauaguugugacgccccauucuggcgaggagcacgcuguagggaaugauaccggaaagcauggcaaagaaauaaaagucacuccccagucguccauaaccgaagccgagcuaacaggguaugguacaguuacaauggaaugcaguccacgaacaggacuagauuuuaaugaaauggugcuauuacaaauggaaaauaaggcguggcuaguacacaggcaaugguuuuuagaucucccacuaccguggcucccaggagccgauaaacaagagaguaauuggauucaaaaagaaaccuuagugaccuucaaaaauccucacgccaagaaacaggauguuguaguucuaggaucacaagaaggugcaaugcauacagcucuuacaggagcuaccgaaauucaaaugucgucgggaaacuuauuauuuacugggcaucugaagugcagauugcgaauggacaaguugcaacugaaagguaugucuuauucgauguguacaggaaaguucaaagucguuaaggaaauagcugaaacacaacauggaacgauaguuauacgcguacaauacgagggagacggaagucccuguaaaauaccauuugagauaauggaucuugaaaaacgauauguuuuagguagacuaauaacaguaaauccaauaguuacagaaaaggauucgccggugaauauagaggcagaaccaccauuuggugauucauauauuaucauaggaguagaaccaggucaauuaaaacucaauugguuuaaaaaggggucaaguauaggucagauguucgaaacaaccaugcguggugcaaaaagaauggcgaucuuaggggauacggcuugggauuucggaucacuaggcgguguuuucacaagcauagggaaggcacuccaucaaguauuuggcgccaucuacggugcagcuuuuucugguguaucauggaccaugaaaauccuaauaggaguaauuauaacuuggauuggaaugaacucucggucaaccucacuaagcguaagucuuguguugguaggcauuguaacucuuuaucucggaguuauggugcaagcugacagugggugcguaguaagcuggaagaauaaggaguuaaaaugugguagugggaucuucauuacagauaauguccauacuuggacagaacaauacaaauuucagccggaaucaccgagcaaacuugcaagugccauccaaaaggcucaagaagaggguaucugcggaaucagaucaguaacuagacucgaaaaucugauguggaagcaaaucacuccggaacuaaaccauauacucgcugaaaaugagguuaaacuaacgauaaugacuggagacauuaaagguauaaugcaggcagggaaacgaucacuacguccccagcccacugaacuaaaguauucguggaaaacauggggaaaagcaaaaauguuaagcacagaaucuuacaaucaaacauuuuugauugacggcccggagacaacugagugcccgaauacgaaccgggcauggaauagcuuagaaguggaagauuacgguuuuggaguauucacuacuaauauauggcucaaguuaaaagaaaaacaggaugcauuuugugauuccaaguuaaugagugccgcaauuaaggauaaccgugcuguacaugccgauaugggauacuggauagaaucagcauuaaaugauaccuggaaaauagaaaaagccucauuuauagaagugaaaaacugucauuggccuaaaucgcacacucucuggagcaacggcguccuggaauccgaaaugaucauacccaaaaaucuugcuggaccaguaagucaacacaauuaucgcccugguuaccacacacagauugcugggccguggcaucuuggcaaauuggagauggauuuugauuucugugacggaacuacaguuaucguuacugaagacugcgguaacagggggccuucauuacgaacaacuacugcaucuggcaaauuaauaacugaauggugcuguagaaguuguaccuuaccacccuuacgauaucggggcgaagacggcuguugguauggaauggaaauccgccccuuaaaagagaaagaggagaaucuuguuaauagucucguaaccgcaggacacggccaaguggauaauuucaguuugggcguacuggguauggcacuguuuuuagaggagauguuaaggaccagaguggggacaaaacaugcuauacuucugguugcaguuaguuuuguaaccuuaauuacuggaaauauguccuuuaaagacuugggacgaguaguuguaaugguaggugccacaauggccgacgauaucggaauggguguaacuuacuuagcauuacuagcugcguucaagguaagacccaccuuugcugcuggauuguuacuacguaaacuuacaucuaaagaacuuaugaugacaacaauaggaauaguucuuuugagccaaagcaccauucccgaaacgguguuagagcuaacugaugcacucgcacuaggaaugaugguucucaaaaucguaagaaauauggagaaguaucaacuggcgguaacaauuauggccauauuauguguaccgaaugcagugauauuacaaaaugcauggaaagucagcugcacgauacuagcgguuguuaguguaagccccuuauuacugaccagcucacaacagaaaaccgauuggaucccucuggcgcuaacgauaaaaggucuaaauccuaccgccauauuuuuaaccacguugagcagaacaaauaagaaacgaaguuggccuuuaaacgaagccauaauggccguuggaaugguaucaauccuugcuaguagcuuauugaaaaacgauauaccaaugacaggcccucuaguugcuggagggcuauugacaguaugcuacgucuuaaccggaagaucagcugaucuugaauuggaacgggcgaccgauguaaaaugggaagaucaagcagaaauaucagguaguaguccuaucuuauccauaacaauaucugaagacgguagcaugucgauuaaaaaugaggaagaagaacaaacuuuaacuauuuuaauucguacaggauugcuggucauaaguggcuuguuuccgauaucgauucccaucaccgccgccgcgugguauuugugggaagugaagaagcaaagagcugguguauuaugggacgugccaucuccucccccaaugggaaaggccgagcuggaagauggugcauaucgcauaaaacaaaaagggauucuugguuauucacaaaucggcgcaggagucuauaaagaagggacuuuccauacaauguggcaugucaccagaggugcaguccuaaugcauaaagguaaaagaauagaaccaaguugggcugacguaaagaaggacuuaauaucauauggaggagguuggaaacuagaaggagaguggaaggaaggcgaagaggugcagguacuugcucuagaacccgggaaaaacccaagagcuguacaaaccaaaccaggguuauuuaagaccaauacagggacaauaggggcggugucccuggacuucaguccaggaacuucagggagcccuauuauagauaaaaagggaaaaguuguaggauuauauggcaaugguguuguaacacgaucaggcgccuauguaucggccauagcucaaaccgaaaagaguauagaagauaacccugaaauagaagacgacauauuucggaagcggagauuaaccauaauggauuuacacccaggggccgggaaaaccaaacgauaccuuccggcgauaguacgugaagcuauuaaacguggucuccguacccucauacuagcucccacuagaguaguugcagcagagauggaagaggcccuuagaggccucccaauuagguaucaaacaccagcaauucgagcagagcauacaggacgagagauagucgaucugaugugccacgcuacauucacgaugagacuauuauccccaguacgaguucccaacuacaacuuaauaauaauggacgaggcccauuuuacugacccggcgucuauagcugcacgaggauacauaaguacccgaguugaaaugggugaagcagccggaauauucaugacagcaacuccaccaggcucacgagacccauuuccucaaucuaaugcacccauaauagaugaagaaagagaaauaccggaaagaucauggaauacuggacaugaauggguaacggauuuuaaaggcaaaacaguuugguucgugcccaguauaaaggccggcaacgacaucgcagcguguuugagaaagaacggcaagaaagucauacaacuuaguaggaaaaccuuugauagcgaauauguaaagacaagaacuaacgauugggauuuuguuguuacaacugacauuuccgaaaugggcgccaacuucaaagcugaaaggguuauugacccacgccgauguaugaaaccaguaauuuuaacagacggagaagaacgcguaauacuagccggaccuaugcccguaacacauaguagcgcugcacaacgacgaggucguauuggcagaaacccaaagaacgaaaacgaucaguacauauacaugggagaaccacuugaaaacgaugaagacugcgcucauuggaaagaggcaaaaaugcuacuagacaacaucaacacgcccgagggaauaauaccaagcauguuugaaccugaaagagaaaaaguggacgcaauagauggcgaauauagguuaagaggugaagcacguaaaacauucguggaucuaaugcgcagaggagaucuacccguuuggcuagcauacaaaguagcugccgaagggauuaacuaugcugaucgaagaugguguuucgacggaauuaaaaauaaucagaucuuggaagaaaacguugagguagaaaucuggacaaaggagggagaaagaaagaaauuaaagccaagauggcuagacgcccgaauauauagugauccauuggcacuaaaagaguucaaagaauuugcugcuggacggaaauccuuaacauuaaaucuuauuacggaaaugggaagacuacccacauuuaugacgcagaaaacuagagacgcgcuugauaaccuggccgugcuccauaccgcugaggcaggcggucgagcauauaaucaugcgcuuucagaguugccagagacacuagagacacuacuucuguugaccuuguuagccaccgucaccggcgggauauuuuuauuuuuaaugucaggaaggggcaucggcaaaaugacauuaggaaugugcuguauaauaacagcgucaauauuauugugguacgcacagauacaaccgcacuggaucgcagcuucgauaauauuagaauuuuuccuuauaguucuacuuauuccggaaccggaaaaacaaagaacgccucaagauaaccaacuaaccuauguuguaauugcuauacugacaguaguagcagcgacgauggcuaacgaaaugggauuucuagagaaaacaaagaaagaucuaggacucgggucgauagcgacccaacaaccagaaucuaacauacuagauauugaucuuaggccugcuagcgcauggacacuauacgcaguggcuacaacauucguuacgccgaugcuaagacauagcaucgaaaacucaagugugaacgugagcuuaacggcgauugcuaaccaagcuacaguauuaaugggacuaggaaaaggguggccguuaucuaaaauggauauaggagucccucuacuugccauugguuguuauucucaaguuaauccuauuacgcucacggccgcucuauuacuauuaguagcccacuaugcaauuauagguccaggcuuacaagcuaaagcaacacgugaagcucaaaaacgagcagcagccgggaucaugaaaaauccaacgguugaugggauaacgguaauagacuuagauccaauaccguacgauccuaaauucgaaaaacaauuaggccaaguuaugcuguuaaucuuaugugucacacaagucuuaaugaugaggacaacuugggcgcuuugcgaggcucuaacacuagcaacugggccaauauccacucuaugggagggaaauccaggccgauuuuggaauacaacgauugcgguuaguauggcaaauauauucagaggaaguuaucuagcaggagcugggcuauuauuuucgauaaugaaaaauacuaccaacacucgaagagguacaggaaauaucggcgagacccuuggagaaaaguggaaguccagacucaacgcucuugggaaaucggaguuccaaauauacaagaaaagcggcauucaagagguugaucgcacacucgcuaaagaaggaauaaaacguggagaaaccgaucaccaugcagucucaagaggauccgccaaacuacgcugguuugucgaacguaacaugguuacccccgaaggcaagguuguggaccuagguugugggcgugguggauggucguauuauugugguggccucaaaaaugucagggaagugaaagguuuaacaaaagggggcccaggacacgaagaaccuauuccuaugaguaccuauggauggaaccugguaagauuacagucagggguagacguauucuuuaucccaccggagaagugcgauacauugcugugugacauaggugaaaguucacccaacccgaccgucgaagcaggacguacuuugaggguacuaaaucucguagagaacuggcuaaacaauaauacucaauuuuguauaaaaguucuuaaccccuauaugccauccguaauugagaaaauggaagcacuucaaaggaaguacggcggcgcuuuagugagaaauccacuuucacgaaacucaacccaugaaauguacuggguaucaaacgcuagcggcaacauagugucaaguguaaauaugauuucucggaugcuuauaaaucgguucacgaugagacacaagaaagccacuuaugaaccagauguagaccuagggaguggcacuagaaacauugguauugagucagagauuccaaaucuagauauaauuggaaaaaggauugagaaaauaaaacaagaacaugagauaaguuggcauuacgaucaagaccacccauacaaaacaugggcguaucacgguucauacgaaacuaaacagacaggaucagccucuucuaugguuaacgguguuguccgucuucuaacaaaaccaugggacguucuaccaaccguaacucaaauggcaaugacagauacaacacccuuuggucaacagcgaguauucaaagaaaaaguugauacacguacacaagagccaaaagaaggaacuaagaaauuaaugaaaauaacugcugaguggcucuggaaagaacuuggcaagaagaaaacuccuagaauguguacaagggaagaguuuacuaggaaaguccguagcaacgcagcacuaggagcaauauucacggaugaaaauaaauggaagucugcaagggaagcaguugaagauagccgauucugggaguugguagacaaagaacgaaaucuacaucuagaaggaaaaugugagacaugcguauacaauaugauggguaagcgagaaaagaaacuaggugaguucgguaaggcaaaaggaucaagagcuauaugguacaugugguuaggcgccagauuccuagaguucgaagcacuaggauuucuuaaugaagaucauugguucucucgagaaaauucauuaucagggguggaaggggaaggauugcauaaguugggguacauuuugagagaugugaguaagaaagaaggcggggcuauguacgccgaugauacggcagguugggauacacggauaacauuggaggauuuaaagaacgaagaaaugguuacaaaucauauggaaggagagcacaaaaagcuggcagaagcaaucuucaaacuuacguaccaaaacaaagucguaaggguacaaaggccaacaccccgagggacaguuauggacauuauuucucgccgagaucaaagagguaguggacaaguuggaacauaugggcuaaacacuuucacaaauauggaagcccagcuuauaagacaaauggaaggggaaggaguguucaagaauauucaacaucuaacugugacggaagaaguggcuguacaaaauuggcuugcucgaguaggaagagaaagauugucaagaauggcaauauccggugacgauuguguaguaaaaccucuugaugaucgauuugcuaaugcauuaacagcauuaaaugacaugggaaaaauaagaaaggauauacaacagugggaaccuaguaaagguuggaacgacuggacucaaguuccguucuguucacaucauuuucaugaauuaaucaugaaagauggaagagucuuaguaguaccuuguagaaaucaagacgaauuaauagguagagcgagaauaucgcaaggggcuggauggaguuuaagagaaacagcaugucuugggaaauccuaugcgcaaauguggagucugauguauuuucaccguagggauuuacgauuggcagcgaaugcaaucugcucggcgguaccuagccauugggucccgacaagcagaacaacuuggaguauacaugccaaacaugaguggaugacgacagaagauauguuaacaguauggaaucgggucuggauacgagagaauccguggauggaagauaaaacgccaguagaauccugggaagagauuccuuauuuagguaagcgugaagaucagugguguggcucgcuuauaggccugaccucaagagcuacgugggcgaaaaauauacaagccgcaaucaaucaagugagaaguuuaauuggaaaugaagaguauaccgacuacaugccaaguaugaaaagauuucggagggaagaagaagaagcaggaguacucugguaa

SEQ ID NO: 22671 - RNA, 9876 nt, Artificial Sequence
  derived and/or modified CDS sequence (opt6) from DENV-2__EU482449__SS-prME
acggcaggcgucauaauaauguuaauccccacugcuauggcuuuucacuuaacaacucgaaauggcgaaccucauaugauugugggccgccaagaaaaaggaaaaucauuauuguuuaaaacagaagacggaguuaacauguguacacuuauggcuaucgauuugggagaauuaugugaagacacuauaacauauaaaugucccuugcuucgacaaaacgaaccugaagacaucgauuguugguguaauucaacuagcacguggguuacauauggaacauguacgacaacuggggaacauagacgugagaaaagaucgguugcguuagucccucauguaggaauggguuuagaaacuagaacagaaaccuggaugaguucugaaggugcauggaaacacgcacagagaauagaaacauggauauuaagacaccccgguuuuaccauaauggcagcgaucuuagccuauacaaucgggaccacacauuuccaacgagcauuaauauucauuuuguugacagccgucgcgccuuccaugacgaugagaugcauagggaucucuaauagagacuuuguagaaggaguuucgggcggaagcuggguggacauaguccucgaacauggcucaugugugacaacgauggccaaaaacaaaccaaccuuagauuucgaacuaauaaaaacagaggcaaaacaaccugcaacacuccgcaaauauugcauugaagccaaacuaacuaauacaacaaccgaaucucgguguccaacacagggugaacccucacuaaacgaggaacaagauaaacgauuugugugcaaacacucaaugguggaccgaggcugggggaacggguguggcuuauuuggcaaagguggaauuguaaccugugcgauguuuacuuguaagaaaaacauggagggaaaaauuguacaaccagaaaauuuagaguauaccauaguuauaacgccacacuccggugaggagcacgccguagggaacgauacuggaaaacacggaaaagaaaucaaaauaacaccgcaaaguagcaauacggaggccgaacuuacuggauacgguacuguaacuauggagugcaguccucgaacgggacuggauuucaaugaaaugguauuauuacaaauggaagauaaagcguggcucguccauagacaaugguuccuagaccuaccucuaccgugguuaccaggagcagauacacagggaucuaacuggauucaaaaagaaacucuuguaacuuucaaaaauccacaugccaagaaacaagauguagucguauuaggcucacaagaaggagcuaugcacacagcucuaaccggggcuacugagauucagaugagcuccggcaaucucuuauuuacaggccacuugaaauguagauuaaggauggauaaacuacaacuuaaaggaaugagcuauaguaugugcacagggaaauucaaaauagucaaagaaauagcugagacgcaacacgggacuauuguaauccguguccaauacgaaggugauggaagucccugcaaaauaccauuugagauuauggaucuugaaaaacgacacguauuagguagauugauaaccgucaauccaauuguaacagagaaagauucaccgguaaauaucgaagcggaaccuccguuuggcgacuccuauauaauaauaggagucgagccuggacagcuuaaacuaaauugguucaagaaagguaguucaauuggucagauguucgaaaccacaaugagaggugcaaaaagaauggcaauacuaggcgauacggcgugggauuuugguucauuaggaggaguuuucacaaguauaggaaaagcauuacaccaaguauuuggagcaauauauggagcugcauuuaguggugucucguggacaaugaaaauuuuaauaggagcaauaauuacauggauagguaugaauagucggucgacaucguugucaguaagucucguucucguuggaguuauuacguuguaucuuggagcaaugguacaagcagacucaggauguguaguuuccuggaaaaauaaagaauuaaaaugcgguucgggcauauuuauaacagacaauguacacacauggacagaacaauacaaauuucaaccugaguccccaucaaaacucgcuucggcaauacaaaaagcccaugaagaggguauuugcgguauccgaagcguaacaagacucgaaaauuuaauguggaaacagauaacuccugagcuaaaucauauauuaagcgagaaugaaguuaaacuaacaauuaugacaggcgauauuaagggaauaaugcaagcuggcaaaagaagccugcguccacagccaacagaauuaaaauauucauggaaaaccugggggaaagcaaaaaugcucucaacugaaagucauaaccaaacguuccugauagacgggccugaaacagcugaauguccuaauacaaaccgugccuggaauagccuagaagucgaggauuacggauuuggaguauuuacaacaaacauauggcuaaaacuuagggaaaagcaggauguauuuugugacuccaaauuaaugagugcagcgauuaaagacaaucgcgcaguucacgccgauaugggauacuggaucgaaagugcuuuaaacgacacauggaaaauggagaaagcaucauucaucgaaguaaaaaguugucacuggccgaaaucacauacgcuauggucgaacggaguauuagaaagcgaaaugauaauacccaagagcuuugcugggcccgugagucaacacaauuaccgcccuggauauuauacacaaacugcuggaccauggcaccuagguaaauuagaaauggauuuugauuucugugagggcaccacuguuguaguuacggaagauugugggaauagaggcccgagccuaagaacgacaacagcuagcggaaaauuaauaaccgaaugguguuguagaaguuguacuuuacccccucuaagauauaggggagaagauggguguugguacggaauggaaauaaggccccuuaaagaaaaagaagaaaacuuaguaaauucccuuguaacugcaggacacggacaaauugauaauuucagucuaggaguuuuaggcauggcauuauucuuggaggaaauguuaagaacacggguagguacaaaacacgcuauucuucuaguagcgguauccuuuaugacacuaauaacugggaacaugucuuucagagauuugggccgagucauggugauggucggggcuacaaugacagacgacaucggcaugggaguaacauaccuagcauuacuugccgccuucaaaguucgcccgaccuucgcggcaggacuauuacuucgaaaguuaaccucaaaagaacuaaugauggcuacuauugguauagccuuacuuucccaaaguacuauaccugagaccaucuuagaguuaaccgacgccuuggcucuagguaugauggucuuaaaaauugugcgaaauauggaaaaauaucaguuggcaguaacuauaauggcgauuucauguguacccaacgcugugauacuacagaacgcauggaaggugagcugcacuauauuggcagcagugagcguuucaccauugcuccugacaucaucucagcagaaagccgacuggauaccacuagcauuaacuaucaaaggucuaaacccaacugccaucuuccucacuacgcuaucgaggaccaguaagaagcgaaguuggcccuuaaacgaagcuaucauggccgugggaaugguuuccauucucgcuagcucucuauugaaaaaugacaucccaaugacagguccgcuaguugcgggagguuuauugacagugugcuaugucuuaacagggcguucagcggaucuugaacuagagagggcgacggacguaaagugggaggaucaagcugagauuaguggaagcagcccaauacuaucgauuacgauuucagaagaugguucgaugaguauuaaaaaugaagaggaagaacaaacacugacaauacuaauuaggacugguuuauugguaauaucaggauuauuucccgucaguauaccgauuacugcggcagcuugguaucucugggaagugaagaaacagagagcugguguacuaugggacguuccaagcccuccacccgucggaaaggcagaauuagaggacggggcauaucgcaucaaacagaaaggcauacucggauacucacagauuggggcuggaguuuacaaagagggcaccuuccacacgauguggcauguaacucgaggugcaguuuuaaugcaucgaggcaaacguauugaaccaaguugggcugacguaaagaaagaccugauaagcuacggagggggauggaaacuagaaggggaauggaaggaaggggaagaaguccaaguauuagcacuugaacccgguaaaaauccacgcgcaguacagaccaaaccuggauuauucaaaacaaauaccggaacaauuggugcagugaguuuagauuucagcccugguaccagcggaaguccuauuguugauagaaaaggcaaaguaguggguuuauacggaaauggaguaguaacuagaucuggugcauacguaucagcaauagcacagacggaaaaaucuauagaagauaauccagaaauagaagacgacauauuuagaaagaagcgucuaacaauaauggaccuacacccaggagcaggcaaaacgaaaagauacuugccugccauuguaagagaagcaauuaaaagagggcugaggacccuuauauuggccccuacacgcguaguugcagccgagauggaagaagcacuacggggcuugccgauacgguaccaaacucccgccauacgagcugagcauacagggagagaaauaguugauuuaaugugccacgcuacauucacgaugagauuacuuucaccuguacgaguaccaaauuauaaccuaauuauaauggaugaagcacacuucacugauccugcuucgauagcggcucggggauauauaagcacacguguugaaaugggagaagcugcaggaauauucaugacagcgacacccccagggaguagagacccauuuccacaaaguaaugcaccuauuauagacgaagaaagggaaauuccagaacgguccuggagcucagggcaugaauggguuacagauuuuaaagggaaaacgguaugguucguuccgucuaucaaagccgguaacgauaucgcugcgugucuaaggaaaaaugguaagaaagugauacaacuaucaagaaagacuuuugauagugaauacguaaaaacaagaacaaaugacugggacuuuguuguaacaacugacauaucagaaaugggagcaaacuucaaagcugaacguguuauagacccucgucgauguaugaagccugugauacuaaccgacggagaagaaaggguuaucuuagccgguccaaugccuguaacucauucgagcgcggcacaaagaagaggaagaauaggcagaaaucccaaaaaugaaaaugaucaauacaucuacaugggcgaaccucuggagaacgacgaagacugugcacauuggaaggaagccaaaaugcugcuagauaauaucaauacaccugaagggauuauacccuccauguuugaaccagaaagagagaaagucgacgcuauugacggagaauaccguuugaggggcgaggcacgcaaaaccuucguagauuuaaugagacgaggagaucuaccaguauggcuagcauaccgaguugcggcugaagggauuaacuaugcugauagaaggugguguuucgauggugugaaaaacaaucaaauauuggaagagaacgucgaaguugagauauggacgaaagaaggugagaggaagaaacuaaaaccgcgaugguuggaugcuagaaucuacagugauccuuuggcgcuaaaagaguuuaaagaguuugcugccgggagaaaaucuuuaacccugaaucuuauaacugaaauggggagauuaccuacauuuaugacacaaaaggcucgggaugcauuagauaacuuagcuguauuacauacugcggaagccggagggagagcauauaaccaugcacuuuccgagcuaccugagaccuuagaaacacuacuacuucuaacuuuacuagcaacgguaacaggugguauauuccucuuccuaaugagcgggaaaggcguggguaaaaugacacuaggaauguuuugcauaauaacagcuucuauccuauugugguacgcacagauacaaccucacuggauagcugcaucuauaauauuagaguucuucuuaauaguacuguuaauucccgaaccagaaaaacaacgaacaccgcaagacaaucaacucacguacguagucauugcuaucuuaaccgugguugcugcuacaauggccaaugaaauggguuucuuagagaaaacgaagaaagaucuugggcuaggaucuauagcuacucaggagccagaaaguaauauuuuagacauagaccugcgcccggcgagugccuggacccuauacgcaguagcaaccacauucguaacaccuaugcuaaggcacucuauagaaaauagcucaguuaacguaaguuuaacagcgauugcuaaucaagcuacaguucuuaugggauuaggaaagggcuggccguuaucaaaaauggauaucgguguuccacucuuagccaucggauguuacucacaagucaaucccaucacccucacagcagcguuauuacucuuaauugcgcauuacgcaauaaucggaccaggacuccaggcuaaggccacacgggaagcacaaaagagagcagcugcggggaucaugaagaacccaacaguugauggcauaacaguaauagaucuagauccuauuccguacgauccgaaguuugaaaagcaauuggggcagguuaugcuauuaauauuaugugucacgcaaguccuaaugaugagaacaacaugggcgcucugugaagcacuuacuuuagcuacagguccaaucaguacacuuugggaagguaauccagggagauuuuggaauacuacaauagcuguuucuauggcuaacauauucagagggaguuauuuggcuggugcaggccuauuguuuagcauaaugaagaauaccacaaacaccaggagggguacagguaauauuggggaaaccuuaggcgaaaaguggaaauccagguuaaacgcuuuagggaaauccgaguuccagaucuauaagaaaucgggaauccaagagguagaucgaacauuagcaaaggaaggaauaaaaagaggagaaacggaccaucacgccguuucuagagguucagcgaaauugcgaugguuuguagaacgcaacaugguaacgccugaaggaaagguaguggaucucggaugcgggcguggaggauggucuuacuauugcgggggacugaaaaacguucgugaagucaaaggacuaacaaaaggaggaccagggcacgaagaaccuauaccaaugucaacauauggauggaaucuaguucgacugcaaagcggaguugauguauucuucacaccgccagaaaaaugugauacccuacuuugugauaucggggaaucgagcccgaauccuacuaucgaagcagggcgaacacuacgaguacuaucuuuaguugaaaacugguuaaauaaugauacccaauucuguaucaaagucuuaaacccauauaugccaucagucaucgagaaaauggaaacguugcaacgaaaauacggaggugccuuaguccgaaauccacucagcagaaauucaacacaugaaauguacuggguuagcaaugcgacgggaaacauagugaguagugugaauaugauuuccaggauguuaaucaaucgcuuuacaaugaaacauaagaaagcaacuuacgaaccagauguugaucuaggaagugguacucguaacauaggaauagagagugaaauuccuaauuuggauauuauuggaaaacgcaucgagaaaauaaaacaagaacaugaaaccagcuggcauuaugaucaggaucauccauacaaaacuugggcuuaucacggaucuuaugagacuaaacaaaccgggagugcaucaucuaugguuaacgguguugucagauuacugacgaaaccuugggaugucguaccuauggucacgcaaauggcaaugacggauacuacaccguucggucagcaaagaguguuuaaagagaagguugacacccggacacaggagccaaaagaaggaacgaagaagcuaaugaagauaacugcagaauggcuauggaaagaacuagguaagaagaaaacaccacguauguguacaagagaagaguuuacucgaaaagugagaucaaaugcugcauugggcgcuauauucacggacgaaaauaaauggaaaagcgccagggaagcagucgaagacucgcgcuuuugggaacuuguagacaaagagagaaaccuucaucuugaaggcaaaugcgaaaccugcguuuauaauaugaugggcaaaagggagaagaaacugggagaguuugguaaagccaaaggaucgagagcaauaugguacaugugguuaggagcaagauuuuuagaguucgaagccuuaggauuucuuaacgaagaucauugguucagucgcgagaauagccuaagugguguagaaggggaaggacuacauaaauuaggauacauacuuagggaugugaguaagaaagaagguggagcaauguaugcagaugacacggcgggaugggacacgagaauuacauuggaagauuuaaagaacgaggagauggugacuaaccauauggaaggagaacauaaaagacuggcggaggcaauauucaaacuuacguaucagaauaaaguaguccgcgugcaacgaccaacaccuagaggaacuguaauggacauaauuagcagacgcgaucagcgagguucuggucaaguagggacuuacgggcuuaacacuuuuacgaacauggaagcucaacuaauuagacaaauggaaggagaagguauuuuuaaaucaauacaacauuugaccguaacagaagaaauagcugugcaaaauuggcuagcacgaguaggaagggaaagauuaagcagaauggccauuucaggagaugauugcgucguaaagccauuggacgauagauuugcaucugcacugacugcacuaaaugacauggguaaaguacgaaaagauauacaacaaugggaacccucuaaaggauggaacgacuggacacaggugccauucuguucccaucauuuucaugaauuaaucaugaaggacggacgugucuugguagucccgugcagaaaucaagacgaauuaauugguagagcccguauuagucagggagcaggguggagccuaaaagaaacugcaugccucggcaaaucauacgcacaaauguggagccuuauguacuuucacagaagagauuugagauuagcagcuaacgcuauuugcucagcaguaccgucucacugggucccuacaaguagaaccacguggucaauccaugcaaaacaugaguggaugacgacugaggauauguuaacgguguggaaucguguauggauacaagaaaacccauggauggaagacaaaacuccugucgaaaguugggaagaggugcccuauuuaggaaagcgugaagaccaauggugugguagucuaauaggccuuacaucacgagcuacuugggccaaaaacauccaaacugcuauaaaucagguccggucacuuauagggaacgaagaauacacagacuacaugccaagcaugaaacguuuuagaagagaggaagaggaagcugggguuuugugguag

SEQ ID NO: 22672 - RNA, 9876 nt, Artificial Sequence
  derived and/or modified CDS sequence (opt6) from DENV-2__EU482450__SS-prME
ucggcagggaugauaauaauguuaauuccuacggugauggcauuccauuuaacuacucguaauggugaaccucauaugauaguaggcauucaagaaaaaggcaaaucucuacuauuuaaaacugaagauggaguaaacauguguaccuugauggcaauggacuuaggugaauugugcgaagacacuauaacuuauaaauguccauuauuaaggcaaaacgaacccgaagacauugacuguuggugcaauagcacgucaaccugggucacauaugguacauguacaacaacaggcgaacacagaagagaaaaacgaucgguugccuuaguaccacacgucgggaugggccuagaaacaaggacugaaacuuggaugagcagugaaggcgcauggaaacaugcucaaagaauugaaacguggauacuaaggcacccugguuucacaauuauggcagcuauuuuagcauacacuauagggacuacucauuuccaacgagucuuaauauuuauauuacuaaccgcaguagcaccaucaaugacaaugagauguauaggaauuuccaauagggauuucguugaaggagucucuggcgguucguggguagauauaguacucgaacaugggagcugcguaaccacaauggccaaaaacaaacccacacuggacuuugaacuaauaaaaacugaagcaaaacaaccagcgacauuacguaaauacuguauugaagcaaaauuaacaaacacgacuaccgaaaguagaugcccgacucaaggagaaccgucacuaaaagaagaacaagauaaaagguucguauguaaacauucaaugguagacaggggcuggggaaauggcugcggucuauuuggaaaagguggaauaguuacuugugcuauguucacaugcaagaaaaauauggaagggaaaauuguacaaccugaaaaucucgaauauacaauaguuguaacaccccauucuggcgaagaacaugcgguaggcaacgauacggggaaacauggacaagaaauaaaaguuacuccacaguccagcauaacugaagcagagcugacaggauacgggacaguaacaauggaaugcucuccaagaacgggacuagauuuuaaugagaugguacuacugcaaauggagaacaaggcuuggcuaguacaccgacaaugguucuuagaucuaccucucccauggcucccaggcgccgacaaacaagaaucgaacuggauacaaaaagaaacgcuaguuacuuucaaaaacccgcaugcaaagaaacaggauguaguggugcucggaucacaggagggggcaaugcacacggcacuuacgggggcuacagagauacaaaugucaagcgguaauuuauuauuuaccggccaccuuaaaugucgcuugagaauggauaaacuacaacucaaagggaugaguuacucaauguguaccggaaaauucaaaguuguaaaagaaauugcagaaacacaacaugguacgauaguaauaagaguccaguaugaaggagacggaucgccaugcaaaauaccauuugaaauuauggacuuagagaaaagguauguacucggacgauugaucacugucaauccgaucguuacugaaaaagauagcccagucaauauagaagcggaacccccauucggcgacuccuauauaauaaucggaguagaaccuggucaauuaaaacuuaauugguuuaagaaagguucauccauaggacaaauguuugaaacaacgaugagaggggcuaaaagaauggcaauuuuaggagacaccgcgugggacuucgguucuuugggcgguguuuucacguccaucggaaaagccuuacaccaaguguuuggugcaauuuauggugcagccuuuucagggguaagcuggacgaugaaaauacugauaggggugaucaucacauggauuggaaugaacucaagaucgacaagucuaaguguaucucuaguucuaguagguauuguaacccuauaucucggaguuaugguucaagcagacucagguuguguuguaucauggaaaaauaaagagcuuaaauguggaagugguaucuuuauaacagacaauguacacacauggacagagcaauacaaauuucagccagaaagcccgucuaagcuagcaucagccauucaaaaagcacaagaagaaggcauuugcgggauucguucagucacuagguuagaaaaucuaauguggaaacaaauaacaccagagcuuaaucacauauuggcugaaaaugagguaaaacuuacaauuaugacgggugacauuaaaggaauaaugcaagcaggaaagagaucauuacgcccacaaccuacggaauuaaaauacucguggaaaaccuggggaaaagcuaaaauguugucaacagaauccuacaaucaaacauucuugauugauggaccagagacggcugaaugccccaauacaaauagggcuuggaacucauuagaaguugaggauuacgguuucggcguauucacgacaaacauauggcuaaaauuaaaagaaaagcaagaugcuuucugcgauucaaaauuaaugucagcugcaauaaaagauaaccgagcgguucacgccgacaugggauacuggauagaauccgcgcucaacgacacguggaaaauagaaaaggccaguuuuauugaaguaaagaacugucauuggccaaaaucucauacgcuuuggucuaacggaguuuuggaaagcgaaaugauaauucccaaaaaucuugcaggaccagugucacaacauaacuacagaccgggauaccauacgcaaaucgccgguccauggcacuuaggaaaauuggaaauggauuuugauuuuugugaugguacaacaguaguggugaccgaagacugugguaacagagguccuucccuaagaacaaccacagcaucaggaaaacuaauaacggaauggugcugcagaaguuguacacuuccuccccugagauacagaggugaagauggguguugguacggaauggagauuagaccauuaaaggaaaaggaagaaaacuuaguuaacucauuaguaacagcaggacacggacagguagauaacuucuccuugggaguacuagguauggcacuuuuccuggaagaaauguuacggacacgugugggaacaaaacacgccauucugcuagucgcuguaucauucgugacucuaauuaccggaaacaugaguuucaaagauuuaggucgcgugguugugauggugggcgcaacuaugacagaugauauugguauggguguaacguaucuagcacuucucgcugcuuuuaaggucaggcccacuuucgcagcggguuugcuauuacgcaaacucacuagcaaagaacuaaugaugacaacuaucgguauaguccuacuuagccaaagcgccauacccgaaacgguucucgagcugacagaugcuuuagcccuaggcaugaugguuuugaagauaguacguaacauggaaaaauaucaacuggcuguaacuaucauggcaauacuguguguucccaaugcaguaauauuacagaacgcauggaagguauccuguacaaucuuagcaguaguaagcgucucuccacuucuacuaacaagcagccagcagaaaacagauuggauuccauuagcacuaaccauaaaaggccuaaauccaacugcuaucuuucucacaacgcuuucuagaacaaauaaaaagcgaaguuggccgcuuaaugaagcgauuauggcaguugguaugguaagcaucuuagcauccucacuucuuaagaaugacauccccaugacagguccacuuguagcuggcgguuuguuaaccguuugcuacguacucacgggaagauccgcagaucucgaauuagaaagagcaacagacguaaaaugggaggaccaagcagaaauuagcggaucauccccuauuuuaaguauuacuauaucagaagaugggucaaugucaauaaagaaugaagaggaagaacaaacgcuaaccauacugaucagaacuggacuacuuguaauuucuggguuauuucccauuucgauacccauaacggcugcggcaugguaucuaugggagguuaagaaacaaagagcuggcguucuuugggaugucccuaguccaccaccaaugggaaaggcugaacuagaggauggagcuuaccgcauaaagcagaagggcaucuugggguauagucaaauuggcgcugguguauauaaggagggcacauuucauacaauguggcauguaacaaggggagcuguuuuaaugcacaaaggaaaaaggauagagccuaguugggcagacgucaagaaagacuuaauaucauaugggggaggauggaaacuugaaggggaauggaaagaaggugaagaaguacagguuuuagcccucgagcccggaaagaacccuagagcagugcagaccaaaccuggacuuuuuaagacuaacacagguacuauaggagcaguaagccuagauuucaguccaggaacauccggaagucccauaauugacaaaaaggguaaaguaguaggauuauacgguaaugggguagugacuagaaguggcgcuuaugucagcgcaauagcgcaaacagaaaaaucuaucgaagauaauccagagauagaagaugauauuuuuaggaaaaggcggcuuacgaucauggaccuccacccuggagccgggaagacaaaaagauaccucccagcgauuguaagggaagccauaaagcguggucuaagaacacugauauuagcaccaaccagggugguagcagcagaaauggaggaagcucuacgaggucucccaauacgcuaucaaacucccgcuauuagagcagaacacacgggacgagagauaguggaccuuaugugccacgccacuuucacaaugagacuacucucaccgguuagaguaccuaauuacaaucucaucauuauggaugaagcacauuuuacggacccagccaguauagcagcaaggggguauauaaguacaagaguagaaaugggcgaagcagcaggaauuuucaugacggcaacgccaccuggaucccgcgauccauuuccacagagcaaugccccaauaauugaugaagagagagaaauuccggaaagaucguggaacucaggacaugaauggguaacagauuuuaaaggcaaaacaguaugguuuguuccgucaaucaaagcggguaaugacauagccgcauguuuaaggaagaaugguaagaaagugauacaacucucaagaaaaacuuuugacagugaauacgugaaaacgagaacaaaugauugggauuuugucgucacuaccgacaucucggaaaugggugcaaacuuuaaggccgaaagaguaauagauccuaggagguguaugaagccuguuauucuuaccgacggagaagagaggguaauacuagcagggccaaugcccgucacccacagcucugcggcgcaacggcgaggucgaauuggacgaaauccaaagaacgaaaaugaucaauacauauacaugggagagccucuggaaaacgacgaagauugugcacacuggaaagaagcgaaaauguuacucgauaauauaaacaccccugagggaauaauaccaagcauguuugaaccagaacgagagaaagucgacgcuauagauggggaguacagacuaaggggugaggcuagaaaaacuuucguggauuuaaugaggcggggagaucuuccggucuggcuagcuuacaaaguagcugcugagggaauaaacuacgcggaccgcagaugguguuucgauggaaucaaaaacaaucaaaucuuggaagagaacguggaaguugaaauauggacuaaggagggagaacggaaaaagcuaaagccccgaugguuggacgcgcguauuuacucagacccucuagcacuaaaggaauuuaaggaguucgcggccgguaggaaaaguuuaacauuaaaccuuaucacagaaaugggaagacuuccgacuuuuaugacacagaaaacccgggaugcacucgacaauuuggcugucuuacacacugcggaagccgguggcagagcauacaaucaugcccuaagugaacuccccgaaacccuagaaacacuucuacuauuaacgcuauuagcuacaguuacgggugggaucuuucuauuucugaugucaggaagaggcauuggcaaaaugacacuagguaugugcuguauuauaaccgcaaguauuuuacuaugguaugcacaaauccaaccucacuggauagcagcaucuauaauauuggaguucuucuuaauagucuugcugaucccagaaccugaaaaacagagaacaccacaagauaaccaacuaacguaugugguuauagcaaucuugacugucguugcagcuaccauggcuaacgaaaugggcuuucuugagaaaacaaagaaggaccuuggccuugggucgauugcuacucaacaaccugaaucaaauauccucgacauagaucuuaggccagcaagugcauggacgcuauaugcuguagccacuacauucguuacuccgauguuacgacauucaauugaaaauucaaguguaaauguuucauuaacugcaauagcaaaucaagccacugucuuaaugggcuuggggaagggauggccucucucgaaaauggauauuggggugccuuuacuagccauaggguguuauagucaaguaaacccaauuacauugacagcggcguuguuacuauugguagcacacuaugcaauuauaggacccggcuuacaggccaaggccacgagagaggcacagaaacgggcagcagcaggaaucaugaaaaacccaacgguagaugguauaacaguaaucgaccuagauccaauuccauaugauccaaaauuugagaagcagcuuggacaaguaauguuauuaauucuaugcguaacucaaguuuuaaugaugaggacuacaugggcauuaugugaggccuuaacauuggcaacaggcccuaucucaacccuaugggaaggcaaccccgggagguuuuggaacacuaccauugcuguaagcauggcuaauauuuucagagggaguuacuuggcaggagcaggauuacuuuucucaauaaugaaaaacacaacaaacacgcgcagagguacgggaaauaugggagaaacuuuaggagaaaaauggaaaagcagauugaacgccuuaggaaaauccgaguuccaaauauauaagaaaaguggaauccaagaaguagauaggacucuugcgaaggagggaauaaaacgaggggaaacugaucaucacgcugugucaagggggucugcuaagcuaaggugguuugucgaacguaacaugguaacuccugaagguaaaguaguagacuugggauguggaagaggagguuggucauauuauuguggagggcugaagaaugugcgagaaguaaagggacuaacuaaaggagguccaggacacgaagaaccaauuccuaugagcacauacgguuggaaucuuguaagacuucaaucgggaguugacguauucuuuauuccaccggaaaagugcgauacuuuacucugcgauauaggagagucgucaccgaauccaacaguagaagcagggcgaacacuaagagugcuaaacuuaguggaaaacuggcuuaauaauaauacccaguucuguauaaaaguguuaaacccauacaugccuagcguaauugagaaaauggaagcauugcaaagaaaauauggaggggcucuugucaggaauccgcuaagcagaaauucaacucaugaaauguacuggguuagcaaugcgagcggcaacauagucucuagugugaacaugauuagccgcaugcuaauuaauagauuuacuaugagacauaagaaagcaaccuacgaaccugauguggaucucgggucagggacacguaauauagguauagaaucugaaauuccaaacuuagacauaauugggaagagaauugagaaaauaaaacaagaacaugaaacgucauggcacuacgaucaagaucacccguacaaaacaugggcuuaccacgggucauacgaaaccaaacaaacgggaucugcuagcucaauggugaaugggguuguuaggcuacuuaccaaaccaugggauguucuaccaacaguuacgcagauggcaaugaccgauacaacucccuuuggucagcagagaguauuuaaagagaagguagauaccagaacgcaagagccuaaagaggguaccaagaaauuaaugaaaauuaccgcagagugguuauggaaggaacuugggaagaagaaaacgcccagaauguguaccagggaagaguucacucgcaagguccgaaguaacgcagcucucggcgcgauauucaccgaugaaaauaaauggaaaagugcucgugaagcaguagaagacaguagauuuugggaacucguggauaaagaacgaaaccuacaccucgaagggaaaugcgaaacauguguuuauaauaugauggguaaacgugaaaagaaauuaggagaguuugguaaagccaaaggaaguagagcaauaugguacauguggcuuggugcccgauuucuggaauuugaagcacuaggguuucuuaaugaagaucauugguuuagucgggaaaauucacuaaguggaguagaaggugaagguuuacauaaauuaggguauauauugcgggauguaaguaagaaagaagguggagcuauguacgcagaugauacagccggaugggauacucgcauaacucuggaagaccuuaaaaaugaagaaaugguaacaaaccauauggagggugagcacaagaaauuagcggaagccauuuuuaaauuaacuuaucagaacaaaguggugcguguacaacgaccgacgccaagaggcacaguuauggauauuauuucgcgcagggaucagaggggcucaggacaaguagguacuuauggccuaaacacauuuacuaauauggaagcgcaauugauucgccaaauggagggggaagggguuuucaaaaacauccagcauuuaacuguuacugaagagguugcgguaaagaauugguuggcacgugucggaagggaacgucuaucacgcauggcaauaagcggcgaugauugcguagugaagccuuuggaugacagauuugcuaacgcauugacagcucugaaugauaugggcaaaaucagaaaagauauacaacagugggaaccaaguaagggauggaaugacuggacacagguaccguuuuguagucaccacuuucacgaacuuauaaugaaagaugguagaguguuaguuguaccuugucguaaccaggaugaacuaauaggucgagcuaggauaagucaaggagcaggaugguccuuacgugaaacggcaugucuuggcaaguccuaugcucaaauguggagccuaauguacuuucauaggcgcgaucuacguuuagcggcaaacgcgauauguucggcggucccgucacacuggguucccacaagucgaacgacguggucaauacacgcuaaacaugaauggaugacuaccgaagacauguuaaccgucuggaaucgagucuggauaagggaaaauccauggauggaggauaaaacaccuguugaaucaugggaagaaauccccuaccuuggaaaacgcgaagaucaaugguguggaucccucaucggauugacuuccagagcgaccugggccaaaaauauacaggcagcaaucaaccaaguuagaagucucauugggaaugaggaauaugcagacuacaugccaucaaugaaacgauuccggagagaagaggaagaagcuggaguauuaugguaa

SEQ ID NO: 22673 - RNA, 9876 nt, Artificial Sequence
  derived and/or modified CDS sequence (opt6) from DENV-2__EU569721__SS-prME
ucugcgggaaugauuauaauguuaauaccuacuguaauggcuuuccaucucacuacucgcaacggagaaccacauaugauagucggaauacaagaaaaaggcaaaucguuauuauucaaaacugaagauggagugaacauguguacguuaauggcuauggauuugggggaauugugcgaagacacaauaacuuacaaaugcccgcuuuuacgucaaaaugaaccagaagacauugauuguuggugcaauaguacaaguacauggguuacauaugggacauguacaacaacaggcgaacauagacgagagaaaagauccguugcucuuguaccacauguaggaaugggauuagaaacuagaacagaaaccuggaugagcagugaaggcgcauggaaacacgcccaacgcauagaaaccuggauucuuagacauccuggcuuuaccaucauggcggccauacuggcauauacgauaggcacgacgcacuuucaaagagugcuaauauuuauacuccuaacagcagucgccccaucaaugaccaugagauguauagggauuagcaaucgcgauuuuguugaaggaguaaguggaggcaguuggguggacauuguacuugaacaugggucaugugucacgaccauggcgaaaaacaaaccaacacuagauuucgaauugaucaaaacagaagcaaaacaaccugcuacauuaagaaaauauugcauugaagcaaagcugaccaacacaaccacugaaucaagaugccccacacaaggagaacccagcuugaaagaagaacaggacaaacgauuuguaugcaaacauuccauggucgacagaggguggggaaacgggugcgguuuauuuggcaaaggaggaauagucacaugugccauguucacaugcaagaaaaacauggaagguaaaauuguacaaccagaaaaucuggaguacacuauuguaguaacaccucauucaggggaagaacaugcgguugguaaugauacuggaaaacauggacaggaaauaaaagugacuccucagucaaguaucacagaagcggaacugacuggauacgguacaguaaccauggaauguuccccacgaacaggucuggacuucaaugaaauggugcuacugcaaauggaaaacaaggcauggcucguacauagacagugguuccuagaucugccucuacccugguuacccggcgcggauaaacaggaaaguaacuggauacaaaaggaaacuuuaguuacauucaagaauccacacgcaaagaaacaagacgucguaguacugggaagucaagaaggagccaugcauacggcccuaacaggugcaaccgaaauacagaugucaaguggcaaccuauuauuuacgggccaccuaaaguguagauuaagaauggauaaauugcaacuuaagggaaugucauauagcaugugcaccgguaaauuuaaagucguaaaagaaauugcagaaacucaacaugguacaauugugauacgaguucaauacgaaggcgauggcuccccauguaagauuccauucgaaauaauggaccuagagaagagauauguacuuggccgauugauuacuguaaauccuauuguaacagaaaaagacucaccaguuaauaucgaagccgaaccaccuuucggugauucauacaucauuauaggaguugaaccuggucaacuaaaacugaacugguuuaagaaagguagcucaaucggacaaauguucgagacuaccaugagaggggcuaaacguauggcaaucuuaggcgauacagcuugggacuuugguucacucggagggguuuuuacaaguauaggaaaagcauuacaucaaguauuuggagcaaucuacggagcggcauucucaggagugucauggacgaugaaaauucuuauaggugucaucauaacauggauugguaugaacucucggucaacaagccuaucggucucuuuaguucuagucgguauaguuacacuuuauuuaggaguaaugguccaagcggauucaggaugcguaguaaguuggaaaaauaaagaauuaaagugcgggucggguauauucauuacugacaacguccauacuuggacagaacaauacaaauuccaacccgaaaguccuucgaaacuugcaucagcgauacaaaaagcacaagaggaggguauauguggaauuagaucaguuacgagacuugaaaacuugauguggaaacaaauaacuccagaacuaaaucacauacuggcggaaaaugaaguaaaacuuacgaucaugacuggagauauaaaagggauaaugcaagcagguaagcgaagccuacguccacaaccuaccgaacuuaaauacucuuggaaaaccugggggaaagcaaaaauguuaagcacugaaagcuauaaccaaacauuccuuauugacgggccugaaacggcagagugccccaacaccaaccgugcuuggaacucauuagaaguagaagauuauggauucgguguauuuacuacaaauauuuggcucaagcuaaaagaaaaacaagaugcuuucugugauucaaaauugaugucagccgcaauuaaggacaauagggcaguccacgcggacaugggcuacuggauugaaagcgcgcuaaacgauacauggaaaauagaaaaagcgucauucauagaagugaagaacugccauuggccgaaaagucauacccuauggucuaauggaguccuagaaucugaaaugauaauccccaaaaaucuagcaggucccguuucacaacacaacuaccgcccaggauaucauacccagauagcaggucccuggcaucuuggaaagcucgaaauggacuuugacuuuugugauggaacaaccguaaucgucaccgaagacugcggcaacagaggucccagccuccgaaccacaacggcaucaggaaaauuaaucacugaaugguguugcagaucaugcacccuaccuccacuaagauacagaggagaggauggcuguugguacgguauggagauaagaccgcugaaagagaaagaagagaaucuaguaaacagucuaguaacagccggccacggacagguagacaacuucucuuuggguguauuaggaauggcccuauuccuugaggagauguuaagaaccagaguagguacaaaacaugcuauacuucucguugcagugaguuucguaacuuugaucacaggaaauaugucuuuuaaagauuuagggcgggucgucgugaugguaggcgcaacaauggcagacgacaucggaauggguguuacguacuuagcuuuguuagcagcauucaaagugcgaccaacauuugcagcugggcuccugcuuagaaaacucacuucaaaagaacugaugaugacaacaauagguauaguauuacuaagccaaucaacuauccccgagacggugcuugaguuaacagacgcauuagcuuuaggcaugaugguauugaaaauuguacgcaacauggaaaaauaucaacuagcuguuaccauuauggcaauacuaugcgucccaaacgcagucauauuacaaaaugcguggaaagucucguguaccauacuugcaguuguuagcguaaguccccuauuguuaacuagcucacaacagaagacagacuggauaccauuagcauugacuauuaagggcuugaauccaacagcuauuuuccuuacaacuuuaucacggacgaacaaaaagcgaucuuggccauuaaacgaagcuauuauggcaguagguaugguaucgauauuagcgucaagucuacuuaaaaacgacauacccaugaccgguccgcuuguugccggugguuuacuaacugucuguuacguuuuaacagggagaagugcagauuuagaauuagaaagggcaacagaugugaaaugggaggaucaagccgagauuagugguaguagcccgauuuugucuaucacaauuucagaagacgguaguaugaguaucaaaaaugaagaagaagaacaaacauuaacaauacugauacggacuggacuucuugucauuagugggcuauucccuauaucuaucccaauuacugccgcagccugguaccuuugggagguuaagaaacaaagagccggaguauuaugggacgucccaagcccacuaccgaugggaaaagcagaacuugaagauggggcauacagaauaaaacaaaagggaauauuaggauacagucaaauaggcgccggcguguauaaagaaggaacauuccacacaauguggcauguuaccagaggcgcaguucuaaugcacaaagguaagcgaauugaaccaaguugggccgacguuaagaaagauuuaauuucauaugguggaggguggaaauuagaaggugaauggaaagaaggggaggaaguacagguuuuagccuuagaaccuggcaaaaauccgcgagcaguccaaacaaaaccaggacuuuuuaaaaccaauacugggacuaucggcgcaguuucucuugauuuuaguccuggaaccagcgggucuccaauaauagauaaaaagggcaaaguaguaggucuuuaugguaauggcguaguuacaagaagcggagcguaugugucugcuauugcacagacugagaaaaguauagaggauaaucccgaaauagaagaugacauauuccguaaaaagcgcuugacaauaauggaccuucacccaggcgcggggaaaacuaagagauaucuuccugcuauaguacgagaagcgauaaaaagagggcuuagaacguugauacuagcgccuacaaggguuguagcugcagaaauggaagaagcgcuaagaggauugccaauaagauaucaaacgccugccaucagagccgagcacacagggagggagaucguagaccucaugugucacgccacuuuuacaaugcgucuacugaguccaguacguguaccgaacuacaaucuuauaauaauggaugaagcacacuuuacggacccagcuuccauagcggcaagggguuacauuucaacucgaguugaaaugggagaagccgcugguaucuucaugacagcaaccccaccaggaucacgugacccauuuccucaaaguaacgcaccaauaauagacgaagagagggagauaccugaacgcucuuggaacucugggcaugagugggugacugacuucaaaggaaagacggucugguuuguuccuaguauuaaagcagggaaugauauagcugcuugccugaggaaaaaugggaaaaaggugauacaacuaagcaggaaaacauucgauagugaauauguuaaaaccagaacgaaugauugggacuucguuguaaccacugauauuagugaaaugggggcaaauuuuaaagccgaacgugugauagacccgagacgcuguaugaaaccaguaauauugacagauggugaagagagagucauucucgcagguccaaugccaguuacacacucaucugcugcacagcgacgaggaagaauaggaagaaaccccaaaaaugaaaaugaucaauacaucuacaugggugaaccauuagaaaaugacgaggacugugcacacuggaaagaagcaaaaauguuacuagauaacauaaacacacccgaaggaauaauacccuccauguuugagccagagcgggaaaaaguagacgcgauugacggggaauauagacuucgaggagaggcaaggaaaacauuuguagaccuaaugagacguggagaucuuccaguuugguuagcauauaaagucgcagccgaaggcauuaacuaugccgauagacgaugguguuuugauggcauaaagaauaaucagauacuagaagaaaauguugaaguagagaucuggacgaaagaaggagaacggaagaaauugaaaccaaggugguuagacgcucgaauauacagugacccauuagcuuuaaaggaguucaaagaguucgcugcagggcggaaaucccuaacauuaaauuugaucacagaaaugggaagauuaccuacauucaugacgcagaaaacuagggacgcucucgauaacuuggcaguucuacauacagccgaagcaggaggacgugcauauaaccaugcccugucagaauugccagaaacacuagaaacacuacuccuauuaacacuguuagcgacgguaacaggagguauauuccuauucuuaaugucaggacgaggaauugguaaaaugacauuagguauguguuguauuauuacagccaguauuuuauuaugguacgcgcaaauacaaccacauuggaucgcggcaucgauuauacuugaguucuuuuuaauugucuuacuaauaccagaaccugaaaagcaacggacaccucaagauaaccaguuaaccuacguaguuauagcaaucuugacgguaguagcagccacaauggccaaugaaaugggauuuuuagaaaagacaaagaaggauuuagggcuugguagcauagcaacccaacaacccgaaucgaauauccuagauauugaccuacgucccgcaucugcauggacccuauacgcagucgcgacaacauucguuacucccauguugaggcacucgauagaaaacucuagcguuaauguaucguuaacggcuauagcgaaccaagcaacuguauugauggggcucggcaaaggauggccauuauccaaaauggauauaggaguuccgcuguuggcaauagguuguuacagccaaguuaauccaaucacacuaacugcugcccuacuauuacuugucgcacacuaugcgauuauagguccaggucuacaagcaaaagcaacccgcgaagcacaaaagagagcggccgcuggaaucaugaaaaauccaaccguggauggcauuacaguuaucgaccuggacccaauucccuaugacccgaaauucgaaaagcaguugggacaagucaugcuucuuauucuaugugucacacaaguauuaaugaugcgcacgacgugggcauugugcgaggcauuaacacuggcgacuggaccaauaucaacucuaugggaggguaacccagguagauucuggaacacaacaauagcaguaucaauggcaaacauuuuccguggaaguuaucuagcgggagcuggacuccuauuuucaauuaugaaaaauacuacuaauacacgaaggggaacagguaacaugggagaaacgcucggugaaaaauggaaaucgaggcugaacgcccugggcaagucugaguuccaaauauauaagaaaagcggaauacaagagguugaccgaacauuggcgaaagaggggauuaaaagaggggaaacugaccaucacgcgguaucuaggggaucagcuaaauuacguugguucguggaacggaacauggugaccccugaagguaaaguagucgacuuagggugugggcguggcggauggucauauuacugcggcgggcuuaaaaacguuagggaggugaaaggacugacuaaaggagguccaggacaugaggagccuauaccaaugaguacauaugguuggaauuugguucgacuucaaagcggaguagacguauuuuucauaccgcccgagaaaugugauacacugcuuugugacauaggcgaaucuucacccaauccgacgguagaggcaggcagaaccuuacgcguauuaaaccucguagaaaacuggcuaaacaauaauacacaauuuuguauaaaaguauugaauccauacaugcccucagucauugaaaagauggaagcauugcaacgcaaauacggaggagcguuagugagaaauccgcugagucgcaauuccacacaugaaauguacuggguguccaaugcuucagguaacaucguaucgucgguaaacaugauaucucgcauguuaauuaauagauuuacaaugagacacaaaaaggcaaccuacgaaccugauguagacuuaggcagugggacacgaaauauuggaaucgaaagugagacaccuaaucuggauaucaucggaaaaaggauugaaaagauuaaacaggaacaugaaacaaguuggcacuaugaccaagaucauccuuacaagacuugggcauaucaugggucauacgagaccaagcaaacggggucggcaaguaguauggucaacggcgucguuagguuauugacuaaaccaugggauguuuuacccacagucacccagauggcgaugacagacacaaccccuuuugggcaacaacgaguauucaaagagaaaguggauacacgaacucaggagccgaaagaaggaaccaagaaacugaugaaaaucacugcagaauggcuauggaaagaacuuggcaaaaagaaaacacccagaaugugcacacgcgaagaauuuacucgaaaaguacgcucgaacgccgcuuuaggagcuauauuuacagacgaaaauaaauggaaaagcgcaagagaggcuguagaagacucccgcuuuugggaguuaguagacaaagagcggaaucuucaccuagaagguaaaugugaaacaugcguguacaacaugaugggcaaacgagagaagaaacuaggagaauuuggaaaagcuaaaggaucccgcgcuauaugguacaugugguuaggggcuagauucuuggaauuugaagcucugggauucuuaaaugaagaucacugguuuucgagggaaaauagucuauccggcguugaaggcgaagguuugcacaaauuaggauacauccuaagagaugugaguaagaaagaagggggagcaauguacgcggaugacaccgccggcugggauacgcgcaucacccuagaagaucucaaaaaugaggaaaugguaaccaaccauauggaaggggaacacaagaaacuagcagaagcaauauuuaaacuaacuuaccaaaauaaggucguccguguccaaaggccuacgccacgcgggacggugauggauauuauaucacgcagggaccaaagaggaucagggcaaguugguaccuacggacuuaauacauuuacaaauauggaagcucaauuaaucagacaaauggaaggagaaggggucuuuaaaaauauccaacaucuuacugugacugaagagguagcagugcaaaauuggcuagcacgaguaggacgggaaagauuaucucgaauggcaauuucaggggaugauugugugguaaagccccuugacgaccgcuuugcuaacgcauuaaccgcccuuaaugauaugggaaagauccgaaaagauauacagcaaugggagcccaguaaggguuggaaugauuggacucagguaccuuuuugcucgcaucauuuccaugaacuaauaaugaaagauggacgaguucucgucgucccaugucgaaaucaagaugaauugauaggacgagccagaauaagucaaggagccggauggucgcuuagagaaaccgcaugccuugggaaaaguuacgcgcaaauguggucguuaauguacuuccaucgacgcgacuugagguuagcugcuaaugcuaucuguuccgcagucccuucacacugggucccuacaucacgcaccacauggucgauucacgcaaaacaugaauggaugaccaccgaagacaugcucaccguauggaaucggguauggaucagagaaaaucccuggauggaggacaaaacuccuguagaaucaugggaggaaauuccauauuuggguaaacgugaagaccaauggugcgguucauuaauuggacuaacaaguagggcuacgugggccaaaaacauucaagccgcaauaaaccaaguaagaaguuugauuggaaaugaggaauacacagauuacaugcccaguaugaaacgauuccguagagaagaagaagaggcaggcguacugugguga

SEQ ID NO: 22674 - RNA, 9876 nt, Artificial Sequence
  derived and/or modified CDS sequence (opt6) from DENV-2__EU482451__SS-prME
ucagcuggaaugaucauaaugcuuauaccaacaguuauggcauuucaccuaacaacacgaaauggagaaccucauaugauaguagguauacaagaaaaagggaaaucucuccuuuuuaaaacagaagacggcguaaauaugugcacgcuuauggcgauggaccucggagaauuaugugaagacacuauuacuuauaaauguccauuguuacggcaaaaugaaccagaagauauagacuguugguguaauagcacaucaacauggguuaccuacgguacaugcacaacgacuggggaacacaggcgcgagaaaagaucuguggccuuaguaccucauguuggaaugggcuuagaaacgagaaccgaaaccuggaugucuucggaaggugccuggaaacacgcgcaaaggaucgaaacguggaucuugcgacacccaggauuuacaauuauggcagcgaucuuagcauauaccauuggaacuacccauuuucagagaguccuaauauuuauccuccuaacagcuguugcaccaucaaugaccaugcgcugcauugggauaucaaauagagacuuuguugaagggguaaguggaggaaguuggguggauauagugcucgaacauggaucaugugucacaacaauggcuaaaaauaaaccuacauuggacuuugaauugauaaaaacugaagcaaaacaacccgccacacuuagaaaauauuguauugaagcaaaauuaaccaauacaaccacagaaaguagguguccgacgcaaggagaaccguccuugaaagaagaacaagacaaaagauuuguaugcaaacauagcaugguagauagaggguggggcaaugguugcggacuauuuggaaaaggcggaaucguuacuugugccauguucacaugcaagaaaaauauggaaggaaaaauaguacaaccugaaaauuuggaauauacuauugugguuaccccgcacaguggagaagaacaugcaguagggaaugauacugguaaacaugguaaagaaauuaaagugacaccccaaucaucaauaaccggagccgaauuaaccggauaugguacggugacgauggaauguucgccccgaacaggucuagauuucaacgaaauggugcuuuuacaaauggaaaacaaagcaugguuaguacaccgacagugguuucuugauuuaccccuaccauggcuaccgggagcugacaaacaagaaucuaauuggauacagaaagaaacauuagugacauuuaaaaacccccacgccaagaaacaagacguugugguauuaggaagucaagagggagccaugcauacagcauugacaggcgccacggaaauacagaugucaagcgggaaccuuuuauuuacagggcauuuaaaauguagguuaaggauggauaaacuacagcucaaaggaaugucauacagcaugugcacggguaaauucaaagucgucaaagaaauagcugagacucaacacgggacaauagugauuagaguacaauaugagggggauggaaguccguguaaaaucccuuucgagauuauggaucucgagaaacgcuaugugcucggaagauuaauuacuguaaauccaaucgucacagaaaaagacucuccaguaaacauagaagcugaaccaccuuuuggcgacucauauaucaucaucgguguggaaccgggccaacuaaaauuaaauugguucaagaaaggaucgaguauugggcagauguuugaaacuacuaugagaggagcgaaacguauggcaaucuuaggggacacagccugggauuuuggguccuuaggaggaguauucacaaguauagguaaggcacuucaccaagucuuuggggcgauuuauggugccgcuuucucgggcguaaguuggaccaugaaaauacucauaggcgugauuauaacauggauuggcaugaacagccgauccacaagucuuucaguaaguuuggugcuuguuggaauaguaacucucuaucugggcgugauggugcaagcugauucaggcuguguuguuucauggaagaauaaggaacucaaauguggcucugggauauuugugacagauaauguacauacauggacugaacaauauaaauuucagccagaaucaccaucaaaauuagcauccgccauccaaaaagcacaagaagaaggaauaugcggaauccggucuguaacacgacuagaaaauuugauguggaaacaaauaacgccagaauugaaucacauacuggcugaaaaugaaguaaaauuaaccaucaugacaggcgauauaaaagguauuaugcaggcuggaaaacgcaguuuaagaccacagccgacggaacuuaaauauucuuggaaaaccuggggcaaggcaaaaaugcugucaacagaaaguuacaaccaaacuuuccuaaucgauggcccagagacagcagaauguccgaacacaaauagggcauggaacucgcuugaaguagaggacuauggauuugguguguuuacgacuaauauuuggcucaaguuaaaagaaaaacaagacgcauucugugacaguaaguuaaugucggcagcgauaaaagacaauagggcaguucacgcggauaugggcuauuggauagaaucugcacuaaacgacacauggaaaauugaaaaagcguccuucauugagguuaagaauugucauuggccaaaaucacacacucuauggagcaacggaguucuugaaagcgaaaugaucauucccaaaaaccuugcgggcccuguaucucaacauaauuaucgacccggauaucauacccagauagcuggaccuuggcauuuaggaaagcuggaaauggauuucgauuuuugcgacgguacaacaguaauagucaccgaggauugcggcaaucgagguccuucauuaagaacuacaaccgcgucagguaaauuaaucacggaauggugcugucgaagcuguacacucccaccacuccgcuaccgaggagaagauggaugcugguauggaauggagauaagaccacuaaaggaaaaagaggagaauuuaguaaacucucuagugaccgcaggacauggccaaguugacaacuuuucucugggagucuugggcauggcuuuguuuuuagaagaaaugcuaaggacgaggguaggcacaaaacacgcaauauuauugguugcgguguccuucguuacuuuaauuacuggaaacaugagcuucaaggauuuaggccguguaguaguaaugguaggggcaacuauggccgacgauauuggaaugggcguuacuuauuuggcucugcuggcagccuucaaaguucguccaacauucgcugcgggauuacuccuucggaaguuaacaaguaaggaacuaaugaugacaacgauuggaauagucuuacuaucacaaucaacaauuccugaaacaguguuagaguuaacggacgcguuagcacuugggaugaugguguuaaaaauaguucggaauauggaaaaauaccaguuagcaguuacaauuauggcuauuuuaugcgucccuaacgcuguaauucuccaaaaugcguggaaagucagcuguacaauuuuggcuguaguuucgguuucgccacuuuuacuaacuuccagucaacagaaaacugacuggauaccacuggcgcuaacaaucaaaggucuaaauccaacagcaauuuucuuaacuacacuuagcaggacuaauaagaaaaggaguuggccuuuaaaugaagcaauuauggcuguuggaaugguuucgauauuagcaucaucauuacugaaaaacgauauaccuaugacugggccucuaguagcaggaggcuuguuaacuguauguuauguucuuacagggcggucggcagauuuagaacuggaacgggccacagacguuaagugggaagaucaagcagaaauaucgggaucgucuccaauacuaagcauuaccauaucagaggauggaagcaugucaauaaagaaugaagaagaagaacaaacgcugacaauucuaauacgaaccggucuccuaguuauuuccggucuuuucccgauaagcauacccauaacagcagcagcuugguauuugugggaggucaagaaacaaagagccggcguguuaugggacguaccuucuccaccgccgaugggcaaagcugaauuggaagauggagcuuaucguauuaagcaaaaagggauucuaggauauagucaaauuggagcaggagucuacaaagaaggaacguuucauaccauguggcacgugacaagaggggcagucuuaaugcacaaaggaaagcgcauagaaccaucgugggcagaugugaagaaggacuugauaagcuaugguggagguuggaaacuugaaggggaauggaaagaaggugaggagguacaagucuuggcucuagaaccaggaaagaacccaagagcuguacagacgaaaccaggacuauucaaaacaaguacuggcacaaucggcgcaguaaguuuagauuucucgcccggaacuucagggaguccaauuauugauaagaaaggcaaaguagugggacuauauggaaacggcguaguuacacgcagcggcgccuauguguccgcaauagcacaaacggagaaaucaauagaagauaaccccgagauugaagacgauauuuuuagaaaacgucgcuuaacuauaauggacuuacacccuggagccggcaaaacgaaaagguauuuaccggcaauaguuagggaagcaauuaaacgggggcuaagaacauuaaucuuggcaccgacgcggguagucgcagcugaaauggaagaagccuugcgagggcuaccgaucagauaccagacgccugcaauaagagcagagcauaccgguagagaaauaguugaccuuaugugccacgccaccuuuacaaugagauuacuaucaccuguuagaguuccgaacuauaauuuaauuauuauggaugaggcacauuucacagaccccgcaucuauugcagcgagagguuacaucucaacacgaguagagaugggagaagcagcagggaucuuuaugacugcaacaccaccuggaagcagggacccguucccucaaaguaaugcacccauaaucgacgaagaaagagagauacccgaacguuccuggaauagcggccacgaaugggugacagacuuuaaggguaaaacaguaugguucguaccaucuaucaaagcuggcaacgacauagcugcaugucuaaggaaaaacggcaagaaaguaauucaacuauccagaaagacauuugauagugaauauguaaagaccaaaacgaacgauugggauuuuguuguaacaacugauauaagugaaaugggggcuaacuuuaaagccgaacggguaauagauccuagacgaugcaugaagcccgugauccuaaccgauggagaggaaagagugauacuagcugguccaaugccaguuacccauucaucagccgcucagaggaggggaaggauugggcgaaacccuaaaaaugaaaaugaucaauauauauacaugggugagccacuggaaaaugaugaagauugcgcucauuggaaagaagccaaaaugcucuuagacaacaucaacacgccggaagguaucauaccgucuauguuugaaccagagcgagagaaagucgaugcgauagauggagaauaccgauuaaggggagaggcaaggaaaacuuucguggauuugaugaggaggggcgaucuaccuguauggcuagcauauaaggucgcagcggaaggaauaaauuaugcugauagaaggugguguuucgacggaauaaagaauaaucaaauucuagaagagaauguagaaguggaaauuuggaccaaggagggugaacgaaagaaauugaaacccagaugguuagacgcucgaauuuauucugacccguuagcgcuuaaagaguucaaggaauuugcagcaggaagaaaaucacuaacucuaaaccucauaacggagaugggacgacuuccgacauucaugacacagaaaacaagggaugcauuggauaacuuggcuguguuacauacagcggaagcgggaggacgugcguauaaucaugccuuguccgagcuucccgagaccuuagaaacauuacuacuacucacuuuacuggcuacgguaacuggagguaucuuccuauuuuuaaugucgggucgaggcauuggaaaaaugacauuagguauguguuguauaauaacugcuagcauacuauugugguacgcacaaauacaaccacacuggauagcagcgucaaucauacuagaguucuuuuuaauaguccuacuuauacccgaaccggaaaagcaaaggacaccccaagauaaucagcucacguauguaguaauagcaauuuuaacaguaguagcugcaacuauggcaaacgaaaugggguucuuagaaaagacuaagaaagacuuaggauuagggucgaucgcgacacaacaaccagaauccaauauccuugauauagaucuaagaccugcaagugcuuggacacuauacgcaguugcaacuaccuuuguuacgccaauguuacggcauaguauagaaaacucuucagucaauguuucacucacugcuauagcuaaccaggcaacaguauuaaugggacucggaaaaggcuggccacucagcaaaauggacauaggcgugcccuuauuagcaaucggcuguuauucucaagucaacccuauaacauugacugcagccuuguuacuccuaguugcacacuaugcgauaauaggacccggcuuacaagcaaaagccaccagagaagcacaaaaacgagcugcugcuggaauaaugaaaaacccaacaguugaugggaucacuguaaucgaucuagacccaaucccuuaugaccccaaauucgaaaaacaauuagggcaaguuauguuguuaaucuuaugcguaacgcaaguauuaaugaugagaacuacaugggcccuaugugaggcgcuaacuuuagccacuggcccgauaucgacucuaugggaaggaaacccgggaagauuuuggaauacaacaauagcugucucaauggcaaacauauuuagagggaguuaccuagcaggagcaggacuccuauucuccauaaugaaaaauaccacuaacacaagaagaggcacuggcaauauaggugaaacauuaggugaaaaauggaagucgagauuaaaugcauuaggaaaaucugaauuucaaacauauaaaaagucaggcauacaagaagucgauagaacguuggcgaaagaggguaucaagcgcggugaaaccgaucaucaugcaguuucaagaggaagcgcaaaauuacgcugguucguagaaaggaauaugguaacccccgaggguaagguaguagaucuuggcuguggucguggaggguggaguuauuauuguggggguuuaaagaaugugagagaaguuaaaggacugacgaaaggcggcccuggacacgaagaaccuauaccaauguccacauauggguggaacuugguacgacugcaaucgggaguggauguguucuucauacccccagaaaaaugugacacguuacuaugugauaucggugaaaguucuccaaacccuacaguagaggcgggcagaacccuuagaguucuaaauuuaguagagaacugguuaaauaacaacacacaauuuuguauaaaaguuuuaaauccuuacaugccaaguguaauagagaaaauggaagcacuacaacguaaguacggaggagcguuagugcgaaauccuuugucaaggaauagcacucacgaaauguauuggguaucgaacgcgagcggcaauauuguuucgaguguaaauaugauaagcagaaugcuuauaaauagauuuacaaugcgacacaagaaagcuacauacgaaccagauguugaucuaggaaguggaacccguaauauugggaaugaauccgaaauuccuaacuuagacaucauaggcaaaagaauugagaaaauuaaacaagaacaugaaacuucauggcacuaugaucaagaucauccuuacaaaacaugggcguaccacggaucuuacgagacuaaacaaaccggcagugcaaguuccaugguuaacgggguuguacgacuguugacaaaaccaugggauguccuccccacaguaacccaaauggcaaugaccgacacaaccccuuucggucaacagaggguguuuaaggaaaaaguagauacccgaacccaggaacccaaagaaggaaccaagaaauuaaugaaaaucacugcggaaugguuauggaaagaguuagguaagaagaagacuccacgaaugugcacaagggaggaguuuacccgcaaaguccgcucgaaugcagcacuuggagcuauauucacggaugaaaauaaauggaaaagcgcccgagaagcaguagaagauagucgauuuugggagcuaguugacaaggaaagaaaucuccaucuggaaggcaaaugcgaaacuugugucuacaacaugauggggaaacgagagaagaaauugggagaauuuggaaaagcaaaaggauccagagcaauuugguauaugugguuaggugcuagauuucuggaauuugaagcgcuuggauuucucaaugaagaucacugguucagcagggaaaauagcuuaagcgggguugagggagagggguugcacaaacuaggauauauacuaagagauguaagcaagaaagaaggcggggcgauguaugcugacgauacagcugguugggauacaaggaucacucuggaggaucugaaaaacgaagaaaugguaacaaaucacauggaaggugaacauaagaaauuagccgaagcgauauucaaauuaaccuaucaaaauaaaguaguuagaguacaacgcccuacaccgagaggaacagugauggacauuauuucccgacgagaucagagaggaucaggacaagugggaacauacggcuugaacaccuuuacaaauauggaggcucaacucauacgacagauggagggagaaggcguuuucaaaaauauucagcaccuaacugugacagaagaaguggccguccaaaacuggcuggcacgcguaggccgagaacgucuaaguaggauggcaauaucaggggaugauuguguaguuaagccacucgaugauagauucgcgaacgcucucaccgcauuaaaugacaugggaaaaaucagaaaggauauucaacaaugggaacccucaaaaggguggaacgauuggacucaagugccauucugcagccaucauuuucaugaacuaauaaugaaagauggcaggguucuagucgucccuuguagaaaucaagaugaacuuauaggucgcgcccguaucucacagggagcagguuggagucugagagaaaccgccuguuuggguaaaaguuacgcacagaugugguccuugauguauuuccacaggagggauuugagauuagcagcuaaugcuauaugcagugcuguacccucgcauugggucccaacgucgcguacuacauggaguauccacgcgaaacacgaauggaugacuacagaagauaugcugacgguguggaaccgaguuuggaucagagaaaaccccuggauggaagacaaaaccccuguugaaaguugggaagaaaucccauauuuggguaagagagaagaucaauggugcgguagucuuauuggccugacuuccagggccacaugggcaaagaauauacaaguggcaauaaaccaggucaggucuuuaauugggaaugaagaauauacugauuauaugccuagcaugaaaagauuccgaagagaagaagaagaagcugguguacuaugguaa

SEQ ID NO: 22675 - RNA, 9876 nt, Artificial Sequence
  derived and/or modified CDS sequence (opt6) from DENV-2__EU660413__SS-prME
agcgcaggaaugauaauaaugcuaauuccgacagugauggcauuccaucuaacaacaagaaacggugaaccacacaugauaguagggauacaggaaaagggcaagagucuacucuucaagacagaagacggcguaaacaugugcacacuaauggcgauggacuugggugaacucugcgaagauacaauuacuuauaaguguccacuacuucggcaaaacgaaccugaggacauagacugcuggugcaauucaaccucaacaugggugaccuauggaacuugcacgacaacaggagaacaucgaagagaaaaaagaagcguagcacuuguuccccacgucgguaugggacuagaaacacguacggaaacuuggaugaguucagaaggugcguggaaacacgcccagaggauagaaacguggauccuaagacauccgggcuuuaccauaauggcagcaauauuagcguauacaauagggacgacacauuuccaaagagugcuaauauuuauuuugcugacagcagucgccccaucaaugacgaugcgauguauaggaaucucaaaucgugacuuuguugaaggagucucaggggggaguuggguugacauuguguuagagcauggcucaugcguuacuacgauggcgaagaacaaaccaacacuagauuuugaacuaauuaaaacugaagcgaaacaacccgcaacccuuaggaaguacuguauagaagcgaaacuaacaaauacaacaacggaaagucguugcccaacacagggagaaccgaguuuaaaagaagaacaagauaaaagauuuguuuguaaacacaguaugguggacagaggauggggcaaugguugcggccuauuugggaaaggcgggauagucacaugcgccauguucaccuguaaaaaaaacauggagggaaagauuguacaaccagaaaaucucgaguacacuaucguagucacgccacacucaggugaagaacacgcggugggaaacgacaccggaaaacauggaaaggaaauuaaggucacaccgcagucuaguaucaccgaagcagaacuuacgggauaugguacugugacuauggaauguagcccaagaacagguuuugauuuuaacgagaugguauuacuccaaauggagaauaaagcguggcugguucacagacaaugguuccuagaucuuccgcuuccauggcucccgggagcugacaaacaggaguccaauuggauccaaaaagaaacccuagucacuuuuaaaaacccucaugcaaaaaaacaagacguaguuauauuagggucacaagagggugcgaugcauacugcauuaacaggagccacagaaauacaaaugucgucggguaauuuauuauucacuggccaccucaaaugccguuugcggauggacaagcuacaacuuaaaggaaugucguauuccauguguacugguaaauuuaagguaguaaaggagaucgccgagacccagcacgggacuauuguuauccggguacaauacgaaggagaugguucgccuuguaaaauuccguucgagaucauggauuuggagaaaagauauguacuaggccgacuuauuacagucaauccuauuguuacugagaaggacagcccagugaacaucgaggcggaacccccauucggugauucauauauaauaauagguguugaaccgggccaacuaaagcuuaauugguucaagaaaggaaguucuauaggucaaauguucgagacuacuaugcgaggagcuaagagaauggcaauacugggugauacagcaugggauuucggaucuuuagguggagucuuuaccucuauaggcaaagcuuugcaucaaguuuuuggagccauauacggugcugcauuuuccggcguuuccuggacaaugaaaauacuuauaggugucauuauaaccuggauagguaugaacucccguucgacgucauuaucuguuucuuuaguacugguugguauagucacauuauaucugggcguuaugguccaagcagauucaggauguguuguaaguuggaaaaauaaagaacuaaaauguggcagcggaaucuuuauuacugacaacguucauacauggacugagcaauauaaauuucaaccugaaaguccgucgaaacuugcaucagcaauucagaaagcgcaggaagaaggcauaugugguauacgaagugucacaagauuggaaaauuuaauguggaaacagauaacgccggaauuaaaucauauuuuagcugaaaaugaaguuaaacuuaccauuaugacuggcgauauaaggggaauaaugcaagcuggaaaacgaagccuaaggccccaacccacugaacuuaaauacucauggaaaaccugggguaaagccaaaaugcuauccacugaaucuuacaaucaaaccuuucuuauagacgguccugagacggcagaauguccgaauacuaauagagcauggaauagucuagaaguagaagauuacggauuuggaguuuucacaacaaauauaugguugaaacuuaaagaaaaacaggacgccuuuugcgauucuaagcuaaugucugcugcgaucaaagacaacagagcaguacaugcugauaugggauacuggauugagucagcgcucaaugauacuuggaagaucgagaaggcaucuuucauagaaguaaaaaauugucauuggccaaaaucucacacauuauggucuaauggcguccuggaauccgaaaugaucaucccgaaaaaccuagccgguccagugagccaacauaacuacagaccagguuaucauacgcagauagccggccccuggcacuuaggcaagcuugagauggauuuugauuucugugacgguacgacugugauagugacagaagauuguggaaacagaggucccuccuuacgaacgacgacagcuucaggcaaauuaaucacagaauggugcugccgaucaugcacacucccaccuuuaagauaccgaggcgaagacggaugcugguacggcauggaaauaaggccccucaaggaaaaagaggaaaacuugguaaauagccugguuacggcuggccauggacaaguugacaauuuuucauuaggaguuuuggggauggcguuguuccuagaagagaugcugagaaccagaguggguacuaaacaugccauacuacucgucgcugucucuuuugucacguuaauuacagggaauauguccuuuaaggacuuggggcgcguugucgucaugguaggugcuacaauggcggaugacaucggaaugggagucacauaucuggcguuacuggccgccuucaaaguucgcccaacauuugcagcugguuuacuuuuaagaaaauugaccucaaaggaacuuaugaugacgacaauaggaauagugcugcugagucaaagcacgauaccugagacugugcuagaacucacugaugcacuugcauuaggaaugaugguucugaaaauaguacggaacauggagaaauaucaauuagcugucacaauaauggccauacuuugcgugcccaaugccguuauauuacaaaacgcauggaaagugaguugcacaaucuuagcaguaguauccguaucuccauuguugcuaacaaguucccaacagaaaacagauuggaucccauuggcuuuaacaauaaaaggucuuucaccaacagcuauauuuuuaacaacauuaagcagaagcaauaagaagcgaucauggccauuaaacgaagcaauaauggcuguagguauggucucaauauuggcaucuagccuccuuaagaaugauauaccaaugaccggcccucucgucgcaggagguuuacuuacaguauguuacguucuaacaggaagaucagcugaccuugagcuagagagggcuaccgauguaaagugggaagaccaagcugaaauaagugguucaagcccaauauugucaauuacaauuucagaggacggguccaugagcauaaaaaaugaagaggaagagcaaacgcugacaauccucauaaggaccggucuauuaguuauaucaggacuuuuccccauuaguaucccgauaacagcugcggcuugguaucuuugggagguaaaaaaacagcgggcaggaguuuugugggauguaccgucaccgccccccauggggaaagcugaguuagaagauggcgcuuaucggauaaaacagaaagggauacuaggauacucgcaaauaggugcuggaguguacaaagaaggaacauuucacacuauguggcauguuacuagaggugcuguuuuaaugcauaaggggaaaagaauagagccaucaugggcagaugugaaaaaagaucucauaucauacggaggcgguuggaaacucgagggugaauggaaggaaggggaagaaguacaaguacuggcguuagaaccugguaaaaacccuagagccguucaaaccaaaccuggacuauucaaaacuaacacugguacaauaggugcaguguccuuagauuuuucuccgggaacaucaggcaguccaauaaucgacaaaaaaggaaaagucguaggucuguacggaaauggaguagugaccagaucaggagcauacgucucggcgaucgcacagacagaaaaaucaauagaggacaauccagaaauagaagaugacauauuuagaaaaagacgucuaacaauaauggaucuacauccuggcgcgggaaaaacaaaaagauaucugccagcgauaguuagagaagcaauaaaacguggucuuaggacauugauauuagcaccuacacgaguuguugcugcagaaauggaagaagcacucagagggcuaccaauccgauaccaaacaccagcaauucgagcugaacauacuggccgagaaauaguugacuuaaugugccaugcaacauucacaaugcgcuuauugagcccuguccgcguuccuaauuacaaccucauaauuauggaugaagcacacuuuacggacccagcaucaauagcugcuagaggauacauaucaacacguguugagaugggcgaagcggcaggaauauucaugacagcaacuccaccagguucacgugauccguuuccacaaucuaaugcgccaauaauagaugaagaacgggaaauaccugaaagaucguggaauucuggccacgaauggguaacggauuuuaagggaaaaacaguuugguuuguaccaaguauuaaggccgguaacgauauagcggcaugucuaagaaaaaauggaaaaaaaguaauacagcuuucccgaaaaacuuucgacucugaguauguaaaaacacgaacaaacgauugggauuucguaguaacuacagauauaagcgagaugggugcaaacuucaaagcagaacgaguaauagauccacgacgcuguaugaagccaguaauuuuaaccgacggggaagaacgagugauucucgcggggccaaugccaguuacacacucuucagcagcacaacgacguggaagaauaggccgcaacccaaaaaaugaaaaugaccaauauauauauaugggugaaccgcuagagaaugaugaggauugugcacacuggaaagaagcaaaaauguuacuagauaauaucaacacaccugaggguauuauaccaagcauguucgagcccgagcgugaaaaaguagaugcuauagauggggaguaccgacuucgaggggaagcccgcaaaacauuuguagaccuaaugcguaggggugaccugccaguauggcuugcuuacaaaguagccgccgaaggcauaaauuaugcugaucgacgguggugcuucgauggcaucaaaaauaaucaaauauuggaagaaaaugucgaaguugagauauggacuaaggaaggugaacgaaaaaagcuaaagcccagauggcuggaugcacguauuuauagcgauccucucgcguugaaggaauucaaagaauucgcagcaggacguaaaucauuaacuuuaaaucuuauaacggaaaugggcaggcuaccuacuuucaugacccaaaaaacgagggaugcacuugacaaccuagcuguguuacauacggcagaagcugguggaagagccuauaaccaugcacuaucagagcugccugaaacacuugaaacccugcuguuauugacguuacuggcgacaguuacaggaggaauuuucuuauuucuaauguccggccgugguauagguaaaaugacgcuuggaauguguuguauuauaaccgcgagcauucucuugugguaugcucaaauacaaccucauuggauugcugcaucaaucauucuggaguuuuuuuuaauagugcuguuaauaccggagccggaaaagcagcgaaccccucaggauaaccaacuaacauauguaguaaucgcaauucuaaccguuguggcagcaacaauggcaaaugaaauggguuucuuagaaaaaaccaaaaaggauuuagguuuaggaggaaucgcuacucaacaaccagaaucaaauauucuugacauugauuuacgaccugcgagugcauggacauuauaugcaguagcuacaacauuuguaacaccuaugcuucgacauucaauagagaacucaagugucaacguuucuuugacagcuauugccaaccaggcaacuguguuaaugggcuuaggaaaaggcuggccguuaucaaaaauggacaucggcgugccacuccuugcaauaggcuguuacucacagguaaauccuaucacucuaacggcugcuuuauuacuacucguugcucauuacgcaauaauugggccagguuuacaagccaaggcuacuagagaagcucaaaagcgagcagccgccggaauaaugaaaaauccuacaguugacggaauaaccgucaucgaucuagacccgauacccuaugacccgaaguuugagaaacaauugggacaagugauguuauuaaucuuauguguaacucaaguauuaaugaugagaacaaccugggcacuuugcgaggcauugacucucgcaacugggccuauaucuaccuuaugggaagguaacccagguagguucuggaauaccacuauagcgguuucaauggcaaacauuuucagagguaguuacuuggcaggugccggauuacuauuuagcauaaugaaaaacaccacuaacacacggcgggggacagguaacauaggagagacgcuuggagaaaaauggaaaucuagacucaacgcccugggcaagagugaauuccagaucuauaagaaaaguggaauucaggagguagauaggacauuagccaaggaaggaauaaaaagaggggaaacugaucaucacgcuguuuccagggguucugcaaaauuaagaugguuuguagaacgaaauauggugacgcccgaaggaaaggucguagacuuaggcugugggaggggaggcuggagcuacuacugugggggauuaaagaacgugagagagguaaagggcuugacaaaaggagguccuggacacgaagaacccauuccaaugucuacauaugguuggaaucuggugcgacuccaaucuggaguagaugucuucuuuauuccuccugaaaagugugacacacuucugugugauauuggggaaagcaguccaaauccaacaguagaagcgggccgcacacuucgcguccucaaccucguagagaacuggcugaauaacaauacacaauuuugcauuaaagugcuaaauccuuacaugccgucuguuauugaaaaaauggaagcauuacaacgcaaauacgguggugcacucguaagaaacccacuaagucgaaauucgacgcaugaaauguacuggguuucuaaugcuucaggaaauauaguaaguucggucaauaugauuucacgaauguuaauuaauagauuuacgaugagacacaaaaaagcaacuuacgaaccggacguugaucuaggaaguggcacaaggaacaucgguauagaaagcgagaaacccaaucuugacauuaucggcaaacggauagaaaaaauaaagcaggaacaugaaacuuccuggcacuaugaccaggaucaucccuauaagacaugggcauaucacgguaguuaugaaacuaaacaaacagguucagcuucuucaaugguaaaugggguugucagauuauugacuaagccaugggacgugcucccuacggugacgcagauggcaaugacugauacaacaccuuuuggacaacaacgagucuucaaggaaaaaguggacaccaggacccaagaaccaaaagaaggaacaaagaaacuaaugaaaauaaccgccgaaugguuauggaaagagcuugguaaaaaaaaaaccccuagaauguguacuagagaggaguuuacuaggaaaguacggucaaacgcugcacuaggagcgaucuucaccgacgaaaauaaauggaagagugcucgggaagcagucgaagauaguagguucugggaacucguagauaaggaacguaaccuucauuuggaaggaaaaugugaaacuugcguguauaauaugaugggaaagagagaaaaaaagcuuggggaauuugguaaggcaaaaggcucgcgggcgauaugguacaugugguugggcgcaagauuucuagaauuugaagcgcuuggcuucuugaacgaagaccauugguuuucaagagaaaacaguuuaucaggcguagaaggggaaggcuuacacaaauuaggauauauauuacgggauguuucuaagaaagaagggggagcuauguaugcagaugacaccgcugguugggacacucguauaacccuggaggauuuaaaaaacgaagaaaugguaacaaaccauauggaaggagaacauaaaaaauuagcagaggcgaucuuuaaauuaacauaccaaaacaaaguuguaagagugcaaagaccaacaccacgcggaacaguuauggauaucauuucaagacgcgaucaacgcggaucuggacaaguggggacguacgguuugaauacauuuacaaauauggaggcucaguuaauuagacagauggagggugaagguguauuuaaaaauauacaacacuugacuguaaccgaagagguagcggugcacaacuggcuugcucgagugggacgggaacgauugucacguauggcaaucuccggagacgacugcgugguuaaaccccuggaugauagauuugcuaacgcauuaacggcacuuaacgauaugggaaaaaucagaaaagacauucagcaaugggaaccaaguaaaggauggaaugacuggacucaaguuccauucuguagucaucauuuucaugaauuaauaaugaaagacggccguguucugguaguaccguguagaaaucaagaugaauuaaucgggagagccagaauaucccaaggcgcgggauggucgcucagggaaacggcaugucuugggaaaucguacgcacaaauguggagucuuauguauuuucaucguagagauuuaagacuggcagcgaacgcaauuuguagugcggugccuucccacuggguaccuacaucucguacaacauggucaauucaugcgaaacacgaauggaugacuacugaagacaugcucacaguauggaauagaguauggauaagagaaaauccauggauggaggauaaaacaccaguggaaaguugggaagaaauuccuuauuugggaaaaagagaggaccaauggugcggaagccuaauagggcuuacaucacgugcuacuugggcuaaaaacauacaagcagcaauaaaccaaguuaggucacuaauagggaacgaagaauacacugauuacaugccauccaugaagcgauuuaggcgggaggaagaagaagcaggaguacucugguaa

SEQ ID NO: 22676 - RNA, 9876 nt, Artificial Sequence
  derived and/or modified CDS sequence (opt6) from DENV-2__EU660414__SS-prME
ucugcuggaaugauaauaaugcuuauuccaacuguuauggcuuuucauuuaaccacaagaaacggagaaccgcacaugauuguaggaauacaagaaaaagguaaaaguuuacuauuuaaaacggaagacggaguaaacaugugcacucuaauggcgauggacuugggagaacuuugugaagauacgaucacuuacaaauguccguuacuucgacaaaacgaaccagaagauauagauuguugguguaauagcacgaguaccuggguaacguauggaacuuguacuacuacaggggaacaucguagagagaaacgaaguguugcauugguaccacauguagggauggguuuagaaacucguacugaaacuuggaugucaucagaaggcgcauggaaacaugcacaaagaauagaaaccuggguauugagacacccagguuuuacaauaauggcugcuauuuuagccuacacgaucgguacaacacauuuccaaagaguuuuaauauucauacuacuuacugcgguagcaccuucaaugaccaugagaugcaucgguauuaguaauagggauuucguagaaggagugaguggcggaaguuggguugauauaguacuugaacaugguuccugugucaccaccauggccaaaaauaaaccgacacuugacuucgaacuaauuaaaacggaagcgaaacaaccagcaacauuaagaaaauacugcauagaagccaaauugacgaauacuaccacggaaucucgcugcccuacacaaggagaacccucucuaaaagaagaacaagauaaaagauuuguuuguaaacacaguaugguugaccgagggugggguaaugguugcggccuguuuggaaaaggaggaauaguaacgugugcgauguuuacauguaagaaaaauauggaagguaaaauaguacaaccugaaaacuuagaauacacaauaguagucacaccccauucaggagaagaacaugcaguagggaacgauacaggcaaacacggucaggaaauaaaaguaacaccacagucaaguauaaccgaagcugaacuuacgggauauggaaccguuacuauggaauguuccccacgaacuggguuggauuuuaaugaaaugguucuuuugcaaauggaaaacaaagcauggcuuguucauaggcagugguuccuggaccuuccauuaccguggcugccgggugcggauaaacaagaaaguaauuggauacaaaaagaaacacugguaaccuuuaaaaacccucaugcaaagaaacaagaugugguuguuuuagguucgcaagaaggcgcgaugcacacagcuuuaacaggagcuacggagauacaaaugagcagugggaaucuucucuucacuggucaucuaaaauguagacuacgaauggacaaauuacaauuaaaaggcaugagcuauagcauguguacagguaaauucaaagugguuaaagaaauugcugagacacaacacgggacaauuguaauaagaguacaauacgaaggagacggaagucccuguaaaauucccuuugaaauuauggaucuagaaaaacgguauguucuagguagacugauaacugugaaccccauaguuacagaaaaagacucuccagugaauaucgaagcagagccuccauucggagacuccuauauuauuauuggcguugaaccuggccaauuaaaauuaaacugguucaagaaaggauccucuauuggacaaauguuugaaacuacaaugagaggagccaaaaggauggccauucuuggcgacacagccugggacuuuggcucacuuggaggugucuucacaaguauaggcaaagcauuacaccaaguauucggcgcgauuuacggagcugccuuuaguggcguuagcuggacgaugaaaauuuuaaucgggguuaucauaacauggauuggaaugaauagcaggucaaccaguuuaucagugagucuuguauuggucggaauaguuacucuauauuuaggagucaugguacaggcagauagcggguguguagugucguggaaaaauaaagaacucaaauguggaagugggauuuuuauuaccgauaauguucauacauggacggaacaguauaaauuucagccugaaucaccaucuaaacuagcuagugcaauacagaaagcccaagaggaagguauaugugguauaagguccgucacaagacuggaaaauuuaauguggaaacaaauaacuccggaacucaaccauauauuagccgaaaacgaggucaagcuaacgauuaugacaggagauauaaaaggaauuaugcaggcaggaaagaggagcuuacguccacaaccaacagaacuaaaauauucuuggaaaacauggggaaaagcaaaaaugcucucaacagaaucguauaaucagaccuuccugauugauggaccggagacugcugaaugcccuaauacaaacagggcuuggaacucgcuugaaguggaagauuacgguuucggcgucuuuacaaccaacauauggcuuaaacucaaggagaaacaagacgcauucugugacucaaaacuuaugagugcugcuauaaaggacaauagagccguccacgcugacauggguuauuggauagaaagcgcccucaaugacacuuggaaaauagagaaagcaaguuuuauugaaguuaaaaacugccacuggccaaagucccacacauuauggucuaacggcguacuggagucugagaugaucaucccaaagaauuuagccggaccagugucacaacacaacuaccgaccuggcuaucauacucaaauugcugguccauggcaucuugguaaacuagagauggauuuugauuuuugugauggcacaacagucaucguaacagaagauuguggaaauagaggucccagcuugaggacaacuaccgccagcgguaagcuaauuacugaaugguguugccgaagcuguacacuuccaccucuccgcuacagaggcgaagacggauguugguaugggauggagaucagaccuuuaaaagaaaaggaagaaaacuuagucaauagucuggucacugcuggucacggucaaguugacaauuuuucauuagguguuuuagguauggcguuguuucuggaggaaauguuaagaacacgaguuggcacuaaacaugcuauacucuuaguagccguuaguuuugucacucucauuacuggaaauauguccuuuaaggaccuggggcgggugguaguaauggugggagcuacuauggcagaugacaucggaauggguguaacauauuuggcauuacuagcugccuuuaagguaagaccgaccuuugcagcaggccuccugcuacgaaaacugacuuccaaggaacuuaugaugaccacgauuggaauaguauuacuuagucagucuaccauuccggagaccguacuagaacuuacagaugcucuagcacugggaaugaugguacuaaaaauuguaagaaauauggaaaaauaucaauuggcagugacgauuauggcaauacuuuguguaccaaaugcaguaauauugcaaaacgcguggaaaguaucauguaccauuuuagccguggugucaguaaguccucuucuacuaacuucuucacaacagaaaaccgacuggauaccuuuagcacuaacaaucaaggguuugaacccaaccgcaauauuuuuaacaacacuaucgagaaccaauaagaaacgaucguggccacuaaaugaagcaauuauggcaguuggaaugguaaguauucuugcuuccuccuuauuaaagaaugauauuccaaugaccgguccuuuaguagcaggaggucuuuuaacuguguguuacguacucacggguagaagcgccgaccucgaguuagaaagagcgacagaugucaagugggaagaccaagccgaaauuagcggaagcaguccgauacucuccauaacaauaucugaagacgggucaaugagcauaaagaaugaggaagaagaacaaacauuaaccauucuaauuaggacuggcuuauuaguaauuagcggccuguuuccgauaagcaucccaaucacugcggcggcuugguauuugugggaagugaagaaacaacgagcuggcguuuuaugggacgugccuaguccuccgccgaugggcaaggcagaauuggaagauggcgcuuauagaauaaaacagaaaggcauucucggguacagucaaauaggagcuggcguguauaaagaaggcacguuccacacaauguggcacguuacucgaggggcaguguugaugcauaaaggaaaacgaauugaaccgucuugggcggacgucaagaaagaucuuauuucauacgggggagguuggaaauuagagggcgaauggaaagagggugaagaaguacaaguucucgcccuagaaccagguaagaauccacgugcaguucaaacaaagccuggguuauucaaaacaaauaccgguaccauaggcgcuguaagccuggauuuuucuccggggacaucggggaguccaaucauagauaagaagggcaaggucguggguuuguacggaaacggagucgucacuagaucuggagcauaugucuccgcgaucgcucaaacagaaaaaucuauagaagauaauccugagauugaggaugacauuuuucgcaaacgaagacuaaccauaauggaccuucauccgggagccggaaaaacaaagcgguacuugccugcaauuguaagagaagcaauuaaaaggggucuuagaacgcucauuuuagcgccgaccagagucguugcggcugaaauggaggaagccuugcggggcuugcccauacguuaucagacaccagcaauacgugcagagcauacgggcagagaaauuguagaucucaugugccacgccaccuucaccaugcgacuuuuaucgccgguaagaguucccaauuauaauuuaauaauaauggaugaagcccauuuuaccgauccugcaucgauugccgcucgaggcuacauuucgacacgaguagaaaugggagaagcugcuggaauuuuuaugacagcaacaccuccuggaaaucgagauccauucccccaaucuaaugcaccuauaauagaugaggaacgugagauacccgaacguuccuggaacucuggucaugaauggguaaccgacuucaaagguaaaacuguuugguucguaccaucuauaaaggcagggaaugauauagcugccugcuuaaggaaaaauggcaagaaagugauacaacugucuagaaaaacguucgacucagaauauguuaagacacguauaaaugauugggacuuuguuguuaccacagauaucucugaaaugggagcaaauuucaaggcagaaagaguaauagacccucgaagauguaugaaaccugucaucuuaacagauggugaagaacguguuauacuagcagggcccaugccuguaacccacucuagcgcagcccagagacgaggcagaauagguaggaauccaaagaaugaaaaugaccaauauauuuacaugggcgaacccuuggaaaaugacgaagauugugcucauuggaaagaagcuaaaauguugcucgauaacauuaacaccccagaaggcaucaucccauccauguuugaaccagagagagaaaaaguagaugccauagauggcgaauauagauugagaggagaggcaagaaaaacauucguagaucuuaugcggaggggagaccugcccgugugguuggcauauaagguggcagcagaaggcauaaauuaugcagaccggcguugguguuucgauggaaucaagaauaaccagauuuuagaggagaauguggaaguugaaauuuggacuaaagaaggugagaggaagaaauuaaaaccaagauggcuugaugcacguauuuacucugacccguuagcucuaaaagaauuuaaagaguucgcugcaggaagaaaaagucugacccuuaaccuaauuacagaaauggggagacuaccgacuuuuaugacucagaaaacucgugaugcgcuagacaaccuagcagucuuacacacugcggaagcagggggcagagcauauaaucaugcacuaagugaacugcccgaaacccuagaaacauuauuacuucucacacuauuagcaacaguuacgggagguaucuuucuauuccugaugucuggaagagguauagggaaaaugacacuuggaaugugcuguauaauaacugcgucuauauuguugugguaugcccaaauacaaccacauuggauugcugccucuauaauacuagaauuuuuccugaucguacuucuaauccccgaaccagaaaaacaaagaacaccacaagauaaccaauuaacauacgugguaauagcaauucuaacgguugucgcagcaacuauggccaaugaaaugggguucuuagagaaaacgaagaaagaucuuggauuaggaucuauugccacucaacaaccggaaucgaauauacucgauauugauuuaagaccggcgucagcauggacguuauacgcgguagcuacaaccuuugucacccccaugcuaaggcacaguauugagaauaguucuguuaauguuagccucacggcaauagcgaaccaagccaccguuuuaauggggcuagguaaaggguggccuuuauccaaaauggacaucggugugccucuauuagcaauaggauguuauucgcaagugaauccuauaacccucaccgcggcguuauuacuucucgucgcacacuaugcgauaauagggccaggacuacaagcaaaagcaacucgcgaagcacagaaaagagcugcagcagguaucaugaaaaacccgacaguagaugguauaacaguuauugacuuagauccaauucccuaugacccuaaauuugaaaagcaacucggucaaguuauguuauugauuuuaugcguaacacaaguacuaaugaugcguacuacgugggcacuaugcgaggccuuaacacuggcuacaggaccaauuaguacccucugggagggaucaccagguagguuuuggaauacuaccaucgcuguaaguauggcgaacaucuuccguggaucauaucuugcaggagcuggacuauuauucagcauaaugaagaauacaaccaacacgaggagaggaacagguaauaugggagaaacacucggagaaaaauggaaaucuagauuaaaugcccuuggaaaaucugaauuucagauauauaagaaaucaggaauacaagaaguugauagaacauuagcaaaagaagggauuaagagaggggaaacugaucaucacgccguaucaagaggaagcgcgaaauuacgcugguuugucgaaaggaacauggugacuccagaaggaaaaguaguugaucuaggaugcgggagaggugguuggucauauuauugugggggccuaaagaaugucagagaaguuaaaggauuaacuaaaggugggccagggcaugaagaaccuauuccuaugucgaccuauggguggaauuuggugcgccugcaaucaggcguagacgucuucuuuauacccccugaaaaaugugauacacucuugugugauauuggggaaaguagccccaauccuacgguugaagccggcaggacucuucgaguccugaaucuggucgaaaacugguuaaauaauaauacacaauucuguauaaaaguacucaauccuuauaugccaagugucauagagaaaauggaagcauuacagagaaaauauggaggcgcauuagugagaaacccuuuaaguaggaacagcacucacgaaauguauugggugucgaaugcuuccggaaauauaguaucaagugugaauaugauaaguaggaugcuuauuaaccgauucacaaugcgccauaagaaagcaaccuaugaaccugauguugaucuaggaagcgguacuagaaauauaggaauugaauccgaaacgccgaacuuagauauaauagggaaacgaauugagaaaaucaaacaggaacaugaaacuuccuggcacuacgaccaagaucacccauauaagacuugggcauaucaugggaguuacgaaacuaagcaaacugggucggccuccaguaugguaaauggcguaguaagguugcuaacaaagcccugggaugugcuuccaacaguaacacagauggcuaugacugauacaacccccuuugggcaacaaagaguauuuaaggagaaaguagauacgcgaacgcaagaaccaaaagaagggacaaagaaacucaugaaaauuacagcugaauggcuauggaaagaacuuggcaaaaagaaaacuccgcguauguguacacgggaagaguucacaagaaaaguaaggucuaacgcagcauugggagcaauauuuacugacgagaauaaguggaaguccgcucgugaagccguagaagauagccgauuuugggaguuaguugacaaagagaggaacuugcaucuagaagggaaaugugaaacaugcguuuauaauaugauggggaaacgagagaagaaacuuggugaguuugguaaagccaaaggaagccgugccauaugguauauguggcucggugcacguuucuuagaauuugaagcucuaggcuuucuuaacgaggaucacugguuuagccgugaaaacucuuuaucgggaguugaaggggagggucuucauaaguuggguuacauccugagagauguaucaaagaaagaagggggcgccauguaugccgaugauaccgcugggugggacacaagaauaacacuagaagaccuaaagaacgaagaaaugguuacgaaccauauggaaggagagcauaagaaauuagcggaagcuauauuuaaacuaacauaucaaaauaaaguagucagaguccaacguccgacccccaggggaacggugauggauauuaucaguagaagagaccaaagaggaagcgggcaagucgggacauauggauuaaauacuuuuacgaauauggaagcacaauuaauaaggcaaauggaaggagaaggcguguuuaaaaacauucaacaucuuaccguaacagaagaaguagcggugcaaaauuggcuugcacgaguagggagggaaagguuaaguagaauggcaauaagcggagaugauugugugguaaaaccauuagaugauagguucgcaaacgccuuaacagcuuuaaacgauauggggaaaaucagaaaagauauucaacaaugggaaccaaguaaaggauggaacgacuggacgcaaguaccauuuuguagucaccauuuucacgaauugauaaugaaagauggaaggguuuugguagugccuugucgaaaucaagaugaauuaaucgggcgggcacguauuagccagggagccgguuggucacuucgggaaacggcauguuuagggaaauccuacgcacaaauguggucacuaauguauuuccaccgucgagaccuccgacuugcggcgaacgccauauguuccgcaguacccagucacuggguaccaacuucaagaacuacauggagcauccaugccaaacacgaauggaugacaaccgaggacaugcuuacuguuuggaaccgagucuggauucgagaaaacccauggauggaagauaaaacaccuguagaaagcugggaggaaaucccuuaucugggaaagagagaagaucaaugguguggaagccuaauaggacucacaagucgagcaacaugggccaaaaauauucagguugcaauuaaccaaguuagaagucuaauugguaacgaagaauacacugauuauaugccgagcaugaaacgauuucgucgcgaagaagaagaggcaggaguacuuugguga

SEQ ID NO: 22677 - RNA, 9876 nt, Artificial Sequence
  derived and/or modified CDS sequence (opt6) from DENV-2__EU660415__SS-prME
ucagcaggaaugaucauaaugcuuauaccaaccgucauggcuuuccaucuaacaacuagaaacggcgaaccucacaugaucgugggaauacaagaaaagggaaaaagucuacuuuuuaaaacagaggacggaguuaacauguguacucuuauggccauggaccuaggggaacuuugugaggacacuauaacauacaaauguccacuccuccgacaaaaugagccugaagauaucgauuguugguguaauucaacuucaacuuggguaacguaugguacuugcacaacgacaggggaacacagacgggaaaaaaggucugucgcacucguaccccauguaggaaugggauuagaaacaagaacagagaccuggaugagcagugagggcgcguggaagcaugcucagagaauagaaacauggauccuuaggcauccaggauucacgauaauggccgcgauuuuagcauacacaauuggcacgacacauuuccaaagaguauuaauauuuauccuccuuacugcuguugcaccaucaaugaccaugaggugcauugggauuucgaacagagauuuuguagaaggcguauccggaggcaguuggguugauauaguccuagagcaugguucuugcguaaccacuauggcaaaaaauaaaccuacuuuagacuuugaacuuauaaaaacggaggcuaaacaaccagcgacacugagaaaauacugcauagaggccaaacuaacaaacacuacaacggagucacgauguccgacacagggggaaccaagccuaaaggaagaacaagauaagagauuugucuguaaacauaguauggucgacagaggcuggggaaauggcugugguuuguuuggcaaaggagguauugugacaugugcgauguuuacguguaaaaagaacauggaaggaaaaauuguccaacccgaaaaucuagaguacacaauuguaguaacgccacacuccggagaagagcacgcuguuggcaacgauacggguaaacacggcaaagaaauaaaagugacuccacagucaucaaucacugaagcagaauugacuggguauggaaccguaacgauggaauguagcccaagaacaggacuugacuuuaaugaaauggucuuguuacaaauggaaaauaaagcaugguuaguacauagacaaugguuucuagaucugccuuugccauggcugccaggugccgacaaacaggaaaguaacuggauacaaaaagaaacgcucgucacuuucaaaaacccucaugcaaaaaaacaagaugucgugguacuaggaucacaggaaggggcaaugcauacggcucuuacuggagcaaccgagauacagaugagcaguggcaaucuguuauucacuggucauuuaaaaugucgucuaagaauggacaaguuacaacuuaaggggaugucauauucaauguguacugggaaauuuaaaguaguaaaagaaauagcagaaacucaacauggcacaauugugauaagaguccaauaugaaggggacgguucgccuugcaaaauacccuucgaaauaauggacuuagaaaaacgauaugucuuagguagguuaauaaccguuaauccaaucguaacagaaaaagauuccccaguaaauauagaagcggaaccaccguucggugauaguuauauuauuauaggagugggaccaggacaauugaagcucaacugguucaaaaaagggagcaguauuggacagauguucgaaaccacgaugagaggggcuaaaagaauggcaauccugggugacacugcaugggauuuugguagccuaggcgguguauuuacaaguauagggaaggcguuacaucaaguauuuggagcaaucuacggugccgccuucucuggugugucauggaccaugaagauauugauaggcgucauuauuacauggauagggaugaacucucgcucuacaucucuaaguguaagccuaguucucguagguauagugacauuauaccuagguguaaugguccaggccgauaguggaugcgucguaucuuggaagaauaaagagcuaaaauguggcucaggaaucuuuauaacagacaacgugcauacuuggacagagcaauauaaauuccaacccgagucaccaagcaaauuagcuuccgcuauacaaaaggcacaagaagaaggaauuugcggaauaagaucugucacaagacuggagaauuuaauguggaaacaaauaacaccugaauuaaaucauauccuagcagaaaaugaggucaaauugacgauuaugacuggugauauuaaaggcauaaugcaggcaggcaaaagaagcuuacgaccgcaacccacagaacuaaaauacagcuggaaaaccugggggaaggcuaaaaugcuuuccaccgaaaguuacaaucaaacauuucucaucgaugggccugaaacagcugagugccccaauacaaacagagcauggaauuccuuagaaguagaagacuacggauuuggaguuuuuacuacuaacaucuggcuaaaacuaaaagaaaaacaagaugcuuuuugcgacucaaaauuaaugagcgcugcuauaaaagacaauagagcaguucacgcugauaugggcuauuggauagaaucggcacuaaaugacacauggaagauugaaaaagcgucguuuauugaaguaaagaacugucauuggcccaaaagccacacgcuauggagcaauggagucuuagaaagugagaugauaauaccaaaaaauuuagcggguccaguaucucaacauaauuauaggcuaggauaccacacgcaaauugcgggaccauggcauuuaggcaaauuagagauggauuucgauuuuugcgauggcacaacugucaucgugaccgaagauuguggaaacagaggaccuucacuaagaacaacaacugcgagugggaaacugauuacagaauggugcuguaggucauguacacucccgccacucagauauagaggcgaagaugguuguugguaugggauggaaauuagaccacugaaagagaaagaagaaaauuuaguaaacucccucguaacagcuggacauggccagguugacaacuuuucuuuagguguucuagguauggcauuauuccuagaagaaaugcuaaggacacgaguuggaaccaaacaugccauacuguugguugccgucaguuuugucacacuaauuacugggaauaugaguuuuaaggaucugggccgagugguagucaugguaggugcaacuauggcagaugauaucgggaugggagugaccuacuuagcucuauuagccgcguucaaagugagacccaccuucgcagcaggcuuauuacucaggaaauuaacaucaaaggaauuaaugaugacaaccauaggcauaguacuccuaagccaaucuacaauuccagagacgguauuagaguuaacugaugcauuagcucuaggaaugaugguauuaaaaauaguacgaaauauggaaaaauaccaacuagcaguuaccauaauggcaauacuauguguaccaaaugcgguaauuuuacaaaaugccuggaaaguaagcugcacgauuuuggccgugguaagugucucuccacuucuucuaacguccagucagcaaaaaacagauuggauuccccuggcauuaacuaucaaaggacuuaauccaacagcaauuuuuuuaacuacucuuucgcgcacaaauaaaaaaagaucauggccccucaacgaagcaaucauggccguuggaauggugaguauacuagccuccagccuucuaaaaaacgauauaccaaugacugguccguuaguagcuggcggacuuuuaacgguauguuauguccuuacaggacggagcgcggauuuagaacuugaaagggcaacagacguuaaaugggaggaucaagcagagauaaguggcuccucgccgaucuuguccaucacuauaucagaagauggaucaaugucaauaaagaaugaagaagaagaacaaacacuaacgauauuaaucagaacaggacuuuuaguuauaagcggauuguuuccaauaaguaucccuauuaccgcggccgcuugguaucuaugggaaguaaaaaagcagcgggcagggguacucugggacguaccuagcccgccuccaaugggcaaggccgaacuagaggacggggcauacagaauaaaacaaaaagggauucuaggguauagccaaauaggugcagguguuuauaaagaagggacauuucacacgauguggcauguaacccgaggcgcuguauuaaugcauaaagguaagcgcauugaaccuuccugggcagauguaaaaaaagauuugauaucuuauggaggaggguggaaguuagaaggcgaauggaaggaaggagaagaagugcaaguacuggcccuagaaccggguaaaaacccccgugccguccaaaccaaaccaggucuuuucaaaacuaauacaggaacaauuggggcgguguccuuggacuucagcccagguacaucuggcagcccgauaaucgauaagaaggggaaagucguaggucucuauggaaacggggucgucacuagaucuggugcuuauguuucugcgauugcccaaacggagaaggguauugaagauaacccagaaauagaggaugauaucuuucgaaaaagacguuuaacuauuauggauuuacauccgggggccggaaaaaccaaaagguacuugccagcgauagugcgggaagcuauaaaaagaggacuacgcacuuuaauauuggcccccacacggguuguagcugcggaaauggaagaagcacuaaggggcuuaccuauaagauaccaaacgcccgcgauuagagcagagcauacaggaagagaaauagucgaucucaugugccaugcuacguucacgaugaggcuacuauccccuguacguguaccuaacuacaacuuaauuaucauggaugaggcucauuucacagauccugcaucuauagcugcgcguggauauauuucuacaagaguugaaaugggagaagcugcagggauauucaugacagcaacaccuccggggagccgagauccuuucccacaaaguaaugccccuauaaucgaugaagaaagagagauuccggagagaucuuggaauucugggcaugaaugggucacagauuuuaaaggcaagacuguuugguucguaccuaguauuaaagccggcaaugauauagccgcgugcuuaaggaagaacggaaaaaaagucauacaacuaucgcguaaaacauuugacuccgaauacguuaaaacaagaacuaacgacugggauuuugucguaacaacugacauuucugagaugggggcaaauuuuaaagcagaaagaguaauugauccacgccgauguaugaaaccagucaucuuaacggauggagaagagagaguaauccuagccgguccgaugccuguaacccacaguagugcagcccaaagaagagguaggauaggucguaauccuaaaaaugaaaaugaccaauacauauacaugggagaacccuuggaaaacgaugaagauugcgcucacuggaaagaggcuaaaaugcuucuagacaacauaaauaccccggaagguaucauuccuucaauguucgaaccagagcgcgaaaaaguggaugcaauagauggcgaguaucgguugagaggugaagcaagaaaaacuuuuguagacuuaaugcguagaggugaccuaccagugugguuagcguauaaaguugcggcggaaggcauaaauuaugcggaucggcgaugguguuuugaugggauaaaaaauaaccaaauucuagaagaaaauguugaaguggaaauuuggacaaaggaaggagagaggaaaaaguugaaaccuagauggcuggaugcaaggauauacagugauccacucgcgcucaaagaguuuaaagaauuugcagcaggaagaaaaaguuugacauugaacuuaauaacggaaauggggcgucuccccacuuuuaugacucaaaaaacccgugaugccuuggauaauuuggcaguccuacacacagcagaagccggugguagggcauauaaucaugcacucagugaauuaccagagacccuugaaacucuacuauuacuaacguuacuugcuaccguuacuggagggauauucuuauuccuuaugucuggacguggcauaggaaagaugacgcuuggaauguguuguauaauuacugcgagcaucuuguuaugguacgcacaaauacaaccucacuggauagcugcguccauaauccuagaauuuuuucuaauaguauuauugauucccgaaccugaaaagcaaaggacuccacaggacaaccaauuaaccuauguuguaauagccauccuaacagugguugccgcaacuauggccaacgaaaugggauucuuagaaaaaaccaaaaaagauuuuggcuuaggaucuaucgcgacgcaacaaccagaaaguaauauauuagauauagaccuacgcccagcauccgcauggacucuauaugcaguagccaccacauuugucacgccaaugcuacgucacucaauagaaaauucaucgguaaauguuagucuaacggccauagcuaaccaagcuaccguauugaugggacuaggcaaaggcuggcccuuaaguaaaauggacauaggagucccacuauuggcaauaggguguuauagccaagucaacccaauaacacucacggcugcauuacuccuauuaguggcacauuacgcaauuaucggaccaggucuucaagcaaaagcgacaagggaagcacaaaaaagggcagcagcuggaauuaugaagaacccaacuguugaugguauaacagugauagaccuagacccgauaccuuacgauccaaaguucgaaaaacaacuaggucaagucaugcuacuuauuuuauguguaacacaggucuuaaugaugagaacaacaugggcucuuugcgaagcacuaacuuuagcuacugggccgauuucgacacuuugggagggcaauccuggacgauuuuggaauacuacuauagcaguuagcauggcaaacaucuuccgaggcagcuaccuagccggggcaggccuguuauuuagcauuaugaaaaacacaacgaacacacggaggggaaccgguaacaucggcgagacgcucggggagaaauggaaaucaagacuaaaugcucuggguaaaucagaauuccaaauuuauaaaaagagcggaauccaagaaguugacagaacauuagcuaaagaagguauaaaaagaggagaaaccgaucaccaugccgugucuagaggaucagccaaguugagaugguucguugaaagaaacaugguuacaccggaggguaaaguuguggacuuagguuguggcagaggcgguuggagcuacuacuguggagguuugaaaaacguucgagaagugaaaggccugacaaaaggugguccuggacacgaggaaccaauaccgaugagcacauauggcuggaacuuggucagauuacaaagcggcguagacguauucuuuaucccaccugaaaagugcgauacguuauuaugcgauauaggugaaagcucgccaaacccuacaguugaagcuggaagaacguuacgcguucucaaucuuguggaaaauugguuaaauaacaauacgcaguuuuguauuaaagugcucaacccuuauaugccaagcguaauagaaaaaauggaggcucuacaaaggaaauauggaggagcucugguaaggaacccucuaucaagaaacaguacacacgagauguacugggucucgaacgcuuccggaaauaucguuucaagugucaacaugauuucgagaaugcuuauaaauagauuuacgaugcggcacaagaaagcuacauacgaaccugacguagacuuaggaaguggaacccgcaacauagguauagaaucugaaaucccaaaccuagacauuauaggaaaacgaaucgagaaaauuaaacaggaacacgaaacgucauggcauuacgaccaagaucacccauauaaaacuugggccuaccauggaagcuaugaaacaaaacaaacagggagugcaaguucuaugguuaacggaguaguucgauuacuaacgaaaccgugggacguuuuacccacagucacacaaauggcaaugaccgauacaacuccuuuuggacaacaacgaguauucaaagagaaaguagacacuaggacacaagaaccuaaggaggguacgaagaaacugaugaaaauaacugcagaauggcuauggaaagaacuaggcaaaaagaaaacuccgcgcaugugcacuagagaagaguuuacuaggaaaguaaggucaaacgcagcgcucggugcaauauuuacugaugagaauaaguggaaauccgcucgcgaagcaguagaagacucaagauuuugggaauuaguggauaaagaacguaauuuacaccuagagggaaaaugcgagaccuguguauauaacaugaugggaaaaagagaaaaaaaauuaggcgaauuuggaaaagccaaaggaucacgcgcuauaugguauauguggcucggagcuagauuccucgaauuugaagcuuuaggcuuucucaacgaagaccauugguucagucgagaaaacucccuaucaggaguagaaggugaagguuuacacaaauuaggauauauacuuagagacgugagcaaaaaagaaggaggggcuauguacgccgacgacacugcgggcugggauacaagaauaacauuagaagaccucaaaaaugaagagaugguaacgaaucacauggaaggcgagcauaaaaaacuugccgaagccauauuuaagcuaacauaucagaacaaaguuguuagagugcaaaggccaacgccucggggcacugucauggauauaauuucucgaagagaccaaagggguucugggcaaguaggaacauacggacuaaauacauuuacuaauauggaggcgcaauugauacggcaaauggagggcgagggagucuuuaaaaauauucaacaucugacugucaccgaagaggucgcagugcaaaauugguuagcgagaguuggucgugagagauuaagucgaauggccauaucgggggacgauugcguuguuaagccucuggaugaucgauucgcaaacgcguuaacugccuuaaacgauauggguaaaauccgaaaagacauacaacagugggagccaaguaagggguggaacgacuggacucaagugccauucugcagccaucacuuucaugagcuaaucaugaaggacggcagaguauuaguaguuccaugcagaaaccaagacgaacugauagggcgagcucgaauaucucaaggagcuggguggucacuucgcgaaacugcuugcuuagguaaguccuaugcccaaauguggucucuaauguacuuccaccgccgugacuuacgacuagcugcaaaugucauuugcucugcaguucccucucauuggguaccaacuaguagaacuacauggagcauacacgcaaaacacgaauggaugaccaccgaagacaugcuaacugucuggaaucgcguuuggauaagagaaaaccccuggauggaggauaaaacuccuguagaaagcugggaagaaaucccuuauuuggguaaaagagaggaucagugguguggaucucuaauaggccucacgucaagagcaacgugggcaaaaaauauacaagccgccaucaaccaagucaggucuuugaucgguaaugaggaguacaccgacuauaugccaagcaugaaaagguuccgucgugaagaagaagaagcagguguccuuugguga

SEQ ID NO: 22678 - RNA, 9876 nt, Artificial Sequence
  derived and/or modified CDS sequence (opt6) from DENV-2__EU687249__SS-prME
agugcagggaugauuaucaugcuaauuccgacuguuauggcauuucacuuaacaacuagaaacggggaaccacacaugauaguugguauccaagaaaaaggcaaaucacuuuuguuuaaaacagaagacgguguuaacauguguacacucauggccauggaucuaggggaauugugugaagacacuaucacauauaaaugcccucuauuacgacagaaugaaccagaagauauugauugcugguguaauucgacaucaacuuggguaacguauggaacaugcaccacaacgggggaacauagaagagagaaaagguccguggcuuugguuccgcauguaggcaugggcuuagaaacaaggaccgaaacauggaugaguucagaaggugcuuggaaacaugcucagagaauagaaacuuggaucuuacgacacccgggcuucacuauuauggcagccauacuggcuuacacaauagguacaacgcacuuucaaagagugcuaauuuuuaucuuguuaacagcaguugcacccaguaugacuaugagauguauaggaaucagcaaucgagacuucguagaaggaguaagcggagggucauggguugauaucgugcuagaacaugguucauguguaacgacuauggcuaaaaauaaaccuacgcuagauuuugaauuaauaaaaaccgaagcaaaacagccggcaacccugaggaaauauuguauugaagcuaaacugaccaauacaacaacagaaagccggugucccacacaaggcgaaccaucucuuaaagaagaacaggacaaacgcuucguauguaaacauaguaugguagaccgaggaugggguaacgguugcggcuuguucggcaaaggaggaauaguuacuugugcaauguuuacaugcaagaaaaacauggaagguaaaauuguacaaccagagaauuuagaguauaccauagucguaacaccucacaguggagaggaacaugcaguagguaacgacacgggaaaacacggcaaagaaauaaaaguuaccccacaaagcuccauuacggaggccgaacugaccggguaugggacaguaacuauggaguguuccccucguacaggccuugauuucaaugagaugguccugcuucaaauggaaaacaaagccugguuaguccacagacaaugguuccuugacuuaccacuuccgugguuaccaggugcagacaaacaagaauccaauuggauucagaaagaaaccuuaguaacauucaaaaauccccaugcgaagaaacaggaugucgucguacuuggcucccaggaaggagcaaugcauacugcccuuacaggagcgaccgagauacagaugucuucgggaaaccuccucuucacaggucacuuaaaaugcagauuaagaauggacaaacuacaguuaaaaggaaugagcuacagcauguguacaggaaaauuuaaaguuguaaaagaaauagccgaaacucaacauggaacaauaguaauucggguccaauacgagggugauggaaguccguguaaaauaccauuugaaauuauggaucuagagaaaagauauauauuagggagacuaauuacagugaaucccauaguuaccgaaaaagacucgccaguuaacauagaggccgaacccccauuuggagacucuuauaucauuauuggcguagaaccgggacaacuuaaauugaauugguuuaaaaaggggaguucaauaggacaaauguuugagacgacaaugcgaggagcgaaaaggauggcuauauuaggcgacacugccugggacuuuggcucucucgguggcguauuuacaagcauaggaaaggcuuugcaucaggucuuuggggcuauauacggagcagcuuucaguggaguaucauggacgaugaaaauauugaucggagucaucauuacuuggauagguaugaauagcagaaguacuucacuaagcguaagucuaguucuaguuggaauugucacgcuguaccuaggcguaaugguacaagcagauucaggcugugucguaaguuggaagaauaaagaguugaaaugcgggagugguauauucauaaccgacaacguccacacguggacagaacaguauaaauuucagccagagaguccauccaaacuugcgagcgcaauacaaaaggcaagggaggaaggaauaugcgggauucgcucuguaacuagguuagaaaauuuaauguggaaacagauaacuccagaauuaaaucacaucuuagcugaaaaugaaguaaaacuaacgauuaugacgggcgauauaaaagguauaaugcaagcuggaaaaaggagccugcgaccucaaccaacagaauugaaauauuccuggaagacaugggguaaagccaaaaugcuaagcaccgaaucauauaaccaaacguuuuuaauagauggaccugaaacugcggaguguccaaauacuaaucgagcauggaacucccuagaaguugaagacuaugguuucggcguuuucacaacaaacauauggcuuaaacuaaaagaaaagcaagaugcauucugugacagcaaauuaaugagugccgccauaaaagacaacagagcaguucaugccgacaugggauauuggauagaaucagcguuaaaugauacauggaaaauagaaaaagcaucguucauagaagucaaaaacugucauuggccuaaaagccacacccuguggucaaacggaguauuagaaucagaaaugaucauucccaaaaaucuagcagggccaguuucacaacauaauuaccgccccggauaccacacgcaaauagcuggaccuuggcauuugggaaaauuggaaauggacuucgauuuuugcgacggcaccaccguuauuguuaccgaagauugcggaaacagggguccaucucuacguacgaccacggcaagugggaaguugauuacggaauggugcugcagaagcugcacacuaccaccauugcguuauagaggagaagacgggugcugguacggcauggaaauuagaccacuaaaggaaaaagaagagaaccucgugaacucauuaguuaccgcuggacacggacagguugacaauuuuucguuggguguauuagguauggcccuauuuuuagaagaaaugcugcguacaaggguaggcacuaagcaugcaauacugcugguagcuguaucauuuaugaccuugauaaccgguaauaugaguuuuaaagaucuaggucgaguagugguuaugguaggagccacgauggcagacgauauaggaaugggcguaacguauuuggcacuuuuagcggcuuucaaaguaagaccgacuuucgccgcugguuuauuauuaagaaagcucacuagcaaagaacuuaugaugacuacuauuggcauaguauuauuaucccaauccacaauaccggagacgguuuuagaauuaacagaugcucucgcauuagguaugauggucuuaaagauuguaaggaacauggaaaaauaccaguuagcaguuaccauaauggcgaucuuauguguuccaaacgcuguaauacuucagaaugcuuggaaggucucauguacaauacuagcagucguaucgguuucaccuuuauuacugaccucuucacaacagaagacagacuggauuccgcuugcccugacaaucaagggauuaaauccaacagcaauauuccuaacaaccuuaaguagaacuaacaaaaagagaucguggccacuaaaugaagccauuauggcagucggaaugguaucuauauuagcaucaucucuccuuaaaaacgacauuccgaugacaggaccauugguagcuggagggcuccuaacaguuuguuauguacuaacaggcaggagcgcggauuuagaacucgaacgugcgacugacguaaaaugggaggaccaagcggagauaaguggaagcucgccgauacucuccauaacaauuuccgaggauggcucuaugaguauuaaaaaugaagaggaagaacaaacauugacuauacuaauccgaacaggucuccuagugaucagcggacuguuuccaauaucaauccccauaacggccgcugccugguaucugugggaagucaaaaagcaaagagcuggaguguugugggacguaccgagcccgccuccaauggggaaggcugaacuugaagauggagcauauagaauuaaacaaaaaggaauauuaggauauucucagauaggcgccgguguuuacaaagaagggacguuucauacaauguggcacgugacaagaggagcagugcugaugcauaaaggaaaacggauugagccaucaugggccgacguaaagaaagacuuaaucuccuauggaggaggauggaaauuagaaggugaauggaaagaaggggaagaaguccagguauuagcccuagaaccugguaaaaaccccagagcuguccagacaaaaccuggacuauuuaaaacaaacacgggcacaauuggggcagugucacuugacuucagccccggaacgucugggucccccauuauagauaagaaaggaaaaguagucggguuauacggcaacggaguaguaacgagaucuggugccuauguuagugcgauagcucaaaccgagaaaaguauugaggauaauccugaaauugaagaugauauauucagaaaaaggcgcuuaacaauaauggaucuccauccgggcgcggguaaaaccaaacgauauuuaccugcaaucgugagagaagccaucaaaagaggucugaggacucuaauccuagccccaacucgaguuguggcugcagagauggaagaagcucuaagaggguuaccgauucgguaucagacaccggcaauuagggcggaacacacugggcgagaaauuguugaccugaugugucaugcaacuuuuacgaugagauuacuaagccccguacgcgugccaaauuauaaccuaauuauaauggaugaggcacacuucacggacccugcaucaauagcagcacgaggcuauauuucaacaagaguggaaaugggagaggcggcugguauuuuuaugacagcaaccccucccgguucaagggauccauuuccacaaucgaaugcuccgauaauagaugaagaacgggaaauuccagagcgcucauggaacucagggcacgaaugggucacugacuucaaagguaagaccguuugguuuguaccuagcauuaaagcuggaaaugauaucgcagccugucuucgcaaaaauggaaagaaaguaauacaacuaucaagaaaaacuuucgacagugaauauguaaagacaaggacuaacgauugggauuucguaguaacuacggacauaucagaaaugggagcaaauuuuaaagccgaacgggucauugaccccagacgauguaugaaaccaguaauacuuacugacggggaagagagggugauccucgcaggucccaugccaguaacacauaguucagccgcgcaacgaagagguaggaucggacgaaacccuaaaaaugaaaacgaccaauacaucuauaugggagaaccacucgaaaaugacgaagacugcgcacauuggaaagaagcuaaaauguuacuagacaauaucaacacaccagaaggaauaauaccuaguauguuugaaccagaaagagaaaaaguggacgccauugauggggaauauagacuacgaggugaagcacgaaagacauuuguggauuuaaugagacggggagaccuaccaguauggcuagcuuauaaagucgcagcagaaggaauuaauuacgcugaccguaggugguguuucgaugguauuaagaauaaccaaauacucgaagaaaacguagaagucgaaaucuggacgaaagaaggcgaaaggaagaaauugaaaccucguuggcuugaugcgcgcauauauagugauccauuagcuuuaaaagaauuuaaagaauuugcagcagggagaaaaagucuaacgcugaauuugauaacugaaaugggacggcuaccgacguuuaugacgcagaaaacucgagacgcguuggauaaucuggcagucuuacacacugcugaagcaggaggcagggcauauaaucacgcuuuauccgaacuacccgagacgcuagaaacguuacuccuacugacacuacuugccacgguaacaggaggcauauuccuguuccuaaugagcggaaggggcauaggaaaaaugacauuaggaaugugcuguauuaucacggccagcauccuccugugguaugcgcaaauucaaccccauuggauugcugcaucuauuauacucgaguucuucuuaauagugcuacugauaccagagcccgaaaaacagcgaacaccacaagauaaucaauuaacuuacguugucauagcaauacuaacugugguagccgccacaauggcgaaugaaauggguuuccuagaaaagacaaagaaagaucuuggauuagggucaaucgccacacaacagcccgaaucuaauauccuagauauagauuuaagaccagcaucugcauggacguuauaugcggucgcaacuacauucgucacaccgauguuaagacauucgauagagaacucuagcguuaauguaagucugacugcaauagcaaaucaagccacaguuuuaaugggacuagggaaaggguggccauugucgaagauggacauaggcguuccuuuacuagccauuggaugcuacagucaaguuaauccgauuacguuaacugcugcgcuauugcuuuuaguagcccacuacgcaauaauugguccgggucuccaagcuaaggcgacuagagaggcucaaaagcgagcagcagcaggaauaaugaaaaauccaacugucgacgguaucacuguaauagaucucgauccaauaccauaugauccuaaauucgaaaagcaauuagggcaaguaaugcuauugauccuuugugucacccagguacugaugaugagaaccacuugggcgcucugcgaagcucuuacucuugcaacaggaccaauuaguacucucugggaggggaacccagggagauucuggaacacaacuaucgcggugaguauggccaacauauuuagagguaguuaucuggccggugccggccuccuguucucuauaaugaaaaacacaacaaacacacguagagguacuggaaacauaggagaaaccuugggugaaaaauggaaaucaagguugaacgcauugggaaagucggaguuccaaauauacaagaaaagcggaauacaagaagucgauagaacacuagcuaaagagggaaucaaacgaggcgaaacggaccaucaugcuguaucacgggguucugcaaaacugcguugguuuguagaaagaaacaugguuacacccgaaggacgugugguagaccuugggugcggaagggguggauggucuuauuauugcggaggccuuaaaaacgugagggagguaaagggauuaacaaaagggggacccggacacgaggagcccauacccaugaguaccuauggauggaaucucguaagacuccaaucgggaguagauguauuuuucauaccgcccgagaaaugcgacacauuacuuugcgauauaggggaaaguagucccaacccaacgguugaggcugggagaacauuaagaguacuaaaucuaguggaaaauugguuaaacaauaauacgcaauuuuguauaaaagucuuaaacccuuauaugccgucaguaauagaaaagauggaagcucuccagcguaaguaugggggagcauuaguucgaaauccucugucgagaaacaguacucaugagauguacuggguaucaaaugccaguggaaauauuguaucaucaguaaauaugauaaguagaauguuaaucaaucgcuucaccaugagacacaagaaagcaacauaugaaccagacguugacuuaggauccgggacuagaaauauagguaucgaaagugaagucccaaauuuggauauaaucggcaaaagaauugaaaagaucaagcaagaacacgaaacgaguuggcauuacgaucaggaucacccauauaagacuugggcauaccaugguucuuaugaaacaaaacagaccggaucagccucaucuaugguaaaugguguaguacgacuauuaaccaagccaugggauguacucccgacggucacucaaauggccaugacugauaccacuccauuuggacagcaaagggucuucaaagaaaaaguagauacaagaacucaagagccaaaagaaggcacuaagaaauugaugaaaaucaccgcagaaugguuauggaaagagcuaggcaaaaagaaaacccccagaauguguacuagagaggaauuuacgcgcaaagucagaucgaacgcagcacucggagcaauauucacugaugaaaacaaauggaaaucugcccgagaagcuguagaagacuccagauucugggaauuaguggauaaggaaaggaauuugcaccucgagggcaaaugugaaacuugugucuauaauaugauggguaagcgugagaagaaacuaggagaguucgguaaagcaaaaggcuccagagcaauuugguacauguggcuaggugcucgguuuuuagaauuugaggcuuugggauucuuaaaugaagaccacugguuuagcagagaaaauaguuugucagguguagagggugagggacuacauaagcucggcuacauucucagagauguaaguaagaaagaaggaggggcgauguaugcggaugacacagcaggaugggauacaagaauaacacuagaggacuugaaaaaugaagaaauggugacaaaucacauggaaggcgagcauaagaaacucgcagaagcuaucuuuaaacuaacauaccaaaauaaaguaguccgugugcagcgacccaccccucgagggacagucauggauaucauaucccgcagagaucaacgagggucaggucagguaggaacauauggacuaaacacauuuacaaauauggaagcucaacuaauaaggcaaauggagggagaaggaguguucaaaaacauacaacaccucacugugacagaagaaguagccguacaaaacuggcuggcgcgcgugggucgagaacguuuaucacgaauggcuauaagcggagaugacugcguaguuaaaccuuuggaugacagauuugcuaaugcccuaaccgccuuaaacgauaugggcaaaauaaggaaagauauacaacagugggagccuagcaaaggcuggucagauuggacacagguaccuuucuguagccaucacuuccacgaacuaauaaugaaagacggaaggguucuugucguacccugucgcaaucaggaugaguugauagggagagcaaggauuucacagggcgcugguuggucucugagagaaaccgcaugcuugggcaaaaguuacgcucaaauguggucucuaauguauuuucaccgucgagaucugcgucuugcagccaaugcaauaugcagugcaguaccaucgcauuggguaccuacaucacgaacuaccugguccauacaugccaagcacgaauggaugacuacagaagauaugcuuacagucuggaacagggucuggaucagggagaacccauggauggaagauaaaacaccaguugaaagcugggaggaaauuccguaccuggguaaacgagaagaucaaugguguggaucauuaaucgguuuaacaaguagagccacaugggcaaagaacauccaggcagcaaucaaccaagugcgcagucuaauaggaaaugaagaauacacagacuacaugccuagcaugaaacgcuuuaggagggaagaggaggaagcuggaguccuaugguaa

SEQ ID NO: 22679 - RNA, 9876 nt, Artificial Sequence
  derived and/or modified CDS sequence (opt6) from DENV-2__EU660416__SS-prME
ucugcagguaugauaauaaugcuaauacccacaguuauggcuuuccaccugacuacgagaaauggagaaccucacaugauuguagguauacaagaaaaaggaaaaagucuauuauuuaaaaccgaagacggaguaaacauguguacauuaauggcgauggaucuuggggaacugugugaagauacuauuacauacaaauguccucugcugcgacaaaaugaaccagaagacauagauuguugguguaauaguacaagcacauggguaaccuacggaacauguacuacgacaggggaacacagaagagagaaacgaucgguagcucuagugccacacguagggaugggacuugaaacaagaacugaaacguggaugucaagugaaggagcauggaaacaugcacaacgaauagaaacauggauauuaaggcacccgggauuuacuauaauggcagcuauauuggcauauacaauaggaacuacacauuuucaacgugugcuaauauucauacuguuaacugcaguagcaccaucaaugacaaugagguguauaggcauuucaaaucgagauuucguugaaggugucucuggcggcaguugggucgacaucguucuagaacacgggucaugcguaacuacaauggcuaaaaacaaaccuacauuggacuuugaacuaauaaaaacugaggcaaaacaacccgcuacauugagaaaauauuguauagaagcaaaacucacaaauacuacaacugagucgcguuguccaacacaaggugaaccuucauuaaaagaagaacaggacaaacgauucgucuguaaacacucuaugguagaucgaggaugggggaaugguugcggacuuuuuggaaaagggggaauagugacaugugcaauguuuacgugcaagaagaauauggagggaaaaauuguccaaccggagaaucuggaauauacaauaguaguaacaccgcacucaggugaagaacaugcagugggaaacgauacuggcaaacacggaaaagaaauuaaaguuaccccacaaucgucaauaacggaagcggaauuaacuggguauggaacagucaccauggaauguucuccgaggacaggacucgauuuuaaugagaugguguuauuacagauggaaaauaaggcuuggcuuguacaucgacaaugguuucuagauuugccuuuaccauggcuuccaggugcagacaaacaagaauccaauuggauacagaaagaaacacucguaacuuuuaaaaacccacacgccaagaaacaagacguggucguccuuggcagccaagaaggugcaaugcacaccgccuuaacaggagcaacggaaauacaaaugaguucgggaaaucuuuuguuuacaggacacuuaaaaugucgacucagaauggacaaauuacaacucaaaggaaugagcuauagcaugugcaccggcaaauuuaaaguagucaaagaaauugcagagacacaacacggaaccauuguuauaaggguacaauaugaaggugacggcaguccaugcaaaauaccuuuugaaauaauggacuuggaaagaagauacguucuaggaagacucauaacaguaaauccuauugucacagaaaaagauucuccuguaaacauugaggcagagccgccuuucggcgacucuuauauaauuauagguguagaacccggacagcuaaaauuaaacugguuuaagaaagguaguucaauuggacaaauguuugaaacuacaaugcggggugcgaaaagaauggcaauuuuaggggauacagcgugggauuucgggagcuuaggggguguauuuacgaguauagguaaggcuuuacaucaaguauuuggugcaaucuauggugcggcauucagugguguaucguggaccaugaaaauucucauagguguuaucauaacuuggauagguaugaacucuagaaguacuagccuaucggugucacuuguauuagugggaauugugacucuauaccuuggggugauggugcaagcagacagcggaugcgugguuagcuggaaaaacaaagaacuaaaaugcggaagugggauauucauaacagauaauguucauacauggaccgaacaauauaaauuccaacccgaaucuccaucaaaacuagcuagcgcuauucagaaagcucaagaagaagguauuugugguauaagaucaguuacacguuuagagaauuuaauguggaaacaaauuaccccugaauuaaaucacauauuggccgaaaacgagguaaaacugacuauaaugacaggagacaucaaaggaauaaugcaagcuggaaaaagaucauuaagaccucaaccgacggaauuaaaauauucauggaaaacuuggggaaaagcuaaaaugcucagcacagaaagcuacaaucaaacuuuucuaauagacggcccagaaacagccgaaugcccaaauacaaaucgcgcuuggaauagucuagaaguagaagauuacggguucggaguuuucacaacgaauauuugguugaaauugaaagaaaaacaagacgccuucugcgacaguaaauuaaugagugcggcgauaaaagauaaccgagcaguccaugcugacaugggauauuggauagaaagcgcauuaaacgacacguggaaaauagaaaaagcgagcuuuaucgaagucaaaaauugucauuggccaaaaucucauacucuauggucuaacggagucuuggaauccgaaaugauaauaccuaaaaaucuggcagguccagucucucagcauaauuaucggcccggauaucacacucaaauagcagggcccuggcauuuaggaaaauuagaaauggacuucgauuuuugugauggaacaacuguaauaguaacugaagacuguggaaauagggggccaucuuugagaacaaccaccgccaguggaaaguuaauaaccgaaugguguugccgcaguuguacauuaccgccauugagauauagaggagaagaugggugcugguauggaauggaaauacggccccuaaaagagaaagaagaaaaucuuguaaauucgcuuguaaccgcgggccauggacagguugacaacuucagccuaggaguucuaggcauggccuuguuccuugaggaaaugcugaggacgagaguaggaaugaagcacgcaauacuuuugguggcagucaguuuugugacauuaauuaccggaaauaugucauuuaaagacuugggacgagucgucgugaugguuggggcuacaauggccgacgauaucgggauggguguaacauacuuagcucuacuggcagcuuucaagguccggcccacuuucgcagcaggcuuacuccugcggaaacugacaagcaaggagcuuaugaugacuacaauagguaucguacucuuaucacaaucaaccauuccugaaacgguauuagaguugacagaugcauuagcacugggaaugauggugcuaaaaauugugcgcaacauggaaaaauaucaacuagcagugacgaucaugaccauacucuguguaccuaaugcugucauacuucaaaaugcauggaagguuaguugcacaauacucgcaguagugucgguaucuccacuccugcuuacgagcaguagacagaaaaccgauuggauaccauuagcguuaacuaucaaaggcuuaaacccgacagcuauauuccugacaacguuaucuagaacaaauaaaaagaggagcuggccauuaaaugaagcaauuauggcugucggaauggucagcauuuuggccucuucuuuauugaaaaaugauauucccaugaccgggcccuuaguagcuggaggacugcuuaccguauguuauguauuaacaggacgaagcgcagaccuugaacuagaacgagcuacugauguuaaaugggaggaccaagcagaaaucucaggaucaucaccaauacuaucaauuacaauaagugaggaugguucaaugucuaucaaaaaugaagaagaagaacaaacguugacuauacuaauaagaacaggucuucuuguuauaucaggauuauucccaauaucaauaccuaucacugcugcagcuugguacuuaugggagguuaagaaacagagagcgggcguauugugggacguacccaguccuccaccuauggggaaagcagagcuagaagacggggcguacagaauaaaacaaaaaggcauucuaggcuauucgcaaauaggagcgggaguauacaaggagggaacguuucauacgauguggcacguuacucguggggccguucuaaugcacaaaggaaagagaauugaaccaaguugggcugacguuaagaaagaucucauaucuuauggaggaggauggaaacuagaaggagaauggaaagaaggugaggaaguacaaguuuuagcguuagagccuggcaaaaacccucgcgcuguccagaccaaaccaggacuauuuaagacaaacacaggcacaauaggugcaguuagcuuagacuucaguccaggaaccuccgggucgccgauaaucgauaagaaagguaaggugguaggauuguacggaaacggggucguuacccgaaguggugcauauguuagcgcaauagcacaaacagaaaagaguaucgaagauaacccagaaauagaggaugauauauuucgaaaaaggagacuuacgauaauggacuuacacccaggcgcgggcaaaacuaaaagauaccuaccagcaauaguaagagaagccauaaaacggggacugaggacuuugauauuagcaccuacuaggguuguagcagcggaaauggaggaggcacuucgaggucuaccgauacgguaccagacuccagcgauaagggcugaacacacaggcagggaaaucguugaccugaugugccaugcaacuuuuacaaugagacuauugucaccagucaggguaccgaacuacaaucuuauaauaauggaugaagcacauuuuacugauccggcgucaauugccgcacgagguuauauuucaacccguguagaaaugggagaagcagccggaauuuucaugacugccacuccgccuggaucuagagauccauuuccucagucaaaugcaccaauuauagaugaggagagagaaaucccugagagaaguuggaacuccggacaugaauggguaaccgacuucaagggaaaaacuguaugguuuguuccaucaauuaaagcagguaacgacauagcugccugucuuaggaaaaacgggaagaaaguaauacaacuaucaagaaaaacuuuugacagcgaauauguuaaaacacggacaaaugacugggacuucguagugacaaccgauauuucugaaaugggugcaaauuucaaggcagagcgaguaauagauccucgacgguguaugaagccagugauacucaccgauggugaagaaaggguaaucuuagcuggacccaugccaguuacucauucaucagcugcucaacggcgcgggagaauaggccgaaaccccaaaaacgagaaugaucaguacauauacaugggggagccauuagaaaaugaugaggacugugcacauuggaaagaagcuaaaaugcuccuugauaacauuaauacaccagagggaauuauuccuaguauguuugaaccagaaagagaaaaagucgaugcuaucgacggcgaauauaggcuccgcggagaagcaaggaagaccuuuguagaccuuaugcgaagaggagaccugcccguuuggcuugcuuacaaaguugccgcugagggcauuaauuaugcugauagacgaugguguuucgacggcaucaagaacaaccaaauauuggaggaaaaugucgaaguugagauauggacgaaagaaggagaaagaaagaaacugaagccccgaugguuagaugcacgaauuuacucggauccauuggcacugaaggaguucaaagaauuugcugcgggccgaaaaucguuaacucuuaaucugauuaccgaaaugggaagacuaccuacguuuaugacgcagaagacuagggacgcauuagacaaccuggcaguucuccauacugccgaagcugguggucgugcuuacaaucacgccuuaucagaacucccugagacguuagaaacacuuuuguuguuaacauugcuugcgaccguaacuggaggaauauuuuuauuucuuaugagcggucggggcauaggaaagaugacacuagguauguguugcauaauaaccgccucaaucuuauuaugguaugcucaaauacaaccccauuggauagcagcgagcauaauacuagaguucuuuuuaauagugcugcugauucccgaaccggaaaaacaacguacuccacaggacaaccaacuaacauauguuguaauagcgauauuaacuguuguagccgcgaccauggcaaaugaaaugggauuccuugagaaaaccaagaaagaucuuggucuagggucuauugccacacaacagccagaaucuaacauacuagauaucgauuuacgaccagcaucugcauggacucuguacgcaguagcaacaacguucguuacgccuauguugcgacauagcauugaaaauucuucaguuaacguaucauugacggcaauugcuaaccaagcaacaguucucaugggacuagguaaaggauggccucuaucuaaaauggacauuggagucccuuuguuagcaauuggaugcuacagucaaguaaauccgauaacucuaacugcagcucuauugcuauuaguagcacauuaugccaucauagguccugggcuacaagcgaaagccaccagagaagcgcaaaagcgggcagcugccgggauuaugaaaaacccuacgguugaugggauaaccguuauagaucuggauccaaucccauaugacccaaaauuugaaaaacaacuaggucagguaaugcugcuaauucugugcgugacgcaaguguuaaugaugagaacaacaugggcucucugcgaagcucugacccuagccacgggaccaaucucuacauugugggaaggaaaucccggaagauucuggaauacuacaauagcuguaaguauggcuaauauauucagaggcucguaccuugcaggcgcaggauugcuguuuuccaucaugaaaaauaccacaaacacgagacgcgguaccgguaacaugggcgaaacgcuaggagaaaaauggaagucgagacuuaaugcuuuaggaaagucagaauuucaaauauauaagaaaucaggcauucaagaaguugaccgaacacucgcaaaagaagggauaaaaagaggggagacagaccaucaugcagucucuagggguucagcaaaacucagaugguuuguagaaagaaauaugguaaccccagaaggaaaaguuguagauuuaggaugcggacguggcgguuggagcuauuauuguggaggacuaaagaacgucagagaaguaaagggauugacaaaaggcggcccgggucacgaggagccaauaccuauguccacauacgguuggaaucuugucagauuacaaagcgguguagacguauucuuuauaccgccagaaaagugugauacucuucucugugacauaggagagucuaguccgaaucccacuguagaagccgguagaacucugcggguauugaaccuaguagaaaauugguuaaauaauaacacccaauuuuguauaaagguacuaaauccguacaugccgaguguuauagaaaagauggaagcccuucaaagaaaauauggaggcgcacuuguuagaaauccacuaaguagaaauucaacucaugaaauguacuggguaagcaacgcaucuggaaacauuguuuccagcguuaauaugauuucuagaaugcuuauaaauagauuuacaaugaggcauaagaaagcaacguaugaaccagacguugaccuuggaucgggaacaagaaacauaggaaucgagucggagauccccaauuuggacauuauagggaaaagaauugagaaaauaaaacaagaacacgaaacuucuuggcacuacgaccaagaccauccauauaagacuugggcguaucauggcuccuaugaaacaaaacaaacaggcucagcaucaucaauggugaauggaguuguucgauuauugacgaaaccaugggauguauuaccuacgguaacucaaauggcaaugaccgacaccacgccuuuuggccaacaacgaguauucaaagagaaagucgacacucguacacaagaaccgaaagaagguacgaagaaacuaaugaaaauaacggccgaguggcuuuggaaagaauuaggaaagaagaaaacacccaggauguguacccgagaggaauuuacacgaaaaguacgauccaaugcagcauugggagcuauuuuuaccgacgagaauaaauggaagagugcucgggaggcgguagaagacaguagguucugggaauugguugacaaagaaagaaaucuacaucuggaagguaagugcgaaacuugugucuacaauaugaugggaaagcgagagaagaaauuaggugaauuugggaaagcuaaaggaagccgagcuauaugguacaugugguuaggagcucgauucuuagaguuugaggcuuuaggauuuuugaacgaggaucauugguuuaguagagaaaauagccugucaggcguagaaggugaagggcugcauaaacuuggcuacauuuuaagagacguaucgaagaaagaaggaggagcaauguaugcagacgauacagcaggaugggauacuaggaucacauuagaagaucugaaaaacgaggaaauggucacaaaucacauggaaggagaacacaaaaagcuagcugaggcuaucuuuaaacuuacuuaccaaaacaaggucguacgaguucaaagaccgacuccacgagggacagugauggacauuauuucaaggcgcgaccagagagguucuggacaaguaggaacauacggcuuaaacacguuuacuaauauggaagcucaacuuauucggcaaauggagggugaaggaguguuuaaaaacauacagcaucuaacgguuacagaggaaguagcaguccaaaauuggcuugcgcgaguuggccgugagagguugagcagaauggccauaucuggcgaugauuguguuguuaaaccucuagaugacagauuugcaaaugcauugacagcauugaaugauaugggaaaaauacgaaaagacauucaacagugggaacccaguaaggguuggaaugacuggacgcaaguccccuuuuguucgcaucauuuucacgaacuaauaaugaaagacggccguguccuugugguuccaugcaggaaucaggacgaauuaauagggagagccaggauuucgcaaggagcuggguggagucugagagaaacggcuuguuugggcaaaaguuacgcgcaaauguggagccuaauguauuuucauagacgagaucuaagacuggcagcgaacgcaauauguucagcagucccaucucacuggguuccuacuagccguacaacguggucaauccaugcuaagcaugaauggaugacaacugaagacaugcucacaguuuggaauaaagucuggaucagggaaaauccauggauggaagacaaaacacccguggagucaugggaagagauccccuacuuagguaagcgcgaggaucagugguguggcucucucauaggcuugacuagccgggcaaccugggcgaaaaauauacaagcagcuaucaaucaaguuagaaguuuaauaggaaacgaagaauauacugauuauaugccaucaaugaaacguuuucgccgcgaagaagaagaagccggaguucucugguaa

SEQ ID NO: 22680 - RNA, 9876 nt, Artificial Sequence
  derived and/or modified CDS sequence (opt6) from DENV-2__EU660417__SS-prME
ucugcagguaugauaauuaugcuuauaccaacgguaauggcauuucacuuaaccacaagaaauggugaaccacauaugauaguagguauacaagaaaaagguaaaucacuguuauucaaaacggaagaugggguaaacauguguacgcuaauggcaauggaucucggugaacuuugcgaagauacgauaacauauaaauguccacuucuacgacaaaaugaaccagaagacauugauuguuggugcaacucaacaaguacgugggugacauacgguacuuguacaacgacaggagaacaccgacgagagaaaaggagcgucgcgcuggucccacacgugggaaugggacuagaaacacguacugaaacauggaugaguagugaaggagcguggaaacaugcacagagaauagaaacauggauccugagacaccccggguuuacuauuauggcagcuauuuuagcauacacuauaggaaccacccauuuccaaagaguacuaauuuucauuuuacuaacagcugucgcuccaaguaugacuaugagauguauagguauaucuaaccgagacuuuguagagggaguuagcgguggaaguuggguggacaucgucuuagaacauggaaguuguguaacuaccauggccaaaaauaaaccaacauuggacuucgaauugauaaaaacugaagcuaaacaacccgcaacauuaaggaaauauuguaucgaggcaaaacuuacuaauacaacuacggaaagcagauguccaacgcagggagaaccgagcuuaaaagaggagcaagauaaaagguuuguuugcaaacauuccaugguugaccgcgguuggggaaaugggugcggacuguucgguaaaggaggaauuguuacaugcgcaauguuuaccuguaagaaaaauauggaaggaaaaauaguacaacccgagaacuuagaauauacgauagucgucaccccacacagcggagaggaacaugcaguagguaacgauacaggaaaacacggcaaagaaauuaaagucacgccccaaaguucaauaacugaggcagaacuaacugguuacgggacugugaccauggaauguucuccuagaaccggccucgacuuuaaugaaaugguccuacuucaaauggagaacaaagcgugguuaguucauaggcaaugguuuuuggaccuaccacucccguggcuaccuggugcggauaaacaagagucaaauuggauacaaaaagaaacauuagugacauuuaaaaauccacacgccaagaaacaagauguaguaguguuagguagucaagagggagcaaugcauacugcauuaaccggagcgaccgagauacaaaugaguucgggaaaucuacuuuucaccggucaucuaaaaugucgccuucgaauggacaaacuucaauuaaaaggaaugaguuacucaauguguacaggcaaauuuaaaguuguaaaagagauugcggagacgcaacacgguacuauaguuauccgaguacaguaugaaggggacgguucaccauguaaaauuccuuucgaaauaauggacuuagaacgaagguaugugcuaggacgguugauuacggugaacccaauaguaacugaaaaagauucaccaguaaauauagaggcagaaccgccuuucggagacagcuacauaaucaucggaguagagcccggucaauuaaaacucaauugguucaagaaaggaucuucuauuggccaaauguuugagaccacaaugagaggagcgaaacgaauggcuauacuuggcgauacagcuugggacuucggaagccuaggaggaguauucacauccaucggcaaggcuuuacaucaaguguuuggcgcaauauacggagcagcguucucagguguaagcuggacgaugaaaauuuuaaucgggguuauaaucacauggauuggaaugaauaguagaaguacgagucuaagcguuucgcugguuuuggucggcaucgugacauuauacuuaggugucaugguacaagcagauucuggaugcguugugagcuggaaaaacaaggaguuaaaaugcgggagugggauuuuuauuacagauaacguacauaccuggaccgagcaguauaaguuucaacccgagagcccuaguaaacuugcaucagcaauacaaaaagcccaagaggaagggauaugcggaauuaggucaguaacacguuuagaaaaccuaauguggaaacagaucacuccggaauuaaaucauauuuuagcagaaaacgaaguaaaacuaacgauuaugaccggggauauuaaggggauaaugcaggcaggaaaaagaaguuugagaccacaacccacagagcuaaaauauaguuggaaaacuuggggaaaagcgaaaaugcugucaacagaaaguuauaaccagacauuucugaucgaugggccagagacagcugaauguccaaacacuaauagagcuuggaacaguuuggaaguagaagauuacgguuuuggcguauucacaacaaauauauggcugaaguugaaggagaaacaagaugcguuuugugacuccaaauuaaugagcgcagcuauuaaggauaaucgcgcaguacaugcagauaugggauauuggauugagagugcuuugaacgacacauggaaaauugaaaaagcgaguuucauagaaguaaagaacugucauuggccaaagucgcacacauuauggucaaacgguguuuuagagucggaaaugauuauccccaaaaaucuugcuggaccagucagucaacauaacuaccgaccaggcuaccauacccaaauagcaggcccuuggcacuuaggaaaacuagaaauggacuucgacuuuugcgauggaacgacaguaaucguaacagaagauugcgguaacaggggacccucuuuaaggaccacuacagccucggguaaauuaauuacagaguggugcugucguucuuguacacugccaccccucagauaucgaggagaagauggauguugguacggcauggagauaagaccacuaaaagagaaagaagaaaaucuuguuaauagcuugguaacugccggccacggacaaguugacaacuuuaguuuaggaguauuagguauggcuuuauuucuagaggaaaugcuucguacacggguuggcacgaagcacgcaauuuuacuuguagcugucucguuuguaacacuaauaacaggcaacaugucauuuaaagaccuaggacgagucgucguuaugguaggagccaccauggccgaugauauagggaugggaguaacguaccuagcucuacuagcggcuuucaaaguccgcccgacguucgcugcagguuugcugcuucgaaaguuaacaagcaaagaacuaaugaugacaacaauuggcaucguauuacuaagccaaaguaccauaccugagacugugcuagaacuaacggaugcacuugcauuaggcaugauggucuuaaagauaguucggaacauggaaaaauaucaauuggcagucacuaucaugacaauccucugugugcccaacgcuguaauacuucaaaacgccuggaaaguaaguugcacaauacuggcgguagucucuguauccccacuuuugcugacaaguaguagacagaaaacugacuggauaccauuagcauugacuauaaaaggcuuaaauccuacugcaauauuuuuaacaacacuuucacguacuaauaagaaaagaagcuggcccuugaaugaagcgauaauggcuguagguaugguaagcauuuuagcuagcaguuuacugaaaaaugauauaccuaugaccgggccucuaguagcggguggacuccuaacaguuuguuacgucuuaacagguagaucagcagaccuggaacuggagcgagcaaccgaugugaaaugggaagaucaagcggaaauaucagguaguaguccaauacuuucuauaacaauaagcgaagacggaagcaugagcauaaagaacgaagaggaggaacaaacacugacaauauuaauaaggacgggacuucugguaauaucaggacuuuucccaauuaguauuccuauaaccgccgccgccugguaucugugggaaguuaagaaacaacgagcaggcguacuaugggacguaccaaguccgccuccgaugggaaaagcagaauuggaagauggugcauaccgaauaaaacaaaagggcauucuggguuacagccaaauaggggcugggguauacaaggaagggacauuccauacaauguggcacgucacuagaggggcaguauuaaugcauaaagguaaaaggauugagccuaguugggcggacgugaagaaagaccucauaucguacggagguggauggaaauuagaaggagaguggaaagaaggggaagaaguucaagugcuagcuuuagaaccaggcaaaaauccaagagcgguccagacaaaacccggacuuuucaaaacaaacacagguaccauaggggcgguuagccuggacuuuucacccggaacaaguggaaguccaaucauugacaagaaaggaaaaguaguaggacuauauggaaaugguguagugacucgaucgggcgcauacguaucugcaauagcccaaacagagaagucaauagaagauaacccugaaauagaggacgauauauucaggaagcguagauuaacgauaauggaccuacacccuggcgcaggcaaaacaaaaagguacuuacccgcaauaguaagagaagcaauaaaaagggggcuacgaacccuuauucucgcaccaaccaggguaguugcggcagagauggaagaggcuuuaagaggauuaccaauaagguaucaaacgccagcgauacgagcagaacacacugggcgcgagauaguugaucuaaugugucacgcaacauuuacgaugagacugcugucgccugugcgagucccgaacuacaaucugauuauaauggacgaagcucauuucaccgacccggcuucaauagcugcucgaggauacauuaguacaagaguagaaaugggugaagcugcaggcaucuuuaugacagcuacuccaccuggaucaagagacccguuuccccaauccaacgcucccaucauugacgaggagcgugagauaccugagagaucauggaacuccggacaugaauggguaaccgacuucaaaggaaaaacgguaugguuugugccaaguauaaaagccgguaaugauauugcagcuugucuacggaagaauggcaagaaaguaauccaacuuaguagaaaaacuuuugacucagaauauguaaaaacuagaacgaaugauugggauuuuguuguaacaacagacaucucugaaaugggggcuaauuuuaaagcagaacgcguaaucgacccaagaagauguaugaagccugugauacuaacggauggugaagaacguguaauucuagcggguccaaugccagugacacauucgagugcagcacaaagaagagguagaauaggaagaaaucccaaaaacgagaacgaucaauacauuuacaugggagaaccacuggaaaaugaugaggacugcgcucauuggaaagaagccaagauguuacuagauaauauaaacacaccugaaggaauuauacccucaauguuugaaccggaaagagaaaaaguagacgcgauagacggugaguauagacuaaggggugaagcgagaaagacauuuguagaucuaaugcgaagaggcgauuuaccuguaugguuggcguacaagguugcagccgaaggaauaaauuacgccgauaggcggugguguuuugauggaaucaaaaauaaccaaauuuuagaagagaacguugaaguugaaauauggacaaaggaaggugaaaggaagaaauugaagccgagaugguuggacgcccggauuuauucugacccauuggcauuaaaagaauuuaaggaguuugcagccggacgaaaaucucuaacacugaaucuuaucacagaaaugggaagguuaccuacguucaugacccaaaagacuagagaugcucuagauaaccucgcgguucuacacacagcugaggcugguggacgugcauacaaucacgccuuaucugaacugccggagacauuagaaacauuauuacuacuaacauuacuggcaacgguuacuggcgguauauuuuuauuucuuaugucaggaagagggauugguaagaugacauuaggcauguguugcaucauaacagcaucuauacuguuaugguaugcccaaauacaaccccacuggauugcugccucaaucaucuuagaguucuuuuugauaguccuacuaauuccugaaccagaaaagcaaagaacuccccaagacaaucaacugacguacguagucauagccauucuuacgguugucgcggcaacaauggcaaaugaaauggguuuccuggagaaaacuaaaaaggaucucggauugggaaguauagccacgcagcaaccugaaaguaacauauuagauauagaucuacgaccagcgucagcuuggacucucuaugcggucgcgacaacuuuugucacgccgauguugaggcacaguauugaaaauagcucuguaaacguaucauugacagcuauagcaaaccaagccacaguauuaauggggcuuggaaaagguuggccacuauccaaaauggacauaggaguuccauugcuugcgauuggcugcuauagucaaguaaauccaauaacucuaacugcagccuuguuacuauuagucgcacacuaugcuauaauaggaccaggacugcaagccaaagcaaccagagaagcccagaaaagggcugcagcagggauaaugaaaaauccgacagucgauggaauaacgguuauugaucucgaccccauacccuaugauccuaaguucgaaaaacaacugggacagguaaugcuuuuaauccuauguguaacacagguacuaaugaugcgcacgacaugggcauuaugugaagcacuaacacuagccacugguccuaucucuacauugugggaaggaagcccuggcagauucuggaacacgaccauagcaguuucaauggccaauauuuuucgaggaucuuaucucgcuggugcaggacuacuauuuucaauaaugaaaaauacuacuaacacuagacgcgguacuggaaauaugggugagacguugggagagaaguggaaguccagauuaaaugccuuaggcaagucagaauuucaaauauauaagaaaaguggcauccaggaaguagauaggaccuuagccaaagaagggaucaaaagaggcgaaacagaucaccaugcaguuagucgagguagcgcuaaauuaaggugguucguagaacgcaauaugguuacgccggaggggaaaguuguagauuugggcugcggacguggggguuggagcuauuauugugggggacuaaagaaugugcgagaggucaagggguugacuaagggcggaccuggacaugaagaaccaauccccaugagcacauauggauggaacuuaguuagacuacaaucagguguugauguguuuuucauucccccugagaaaugugauacgcuacuuugugauauaggugaaaguagucccaauccaacaguggaagcaggucgaacgcuccggguacugaaucuaguagaaaauuggcuaaauaauaauacacaauuuuguaucaagguucuuaacccauauaugccuucaguaaucgagaaaauggaggcccuucaacgcaaguacggaggugcgcuuguucggaauccauuaucucguaacucuacgcaugaaauguauuggguuuccaaugccucugggaacauaguaaguucagucaacaugaucagccguauguugauuaauagauuuacaaugcgccacaaaaaggcuacauacgaaccagacguagaccucgggagcggaacaagaaacauaggaaucgaaagcgagauaccuaacuuagauauaauagggaaaagaauugagaaaauaaaacaggagcaugagacaaguuggcauuaugaccaggaccauccuuauaaaacgugggccuaucacggaucauacgagacaaaacaaacgggcucugccucaaguauggucaaugguguugugcgucuauuaacaaagccuugggaugucuuaccuacgguaacccaaauggccaugacggauacaacuccguucggucagcaaaggguguuuaaagagaaaguagauacgagaacucaagaaccaaaagagggaacuaagaagcuaaugaaaauuacugcugaauggcuuuggaaggaacuaggcaagaaaaagacgccacguaugugcacacgggaggaguuuacacgcaaggugcgaagcaacgcggcauugggagcaauauuuaccgacgaaaauaaauggaaaagugccagagaagcagucgaagacagccguuuuugggagcuaguagacaaagaaaggaauuuacacuuagaaggcaaaugugaaacguguguauauaauaugauggguaaacgugagaagaaauuaggagaauuugguaaggcaaaaggaagucgagcaauaugguacauguggcuaggggcucgguuucuugaauuugaagcgcucggauuuuuaaacgaagaccauugguucucacgggaaaacucuuugucagguguagaaggggaaggccuacauaaacucggcuauauccuacgagauguuagcaagaaagagggcggggcgauguacgccgaugacacagcaggaugggauacacggaucacacucgaagaccucaaaaacgaagaaauggugacaaaccauauggagggagaacauaagaaacuagcagaagcuauuuuuaaacuaacauaucaaaacaagguaguccggguccaacggccuaccccaaggggcaccguuauggauauuauaagucggcgcgaucagcgagggaguggacagguuggaaccuacgggcuaaauacuuucacaaauauggaagcccaauuaauucggcaaauggaaggggagggugucuucaagaauauacagcaccugacuguuacagaagaaguagcaguucaaaauuggcucgcuagaguuggacgcgagcgucuaucccgaauggcgauaucaggagacgauuguguagucaaaccauuagaugauagauucgcuaaugcuuugacagccuuaaacgauauggguaagauaagaaaagauauccaacaaugggaaccgucaaaaggcuggaaugacuggacacaaguuccauuuugcucccaucauuuucaugaguuaaucaugaaagacgguagaguauuggucguccccugccgaaaucaagacgaauuaauaggacgugcacgcauaucacaaggugcaggauggagucugcgggaaaccgcaugccuaggcaaaagcuacgcacagauguggagucugauguauuuucaucggagagacuuacgauuagccgcgaaugcaaucugcagugcaguuccaucgcauugggugcccacaaguaggacuacaugguccauacacgcaaaacaugaauggaugacuacggaagauaugcucaccguuuggaauaaaguauggauacgugaaaaucccuggauggaggacaaaacccccguagagucaugggaggaaauaccauaccuagguaaaagagaagaucaaugguguggaucccucauuggauuaaccucaagagcuacgugggccaaaaacauccaagcagcaauuaaccaaguuaggucucuuauagggaaugaggaauauacugauuauaugccgucaaugaaaagauuuagaagggaggaagaagaagccgguguacuaugguag

SEQ ID NO: 22681 - RNA, 9876 nt, Artificial Sequence
  derived and/or modified CDS sequence (opt6) from DENV-2__EU677137__SS-prME
agugcuggaaugauaaucauguuaauuccgacaguaauggcauuccacuuaacuacacgaaacggagaaccgcauaugauaguaggcauacaagaaaaagggaaaucccugcuguucaaaacugaggauggaguuaacaugugcacacuuauggcaauggaccuaggcgaacuaugugaagauaccaucacauacaaauguccgcuauuacggcaaaacgaacccgaagauauagauuguugguguaauucuaccucaacuugggugaccuacgguacuuguaccacaacuggugagcaucgccgagagaaaagauccgucgcauuaguaccacacgucgguaugggacuagagacaagaaccgaaacuuggaugaguucggaaggcgcauggaaacacgcucaacgaauagaaacauggauacuacgacacccuggcuuuacaauuauggcagcgauacuagcauacacaaucggcacaacucacuuccaacgcguacuuauauucauucuucugacagcaguagcuccaaguaugacaaugcgaugcauaggcauaaguaauagagauuucguugaaggcguaaguggugguaguuggguagauauaguuuuagagcacgguaguuguguuacaacaauggcuaaaaacaaaccaacauuagauuucgaauuaauaaaaacagaagcaaaacaaccagcaacacuacgaaaauacugcauugaggcaaaacugaccaacacaacaacugagagccgauguccuacacaaggggaaccuagccuuaaagaagaacaagauaaaagguucguauguaaacauucaaugguagauagagguuggggaaacggguguggguuauuuggaaaaggugggaucguaacaugugcaauguuuacgugcaagaaaaauauggaaggaaaaauuguccaaccugaaaaccuagaauauacgauagugguaacaccacacagcggugaagaacaugcgguaggaaacgauacuggaaaacauggacaagagauuaaaguuacgccacaaucgagcauaacggaagcugaguugacugguuaugggacaguaacuauggaauguucaccucguacuggacuagauuuuaacgagaugguacuauuacaaauggaaaacaaagcauggcugguccauaggcaaugguuucuagaccuaccgcuuccgugguuaccgggagcagauaaacaagaaaguaacuggauucagaaagaaacauuagucacauuuaagaacccacacgccaagaaacaagacguaguuguacugggaucccaagagggggcuaugcacaccgcacugaccggagcaaccgaaauucaaaugagcuccggcaaccuacuuuucacuggucacuuaaaaugucguuuacguauggauaagcuacaacugaaagguaugagcuauagcaugugcacugggaaauuuaaaguagucaaagaaaucgcagaaacacaacaugggaccauaguaauuagaguucaauacgaaggagacggaaguccuuguaagauaccuuucgaaauaauggaccucgaaaaacgguauguuuuaggucgauuaaucacggugaaccccauugucacggaaaaagacagucccguuaauaucgaggcggaaccaccauucggagauucauauauaauaauaggaguggagccuggacaacuuaagcucaacugguucaagaaagguucuaguaucgggcaaauguuugaaaccacaaugaggggugcuaaaagaauggcuauacuaggggauacagcgugggauuuuggauccuuagguggcgucuucacaaguauaggaaaagcacugcaucaggucuuuggggcgauauauggugcggcuuucagcgguguaucguggacaaugaagaucuuaauaggaguaauuaucacauggauaggaaugaacagccgaucuaccuccuuaucuguaucauuaguucucgugggcauuguaacauuauauuuggggguuauggugcaagcugacucugguuguguaguauccuggaaaaauaaagaauuaaaaugcggcucugggauauucaucaccgauaauguucacacguggacagagcaauauaaauuucaaccugaauccccaaguaaauuagcuucagcuauacagaaggcgcaagaagaagguauuugugguauacggucuguuacgaggcuagaaaacuuaauguggaaacaaaucacaccugaacuaaaccauauccuggccgaaaacgagguaaaacuaacaauuaugacgggagauauaaagggaauaaugcaagcuggaaagcguucacuaagaccacagccaacugaguuaaaguauuccuggaaaacaugggggaaagccaaaaugcuuaguacagaaucauacaaccaaacauuccuuauugauggcccagaaacagcagaaugcccgaacacaaauagggcuuggaacucauuggagguugaggauuacgguuuugggguauucacuaccaacauaugguuaaaacucaaagaaaaacaagaugcauucugcgauucaaaguuaaugagugcugcaauaaaagauaacagagcgguccaugccgacauggguuacuggauagaaucagcacuaaacgauacuuggaaaauagaaaaagccagcuucauugaaguuaaaaauugccauuggcccaaaagccacacacuuuggucgaacggaguacucgaaagcgaaaugauaauccccaaaaauuuagcuggcccaguaucccaacauaauuauagaccgggguaccacacccagauugcgggaccauggcaucugggaaaguuggaaauggauuucgauuuuugcgacgggacaacaguuaccgucacugaagauugugguaguagagguccaucucugaggacaaccacagcuagugggaaauuaaucacagaaugguguuguagaaguuguacauugccuccacuacgauauagaggggaggacggaugcugguacggaauggaaauacgaccgcuuaaagaaaaggaagaaaaucugguuaacagcuuaguaacugcggggcaugggcaagucgacaacuuuucccucggaguguugggaauggcgcuauuuuuggaagaaauguuacguacuagaguugguacgaaacaugcuauucuucucguagcugucucauucguuaccuuaauuacagggaacaugucauucaaagaucucgguagagucguggucaugguuggugcaaccauggccgacgauauaggaaugggaguuacauaccuugcucuguuagcugcuuuuaaaguucggccaacguuugcagcaggucugcuauuaagaaaauuaaccucaaaagaauuaaugaugacgacaauuggcauaguucuguuaagucaaaguacgauuccagagaccguacuggaacugacggacgcccuggcuuuagggaugauggucuuaaagaucgugcgaaauauggaaaaguaucaacuagcugucaccauaauggcgauccuaugcguuccaaacgccguaauacuccaaaaugcguggaaagucucgugcacaauucuggcuguagucaguguauccccucuguuacucaccucaucgcagcagaaaacagacuggauaccguuggcacuuacuguaaaagguuuaaauccaacagcuauuuucuuaacaacacugaguagaaccaauaagaaaagaagcuggccgcugaaugaagcaauaauggcaguagggauggucucuauucuagcaagcagcuuacuuaaaaacgauauacccaugacaggaccguuaguugcuggagggcuauuaacuguguguuacguccuaacggggcggucagcggaucuagaacucgagagagcgacugaugugaaaugggaggaccaggcggaaauaucagguucgaguccuaucuugaguaucaccaucagugaggaugguagcaugucaaucaaaaaugaagaagaagaacaaacuuugacuauuuuaauaagaacaggacuucuaguuauaagcggacuauucccaaucuccauaccgaucacagcugcagcgugguauuuaugggaagugaagaaacagcgugcgggagucuugugggacguucccucuccaccaccgauggggaaggcugagcuagaagauggugcauaucgaauuaaacaaaaggguauauuaggauacagccagauuggagccgggguauauaaagagggcacauuucauacaauguggcaugugacacgaggagcugugcuaaugcacaaaggaaaaagaauugaaccuagcugggcugacguaaagaaagaucuaaucuccuaugggggcggauggaaguuagagggugaauggaaagaaggagaagaaguacagguucucgcacuggagcccgggaagaacccacgagcuguucaaacuaaaccuggacucuucaagacgaacacuggaaccauaggugcaguaucauuggacuuuagcccugguacgucagggucaccgauaauugacaagaaaggaaaaguuguuggucuauauggaaacggaguggucacucgaaguggcgcguaugugagcgcaauugcgcaaacagagaaauccaucgaagacaauccugaaaucgaagaugacauauucaggaagcgaagacucacgauuauggaccuacauccaggagcagggaaaacaaaacgguacuuaccagccaucgucagagaagcgaucaaacgaggucuuagaacacuaauacuagcaccuacgagaguaguagcggcagaaauggaagaagcucuaagaggccuucccauucgcuaccagacuccugcaaucagggcagaacauacagguagagaaauuguagaucugaugugucaugcaacauuuaccaugagacuccuuucgccaguacgagugccaaacuacaacuugauuauuauggacgaagcucacuuuaccgaccccgcgaguauagcugcgagagguuauaucuccacaagaguugaaaugggagaagcagcuggaauuuuuaugaccgcgacaccgccugggagcagggacccguucccgcaaucaaacgcacccauuauugaugaagaacgugaaauucccgaacgauccuggaauaguggccaugaaugggugaccgauuuuaaaggaaagacgguaugguuuguaccaucuauuaaagcggguaaugauaucgcggcuugcuuaaggaagaauggcaagaaaguaauucaguuaucaagaaagaccuuugacuccgaguacgucaagacuagaaccaaugauugggauuuuguuguaacaacugauauaucagagaugggggcaaacuucaaggccgagcgagugauagacccacgucgguguaugaaaccuguaauucuaacggacggagaggagagaguuauacuagcgggaccaaugcccguuacacacaguuccgcugcacaaagacgggguagaauagggagaaauccuaaaaacgagaaugaucaauauauauacaugggcgaaccauuggaaaacgaugaagacugcgcccauuggaaagaggcaaaaauguuacucgauaauauuaauacaccggaggguauaauuccaagcauguuugaaccggaaagggagaagguagaugcaauugacggcgaauacagacuaagaggagaagcuagaaagacauucguagauuuaaugcgcagaggagaucucccaguguggcuggccuauaaaguagccgcugaaggcauaaacuacgcagauaggaggugguguuuugacggcauuaaaaauaaucaaauauuagaagaaaauguagagguugaaauuuggacgaaggaaggcgagagaaagaaauuaaaaccacggugguuagacgcccgaauauacucagauccucuugcauuaaaagaauuuaaagaauuugccgccggccguaaaucacugacacuaaacuuaauuacagaaaugggcagacuaccuacuuuuaugacacagaaaacaagggaugcauuagacaacuuggcaguacuacauacagcugaagcaggaggacgggccuacaaccaugcacucucggagcucccggagacacuagaaaccuuacuucuguugacucuuuuggcaacagugacaggugguaucuucuuauuuuugaugucaggcagggguauuggaaaaaugacauuaggaauguguuguaucauuacggcaagcauuuuacuuugguacgcccaaauacaaccacacuggauagcagcuucuaucauucuugaguucuuucucauaguacuauugauuccagaaccagaaaaacagagaacaccacaagacaaucaguuaacuuacguagugauugcaauacuaacugugguugcugcaaccauggcaaacgaaaugggauuucucgagaaaacuaagaaagauuugggauuaggaagcauugcaacccagcaaccugaaucuaauauacuugacauugauuuaaggcccgcaucagcguggacucuuuacgcaguagcuaccacguucgucacaccuaugcugagacauagcauagaaaauagcagcguaaacguaucguuaaccgccauagcuaaucaagcuacuguucuuaugggauuggguaaaggauggccacugagcaaaauggauauaggaguaccacuauuagcgauaggaugcuauagccaaguaaauccaauuacucugacagccgcccuucucuuguuaguagcucauuaugcaauaauaggaccaggauuacaagcaaaagcaaccagggaagcucagaaaagagccgcagcuggaauaaugaaaaauccuacaguagauggaauaacuguaauagacuuagauccuauaccauaugacccaaaauuugaaaaacaauugggucagguuaugcuuuuaauauuguguguaacacaaguucuaaugaugcguacuacuugggcuuuaugcgaagcacuaacucuugcaacugggccaauuucaacacuaugggaaggcaauccaggaagauuuuggaauacaacaaucgcggucaguauggcuaauaucuuucgggggucuuaucuagcaggagcuggacucuuauuuagcauaaugaaaaauacaacgaauacaagaagagguacaggaaauaugggagaaacucucggggaaaaauggaaaucaaggcuuaacgcacuuggcaagagugaauuucaaauuuacaagaaaucagggauucaagaaguagacagaacacuagcgaaagaaggaaucaagcgaggagagacugaucaccacgcgguaucucgaggaagugccaaauuaagaugguuuguagaacggaacauggucacucccgaagggaaaguuguagauuuaggaugcgggcgagguggauggaguuauuauugcggcgggcuuaaaaaugucagggagguaaaggggcuuacuaagggugguccaggacacgaggaaccaauaccuaugagcacauaugguuggaaucuuguaagguugcaaaguggaguagacguauuuuucaucccaccagaaaaaugcgacacccuacuaugugauauaggagaaucgagucccaacccuacaguagaagcaggaaggacuuuacgagucuuaaaccuaguugaaaacuggcucaauaauaauacucaguuuugcauaaaaguucucaauccuuacaugccuagcguaauagaaaagauggaagcuaugcaaagaaaauacgggggugcguuaguuaggaacccccugucaaggaacucaacccacgaaauguauuggguaucaaaugcuucagguaacauaguaucaucaguaaauaugaucaguagaauguugauaaacagguuuacgaugagacauaagaaagcgacuuaugaaccagacguagaucugggaucagggacaagaaauauaggcauagaaagcgaaaucccuaaucuggauauaauaggaaagagaaucgaaaagauaaaacaagaacaugaaacaaguuggcauuaugaucaggaucauccguacaaaacaugggcauaucauggaagcuaugaaacaaagcagacuggcagcgcaucuucgaugguuaauggaguugucaggcuacugacuaaacccugggauguauuaccaacagucacgcaaauggcgaugacagauacaacgcccuuugggcagcaaaggguuuuuaaagaaaaaguagauacucggacacaagaacccaaagagggaacaaagaaacuaaugaaaauaacagcagaauggcuguggaaagaacuagguaaaaagaagacgccgcgaauguguacuagagaagaauuuacaagaaaaguuaggucuaaugcagcguugggagcaauauucacagaugaaaauaaauggaaguccgcacgcgaagccgucgaagauucccgauucugggagcuaguugacaaggagcguaaccugcaucuagaggggaaaugugaaaccuguguauauaauaugaugggaaagcgcgagaagaaacugggggaguuuggaaaagccaaaggaaguagagcuauuugguacaugugguuaggugcaagguuccuagaauuugaagcauuaggauuccuaaaugaggaccauugguuuucacgggaaaacucuuugagcgggguagaaggugaaggacuacacaaacucggcuacauauuacgagauguuagcaagaaagaagggggugcgauguaugcagaugacaccgcugguugggauacacgaauaacacuugaagaccugaaaaacgaagaaaugguaacuaaucauauggaaggugaacauaaaaagcucgcggaggcuauuuucaaacuaacauaucagaauaaagugguuaggguucagaggcccaccccuagaggaacgguuauggacauaaucucccgucgcgaucaaagggguaguggacaaguagguacauacggacugaauacauuuacaaauauggaagcgcaauugauucgucaaauggagggugaaggcguauucaaaaacauucagcauuuaacggugacagaggaaguagcuguucagaauuggcuggcgaggguuggacgugaaagacuaucgagaauggcaauuagcggagaugauugugucguuaaaccuuuagacgaccguuuugcgaaugcacuaacagcauuaaacgacaugggaaagauuagaaaagauauccagcagugggaacccagcaaaggauggaaugauuggacacaggugccauuuugcucucaucauuuucacgaacugauaaugaaagauggucgaguccuagucguaccguguagaaaccaagacgaauuaauuggacgggcacgaauaucacagggcgcgggauggagccuccgugagacagcaugucuuggcaagucauacgcacaaauguggucucuuauguacuuccaucgacgggaccuacggcucgcagcgaacgcgaucuguucugcagucccgucacauugggucccaacgagcagaaccacguggaguauccacgcaaagcaugaauggaugacaacagaagauauguuaaccgucuggaaccgcguuuggauacgagaaaauccuuggauggaagauaaaacaccagucgaaagcugggaggaaaucccguauuuggguaaacgugaggaucagugguguggaucgcugauuggcuugacuagccgggcuacuugggcgaaaaacauucaagcugccauaaaccaaguccguucccuuauugggaacgaagaguauaccgauuauaugccaaguaugaaaagauucagaagggaagaggaagaggcaggaguacuaugguaa

SEQ ID NO: 22682 - RNA, 9876 nt, Artificial Sequence
  derived and/or modified CDS sequence (opt6) from DENV-2__EU677138__SS-prME
agugcaggcaugauuauaaugcuuauaccaacaguuauggcauuucaccuaacuacuaggaauggggaaccgcacaugauaguugggauacaagaaaaaggaaaaucucuacuauucaaaacugaagaugguguaaacauguguaccuugauggcuauggaucuaggugaacuaugcgaagacacgauaacauauaaaugcccauuauugagacaaaacgaaccggaagacauugauuguugguguaacucuacuucgacauggguaacauacgggacuugcacaaccacgggugaacauagaagagagaaaagaagcgucgcuuugguuccccauguagggaugggacuagaaacuagaacagaaacauggaugagcagcgaaggagcauggaaacaugcucaacgaaucgaaacauggauacuuaggcauccaggauuuacuauuauggcagcgauauuagcuuauacuauaggaacgacacauuuccaacguguacucauauucauuuuacuaaccgcugucgcaccgagcaugaccaugagauguauaggaauaucuaaucgagauuuugucgaaggagucucuggagguagcuggguagacaucguauuggaacacgggaguuguguaacuacaauggcgaaaaacaaaccaacuuuggauuuugaacuuauuaaaacagaagcaaaacaacccgcaacucugaggaaauacugcaucgaagccaaauuaaccaauacaacuacugagucccguugcccuacucaaggcgaacccagccuaaaagaggagcaagauaaaagguucguguguaaacacucaaugguggaccgagguuggggaaacggauguggguuauuuggcaaaggcggcauaguaacgugugcgauguucacuuguaagaaaaauauggaaggaaaaauuguccaacccgagaauuuagaguacacaauuguuguaacaccacauuccggggaagaacaugccguagguaaugauacgggcaaacacgggcaagaaauuaaagucacaccacaaagcucaaucacagaagcagaacugacaggcuacggaacgguuacuauggaauguuccccucgcacaggcuuagauuucaaugaaauggucuuauuacaaauggaaaauaaagcgugguuaguacaucgacaaugguuucuugaccuaccuuuaccauggcucccaggagccgauaaacaagaaucaaacuggauucaaaaagagaccuugguaacauucaaaaacccccacgcaaagaaacaggauguaguaguucucgguagucaggaaggugcaaugcauacugcauuaacuggagcaacggaaauacaaaugaguagcgguaaucugcuuuucacggggcaucugaaaugccgauuacguauggacaaauugcaacuaaaagguaugucauauaguauguguaccggaaaauuuaagguggucaaggaaaucgcagaaacacaacacggaacgauuguuauucgcguacaauacgagggugacgguaguccauguaaaauaccauucgaaauaauggaucuagaaaaacgcuauguacuaggacgucuuaucacgguaaaucccauagucacugaaaaagauucacccguaaauaucgaagcagagccgcccuucggagauucuuauauuauuauugggguagaaccaggacaauuaaaacucaacugguuuaagaaagggucaucuauaggccaaauguucgaaaccaccaugcguggagcaaaaaggauggcuauucucggggacacggcuugggauuucggaagccuaggcgggguauuuacaaguauugggaaagcgcuacaucagguuuucggggcaauauauggcgcugcauucucggggguuagcuggacgaugaagauccucauaggugucaucauaacauggauaggaaugaauaguaggaguacaucauugagcguuucacugguguuaguuggaauaguuacacuauaucugggcguuaugguacaagcugauucaggguguguaguaaguuggaaaaacaaagaacuuaaguguggaucagggaucuucaucacagauaacguacacacguggacagaacaauauaaguuucagccugagagcccauccaaauuagcuagugcaauacagaaagcacaggaagaaggcauaugugguauucgaucaguaacaagauuagagaaucucauguggaaacaaauaacucccgaguuaaaccauauacuugcggaaaaugaaguuaaauuaacaaucaugacaggcgacauaaaaggaauaaugcaagccggcaaaagaagucuuagaccgcaacccaccgaguuaaaguacucguggaaaaccugggggaaagcaaaaauguugucuaccgagucuuacaaucaaacuuuccuuauugacgggcccgaaacagcggaaugccccaacacgaauagggcuuggaacucauuggaaguggaggauuauggauuugggguuuuuacuacgaauauuugguuaaagcucaaggaaaaacaagaugcauuuugcgauagcaaacucaugucagcugcuauaaaagauaauagagcaguucaugcugauaugggguacuggaucgaaagcgcgcucaaugauacguggaaaaucgaaaaagcaaguuucauagagguuaaaaauugccauuggccaaagucucacacacuuuggaguaacggaguauuagaaucugaaaugauaauaccgaaaaacuuggcaggaccggucucccaacauaauuaucggccgggguaucauacacaaaucgcugggccuuggcacuuggguaaacuagaaauggauuucgauuuuugugacgguacaacaguaauaguuacagaagacuguggaaacagaggaccaaguuuaagaaccacaacugccucagguaaauuaauaacagaaugguguuguagaagcugcacacuuccaccguugagauauagaggcgaggacggauguugguacggaauggaaauuagaccuuuaaaagaaaaggaggaaaacuuggugaacagccuugugacagcuggacauggacagguagauaauuuuagucuagguguacuuggaauggcacuguuucuggaggaaaugcuacgcacacggguugguacaaaacaugccauccuauuaguggcgguauccuucguuacucucauaacuggcaacaugucauucaaggaucuaggccgagucguuguaaugguaggggcgacgauggcugaugacauaggcaugggugugaccuaucuagcuuuacuagcggcauuuaaagugagaccuacauuugcugcgggguuauuauuaagaaaacugacuucaaaagaacuuaugaugacaacuaucgggaucguucuacuaucgcaaaguacaaucccugaaacugugcuagaauuaacagaugcucuagcacuaggaaugaugguacuaaaaauuguacgcaauauggagaaauaucaacuggcagugacgauuauggccauacugugcgucccuaaugcuguaauuuugcaaaaugcauggaaaguaaguugcacgauucucgcuguaguuucaguaucaccccugcugcuaacaucgucccaacagaaaacggacuggauaccccuggcucuuacuauaaaaggccuaaacccgacggcuauauuucuaacaacguuaucacguacuaauaagaaaaggucauggccacuuaacgaagcuauuauggccguugggaugguaucaauacuggcaagcaguuuacucaaaaacgauaucccuaugaccggaccucuaguagcggguggauuacugacaguuugcuauguuuuaacggggcguucagcagauuuagaauuagagagagcgacagauguaaaaugggaagaccaggcugaaauuagcggaucgagcccuauacuaaguaucacaauaagcgaggacggaucgaugaguaucaaaaaugaagaagaggaacagacuuuaacaauacuuauuagaaccggacuccuagugauaaguggauuauuccccauuaguauaccaauaacagcggcugcaugguauuugugggaaguuaagaaacaaagagcagggguguugugggacguccccucuccuccuccuauggggagagcagaauuagaagacggagcuuacagaauaaaacaaaagggaauacuuggguauagccagauuggagcaggaguuuauaaggaaggaacguuucauacaauguggcacguuacacguggagccguacuaaugcauaagggaaagcgaaucgaaccaaguugggcggacguaaagaaagauuuaauaaguuauggcggcggauggaaacuugagggugaauggaaagaaggagaagaaguucaaguauuagcacuagagccuggcaaaaauccaagagccguccagacuaaaccagguuuauuuaaaacaaauacaggcacaauaggagcugucaguuuggacuucucaccugggacaucugguucuccaauaauagauaagaaagguaaagucguuggauuauauggaaacggaguaguuacuagaucgggagcauauguaagcgcgauugcucaaacggaaaaaucgaucgaagauaauccagagauagaagaugacauauucagaaaaagaagacugaccauaauggaccuacauccuggggcgggaaaaaccaaaagguaccuaccagccaucguaagggaagcgauaaaacgcggacuaagaacuuuaauuuuagccccaacgagagugguagcugcagaaauggaggaagcacuaagaggacuuccaauucgcuaccaaacaccagcaauaagagcggaacauacagguagagaaauugucgaucuaaugugucacgcgaccuuuaccaugaggcuacuaaguccuguaagaguuccaaauuauaaccucauaauaauggacgaagcccauuuuacugauccagcuagcauagcggcucguggauauauaucuacucgcguagagaugggagaagcagcaggcauauucaugacggcgacaccgccgggcucuagggaucccuucccccagagcaaugcaccuauuauugaugaagagagagaaauccccgagaggucuuggaacuccggucacgaauggguaaccgacuuuaaggggaaaacugugugguuuguaccuucaauaaaagccggaaaugauauugcagccugcuugagaaagaauggcaaaaaggugauucaauugucgcgaaaaacauucgauagugaguauguuaaaacccgaacgaaugacugggauuuugucguuacaacggauauaucagaaaugggagcuaauuucaaggcagaaaggguuauagaccccagaagauguaugaagccaguaauauuaacagauggagaagaacgagugauucuggcagguccgaugccaguuacacauuccagcgcagcucaacgaagagguagaauaggucgaaaucccaaaaacgaaaaugaucaguauauauauaugggagagccgcuggagaacgaugaggacugcgcacacuggaaagaggcgaaaaugcuucuugauaauaucaauacacccgaaggcauuaucccaaguauguuugaacccgagcgugaaaagguagacgcuauugacggagaauauagauugagaggagaagcuaggaaaacuuuuguggaucucaugaggcguggugaucuuccuguuuggcuagcuuauaaagucgcugcugaagguaucaacuacgcagauagaaggugguguuuugacggaaucaaaaauaaucaaauacucgaagaaaacgucgaaguagagauuuggacuaaagaaggcgaaaggaagaaacugaagccccgguggcuagacgcacgaauauauucagacccacuggcgcuuaaagaguuuaaggaguucgcagcgggcagaaaaucuuuaacacucaaccuuauaacggagaugggacgccuuccaacauucaugacacagaaaacuagagacgcuuuagauaacuuagcaguuuugcacacugccgaggccggcggucgcgcauauaaccaugcgcucucagaauuaccagaaacacuagaaacucuauuacugcuaacauuacuugcaacugucacagggggaauauucuuguuuuuaaugaguggaaggggcaucgguaaaaugacauuggguauguguuguauaauaacagcuucgauuuuacuaugguacgcccaaauucaaccacauuggaucgcagcaagcauuauacuugaguucuuuuuaaucgucuuguuaauucccgaaccagaaaaacagagaacuccccaggacaaucagcugacauaugucguuauugcaauccucacaguaguggcggccacuauggcaaaugaaaugggauuuuuagagaaaacaaagaaagacuuaggucugggaucgaucgccacgcaacagccggaaucaaauauccuggacauagauuuaagaccugcuagugccuggacucucuacgcgguugccaccacuuuuguuaccccaaugcuuagacacaguaucgagaacaguaguguaaacgucucauugacggcgauagcuaaucaggcgacaguucuaauggggcucggaaaagguuggccauugagcaaaauggacauaggaguuccucucuuagcaauaggauguuacucacagguuaacccgaucacgcuaacagcggcacuauuguugcuagucgcccauuaugcaauaauaggcccaggccuucaagcaaaagcaacgagagaggcacaaaagagagcagcugcagguauaaugaaaaauccaaccguugauggcauaacagucauagaccucgaucccauuccguaugacccaaaguuugaaaagcaguuaggccagguaaugcuccuaaucuuaugcgugacacaaguacuaaugaugcgaacaacaugggcacuaugugaagcguuaacacuagcuacuggaccgauuucgacguuaugggagggcaacccaggaagauucuggaacacuacgauagcagugucuauggcuaauauauucagaggaagcuacuuggccggugcuggcuuguuauuuuccauuaugaaaaacacaacaaacacacgucgagguacagguaauaugggugaaacacuuggagagaaauggaaaucaagacugaacgcuuuaggaaaaucggaguuccaaauuuauaagaaaagcggcauucaagaaguagauagaacgcuugcaaaggaggggauaaaaagaggagaaacagaucaucacgcaguaucaagaggaucugcaaaacuacggugguucgucgaacggaauaugguuaccccagaaggcaagguaguggaucuaggaugugggaggggcgguuggucguauuacugugguggucuaaagaacgucagggaaguaaaagggcugaccaaaggcgggccagggcaugaagaaccgauuccaaugucaaccuacgguuggaauuuaguaagauugcaaagcggcguagacgucuucuucauaccuccugagaaaugugacacgcuacugugugacauuggagagucgucaccgaacccgacaguugaagcuggccgaaccuuacgagugcuuaacuugguagaaaauugguuaaacaacaauacucaauuuuguauaaaaguucuuaaucccuacaugccaaguguuauagagaaaauggaagcgcuacagagaaaauauggaggggcccuagugaggaauccacucucuagaaauucaacccacgaaauguauuggguaucgaaugcauccggaaacauugucagcucaguuaauaugauaucacguauguuaaucaacagauuuacgaugaggcauaagaaggccacguacgaaccugauguggaucuuggaucagguacacgaaauauagggauagagucggaaacuccuaaccuagacaucauagguaaacgcauugagaaaauuaaacaagaacaugagacaagcuggcacuacgaccaggaccauccuuauaaaacuugggcuuaccauggaagcuacgaaaccaagcagacgggaucugcaucuucaaugguuaauggcguaguacguuuacucacaaaaccuugggauguacuaccgacgguaacacaaauggccaugacagauacaacaccauucggacaacagcguguauucaaagaaaaaguagauacaagaacacaagagccuaaagaaggcacuaagaaauugaugaaaauuacugcggaauggcucuggaaggaauuagguaagaagaaaacgccacggaugugcacacgcgaggaauuuacuagaaaggugaggaguaacgccgcguuaggagcgauuuucaccgaugaaaauaaauggaagucugcaagagaagcaguugaagacagccguuuuugggagcuaguagacaaagaacguaaucugcaucuugaagguaagugcgaaaccugugucuauaacaugaugggcaaacgagaaaagaaacuaggggaauuugguaaagcuaaaggcagucgugcgaucugguauauguggcucggugcaagguucuuagaauuugaggcgcuggguuucuuaaaugaagaccauugguuuucaagggagaacucucugaguggcguagaaggagaaggccuacauaaauuaggauauauauugcgugaugugucaaagaaggaaggcggagcaauguaugcugaugauaccgcagguugggauacgcggauaaccuuagaggaucugaagaaugaagaaaugguuacaaaccauauggagggagaacacaagaaacucgcagaggcuaucuuuaaguugacguaucaaaauaaaguagucagaguccaaagaccaacaccucggggaacugugauggacauaauaucucgacgugaucagagagguagcggccaaguagggacauauggguuaaauacauuuacuaauauggaagcacagcuaauccgucagauggaaggcgaagggguauuuaagaauauccaacauuuaacagccacggaagaaguagcgguacaaaauuggcuugcgagagucggucgugaacgacuaucuaggauggcuauaucaggagaugauuguguuguuaaaccgcuggaugauagauuugccaaugcucuuaccgcgcucaacgauaugggaaaaauucgaaaggacauccaacaaugggaaccuuccaaaggauggaaugacuggacacaaguuccuuuuugcucacaucauuuccacgaacuuauaaugaaggacggucguguucuggucgugccuugucgaaaccaggacgagcuaauaggucgugcgcgaaucagucaaggagcuggcuggagucuucgggaaacggcauguuugggaaaaaguuaugcucaaauguggucucuuauguacuuucaccgcagagaccuaagacucgcggcaaaugcaaucuguucggcuguaccaucacacugggugccuacaucacggacaacuuggaguauacaugcuaaacaugaauggaugacaacagaagauauguuaaccguguggaaucgaguauggauaagagaaaauccauggauggaagacaaaacaccaguagaaaguugggaggagauaccuuacuuaggcaaaagagaagaucagugguguggaagccugaucggauuaaccaguagagcaacaugggccaaaaacauacaaguagccauaaaucaaguaagaucacucauugggaacgaagaauacacagauuauaugccuucgaugaaaagauuuaggcgcgaagaagaagaagcaggaguacuaugguaa

SEQ ID NO: 22683 - RNA, 9876 nt, Artificial Sequence
  derived and/or modified CDS sequence (opt6) from DENV-2__EU677149__SS-prME
uccgcugggaugauaauuaugcuaauacccacuguuauggcauuccaucuaacuacuagaaacggagaaccucacaugaucguagguauucaagaaaaaggaaaaaguuuacuauucaaaacggaggaugggguuaauauguguacauuaauggcuauggauuugggagagcuuugugaggauacuauaacauauaaaugcccauugcuuaggcaaaaugagcccgaagacaucgauugcugguguaacucgacuucaacuuggguaacauauggcacuugcacgacuacaggggaacauaggagagaaaaacgaucaguagcacugguaccucaugugggaauggguuuagaaacucgcacugaaacauggaugagcucagaaggagcauggaaacacgcgcaaagaauugaaacguggauuuuacgacauccaggauuuacuaucauggcggcuauacucgcauacacaauaggcaccacacacuuccaaagaguacuaaucuuuauacuuuuaacagcuguagcaccuaguaugaccaugagguguauaggaauaucgaauagagacuuuguggagggagugagcggggguucguggguugauaucgucuuggaacauggaaguugcgucaccacgauggcuaaaaauaaacccacacuagauuuugaauugauuaaaacagaggcaaaacaaccggcaacauuacgaaaauauuguauagaggcgaaguugacaaacacaacaacagaaucacguugcccuacacaaggagagccaucacuuaaagaagaacaagacaaaagauuuguaugcaaacacaguaugguugacagagguuggggaaauggauguggauuauuugguaaaggcgggaucguuacaugugccauguuuaccuguaaaaagaauauggaagggaaaaucguucaaccggaaaacuuggaguauaccauuguaguaacaccgcacucgggagaggaacaugcgguaggaaaugauacugggaagcauggaaaggaaauaaaaguaaccccacaaucaagcauuacagaagccgaauugacaggauacggcacaguaacgauggaaugcaguccaagaacagggcuagauuucaaugaaaugguauuauuacaaauggaaaauaaggcuuggcucguacacagacaaugguuuuuggacuuaccauuaccgugguuacccggggcagauaaacaagagagcaauuggauacaaaaagaaaccuuaguaacauuuaagaauccucacgccaaaaagcaagaugucguaguccuagguucacaagaaggugcaaugcauacggcgcuaacaggcgcaacggaaauucaaaugagcuccgguaacuuacuuuucaccggucaccucaaauguagauugcgaauggacaaguuacaauuaaaaggaaugucguauucaaugugcacaggaaaauuuaaaguaguuaaagaaauugcugaaacgcaacauggaaccauugucauaaggguacaauacgaaggugauggaagcccguguaagauuccauuugaaauuauggaucuugaacguagauauguccuuggacgauuaauuacuguaaauccaauagugacggagaaggauaguccuguaaacauugaagcagaaccacccuuuggcgauucauauauuauuaucgggguagaaccgggacaacugaaacuuaauugguuuaagaaagguaguaguauaggucaaauguuugagacaacaaugcgaggagcaaaaaggauggcaauucucggagauacggccugggacuucggaagucuaggcgggguauuuaccagcaucgguaaagcguuacaccaaguauucggggcuaucuauggagcggcuuucaguggagucagcuggacuaugaaaauacuuauuggaguaauuauaacuuggauaggcaugaacagucgcucuacaaguuuaaguguaaguuuagugcuuguuggaaucguaacacuauacuuggguguaaugguucaagccgacagugguuguguugucucguggaaaaauaaagaauuaaaaugcgggagugguauuuucauaacugauaauguacacaccuggacagaacaauauaaauuucaaccagaaagcccgagcaaacuugccagugcuauacagaaagcucaagaagaaggaauuugcgguauucgaucaguaacaaggcuagaaaaccuaauguggaaacagauaaccccggaacuuaaucacauacuagcugaaaacgaaguaaaguuaaccauuaugacgggugauaucaaagggauaaugcaggcuggcaaacgaaguuugcggccgcagccaacagaacuaaaauauaguuggaaaacguggggcaaagcgaagaugcuaucaacugaaucauauaaucagacauucuuaauagacgguccagagaccgcagaaugcccuaacacaaacagagcguggaacucauuggaaguagaagacuauggauucggcguuuuuacuacaaauauauggcugaaacuuaaagaaaaacaagacgccuucugugauaguaaauuaaugagugcugccaucaaagacaauagagcuguucacgcagauaugggguacuggauagagagugcuuugaaugacacuuggaagauagagaaagcaucguuuauugagguuaagaacugccacuggcccaaaagucacacacuguggucaaauggaguauuggaaagugaaaugauaauaccgaaaaauuuagcgggaccgguaucgcagcacaauuacagaccaggauaucauacacaaauagcuggcccauggcaccuagggaaacuagaaauggauuuugacuucugugauggaacgacgguaauaguaacugaggacugcgguaaccgcgguccaucguugagaacuacaacugcuuccggaaaacucaucacggaaugguguugccguucgugcaccuuacccccauugagguauagaggugaagauggcuguugguaugggauggaaauaagaccccucaaagaaaaagaagaaaaccugguuaacucuuuagucacugcuggucacggucagguagauaacuuuagccuaggaguucugggaauggcccuauuuuuagaagaaauguuaaggacacgaguagguacuaagcaugcaauucuucuuguggcagucucuuuuguuacucuuaucacaggaaauaugucauucaaggaucuagggagggugguuguaauggugggcgcaaccauggcagacgacauagguaugggcgugacauaucucgcgcuacucgccgccuuuaaaguccgccccacauuugcagcggggcuauuguugcgcaaacuuacuucaaaagaacuaaugaugacuaccauaggcaucguccuguuaucucaaagcacaauacccgaaacgguucuggaacucacagaugcucuagcacucggaaugaugguacugaaaaucgucagaaacauggaaaaauaccaacucgcaguaacaauuaugacuauuuuaugcgugccuaacgccgugaucuugcagaacgcauggaaaguuaguuguacgauacucgcagucgucaguguuucaccacuucuauuaacaucaucccgccagaaaacagauuggauaccuuuagcguuaacaauaaaaggacuuaacccaacggcgaucuuccucaccacacuuuccagaacaaauaagaaacgaucguggccacuaaaugaagcuauaauggcaguaggaaugguaucuauacucgcaucuucccuacucaaaaaugauauuccaaugacaggcccacucguagcgggagguuugcuaacaguguguuaugugcuaacaggaaggucggcagacuuagaauuagaacgugcgacggaugucaaaugggaggaucaagcagaaauuucagguagcagcccuaucuugagcauuacuauuucagaggacgguucaaugaguaucaaaaaugaagaagaagaacaaacucuaacgauauuaauuagaacgggccuguuagugauaucgggguuguucccaauaucgaucccaauuaccgcugcagcaugguaccugugggaagucaagaaacaacgggcaggaguuuuaugggacgugccaagcccuccaccaaugggaaaagccgaauuggaagacggcgcuuaucguauaaaacaaaagggaauauugggauauagccagauaggugcagggguguacaaagaagguacauuccauacaauguggcacguuacaagaggagcgguucuaaugcauaaagggaaacggaucgaaccaucaugggcugauguaaagaaggacuuaauuucauacggaggaggauggaaacuagaaggugaauggaaagagggagaagagguacagguauuagcauuggaacccgguaaaaauccaagagcgguucaaacuaaaccuggacuguucaaaacaaacaccgguacaaucggugccgugucccucgauuuuucaccugguacaagugguaguccgauaauugauaaaaaggguaagguugucgggcuguauggcaacggugucguuacaagaucuggugcauaugucucagcuaucgcccaaacugagaaaucuauagaggacaaccccgagauugaagaugacauauucagaaaaagacguuuaacuauaauggaucuacauccaggagcaggcaaaaccaaaagauacuuaccagcaauaguuagagaagcaauaaaacgaggacugcgcacccuaauucuugcgccuacucgaguuguagcagccgagauggaagaagcgcuccguggauugccaauaagauaccagaccccagcaaucagggcagaacauacgggacgggaaauuguagaccuuaugugucaugcuacauuuacgaugagauuacucucgccgguucguguaccgaauuauaaccuuauaauuauggaugaagcacauuuuacggauccagcuucaauugcagcgcgaggauauaucagcacaagaguagaaaugggagaagcagcgggaauauuuaugaccgccacgccaccagggucacgagaucccuuuccacagucaaacgcaccaaucauugaugaagaaagggaaaucccagaacguaguuggaacucuggacaugaaugggugaccgauuuuaaagggaaaacggucugguuuguccccucgaucaaagcuggaaaugacauagcagcaugcuuaagaaagaauggcaagaaaguuauccaacuaagccgaaaaacauucgauucugaauauguuaaaaccagaacuaaugauugggacuuuguaguaacaaccgauauuucagagaugggggcaaauuuuaaagccgagcguguaauugacccuagaagauguaugaaacccgugauacucacggacggcgaagaaagagugaucuuagcaggaccgaugccagucacacauucgagugcagcucaaagaagaggcaggauaggucggaaucccaaaaaugagaaugaucaauacauuuacaugggugaaccguuagaaaaugaugaggauugugcucacuggaaagaggcgaaaauguuacuagacaacauuaacacuccugaaggaauaauaccaaguauguucgagccagaaagagaaaagguagaugcgauagacggagaguaccggcugaggggcgaagcacgaaagacuuuuguagauuuaaugagaagaggagaucucccaguauggcuugccuauaagguagcagcagaaggaauaaauuacgcagauagacgcugguguuuugacggaaucaaaaacaaucaaauccuggaagagaauguagaaguagagaucuggacuaaggaaggugaaagaaagaaauuaaaaccaaggugguuagacgcaaggauuuauucggacccauuagcucucaaggaguucaaggaguucgcagcagguagaaagucacuuacccuuaaccuuauuacagaaaugggccgacuuccgacuuuuaugacacagaaaacaagagaugcauuagauaacuuggcgguccuacauacggcagaagcagggggcagggcuuauaaccaugcccuauccgagcuacccgagacucuagaaacauuauugcuguuaacauuguuggccacgguaacagguggaauauuuuuauucuugaugucagguagggggauagggaaaaugacuuuggguaugugcugcaucauaaccgcuagcauauugcucugguacgcucaaauacaaccucacuggauugcagcaagcauaauccuagaguucuuccuuauagugcuccugauaccagaaccggagaaacaacgcaccccacaagacaaccagcuuacuuauguaguuauagcuauacucacaguaguagcagccacaauggcaaacgaaaugggauuuuuagagaaaaccaagaaagacuuaggccugggaucaauagcuacacagcagccagagaguaauauucuagacauugaccuaagaccggcaucagcuuggacucuauaugcaguagcuacgaccuuuguuacuccgaugcuuaggcacucuauagaaaauucaucuguuaacguuucacuaacagcaauagcuaaucaagcuacaguacuuaugggacuaggaaaaggauggcccuuaagcaaaauggauauaggaguccccuuguuagccauaggauguuauagccaaguuaacccaauuacauugacagcagcauuacuccuacuuguggcucacuacgcgauaaucggcccuggucuccaggcgaaagccacgcgugaagcucaaaaacgagcugccgcaggcauuaugaagaacccgacuguagaugguauaacagugauagauuuagacccuauaccauacgauccaaaauucgaaaaacagcucggucagguaaugcucuugauacuauguguaacgcaaguuuugaugaugcgaacaacaugggcauuaugugaggcuuuaacacucgcaacgggaccaauaucaacgcuaugggagggaaacccaggacgcuucuggaacacuacgauugcaguaucgauggccaacaucuuuagagggucuuaucucgcaggagcaggacugcuauuuuccaucaugaaaaauacuacgaacacacguagggggacaggaaacaugggggaaacauuaggcgaaaaauggaaaagccgccucaaugcguuagguaaaucugaguuucagauuuacaagaaaucaggcauucaagaaguagacaggacauuagcaaaagaagguauuaaaagaggggaaacugaccaucaugccguuuccagggguucugcuaaacuaagaugguucguagaaagaaauauggucacacccgaaggaaaaguuguagaucuuggcuguggucgaggaggauggucauauuacugcggggguuuaaagaauguacgugaggucaagggucuuaccaaaggugggccugggcaugaagaacccauaccaaugucuacguauggauggaaccucgugcgauugcaaucaggaguagacguauucuuuaucccgccagaaaaaugugauacacuauuaugugauauuggagaaaguucuccuaauccgacuguagaagcaggacgcacauuaagaguauuaaaccucguggaaaacugguugaacaauaacacacaauuuugcauaaaaguucucaaccccuauaugccaagcguaauagagaaaauggaagcccuucaaagaaaguacggcggugcucuugugagaaauccacugucgagaaacucaacgcaugaaauguacugggucucuaaugcaucuggcaauauuguaucaucaguuaauaugauaagucgaauguuaauaaaccgauuuacuaugcggcacaagaaagcuacauacgagcccgacguugacuuaggcucagguacaagaaauauagggauugaaagcgagauacccaaucuagacauuauagguaaacggauagaaaagauaaaacaggaacacgaaacaucuuggcauuaugaucaggaccaucccuauaaaacaugggcguaccaugguucuuacgaaacaaaacaaaccggaagcgcuucgucaaugguuaacgguguagucagauugcucacaaaaccaugggaugucuuaccuaccguuacacagauggccaugacugauacaacacccuucggccaacaaagaguauuuaaagagaagguggacacgagaacacaggaaccaaaggaagggacuaaaaagcuaaugaaaaucacagcggagugguuauggaaagaacuaggcaagaagaaaacuccuaggauguguacaagagaagaguucacucguaaagugaggagcaacgcugcucugggagcgauauucacggaugaaaauaaauggaaaucagccagagaagccguagaagacagcagauuuugggaacuuguggacaaagagagaaacuuacacuuagaagguaaaugugaaacuuguguauauaauaugauggguaaaagagaaaagaaauugggugaauuugggaaagcgaaagggucacgcgcuauuugguacaugugguuaggagcaagauuccuagaauuugaagcacugggauucuuaaacgaagaucauugguuuagccgugaaaauucgcucucggggguagagggagagggucuccauaaacuuggguauauccuuagagauguaucaaagaaagaaggaggagcaauguaugccgacgauacugcggguugggacacgagaauuacucuagaggaucuaaagaaugaagagaugguaacuaaccauauggaaggcgaacauaagaaauuagcagaagcaauauuuaaacuaacauaucagaauaaaguaguacgcguacagcgcccaacgccucggggaacaguuauggauauuaucucaagaagagaccagcgaggaucgggccaaguaggaaccuacggacuaaacaccuucacuaacauggaagcacaacuaauuagacaaauggagggggaagggguauuuaaaaauauucagcaccugaccgucacggaagaaguugcuguucaaaacuggcucgcacgagugggacgagaaagauuaagcaggauggcuauaaguggggacgauuguguuguaaaaccauuagaugauagauucgcaaaugccuuaacugcucuuaaugacaugggcaaaauuaggaaagacauucaacaaugggaaccuucaaaaggauggaaugacuggacccaaguucccuucuguucccaucauuuucacgaacuaauaaugaaagacgguaggguacucguaguaccaugcagaaaucaagaugaauuaauuggucgagcacgaauuagucaaggggcugggugguccuugcgagaaacagcgugcuugggcaagucguaugcgcaaaugugguccuuaauguacuuccacagacgugaccucagguuagcagcgaaugcaauuuguagugcagucccuucucauuggguuccaacaucccgaacuacauggucaauccacgcaaaacaugaguggaugacaacugaggauauguuaacuguuuggaauaaaguauggauaagggaaaauccauggauggaggauaaaacucccguugaaaguugggaagaaauuccauaucuaggaaagcgcgaagaucagugguguggcucacuuauugguuugacgucacgagcaacgugggcgaaaaacauacaggcagcaaucaaucagguaagauccuuaauaggaaaugaagaauauacugauuacaugccaaguaugaagcgauucagaagagaagaggaagaagcaggaguacuuugguaa

SEQ ID NO: 22684 - RNA, 9876 nt, Artificial Sequence
  derived and/or modified CDS sequence (opt6) from DENV-2__FJ024452__SS-prME
agcgcagggaugaucauuauguuaauaccgacggucauggcauuccacuuaacaaccagaaauggggaaccucauaugauaguuggaauucaagaaaaaggaaagagucuacuuuucaagacggaagauggcguaaauaugugcacucuaauggcaauggacuugggagaacuaugcgaagacacaaucaccuauaaaugcccgcuuuuaagacagaaugaaccagaagacauugacugcugguguaacucuacuaguacauggguaacuuaugggacguguacuacaacugguggacacagaagagaaaaacgcucuguagcauuaguaccacauguaggcauggggcuagaaacaagaacagaaacauggaugagcagcgaaggggcguggaaacacgcgcagagaauugagacuuggaucuuacggcauccaggcuucacuauaauggcagcaaucuuagcguacacuauagggacaacacacuuccaaaggguauuaauuuucauacuucuaacugcaguggcuccaucaaugacaaugagguguauagguauaucaaaucgagauuucgucgaaggugugaguggcggcucauggguagauauuguacuagaacaugggaguuguguaacuacuauggcgaagaacaagccgacacuagauuuugagcuuauuaaaacagaggcaaagcaaccugcgacacuaagaaaguacugcauagaagcgaaauugacgaauaccacuacggaaagccgcugcccuacccaaggagaaccuagccugaaggaggaacaagacaaaagguucauuuguaaacauucaauggucgaccggggauggggaaauggauguggucuuuuuggcaaaggcggcauagucacaugcgcuauguucacauguaagaaaaauauggaggggaagauaguucaaccagagaauuuagaguauaccaucguugucacaccucacucgggagaagaacacgccgucggaaacgauacaggcaaacaugggaaggaaauaaaggugacuccgcaguccagcauuaccgaagcagaauuaacaggguaugggacaguuacaauggaguguaguccaagaacuggcuuggauuuuaacgaaauggucuuacuucaaauggagaacaaagcauggcucguacaccgacaaugguuucuggaucuaccauuaccaugguuaccuggcgcugacaagcaagaaagcaauuggauccaaaaggaaacacuaguuaccuucaaaaauccacacgcaaaaaaacaagaugucgugguacuagggucacaagagggagcgaugcacacugcuuuaacaggagcuacagaaauucaaauguccaguggaaaucuacuauucacuggacaucugaaguguagacugagaauggacaaauugcaauuaaaagggaugucauacucuauguguacagguaaauuuaagguuguaaaggagauugccgagacacaacacggaacaaucguaaucaggguacaauaugagggagaugggucaccgugcaagauaccauuugagauuauggacuuagaaaaaagauauguucuaggaagauugauaacagucaacccgauaguaacugaaaaagacucaccagugaacauagaagcagaacccccuuuuggagauagcuacauaauaauaggcguggaaccuggucagcuaaaacuaaauugguuuaagaaaggaaguucgauaggacaaauguuugaaacaacaaugagaggugcuaaaagaauggccauucugggagauacggcuugggauuuuggaucauuaggcggcgucuucacgucaauagguaaggcccuccaucaaguauuuggggcaauuuacggagcggcguuuucuggagucagcuggacgaugaaaauacugauagggguaaucaucacauggaucggcaugaacuccagaucuacgucucucagcguaagcuuggugcuaguugggauuguaacucuguacuuaggagucaugguccaagcagauagcgguugcguagugaguuggaaaaauaaggaauuaaaauguggaucaggaauauuuauuacagauaacguacacaccuggacugaacaauauaaguuucagccugaaaguccuucaaagcucgcaucagccauacaaaaagcccaggaagaagguauuugugggauacgaagcguuacacgucucgaaaaucuaauguggaaacaaaucaccccugaauugaaccauauccucgcggagaacgaaguaaaguugacgauaaugacgggagauauaaaaggaauaaugcaggcggguaaaagaucacuucguccucaaccaacugaacuuaaauauuccuggaagacuugggggaaagcuaaaauguuaagcacagagucuuacaaccagacguuccuaauugaugguccagaaacagccgaguguccuaauacuaaucgagcuuggaacagccuggaaguugaagauuauggguucgggguguuuaccacaaauauuuggcuuaagcuaaaagagaagcaagacgcuuuuugcgacucaaaguugaugagcgccgcaauaaaagauaauagagcuguucacgcagauaugggguacuggauagagucagcauuaaaugauacuuggaaaauagaaaaggccuccuucauagaagucaagaauugucauuggccaaagucacauacauuguggucaaaugggguauuagaaucagagaugauaauacccaagaaccuagcgggcccagucucccaacacaauuacagaccgggauaucauacacagauugcaggcccuuggcaccuagggaagcuagaaauggauuuugacuuuugugaugggacuacagucauagucacggaagauugugggaaccgaggccccaguuuacgcacaaccacagcuaguggaaaacugauaacugaauggugcuguaggucgugcacauuacccccccuaagauacagaggugaagacggcugcugguaugguauggaaaucagaccucuuaaggaaaaagaagaaaacuuaguuaauucacugguuacugcugggcaugggcaaguugacaauuuuagucuaggaguacugggcauggcgcuauuucuugaggaaauguugaggaccagagugggaaccaaacaugcgaucuuacuaguggcagugaguuuugucacguuaaucacuggcaacaugaguuuuaaggauuuaggccgagucgugguaaugguuggggcgacaauggcagaugacauagguaugggagucacguacuuagcacucuuagcagcguucaaaguacgucccacauucgcugcuggucuacucuuacgaaaauuaacgucaaaagaacugaugaugacaacaaucggaauaguucuacuaagucagucaacaaucccugagacaguacuggaguugacggaugcuuuagcacuagguaugauggugcugaaaaucguuaggaauauggagaaauaccaacuagcaguaacaauaauggcaauacucuguguucccaaugcagucauuuuacaaaacgcuuggaaaguaucaugcacaauucucgcugucgucagugugagcccucucuuauugacaaguucucaacaaaaaacagauuggaucccauuagcauuaaccauaaagggucuuaaucccacugccauuuuucugacuacccuaagcagaacuaacaagaagagaucguggccuuuaaacgaagcuauaauggcuguugguaugguuucgauacucgcauccagucuguuaaagaacgacauuccaaugacagguccccuaguggcagguggacuauuaacaguauguuaugugcuaaccggacgaagugcagaccuagagcuagaaagagcgacugauguaaaaugggaagaucaggcagagauaucaggaagcucgccuauauuaucaaucacgauaucugaagacggaaguaugaguauuaaaaaugaggaggaagaacaaacucuaacaauuuugauaagaacuggcuuauuaguuauaucgggauuauuuccaauaucaauaccaauaacugcggcggccugguaucuaugggaagugaaaaaacaacgcgcaggugucuuaugggacguuccuuccccgccuccaaugggaaaagcugaacucgaagacggagcguaucgcauuaagcaaaaagguauauuaggauauagccagauaggagcuggaguauauaaggaaggcacauuucacacaauguggcacgugacacggggagcaguucuaaugcauaaaggaaaacgaauagaaccaucgugggccgacgucaaaaaagauuuaauaucauaugggggaggcuggaaacuagagggcgaauggaaagaaggcgaggaaguccaaguuuuggcacuagaacccggaaaaaauccacgugcaguccaaaccaagccaggucuauuuaaaaccaauacagggacaauuggggcugugucucuugauuuuucacccggcacgucaggcucuccaauaaucgacaaaaaagguaaaguagucggccucuacggaaacggaguaguaacacgaaguggagcauaugucagcgccaucgcacaaacagguaaaucgauugaagauaacccggaaauugaagacgauauauucagaaagagacgacuuacgauuauggaccuccacccaggagcaggaaaaacaaaaagauauuugccggcaaucgugagggaagcgauaaagagaggacugcguaccuuaauuuuagcaccaacaagaguagucgcugcggaaauggaagaagcucuacgaggucuaccgauuagguaccaaacaccagcgauaagggcugaacauacgggaagggaaauaguagaucucaugugccaugcaacguuuaccaugagacugcuauccccuguacgcguaccaaauuacaaucuaauuauaauggaugaagcucacuuuacagacccggcgagcauagcggcaaggggauauauaagcacacgaguagaaaugggagaggcagcgggaauuuucaugacagcaacaccaccgggaucuagagacccauucccccaaaguaaugcaccuauaauagacgaagaaagagaaauuccagaaagaaguuggaacaguggccaugaaugggugacagacuucaaagguaagacaguuugguuugucccaaguauaaaggcaggcaaugacauagcagcauguuugcgaaaaaacggaaaaaaaguuauucaacucucaagaaaaacuuuugacucggaauauguaaagacacgaauaaaugacugggauuuuguaguaaccaccgauauuagugaaaugggagcaaacuucaaagcagagagaguaauugaccccagaagauguaugaaaccggugaucuuaaccgacggcgaagaaagaguaauacuggcaggaccaaugccaguaacucauucuucggccgcucaacgacguggaaggauagggcgaaacccuaaaaacgaaaacgaucaguacauuuacaugggagaaccuuuagaaaaugacgaagacugugcccacuggaaagaggcgaaaaugcuuuuagacaauauaaauacaccagaagggauaauacccucgauguuugaacccgagcgagaaaagguugacgcgauagauggggaauauagauuaagaggugaagcaagaaaaacguucguugaucugaugagacgcggugaccuuccaguauggcuagcauauaaaguagccgcugaagguauaaauuaugcagaucgaagguggugcuucgauggaauuaagaauaaccagauccuggaagaaaacguagaaguagagaucuggacaaaggagggagaacgaaaaaaauuaaaaccgcgauggcucgaugcaagaaucuauucagacccuuuagcacuaaaagaguuuaaggaguucgcugccggaagaaaaucauugacacuuaaucuaauuacagagauggggagacuaccaaccuucaugacgcaaaaaacgagggacgccuuggacaauuuagcuguucuucauacugcggaagcaggcgguagagcauauaaccacgcgcucuccgaacucccugaaacacuggaaacguuauuacuccuaacccuauuagcgacaguaacaggaggaauauuccuauucuuaaugaguggaagggguauagguaaaaugacauuaggaaugugcuguauaauaacagcgagcauucugcuaugguaugcacaaauacaaccucauuggauagcggcaucuauaauauuagaguuuuuucugauaguguuacucaucccagagccggagaaacaacguacgccucaggauaaucaguuaacguaugucguaauagcgauacuaacaguaguugcagccacaauggcaaaugagaugggauucuuggaaaagacuaagaaagauuugggucugggaucaauagcuacgcaacaaccggaguccaauauccucgacauagacuuacguccagccucugcguggacuuuauacgcaguugcaacgacuuuuguaacuccuauguugaggcacucaauagagaauucaaguguuaaugucuccuuaaccgcuauagcaaaccaagccacgguucuuaugggccuaggaaaggguuggccauugucgaagauggauaucggagucccacuacuugcgauugguugcuauagucaaguaaauccuauaacuuugacugcagcucuguuauuacuaguugcacacuacgcuauaauaggucccggauuacaagcuaaagccacuagggaggcacaaaagcgagcugccgcuggaauaaugaaaaaccccacuguagauggaauaacaguuauugauuuagauccgauaccguaugacccgaaguucgagaaacagcuagggcaagucaugcuccuuauuuuaugcguaacgcaaguucuaaugaugagaacaacuugggcgcuaugugaagcacucacacuagcaacggggccuauuagcacccuaugggaaggaaacccggggcgguucuggaacacuaccauagccguaaguauggcaaacauauuuagaggcucauacuuggccggagcaggauuauuguucaguauaaugaaaaauacaacuaauacucgaagaggcacaggaaacauaggagaaacacuuggagaaaaauggaaaagccgguuaaaugcucuaggcaaaucggaauuucaaauuuauaagaaaucagguauacaagagguagauaggaccuuagcgaaagaagggauaaaaaggggagaaacagaucaucaugcagugucaagaggaucugcuaaacugcgaugguucguugaaagaaauaugguaacuccggagggaaaaguaguagaucucggguguggucguggugguuggucauacuacugugggggccugaaaaaugugcgagaaguuaaggguuugacaaaggguggaccgggccaugaggaaccgauaccaaugaguacuuacggauggaaucugguaagguuacaaucaggcguugacguuuucuucauaccuccugagaaaugugauacucuuuugugcgacauaggagaaaguaguccaaacccgacuguggaagccggacgaacacuacgaguauuaaacuuaguagagaauuggcuuaacaacaauacccaguucugcauuaaaguguugaauccauauaugccaagcgugauagaaaaaauggaagcucugcaacgaaaauacgguggagcgcuaguucgcaauccucuaucucguaacaguacgcacgaaauguauuggguuucaaacgccucggggaacaucguaagcaguguaaacaugauuuccagaaugcuuauuaaccguuuuacaaugaggcauaagaaggcuacauaugagccugauguagaccuaggauccggcacgagaaacauagggauugaaagcgaaaucccaaaucuagacauuauaggaaaacggauagaaaaaauaaaacaagaacacgaaacuaguuggcauuaugaucaagaccaucccuacaaaacaugggcuuaucauggaucguaugaaacaaaacaaaccgguagugcuucaagcaugguaaacgguguaguccguuuauuaacaaaaccuugggauguucuaccgacgguaacucaaauggcaaugacagacacaacuccguuuggacaacaaagaguauuuaaagagaaggucgacacaagaacucaagaaccuaaagaaggaacaaaaaaguugaugaagauaacagcagaauggcuauggaaggaacuagggaaaaaaaaaacuccaagaaugugcacacgggaggaauucacuagaaaggucagaagcaacgcagcacugggcgcuauauuuaccgacgaaaauaaauggaagagugcaagagaagcgguugaagauucuagauucugggagcuaauugacaaagagcggaacuuacauuuggaggggaaaugugagacguguguuuauaauaugauggggaaacgcgaaaaaaaguuaggggaauuuggaaaggccaaagguagcagggccauaugguauauguggcuaggugcacguuuccuggaauuugaagcacucggauuucuaaaugaagaucauugguucagccgggaaaauaguuugagcggcguagaaggagaagggcuacacaagcuaggcuacauucuacgagaugugucaaaaaaagagggaggagcgauguaugcagaugacacagcugguugggauacgcguauaaccuuagaggaccucaagaacgaagaaaugguuaccaaucacauggagggugaacauaaaaagcuagcagaagccaucuucaaauugacauaccaaaacaaggucguacgaguacaaaggccaacuccaaggggaacuguaauggauauuaucuccaggcgugaccaaagaggaagcggacaaguaggaacuuauggacucaacacauucacgaauauggaggcucaacuuauuaggcagauggaaggugaaggaguauucaagaacauucaacaucuaacuguuacagaggagguggcgguccaaaauuggcuagcacgggugggaagagaaagacuaagcaggauggcuaucagcggcgacgauuguguuguaaaaccuuuagacgauagguuugccaacgcgcucacagcguuaaaugauaugggcaagguuaggaaagauauacagcaaugggaacccagcaaggguuggaacgauuggacucaaguaccuuuuuguucacaccauuuucacgaacuaauaaugaaagauggaagaguuuuagugguuccuugucguaaucaagaugagcuaauugccagagcaaggauuucacaaggagcuggauggaguuuacgugagacagccugucucggaaaaaguuaugcucaaauguggagucuuauguauuuucaccgacgugaucuaagguuggccgcuaaugcuauaugcucagcugugccaucacacuggguaccuacuagucggacaacaugguccauacaugcgaagcaugaauggaugacaacugaagauauguugaccgucuggaacaggguauggauacgagagaacccauggauggaagacaaaacgccuguagaaagcugggaagaaauucccuaccuggggaaacgggaagaccaaugguguggauccuuaauaggacucacaagccgagccacaugggcgaaaaauauucaagcugcgaucaaucaaguaagaucacuaauaggaaaugaggaauacacggauuacaugccaagcaugaaacgauuuagacgcgaagaagaagaagcggguguacuuugguaa

SEQ ID NO: 22685 - RNA, 9876 nt, Artificial Sequence
  derived and/or modified CDS sequence (opt6) from DENV-2__FJ205877__SS-prME
agcgcaggcaugauaauuauguuaauaccaacaguuauggcauuccaccuaacuacacgaaacggugaaccgcacaugauuguagggauucaagaaaaagguaaaucauuguuguucaaaacggaagaugguguaaauauguguacccuaauggccauggaucuuggagaauuaugugaggauaccauuacguacaaauguccuuuacuacgacaaaaugaaccagaagacauagauugcuggugcaauucuacaucgaccuggguaacguacggcacauguacgacuacaggggaacaucggagggaaaaacgauccguugcucuuguaccucauguaggaauggguuuagaaacuaggacagaaacauggaugucguccgaaggagcauggaaacacgcgcaaaggauugaaaccuggauauuaaggcauccaggguuuacgauaauggcagccauauuggcguauacuauagguacgacacauuuccaacguguauuaauuuucauucuacuaacugcgguagcgccgucaaugacuaugagaugcauuggaaucagcaacagggacuuuguggaaggcguaucaggagggaguuggguagacauaguacuagaacaugguagcugcguaacaacuauggcgaaaaauaaaccaacauuagauuucgaacuaauaaaaacagaagcgaaacaaccggcgacucuucgaaaauauugcauugaagcuaaauuaacgaauaccacaacggaaucccgguguccgacacaaggugagccaagucuaaaagaagaacaagacaaaagguucguauguaaacacucgaugguagacaggggauggggaaauggcugcgguuuguuugguaaaggaggaaucgucacaugugcuauguuuaccuguaagaaaaauauggaggguaaaauuguacaaccugaaaaccuagaguacacuauaguuguaacgccacauuccggagaagaacaugcuguaggaaaugauacggguaaacacgguaaagaaauuaaaguuacaccacaaucgaguauaacugaggcagaauuaacggguuacgguacgguaaccauggagugcucuccaagaacaggacuggacuuuaacgaaauggugcuacuacaaauggagaacaaagcaugguuaguucauagacaaugguuucuugaucuuccccuuccauggcuaccaggagcggauaaacaagaaucuaauuggauacagaaagagacgcuaguuacuuuuaaaaauccacacgccaagaaacaagacgugguuguguugggaucucaagaaggcgcaaugcauacagcacuuacgggggcaacagagauacaaaugucaucugggaaucuucuuuuuaccggccauuuaaaguguagacuaagaauggacaaacuacaacuaaaaggcaugagcuacuccauguguacuggcaaauuuaagguagucaaagaaauagcugaaacacaacaugguacuauugucauuagaguacaauaugaaggagauggcucaccauguaaaauuccauucgagaucauggaccuagaacggagauauguacucggcagacuaaucacagugaauccuaucguaacugagaaagacaguccggugaauauagaagcagaaccaccauuuggugacucuuacauaauaaucggcguugagccaggacaacugaaacuuaauugguuuaaaaaggggucuagcauaggucaaauguuugaaacuacaaugcgaggagcaaagcguauggccauauuaggagauacugcgugggacuuugguucauuagguggcgucuuuaccuccaucggcaaggcuuugcaucaaguuuuuggagccauauauggugcugcauuuucuggggucagcuggacuaugaaaauccuaauuggagucauuauaacuuggauuggaaugaacagucgauccaccaguuuaucuguuucacuuguauuaguaggaauaguaacccuuuaccucggcgugaugguacaggcagacagcggauguguagugagcuggaagaauaaagaauugaaauguggaagcggaaucuuuauuacagauaacgugcauacuuggaccgaacaauauaaauuucaacccgaaucucccuccaaauuagcaucagccauacagaaggcucaagaggaaggaauuugcgggaucaggagcgugaccagauuagaaaaucuaauguggaagcagauuacgccagaacuuaaccacauauuagcagaaaacgaaguaaagcucacgauaaugaccggagacauuaaagggauaaugcaggccgguaaacguucguuacgaccucaaccgacugaacuaaaguauucuuggaaaaccuggggaaaagcaaaaaugcuguccacggaaucauauaaucaaacauuccugauagacggucccgagaccgcagaguguccaaauacuaaucgcgcuuggaauagucuagaagucgaggacuacggauuugguguuuuuacgacuaauauaugguugaaacuuaaagagaagcaagacgcguuuugcgacucaaaauugaugucugccgcuauaaaagauaaccgagcugugcaugccgauaugggauauuggaucgaauccgcauuaaacgauacauggaaaauugaaaaagcuaguuucaucgaggucaaaaauugucauuggccgaaaagccacacauuauggucaaauggaguauuagaaagugaaaugauaauucccaaaaaccuagcgggaccuguuucacaacacaauuaucgcccuggauaucauacacagauagccgguccauggcaucuggggaaauuagaaauggacuucgauuuuugugaugguaccacgguaauuguaacagaagauuguggaaacagaggcccauccuuaagaaccaccacggcuucuggcaaguuaauaacagagugguguuguagauccuguacauuaccuccauuaagauaucgaggagaagacgguugcugguaugggauggaaauaaggccacuuaaagaaaaagaagaaaaucuagucaauucucuagucacggcgggacauggacaagucgauaauuucagcuuggguguacuagguauggcuuuguuccuagaagagaugcuacguacccgcguggguacgaaacaugcaauucucuuaguagcagucaguuuugugaccuuaauaacuggaaauaugaguuuuaaagaucucgggagagugguuguaauggugggcgcaaccauggcggacgauauagggauggggguaacuuauuuagccuuacuugccgcauuuaagguucguccaacauucgcagcaggacucuuguuaagaaaacuuacaucaaaagaacugaugaugacaaccauuggcaucguauuacuuucgcaaaguacaauaccugaaacagugcuggaguuaacagaugcccuagccuugggaaugaugguauuaaaaaucgugcgaaauauggaaaaauaucaacuagcuguuaccaucaugaccauccuauguguacccaaugcagugauccuacagaacgcauggaaagucucaugcacaauauuagcuguuguaagcgugagcccguugcugcuaaccaguagucgucagaaaacagauuggaucccucucgcccuuaccaucaagggucuaaacccaaccgcaaucuuucuaacaacucuaagucgaacgaacaagaaacgaaguuggccacuuaaugaagcuauaauggcgguaggcauggugucgauccucgcaaguucauuacucaaaaaugacauuccgaugacagguccgcucguagcagggggccuauuaacgguuuguuauguccuaacgggaagaucagcagauuuagaacucgaacgcgcuacagauguaaaaugggaagaccaagcagaaauuucuggaagcucaccgauucuaucuauaacaauaucugaagauggauccaugucaauuaaaaaugaggaagaagaacaaacacuaaccauucuuauaagaacagggcuccuaguuaucucaggucuuuuccccauauccauaccgaucacugcugccgcaugguauuugugggaggucaagaaacaaagagcuggaguucuaugggacgugcccucaccgccuccgaugggaaaagcugaauuagaagauggagcauacagaauaaaacagaaaggaaucuuaggguauagucaaauaggugccggaguuuacaaggaaggaacauuucauaccauguggcauguuaccagaggugcaguccugaugcauaaagguaaacggauagagccuucaugggcggaugucaagaaagaccugaucucauacggcggaggauggaaauuggagggggaauggaaggagggugaagaaguucaagugcucgcgcuagaaccugguaaaaauccacgagcugugcaaacgaaaccaggauuauuuaaaacaaauacgggaacgauaggugccguuaguuuagauuuuuccccggguaccuccggauccccuauuauagacaaaaaggguaaggugguggguuuauauggaaaugguguaguaacuagaucgggagcuuauguaagcgcaauagcgcagacggagaaaaguauugaagauaauccggaaauagaggacgauauauuuagaaaaagacgucucacgauaauggauuuacacccaggagccggaaagacaaaaagauauuugccagccauagucagagaggcaaucaaaaggggacugagaacauugauacuggcaccuacgagaguaguagcagcagaaauggaagaagcccucaggggccuucccaucagauaucaaacgccggcaauucgggcggaacacaccggcagagaaauagucgaccuaaugugccacgcuaccuucacgaugaggcuccuguccccuguaagagugccgaauuacaaucuuauaauuauggacgaagcccauuuuacugaccccgcaagcaucgcagcacgaggauacaucucaacuagggucgaaaugggcgaagccgcagguaucuuuaugacagcaacuccaccugguucaagggacccauuuccccaaagcaaugccccgauuauagaugaagaaagggagauaccugagaggaguuggaacucuggacaugaauggguaacggauuuuaaaggaaagacugucugguuugugcccagcauaaaggcugguaaugacauugccgccugucuccgaaagaaugguaagaaaguaauucaacuaagccgaaagacuuuugacucagaguacguuaagacgagaaccaaugauugggauuuuguaguuacaaccgauauuagcgagaugggagccaauuuuaaggcagaaagaguaaucgaucccaggagauguaugaaaccugucauacugacagauggagaagaaagaguaauauuagcagguccgaugcccguaacgcauucaagcgcugcgcagaggaggggucgaauaggaaggaacccaaagaaugaaaaugaucaauauaucuacaugggggagccacuggaaaaugacgaggauugugcacacuggaaggaagcaaagauguuacuagauaacauuaauacaccagaagguauuauaccaaguauguucgaaccagaacgcgaaaaaguagaugcaauagacggagaauacagauugagaggcgaggcacguaaaacauucgucgaucuuaugagaagaggggaucuccccguuugguuagcuuacaagguugccgcagaaggaauaaauuacccugaucgucgauggugcuucgauggaauaaagaacaaucaaauuuuggaggaaaacguggagguagaaaucuggcccaaagaaggagaaaggaagaaauuaaaaccucggugguuagaucccagaauuuauuccgagccccgugcauuaaaagaauuuaaagaguuuccacccggacguaaaagccuuacuuuaaaucuaauaaccgagaugggcagacuaccaacguuuaugacucagaaaacaagagacgcacuggauaauuuggcaggacuacauacggcggaagcgggugguagagcugacaaucacgccuuaagcgaauuggcugaaacgcucgaaacauugcuccucuuaacguuguuggccacugggacaggcggaauauuucucuuucuaaugucaggaagagguauaggaaagaugacuuuaggcauguguugcauuauuaccgcuucuauucuuuuaugggacgcacagauucaaccgcauuggauugccgccaguauaauacuagaguucuuucuaaucguauugcucauaccugaaccugaaaaacaaaggacgccccaagauaaucaacugacauaugucgucauugcaauacucacugucgucggugcgacaaugcccaacgaaaugggguucuuagagaaaacaaagaaagaucugggacucggaucgauagcuacucaacaaccugagucgaacauacuagauauugacuuaagacccgcauccgcguggacguuauacgcaguagcaaccacauuugugacaccuaugcuuagacauaguauagaaaauuccucuguaaacgugagucuaacagcuauagcgaaucaagccacaguauuaaugggacuagggaagggaugggccuuagcuaaaauggacauuggggugccucuacuagguauaggguguuauucucaaguuaauccuaucacguugacaggggcccuacuauugcuaggcggacauuacgcaauaauaggaccaggcuuacaggccaaggcgacaagagaagcacaaaaacgcgcugcgcccggaauuaugaagaacccaacaguagaugguauuacuguuaucgauuuggacccaauaccuuacgaucccaaauucgaaaagcagcuaggacagguuauguuauuaauauuaugcguaacccaagucuugaugaugagaacuacgugggcccuuugugaagcguugacacuagcgaccggaccaauuucaacucuuugggaagguaacccgggacguuucuggaauacaacuauagcaguaagcauggcuaacauuuuuagggggucauaccuggcaggggccggccuauuguuuucuauuaugaaaaacacaacaaacacucgaagaggaacgggaaauaugggagaaacucuuggugaaaaguggaaaaguagacuaaacgcucuuggaaaaucagaauuucagauuuacaagaaaucaggcauccaagagguagaccggacucuagcaaaagaaggaaucaagcguggugaaaccgaccaccaugcaguaucaagggggagugcuaaacugcguugguuugucgaacguaauauggugacuccugaaggaaagguaguagaccuugguugugcaagagggggauggucauauuacugugguggccuuaagaauguaagagaaguaaagggauuaacgaaaggaggacccggacaugaagaaccaaucccuauguccacguacgguuggaacuuaguuagacuccaaagcggaguagacgucuucuuuauuccucccgaaaaaugugauacucuacugugugacaucggagaauccagucccaauccuacaguugaagcaggacgaacacuccgugugcuuaaucucguagaaaauugguuaaacaauaacacacaauuuuguauaaaaguauuaaauccauauaugccaaguguaauugagaagauggaggcacuccagaggaaauauggaggugcccuaguaagaaacccucuaucaagaaacaguacccaugagauguacuggguaaguaacgcaagugggaacauugucucaucaguuaacaugauaaguaggaugcuaauaaaucguuucaccaugaggcauaagaaagcaacauaugaaccugauguugaccucgguuccggaacaagaaauauagguauagaaucagaaauuccaaacuuagauaucauuggaaaacguauagagaaaauaaaacaagaacacgaaacaucguggcauuacgaucaagaccauccauauaaaacaugggcauaucauggaaguuacgagacaaaacagacagguucagcaagcaguaugguaaauggcguagugagacuacuuacaaagcccugggaugucuuaccuacggugacacaaauggcuaugacagacacgaccccuuuuggucaacaaagaguauucaaagagaagguggauacgcggacccaagauccaaaagaagggacuaagaaauugaugaaaauaacugcugagugguuauggaaggaacuaggaaagaaaaagacaccaaggaugugcacaagggaagaauuuacgcgcaagguuagaaguaacgccgcgcuaggugcuauauuuacggaugaaaauaaauggaaaagcgcacgugaagcuguagaagacucaagguucugggaauuaguagauaaggagcgaaauuuacaucuggaagggaaaugugaaaccuguguuuauaauaugauggguaaaagagagaagaaacucggugaauuuggcaaagcgaaagcaucgcgagcuauaugguauaugugguuaggcgcaagauuccuugaguuugaagcccuaggauuucugaacgaagaucacugguuuucucgagagaacuccuuaucuggcguagaaggagagggacuacacaaacugggauacauucuuagagauguaagcaaaaaggaagggggagcuauguacgcagacgauacggcgggaugggauacaagaauaacucuugaagaucuuaaaaacgaggaaaugguuacuaaccacauggaaggcgagcacaagaaacuagcagaagccauauucaaacucacuuaccaaaacaaaguuguacggguacaaagacccacuccaagagguacaguuauggauauuaucucgagaagagaccagagaggcucuggacaaguagcuacauauggcuugaauacauuuacaaauauggaggcacaacuaauaagacaaauggaaggcgaaggcguguuuaaaaauauacaacauuugaccguuaccgaagaagucgcaguacaaaauugguuggccagggucggccgagaacgucugcccagaauggcaauuucaggcgaugauugcguggugaaaccgcuagaugcacguuuugccaaugcucugacagccuugaacgcaauggguaagauaagaaaagauauacaacaaugggagcccaguaaagguuggaacgauuggacgcaaguucccuucuguagccaucacuuucaugaauuaauaaugaaagaugggagaguucuaguaguaccgugucgcaaccaagacgaacucauuggucgugcgaggauuucacaaggagccggcuggagucuccgagaaacagccuguuuaggcaaaagcuaugcgcaaauguggucgcuaauguacuuucauagaagagaucucagauuagcagcaaaugcaauaugcagugcaguuccaucacacuggguccccacaagcagaacaacauggucaauacaugccaagcaugaauggaugacaacagaggauauguuaacaguuuggaacaagguauggauaagggaaaauccuuggauggaggacaaaacaccagucgaaucaugggaagaaaucccauaucucggaaaacgugaagaccaauggugugguagccuuauuggcuuaacaagucgagccacaugggcaaagaacauucaagcagcaauaaaccagguuaggucucuuaucggcaacgaggaauauacagacuacaugccaucgaugaagcguuuccgaagagaggaggaagaagcggguguauuaugguag

SEQ ID NO: 22686 - RNA, 9876 nt, Artificial Sequence
  derived and/or modified CDS sequence (opt6) from DENV-2__FJ024454__SS-prME
agcgcgggaaugauaauaaugcuaaucccuacuguaauggcguuucauuuaacaacacguaauggggagccccauaugauuguuggaauucaggagaagggaaagucguuacuguuuaagacugaggauggagucaacaugugcacccucauggcuauggauuuaggagaacuuugugaggacacaaucacauacaaguguccccuucuccgacagaaugaaccggaggacauagacuguugguguaauucaacgucaacauggguaaccuauggaacuugcacaacaacgggagaacaccgacgagaaaaaagaucuguagcguuaguuccucacguagguaugggucuugagacgagaacagaaaccuggauguccucagaaggcgcguggaaacaugcccaaagaauugagacauggauacugagacaccccggauucacaauaauggcagcgaucuuagccuauacuauaggaacuacacauuuucagagaguacuaauuuucauacucuuaacagcaguugccccgagcaugacuaugagauguauuggaauaucaaauagggacuucguugaaggugucagugguggaucauggguugacauaguauuagagcauggaagcugcgucacaacuauggcaaaaaauaagccaacauuagauuucgaacugauaaaaacagaagcaaagcaaccggcuacccuucgcaaauacugcauugaagcaaaauuaacaaauacaacaacggaaaguaggugcccuacacagggggagccauccuuaaaggaggaacaggauaagagauuuguuugcaaacauucaaugguagauagaggauggggcaacggauguggauuauucgggaaaggcgguaucgugacuugugcaauguuuacuugcaagaaaaauauggaaggaaagauaguacaaccugaaaaccuugaauacacuauaguuguuacaccccacucaggggaggaacaugcuguuggcaaugacacaggcaaacauggccaagagauuaaggucacgccacaaucuagcaucacagaagccgaacugaccggguaugggccaguaacaauggaaugcaguccacguaccggacuggacuucaacgagaugguauuguuacaaauggaaaauaaagcuuggcuuguccacaggcaaugguuucuagauuuaccauuaccguggcuucccggcgcagauaagcaggaaucuaacuggauccaaaaggaaacccuaguaacuuuuaaaaacccccacgcuaaaaaacaagacguaguaguuuuaggaucacaagaaggggcgaugcauacggcucucacaggcgccacggaaauacaaauguccucggggaauuuguuauuuacugggcauuuaaagugcagacuucggauggauaaacuccaauugaaaggaaugucauauucuauguguacugggaaauuuaagguaguaaaggagauugcagaaacucagcacggaacuauugucauacggguacaauaugaaggcgacggcagcccguguaagauuccauuugaaauaauggacuuagaaaaacgauacgugcucgggagacuaauaacuguaaacccgaucguaacugaaaaagauucaccaguaaacaucgaagcagagccaccguuuggugauagcuacauaaucauaggagucgaaccgggacaacugaaacuuaacugguuuaaaaaaggcagcuccauaggccagauguucgaaacaacaaugagaggagcaaaacguauggccauauugggugauacugcuugggauuucgguucucuuggaggugucuuuaccucaauaggaaaagcacuucaucagguauuuggggcaauuuauggggcagcauuuucaggagucagcuggacuaugaaaaucuugauaggagucauuauaacguggauagggaugaacucacguucuacuagucuaucaguaucccuaguguuaguaggaauuguaacauuauauuuaggagucaugguacaagcagacaguggauguguaguuucuuggaaaaauaaagaauuaaaauguggcagcggcauauucauaacagacaauguacauacguggacugaacaauacaaauuccaaccagagucgccuucaaaauuagcuuccgccauacagaaagcucaagaggaggguauaugcggcauuaggucagucaccagacuggagaacuuaauguggaaacaaauuacacccgagcugaaccauauccuagcugaaaacgaaguuaaacugacaauuaugaccggcgauauuaaagguaucaugcaggcggguaagcguucucugcguccccaaccgacugagcuaaaauauucuuggaaaacuuggggaaaggcaaagauguuaagcacggaaucauacaaccagacauucuuaauagauggaccugaaacagcugaauguccuaauacuaaucgcgcuuggaauuccuuagagguugaagauuacggauuuggugucuuuaccaccaauaucuggcuuaaguugaaagaaaaacaagacgcuuucugugacucgaaguuaaugucagcugcaauuaaagauaaucgcgcaguccacgcagacaugggauauuggauagaaagugcuuuaaaugacacauggaaaaucgaaaaggcaagcuucauagaaguuaaaaauugucauuggccaaaaucccacacucucuggucuaauggugugcuggaguccgaaaugauuaucccaaaaaaccuggccggaccuguaucacagcauaauuacaggccaggcuaccauacucaaauagcaggcccuuggcaccuuggaaaacuugaaauggauuuugacuuuugugacggaacaacaguaauugugacagaagacugcggaaacagaggaccaucacuacgaacaacaaccgcuucagguaaacucauaacagaguggugcuguagaucuuguacguuaccuccccuacgauaucgaggagaagauggcugcugguacgguauggagauucguccauuaaaagagaaggaagagaaucugguuaacuccuuagugacagcuggacacggacaaguagacaacuucagcuugggaguacuuggaauggcucucuuucuugaggagauguuacguacacgcguuggcacaaagcaugccauuuugcuaguggccguaaguuuugugacucuaauuacagguaacaugagcuucaaagaucuugggcgaguaguugugaugguuggugccacaauggccgacgauauugggaugggaguaacuuauuuagcauuacucgccgcauucaaaguaagaccaacauuugcugccgguuuauuacuccgaaaauugacaucaaaagagcuuaugaugacaaccauaggcauaguauuacugagucagucaacaauuccugaaaccgugcuagaacuaacagaugcauuagcacucgggaugauggugcuuaaaauuguaagaaacauggaaaaguaccaacuugcagucacuaucauggcaauuuuaugugucccaaaugcugucaucuuacagaaugcguggaaagucucgugcacaauauuagcugucguauccgugucgcccuuauuacuuacgaguucccagcaaaagaccgacuggauaccgcucgcucuuacuauuaagggacuaaauccgacggccauuuuuuugacuacguuaucaagaacuaauaaaaaaagauccuggccacuaaacgaagccauuauggcaguggguaugguguccauccuagcuucaagccugcuuaaaaacgauauuccaaugacaggaccgcuugucgcuggcggccuauuaaccguuugcuauguucucacuggaaggucugccgaucuggaacuugaacgugcaacugauguuaagugggaagaucaggccgaaaucuccggauccuccccgauauugucuauuacaauaucagaggacgguagcaugaguaucaaaaacgaagaagaggaacaaacacuaaccauuuuaauuagaaccgguuuacuagucauuucuggacuauuuccuauaaguaucccgauuacagcugcugcaugguacuuaugggaaguaaaaaagcaaagagcagguguauuaugggauguaccuucgccgccccccauggguaaagcagaacuagaagauggcgcauaccgaauaaagcaaaaagguauauuaggcuauucucaaauuggagcaggcguauacaaagaaggaaccuuucacacaauguggcauguaacaaggggugcuguacuaaugcacaaagguaagaggauugaaccauccugggcagaugugaaaaaagaccuaauaucguacggagggggauggaaacuagaaggugaauggaaagagggggaagagguacaaguauuagcucuggaaccuggaaaaaacccucgugcaguccagacaaaaccaggacuguucaaaacaaacaccgggacuaucggagcgguaagccucgauuuuucucccggaacgucaggaucacccauaauagauaaaaagggcaaaguugugggacucuacggcaauggagucguaacucgcucuggagcauacguaucagcaauugcacaaacggaaaaaucaauagagaacaauccugaaauugaagaugacauauucaggaaaaggcgauuaaccaucauggaccuucacccaggagcugggaaaaccaagcgauacuuaccugcuauuguacgugaagcuauaaaacggggcuuaagaacgcucaucuuagccccaacaagagucguugcagcugaaauggaagaagcucuacgaggucuaccaauccgguaucaaacccccgcaauaagggcagaacacacuggaagagagauuguugauuuaaugugucacgcuacauucacaaugagacuacuuucacccguacguguaccaaauuacaaccugauaaucauggaugaagcccacuuuacagauccagcuucuaucgcggcccgaggguauauauccacaagaguggaaaugggagaagccgccggcaucuuuaugacagcaacaccuccgggaucacgagacccguuuccgcaaagcaaugcaccaauuauugaugaagaaagagagauaccugagaggucauggaauagcggccaugaaugggugacagauuuuaaagguaaaacugucugguuugucccaaguauaaaagcuggaaaugauaucgcugcaugucucaggaaaaauggcaaaaaaguaauucaguugagccgaaaaacuuuugacucugaguauguaaagacuagaacuaaugauugggauuuuguaguaacgacggacaucucugagaugggagccaauuucaaagcugaaagggucaucgacccaagacgcuguaugaaacccgucauccuaacagauggagaagaacgugugauauuagcaggaccuaugccugugacgcauagcagugcagcgcaacgacgaggaaggauuggccgaaacccaaaaaacgaaaacgaucaauauaucuauaugggagaaccacuggaaaaugaugaagauugugcccauuggaaagaagcaaaaaugcuguuggauaacauuaauacgccggaaggcauaauaccuuccauguucgaaccugagagagaaaaaguggacgcaauagauggagaguaucgauuacgaggcgaggcuagaaaaacauuuguagauuuaaugaggagaggcgaccuucccguuuggcucgcuuacaaaguagcagccgaagguauaaauuacgccgacaggcgaugguguuuugacggaauuaaaaauaaccaaauacuugaggaaaauguagaagucgaaauauggccaaaggaaggggaacggaagaagcucaagccaagauggcuagacgcaagaauuuauucugacccauuggcuuuaaaagaauucaaagaauuugcugcggguaggaaaaguuuaacauuaaaucucauuaccgaaaugggaagauuaccgaccuuuaugacucagaaaacuagagacgcuuuagauaaccuugcuguccugcauacagccgaggccgggggacgagcuuauaaucaugcacugagugaauuaccagaaaccuuagaaacucuacuauuacuuacccuacucgcuacagugaccggaggaaucuuucuguuucuaaugucuggacguggaauagggaagaugacccuagguauguguugcauuauaacugcaaguaucuugcuuugguaugcacaaauccaaccccacuggauugcugcaaguaucauucuggaauucuuucuaauuguuuuauuaauaccugaaccagaaaaacaacgcacaccccaagacaaccaauuaacuuauguugucauagccauauugaccguuguagcugccacaauggcuaacgaaauggguuuuuuagaaaaaacaaaaaaagaccuagguuuagguagcauagcgacccaacaacccgagaguaauauacuugacaucgaccuacgaccggcuucagcguggacacucuacgcagucgcuacuaccuucguaacuccgaugcuacgacauucgauugagaacucuagcguuaaugucucauuaacagcaauagcgaaccaagcaaccguacucaugggcuuggggaaaggauggccacucucuaaaauggacauagguguaccgcuauuagccaucggauguuauucucaaguaaauccaauaacacugacggcugcacuauuacuguuaguugcacacuaugcuauaauaggacccggacugcaggcaaaagcuacacgugaggcacaaaagcgugcugcagcugguauaaugaaaaauccuacaguagauggaauuacaguaauagaucuagacccaauucccuaugacccaaaauucgaaaaacaguuaggacaaguuauguuacuaauauuaugcguuacgcaaguacuuaugaugaggaccacgugggcacuaugcgaagcuuuaacacuagcgacaggucccauuagcacauugugggaagguaacccaggucgauuuuggaauacgacuauugcaguuucgauggcaaauauauuccgagggaguuaccuagcaggugcaggauuguuguucaguauaaugaaaaauacuacuaacacgaggagagguacuggaaacaugggagagacacugggugagaaguggaaauccaggcuuaacgcauuagggaaaagugaauuccaaauuuacaaaaaaagcgguauucaggaaguagauagaacucucgcaaaagaagguauaaaaaggggagaaacagaccaccaugcaguaagucgaggaagugcgaagcuuagaugguuuguagaaagaaauauggugacacccgagggaaagguagucgaucuuggauguggacgaggagguuggucguauuacugugguggguuaaaaaacguaagagaagugaagggacuuaccaagggaggucccggacacgaggaaccuauaccaaugucaacguacggauggaacuuaguaagauuacaauccgguguggauguauuuuuuaucccaccagaaaaaugugacacgcuauuaugugauauuggugaaaguucaccaaacccaacuguggaagccggacguacuuugcggguccuuaauuuaguugaaaauuggcuuaauaacaacacacaguuuuguauaaagguacuaaauccauauaugccaucaguaaucgaaaaaauggaggcccuacaacggaaauacggaggagcucuuguaagaaacccucugucuagaaacucuacucacgaaauguacuggguuaguaaugcaagcgguaauauaguuaguagugugaauaugaucucacguaugcuaaucaauagauuuacuaugagacacaagaaagcaacguaugaaccugaugucgaucugggaaguggaacccguaauaucggaauugaaucugaaacacccaacuuggauauaauaggcaaacguaucgagaaaauaaaacaggaacaugaaacaucguggcauuaugaucaggaccauccauacaagaccugggcuuaccacgguucguacgaaacgaagcaaacggguagcgcaucuaguaugguuacaggcguagugagacuguugacgaagccgugggacguacuaccuacaguaacacagauggcaaugacugacaccacaccuuucggucaacaaagagucuucaaagagaaaguagauacccguacacaagacccuaaagaagcaacaaaaaaacuuaugaaaauuacagcagaguggcucuggaaggaacugggcaaaaaaaaaaccccaagaauguguacacgugaagaguuuacucgcaaaguaagaaguaacgccgccuuaggcgccauauuuaccgaugaaaacaaguggaaaagugcuagagaagcgguggaagacucaagauucugggaacuaguugauaaagaacguaaucuucacuuggaagggaaaugugaaacuugugucuauaacaugaugggaaagagggaaaaaaaacucggagaauuuggaaaagcaaagggcucacgggcaauaugguacauguggcucggcgcacguuucuuagaauuugaagcacuaggauuccugaaugaagaucauugguuuagccgugaaaauagucugucgggaguugagggggaaggauuacauaaauuagguuacauacuuagggacguaucgaaaaaggaaggcggagcaauguacgcggacgauacugcaggcugggacacucguaucacccuagaagauuuaaaaaaugaagaaauggucaccaaucauauggaaggagagcauaaaaaauuagcugaagcaauauuuaaacucacauaucaaaacaagguaguaagagugcaaagacccacaccgcgcggcaccguuauggacauaauuagcaggcgagaucagaggggaucuggacaaguagguacuuauggguugaauacuuuuaccaauauggaggcccaacuaauaagacaaauggaaggagaagguguauuuaaaaacauacaacaucuaccagugacagaagaaguagccguccagaacugguuggcacgugucggaagggaaagacuaucgagaaugccaauauccggcgacgauugugugguuaaaccgcuggaugccagauuuccuacggcucuaacaccauuaaacgacaugggaaaaauaagaaaagacauucaccagugggauccaaguaaaggguggaaugauuggacccaagugccuuucuguucucaccauuuccacgaauuaauaaugaaagacggcagaguguuaguugucccauguagaaaccaagaugacuuaaucgcgcgugcccgaauaucccaaggaccagggugguccuuaagagaaacagcuuguuugggcaaaucguacgcucaaauguggucacuaauguauuuccaucguagagauuuaagauuggcagcaaaugcuauauguagcgccguuccaagccauuggguucccacgucgcgaacaacaugguccauccaugcuaaacaugaauggaugacgacugaagauauguuaacaguauggaaccggguuuggauacgagaaaacccuuggauggaagauaagacaccgguggagaguugggaggaaaucccguaucuggggaaaagggaagaccaguggugugguagucuuauaggacuuaccagcagagcuaccugggcuaagaauauacagguggcaauaaaucaaguuaggucucuuauaggaaacgaagaauauacagauuauaugccaucuaugaagcguuuccgaagagaagaagaagaggcaggaguuuugugguag

SEQ ID NO: 22687 - RNA, 9876 nt, Artificial Sequence
  derived and/or modified CDS sequence (opt6) from DENV-2__FJ205878__SS-prME
agugcaggcaugaucauaaugcuuauuccuaccguaacugcauuucacuugacaacuagaaauggcgaaccccauaugauuguuggaauacaagaaaaagggaaaucucuacuauuuaagacagaagauggcguaaauauguguacgcuaauggcaauggaccuaggagaauugugcgaagacaccauaacauauaaauguccacuauuaaggcagaacgagccagaagacaucgauuguuggugcaauucaaccucaacauggguaacuuauggcacuugcacuacaacuggagagcauaggagagagaagagauccguagcguugguaccucauguaggaauggguuuagaaacuagaacagaaacuuggauguccagugaaggcgcuuggaaacacgcacaaagaaucgaaacuuggauccuaagacauccuggauuuacgaucauggcagcaauucuggcguacacaaucggcacuacacauuuucaaagaguccuuauauuuauucuuuuaacugcuguugccccaucaaugacuaugagaugcauuggaauuuccaacagggacuucguugagggcguuucuggagguucaugggucgauauugugcuagaacaugguucaugcguaacuacgauggcuaaaaacaaaccuacacuagauuuugagcucauuaaaacagaagcgaagcaaccggcuacacugaggaaauauuguauugaggcgaaauugacaaacacaaccaccgagucuagauguccaacucaaggagaaccuucuuuaaaggaagagcaagauaagagguucgucugcaaacauucaaugguagauagaggauggggaaacgguuguggccuuuuuggaaaagggggaauuguaacuugugcaauguuuacauguaaaaaaaauauggaagguaagauagugcaacccgaaaauuuagaguacaccaucguagugaccccucauuccggagaggaacaugcagucggaaacgacacagggaagcacggacaagaaaucaagguaacgccgcagagcucaaucacagaggcagaacuuacuggguacgggacgguaacaauggaguguucaccgagaacaggacucgauuucaaugaaaugguauugcugcagauggagaauaaagcaugguuaguacauagacagugguuccuugaucucccacuuccauggcugccuggugcagauaaacaagaauccaauuggauacagaaagaaacccuuguaacuuucaaaaacccgcaugcaaaaaaacaggaugugguaguauuaggaagccaagagggagccaugcacacagcguuaacaggagcaacagaaauacaaaugucaucaggaaaucuauuauuuacgggccaucugaaaugcagauugagaauggauaaacuccaacuuaaagguaugucguauucgauguguacuggcaaauuuaagguaguuaaagaaauugcagagacccaacaugguacaauagucauacggguccaauacgaaggagauggaucaccaugcaaaaucccuuuugagauuauggaccuagaaaaacgguacguacugggucguuuaauaacugucaauccaauagucacggagaaagauucaccgguuaauauagaagcggagccuccuuucggagacuccuauaucauuaucggaguagaaccuggacaacucaaauugaauugguucaaaaagggaucgaguauuggacaaauguuugaaacaacgaugcggggggcaaaaagaauggcaauucuaggugauacggcaugggauuucggaagccuaggaggaguuuuuacgaguauaggcaaggcucuacaucaggucuuuggugcaauauauggagcagcuuucucaggagucucauggacaaugaaaauauuaauuggcguaauaauuacguggauugguaugaauuccagauccacaagccuuucuguuucauuaguuuuaguggguauuguaacgcuuuauuuagguguuaugguacaagcagacucagguugugucgugagcuggaaaaauaaagagcuaaaauguggcagcgggaucuucauuacggacaauguacauacauggacagaacaauacaaauuucaacccgaaucaccuucuaaacuagccuccgcaauacaaaaagcacaagaagaagggauauguggcauacgaagcguuacuagacucgaaaacuugauguggaaacaaauuacaccagaacuuaaucacauacuagccgaaaaugaagucaaauuaacuauaaugacuggugauauaaaaggcaucaugcaagcagggaaaagaucauuaagaccgcagccaacugaauuaaaguacucauggaagacauggggaaaagcaaaaaugcuaagcacugaaaguuacaaucaaaccuuucucauagauggcccugaaacagccgaaugcccuaacaccaauagggcauggaacucauuagaaguugaggauuacggauucgggguauuuacaacaaauaucugguuaaaacuaaaagaaaaacaagaugcauuuugcgacucaaaguuaaugucggcugcaauaaaagauaaccgcgcuguacaugcggacaugggauauuggauagaaucagcauuaaaugauacuuggaaaauagagaaggcuucauuuauagaagucaaaaauugucacuggccuaaaucucacacgcuuuggaguaacgguguucuugaguccgaaaugauaauacccaaaaaucuagcugguccgguaagucaacacaauuacagaccuggcuaucauacacagauagcgggaccuuggcaucuaggcaaacuugagauggauuucgauuucugugacgggacaacuguuauuguuacagaggacugcggcaauaggggucccucgcuacgaacaacuacugccucuggcaagcuaauaacagaguggugcuguagaaguugcacacugccgccccuaagauauaggggugaagacggaugcugguacggcauggaaauuaggccccuaaaggaaaaggaagaaaaccuaguaaacuccuuggucacagcagggcaugggcaaguggauaauuuuagucugggaguauuaggaauggcuuuauuucuagaagaaaugcuucguacaagagucggcacaaaacacgccauacuccucguagcugucucauuuguaacacuuauuaccggaaacaugaguuuuaaagaucuggggagaguuguaguaaugguaggugcuaccaugacagacgauauuggaauggggguaacuuaucuggcauuacuagccgcuuucaaggugagaccuaccuucgcagcaggucuacuauuaaggaagcuaacgucuaaggaacuaaugaugaccacuauagggauaguauuacuaucucaaaguacaauaccagaaaccguacucgaauugacugacgcgcuagcacucggcaugaugguacuaaaaauaguuagaaauauggagaaauaucaauuagcuguaacaauuauggcuauuuuguguguaccuaaugcagucauacuccagaaugcuuggaagguaucauguacaauucucgccguugugucuguaucgccucuucuacugacgucgucccaacaaaaaaccgauuggauuccucuagccuuaacuauaaaagguuuaaacccaacugcuauauuuuuaacaaccuugucuagaacgaauaaaaaacgcuccuggccacucaaugaagcaauaauggcaguaggaaugguaagcauacuagccagcucauuauuaaaaaaugauauaccuaugaccgggccacuaguagccggaggucuauuaaccguuuguuauguguugacuggaaggucagcagauuuagagcuugagagggcgacagacguaaaaugggaagaccaagcugaaauuaguggcucuagccccauucugucaauuacaauuagcgaggacgguucgaugaguauuaaaaacgaagaggaagaacaaacauuaacgauacucauccguaccggucuacuugugauuucaggcuuauucccaaucaguaucccuauaacggcugccgcaugguacuuaugggaaguaaaaaaacaaagagcaggaguuuuaugggacguaccaagucccccaccaaugggaaaagcagaauuggaagauggggccuauagaauaaagcagaaaggaauucuaggauacagccaaauaggugccggcgucuauagagaagguacguuucacacaauguggcauguuacaagaggagcuguacugaugcacaaaggaaaacguauagaaccuucgugggccgacguaaagaaggaucuaauaaguuauggaggggguuggaaacuggaaggcgaauggaaagaaggagaggaaguucagguguuagcccuagaaccuggaaagaacccacgagcaguccaaacuaaaccuggcuuauuuaagacuaacacagggacgauuggagcaguaucacuugacuucaguccaggcacaucugggaguccuauaaucgauaaaaagggcaaaguuguuggauuguauggaaacgguguuguaacacggaguggugccuauguaagcgcaauagcacaaacagaaaaaagcauagaagauaaucccgaaauugaagaugacauauuucggaaacgacgucuaaccaucauggauuugcauccuggagcagggaaaacgaaaagauacuuaccagcaauaguacgcgaagcaauaaagagaggucuucguaccuuaauucuagcaccaacaagagucgucgcggccgaaauggaggaagccuuaagaggauuaccgaucagauaccaaacaccugcaauacgagcagaacauacugguagagaaauaguagauuuaaugugucacgcaacuuuuacuaugcgacugcuuucaccggugcgcgucccaaauuauaaucuaauaauaauggaugaagcucauuuuacggacccagcaucaaucgcggcaaggggauauaucucuaccagaguagaaaugggcgaagcagcuggaauauuuaugacggccacaccacccggauccagggauccauuuccgcaaucaaacgcaccgauaauagacgaagaacgagaaauacccgaaagaucauggaacuccggucaugaaugggucacagauuuuaaggguaaaacugugugguucguucccaguauaaaagcuggaaacgacauagcugccugcuuaagaaaaaacgggaaaaaggugauucaacugagccguaaaacuuuugauucagaguacguaaaaacaaggacuaaugauugggacuucgucgucaccacugacaucagcgaaaugggggcaaauuuuaaagcggaaagaguuauugauccacgucgauguaugaagccaguaauauuaacagauggagaggagagagugauacucgcuggcccgaugccaguuacacacaguucugcggcccaaaggagaggacggauugggcggaauccaaaaaaugaaaacgaccaauacauauauaugggugaaccguuggaaaaugaugaagauugugcacauuggaaagaggcgaaaaugcuccuugauaauauuaauacuccugagggcauuaucccuucaauguuugaacccgaacgagagaaagucgaugcuauagacggagaauauagacucagaggugaagcgcgcaagacauucgucgaucuaaugagacgaggggauuuacccguaugguuggcauacaaaguugcugcagaaggcauaaacuacgcagauagacgcuggugcuuugaugggaucaaaaacaaucaaauacuagaagaaaaugucgaaguggagauauggacaaaagagggugaacguaaaaaacuaaaaccgagaugguuagaugcacggauuuacucagauccacuggcacucaaagaauuuaaagaauucgccgcggguagaaagucauuaacuuuaaaccuaauuacagaaaugggaaggcuaccaacuuucaugacacaaaaaaccagagacgcucuagacaaucucgcaguacuacacacagcggaggcaggaggcagggcauauaaccaugcacuuagugaacuaccagagacgcuagaaacacuucuacuuuuaacacuacuagcgacggugaccggagggauuuuccucuuucuaaugaguggccgcgggauuggaaaaaugacauuggguauguguugcauaaucacugcaucaauuuuacuaugguaugcccagauacaaccucacuggaucgcggccagcaucauucuagaauucuuucuuauaguucuguugauacccgaaccagagaagcagcggacuccccaggauaaucaacuuacuuauguaguaaucgcaauuuuaacuguuguagcagccacuauggcuaaugaaauggguuuucucgaaaagacaaaaaaagaucuugguuuggguucaauagcaacacaacaaccagaaagcaacauacuggacauagaccuucgaccugcaagcgcauggacuuuauaugcaguugcaacaacauucguuacaccuauguuacgccacaguauagaaaacucuucagugaauguaucauuaaccgcaauagccaaucaggcuacuguacucauggggcuagggaaaggcuggccgcuaucaaaaauggacaucggagugccucuucuagccauaggcuguuacucccaaguaaacccuauaacauuaacggcagcucuacuacuuuuggucgcacacuacgccauaaucgggccaggauugcaagcuaaagcaacaagagaagcucaaaaacgagcggcggcaggaauuaugaagaacccuacgguugacggcauaacaguaauugaucuagauccaauaccguaugacccgaaauucgaaaaacaacucggccaagucauguuguuaauacucugugucacacaggugcucaugaugcggacaacaugggcucugugcgaggcguuaaccuuggccacaggaccgauuucuacauugugggaaggaaauccgggcagguucuggaauacaacuauagcagucucaauggcaaauauauuuagaggguccuaucuagcuggcgcuggguuauuauuuaguauuaugaaaaacacuacaaauacgcgacgaggaacaggaaacaugggagagacuuugggagaaaaguggaaaaguaggcuuaaugcucucggcaagagcgaguuucaaauuuauaaaaaauccggaauccaagagguugaccgaacauuagcuaaagaaggaauaaaaaggggagaaacagaucaccaugcgguuagcagagguagugcaaaacugcguugguucgucgaaagaaacaugguaacgccugaggggaaaguaguagacuuagguugugggagaggaggguggucauauuacuguggaggccuuaaaaacguucgggagguuaaaggauuaacaaaggguggaccaggacacgaagaaccuauccccaugucaacauacggguggaaucucguccgacugcaaucgggaguggacguguuuuucauaccuccugagaaaugugauacacuacucugugauauaggugaaaguucuccgaacccuacaguggaagcaggccgaacauuacguguauugaaccuuguagagaauuggcucaacaacaauacgcaauucuguauaaaaguucugaacccauauaugccaagugucauagagaagauggaagccuuacaaaggaaauacggcggugcacuugugcggaauccucucucacguaacucuacacaugaaauguauugggugaguaaugcgucaggaaauaucguuucaucagucaauaugauaaguagaaugcugauuaaucgcuuuaccaugcgucauaaaaaagcuacuuaugaaccagauguggauuuagguaguggaacgagaaauauagguacugagagugaaaucccuaacuuagauauaaucgguaaaagaauagaaaagaucaagcaagagcacgaaacauccuggcauuacgaucaagaccaucccuacaaaaccugggcauaccauggauccuaugaaacaaaacaaacuggaucugcuucaaguaugguaaauggcguaguacgacuauuaacgaaaccgugggacguucucccaaugguaacccaaauggcgaugacggacacgacaccauucgggcaacaaagaguauuuaaagagaaaguggacacaagaacacaagagccgaaagaaggcacaaaaaaauuaaugaaaauaacggcagaauggcuauggaaagaguuaggaaaaaagaaaaccccucgaaugugcacucgggaagaauuuacgagaaaagucaggaguaaugcggcacuaggugcgaucuucacugacgaaaauaaauggaaaagugcacgagaagcaguugaggauucccgauuuugggaguuaguugauaaagaaaggaauuuacaccuggaagggaaaugugaaacuugcguauacaacaugaugggaaagagagagaaaaaauuaggagaauuugguaaggcgaaagguucacgagcaauaugguauaugugguuaggagcuagguuucuagaauucgaagcucuggguuuucuaaaugaagaccauugguucucgcgugagaauuccuuauccgggguugagggcgaaggcuuacacaagcuagguuauauccucagggauguaagcaagaaagaaggcggugcaauguaugcagaugauacugcagggugggacacacgcauaacauuagaagaccucaagaaugaagaaauggugacgaaucauauggaaggggaacauaagaagcuggcagaagcaauauucaaguuaacuuaccaaaauaaaguaguuagaguacagagaccaacuccaagaggaacaguaauggauauaauuagucgacgggaucagcgcgguucaggucaagucggcacauauggcuuaaauacauuuacgaauauggaggcacaauuaaucagacaaauggaaggagaagggguauuuaagaacauucagcaucuuacgguuacagaagaaguagccguaaaaaauuggcuagcaagaguagggagggagagguuaucuagaauggccauuucaggagacgauugcguaguaaagccacucgacgaucgcuucgcaaaugcauugacagcgcuuaaugauauggggaaaaucaggaaggacauucaacagugggaaccuaguaaaggcuggaacgacuggacgcaaguuccguuuugcagucaccauuuccacgagcuaaucaugaaagacggucgagucuugguuguaccgugcaggaaccaagacgagcuuauagguagggcaaggauaucucaaggggccggcuggucuuuaagagaaacugcauguuuagguaagucauaugcgcaaauguggagucucauguauuuucaccgccgagaucucagauuggcggccaaugcgaucugcucggccguaccuucacauuggguaccgacaagcagaacuacauggagcauucaugcaaagcacgaauggaugacuacagaagauaugcuuacagucuggaacaggguauggauacgagaaaaucccuggauggaagauaagacgccuguugagagcugggaggagauaccuuauuuggggaaaagagaggaucaaugguguggcucuuuaaucggucucacaucacgugcaacaugggcaaaaaacauacaagccgcgauuaaucaaguuaggucccugauugguaaugaagaauauaccgauuauaugccaaguaugaaacgauuucguagagaggaagaagaggccgguguacuuugguag

SEQ ID NO: 22688 - RNA, 9876 nt, Artificial Sequence
  derived and/or modified CDS sequence (opt6) from DENV-2__FJ205879__SS-prME
agcgcugguaugauaaucauguuaaucccuacggucauggcauuccauuuaacuacgcggaauggagaaccccacaugaucguuggaauacaagaaaaagggaaaucauugcuauucaaaacagaagaugggguaaacauguguacguuaauggccauggacuuaggggaacuuugugaagauacaauuacauacaaaugcccucucuugaggcaaaaugaacccgaagauauagauugcuggugcaacucaacaaguacauggguuacauacgggaccugcacaacaacuggggaacaccguagggaaaaacgaucaguugcuuuaguaccacauguggggaugggcuuagaaacccgaaccgaaacuuggaugucaagugaaggugcguggaaacacgcccaaagaaucgaaacuuggauuuugagacaucccgguuucacaauuauggcagcgauccuugcuuauacuauugguacaacacacuuccagcgaguucuuauauuuauauugcucaccgcuguagcaccaaguaugacaaugcgaugcauugggauaucaaaccgugacuuuguugaaggcgucagcgguggauccugggucgauauaguucuugagcacggaagcugugucacgacuauggccaaaaacaaaccuacauuagauuuugaauuaauaaaaaccgaagcgaaacaaccggcgacuuuacgaaaauacuguauagaagcgaaacuuacaaacaccaccacagaauccagguguccaacacaaggagaacccucucuaaaagaagaacaagauaaaagguucauauguaaacauucaaugguagauaggggaugggguaauggauguggcuuguucggcaaaggaggaauugucacaugugcaauguuuaccuguaagaaaaauauggaaggaaaaauaguacaaccagaaaauuuggaauauaccauuguaguaaccccucauaguggugaagaacaugcaguagguaaugauacuggaaaacauggaaaagaaauaaaaguuacuccacagucgagcaucacugaagcugaauuaacgggauacggcacuguaaccauggaauguaguccaaggacaggccuugacuucaacgagaugguccuguuacaaauggaaaauaaagcauggcugguccauaggcagugguuucuagaucuuccauugccaugguugccaggggcagauaaacaagaguccaauuggauacagaaagaaacgcuaguuacuuucaaaaauccccacgccaagaaacaagauguuguuguguuaggaucucaagaaggagccaugcauacugcuuugacaggggcuacugaaauccaaaugaguucaggaaauuugcuuuuuacuggccaucuaaaauguagguugaggauggauaaacuacaacuaaaggggaugagcuacucgaugugcacuggaaaauucaaaguaguaaaagagaucgcagaaacucagcauggaacuauuguuauacgugugcaauacgaaggagaugguucaccguguaaaauuccuuuugaaauaauggacuuagagaaaagguauguacuaggaagacugauuacugucaacccuauuguuaccgagaaagauucacccguaaacaucgaggcagagccaccauucggugauucuuacauaauuauagggguagagccuggccaauuaaaauuaaauugguuuaagaaagggaguaguaucgggcagauguuugaaacaacaaugaggggagcaaaacgaauggcaauuuuaggugauacggcuugggauuuuggaagucuuggaggaguguucacaagcaucggaaaagcguuacaccaggucuuuggggccauauacggugccgcauucucuggcguaaguuggacgaugaaaauccuuauuggugucauuauuacuuggauuggcaugaacucaaggaguacaucauugucaguaucauuaguacuuguaggaauaguuacccucuauuuaggagugauggugcaggcagacucaggaugcguggugaguuggaaaaauaaggaacucaaguguggcucaggaauauuuauuacugauaauguucacacguggacagaacaauauaaguuucaacccgaaagcccuagcaaauuagcaucugcuauacaaaaagcccaagaagaaggcauauguggaauaagaagcguaacgagacucgagaaccugauguggaagcaaauaaccccagaacugaaccacauauuggcugaaaacgaaguaaagcugacuaucaugaccggagacauuaaaggaaucaugcaagcaggaaaaagauccuuaaggccucagccuacugagcuaaaguauuccuggaaaacuugggguaaggcgaaaauguugucaacugagagcuacaaccagacauuucuaaucgacggaccugaaaccgcugaauguccaaauacaaauagagcauggaacagucuggaagucgaagacuacgguuucggaguuuuuacuacgaauaucugguuaaaacuaaaagaaaaacaagacgcguuuugugauucaaaauuaaugucggcugcaauaaaggauaaccgggccguacacgcagauaugggauauuggauagaaagugcauuaaacgacacuuggaaaauagaaaaggcaucauuuaucgaagugaaaaauugucacuggccaaaaucacacacauuguggaguaauggaguacuugaaagcgaaaugauuauaccgaaaaauuuagcuggucccguuucacaacauaauuauaggccagguuaucauacacaaauugcgggaccauggcaccuagggaaauuagagauggauuuugauuucugugaugguacgacuguggucguuaccgaagacugcgguaaucgcggaccgucuuugagaacaacaacggcgucuggcaaauugauaacugaaugguguugucgaaguuguacgcuaccaccccuaagauauaggggcgaagacggguguugguauggaauggagauccgaccuuuaaaagaaaaagaagaaaauuuagugaauagccuaguuacugcgggccauggccaaguggacaauuucagucuuggugugcugggcauggcguuauuuuuggaagaaaugcuuaggacuagagucgggacgaaacaugcgauccuauuaguggcuguaaguuuugucacuuugauuacagggaacaugagcuuuaaagauuuaggccgggugguggugaugguuggugcaacaauggccgacgauauaggaaugggaguaacauauuuagcacuauuagcagcuuuuaaagugagaccaacauucgcggcaggguugcuccuacggaaacuaacgagcaaggaauuaaugaugacaacaauagguauaguauugcugucacagucgacuaucccagaaaccguucuagaacuuacugaugcguuggcuuuaggaaugaugguuuugaaaauuguucguaauauggaaaaauaccaguuggcuguaacgauaauggcuauacuguguguaccuaacgcggugauucuacaaaaugcauggaaagucucaugcacuauacuagcuguuguaagcguuucaccauuacuacucacaagcagucagcagaaaacggauuggauuccucucgcgcuuacaauaaaaggcuuaaauccaacagcgaucuuccuaacgacacucucgcguacaaauaagaagagaucauggccacuaaacgaagccaucauggcaguugguauggugucaauacuggccaguagccuuuuaaagaaugacaucccaaugacaggcccgcugguagccggaggguuguuaacaguaugcuauguauuaaccggaagaucagcugauuuagaacuagagagagccacagacguuaaaugggaagaccaggcagaaauaucaggaucgucgccgauuuugucaauuacuauaucggaggaugggagcaugagcauaaagaacgaagaagaagaacaaacauuaacgauacuuauaagaacaggauuguuagucauaucagggcuguuuccaauaucaauaccuauaaccgcugcagccugguaucuaugggaagugaagaaacagagagcaggagugcuuugggaugugcccaguccaccuccgauggguaaagcugaacucgaagacggagcuuaucgaaucaagcaaaaagggauucuaggguauucacaaauaggagcaggaguauacaaagaaggaacauuucacaccauguggcauguaacacgaggagcaguuuuaaugcacaaaggcaaacguauugagcccuccugggcugaugugaagaaagaucuaauauccuacggaggcggcuggaaauuagagggggaauggaaggaaggagaagaaguacagguucucgcacuggaacccggcaaaaauccccgugccguacaaacuaagccugguuuauucaaaacgaacacuggaaccauuggagcagugagcuuggacuuuucacccggaacauccgguucaccaauaaucgauaaaaagggaaaggucguuggauuauacggcaacgguguggugacgagaucgggagcguauguaucagcuauagcacaaacagagaaaucuaucgaggacaaucccgaaaucgaggacgauauauuccggaaacgaagguuaaccauuauggauuuacauccuggcgcgggcaaaacuaaaagauacuuaccagcaauuguaagagaagcaauaaaacgaggucuuaggacgcucauacucgcccccacucgugucguagcggcggaaauggaagaggcccuacgagguuuaccaauucgauaccaaacaccagcaauaagagccgagcauacaggucgagagauaguagaccuaaugugucaugcaacuuuuacuaugagacugcuaaguccgguaagagugccaaacuauaauuuaaucauaauggacgaagcccacuuuacagauccagccagcaucgcagcaagagguuauauaucaacacgaguugaaaugggugaagcagcagggauauucaugacagcaacgccacccggcucacgagauccauuuccucaguccaaugcucccauaauagaugaggaaagggaaauuccagaaagaaguuggaauagcggccaugaauggguaacugacuuuaaggguaaaaccguaugguuuguaccaaguauaaaggccgguaaugauaucgcugcguguuuacggaaaaaugggaagaaaguaauucaacuguccaggaaaacauuugacucugaguauguaaaaacccguaccaaugauugggacuuuguaguaacuacggacaucagugagaugggagcaaacuuuaaagccgagagggucauagauccacgcagaugcaugaaaccuguaauacucacugauggagaagaaagaguaauauuagcuggaccaaugccuguaacccauaguucagcggcucaaagaagggguaggauuggacgaaauccaaagaacgaaaaugaccaguacauauauaugggagaaccucuagagaacgacgaggacugcgcucacuggaaagaggccaaaauguuguuagacaacauaaacaccccugagggaauaauaccaaguauguucgagcccgaacgcgaaaaaguagaugcuauugauggagaguaccgccuucggggagaagcuagaaaaacguuuguugacuugaugcgacgaggagacuuaccagucugguuagcauauaaaguugcagcagaaggaauaaacuaugcugaucgaaggugguguuuugacggcauaaagaacaaucaaauccuggaagaaaacguagagguagaaaucuggacuaaggaaggugagaggaagaaacucaaaccaagguggcuagaugcuagaauauauagcgacccgcuugcguugaaagaauuuaaggaauuugccgcgggaagaaaaagccuaacauuaaauuuaauuacugaaaugggucgacugcccacauucaugacacagaaaacgagggacgcucuagacaauuuagcuguuuuacauacagccgaagcuggcggacgcgccuacaaucaugcacucagugagcuuccagaaacacucgaaacauuauuacuuuugacucuucuugcgacgguuaccggaggcauauucuuauuccuuaugagcggaagagggauaggcaagaugacccuaggaauguguuguaucacaacggcaucaauauuauuaugguacgcgcaaauacagccucacuggauagccgccucaauaauuuuggaguucuuuuuaauaguccuccuaauaccggaaccagaaaaacaaagaacgccacaagauaaucagcuaacuuacguaguaauugcaauacuaacaguagucgcagccacaauggccaaugaaaugggauuucuugagaaaacuaagaaagaucugggccuaggaucaaucgcaacucagcaaccagaaaguaacauucuagauauagaccuacgaccagccagugcguggacucuauaugcaguugccacaacguucguuacacccauguugcgccauucaauugaaaauagcucgguaaaugucucucugacagcaauugcgaaucaagcgacagucuuaaugggacuaggaaaaggguggccacuaucgaaaauggacauaggggucccacuauuagcaauagggugcuacucacaaguuaauccgauaaccuuaacagcagcacuucuacugcuaguagcacauuaugcuauuauaggcccaggccuccaagcgaaagcaacacgcgaagcacagaagcgagccgcagcuggcauaaugaaaaauccaacuguugauggaaucacgguaauagaccuagaucccauccccuaugacccaaaauuugaaaaacaguuaggucaaguuaugcuguugauacuuuguguuacucaagugcucaugaugcguacgaccugggcgcuuugcgaggcguuaaccuuagcaacuggcccaauaucuacacuuugggaaggaaaucccggccgauuuuggaauacgaccauugcaguuucgauggcaaacaucuucagagguuccuauuuagcaggggcuggucuccuauuuucgauaaugaaaaauacgacaaauccgagaaggggaacaggaaauaugggggaaacauugggagaaaaauggaaaucccgguuaaaugcuuuggggaagagugaauuucaaauuuauaaacgaucuggcauucaagagguagauagaacuuuagcuaaagaagguauaaaaaggggcgaaacggaccaccaugcgguaagccgcggauccgcuaaauugaggugguucguagaaagaaauaugguaacaccagaaggcaaggucgucgaucuaggauguggaagaggaggcuggaguuauuauuguggaggucucaaaaaugucagggaaguaaaagggcuaacgaaaggcgguccuggucaugaggaaccaauuccaaugucuaccuacggauggaauuuaguuaggcugcaaaguggcguugauguauuuuucauaccaccugagaaaugugauacacuucucugugacauaggcgaauccucgccaaacccaaccguagaagccggacgaacccuuagaguucuaaacuugguagaaaacuggcugaacaauaauacucaauucuguauuaaaguuuuaaacccguauaugccgucaguuauagagaaaauggaagcucuacaaaggaaauaugguggugcuuuagucagaaaucccuuguccagaaauuccacucaugagauguauuggguuucgaacgcgaguggcaauauugucucaagugucaacaugauaucccgcauguuaauaaauagauuuacuaugagacauaagaaagcaacguaugaaccagacguagaccuaggcucuggaacaaggaacauuggcauagaaagcgaaauaccuaauuuagauauaauuggcaagagaaucgaaaagauaaagcaagagcacgaaacaucuuggcauuacgaucaagaccaucccuacaaaacuugggcauaucauggcaguuacgagacaaagcagacuggcuccgcgucaaguauggugaauggugugguaagacuccuuacaaaaccaugggauguacucccaacgguuacucaaauggcaaugacagacacgacaccguuuggucaacaacggguuuucaaagaaaaaguggauacaagaacacaggaacccaaagaaggaacuaaaaaguuaaugaaaauuacagcugaaugguuauggaaagaauuggggaagaagaaaacuccccgaauguguacgcgagaagaguucacacgaaaaguuaggaguaacgcugccuuaggugccauuuucacggaugaaaacaaauggaagucggcgcgagaggcagucgaggauucucgcuucugggagcuagucgauaaggaaagaaauuugcaucucgaagguaaaugcgaaacaugcguuuacaauaugauggggaagcgggagaagaaacuuggagaguucggaaaagcuaaagggucaagagccauuugguauaugugguuaggggccagauucuuagaguucgaagcucuuggauuucugaaugaagaucacugguuuagucgagaaaauucccuaucaggaguagaaggagaaggauuacauaaguugggauauauacuuagagauguuagcaagaaagaaggaggagccauguacgcggacgauaccgcuggaugggacacacggauaacuuuagaagacuugaagaaugaggaaauggucacaaaucauauggaaggagaacauaagaaauuggcugaagcgauuuuuaaacuaacauaucaaaacaaagucguuagaguacaaaggccgacaccccgagguacgguaauggauauaauaagcagacgcgaccaacgggguucgggacaagucgggacuuacggacuaaauaccuuuacaaauauggaagcccagcuuauacggcaaauggaaggugaaggcgucuuuaaaaauauucaacaccugacuguaacagaggaaguagccgugcaaaacuggcuugcaagaguaggaagagagcgucuuucuagaauggcuauuucuggagacgauuguguuguaaagccccuugaugaccguuuugcaaaugccuuaacagcauuaaacgauaugggaaaaauuaggaaggauauccaacaaugggaaccuaguaagggguggaaugauuggacucaaguaccauuuuguagucaucauuuucaugaacugaucaugaaggauggaagaguacuuguuguacccugccggaaucaagaugagcugauaggccgagcgagaaucagucaaggagcuggauggucgcugagagagacagccugccuagggaaaucguacgcccaaauguggaguuuaauguacuuucauagacgcgacuuaagguuggcggccaacgcuauuugcucggcugugccuagucauuggguaccaacaaguagaacaacuuggucgauacacgcaaaacacgaauggaugacuacggaggauauguuaacuguauggaauagaguauggaucagggagaauccguggauggaagauaaaacuccgguagaaucaugggaagaaauaccauaucuaggcaaacgagaggaccaguggugugguagucucaucgggcuuacaaguagggcgacaugggccaagaacauacaagcagcgauuaaucaaguaagaucauuaauaggaaacgaggaguauacagacuauaugcccucuaugaaacgauuuagacgagaagaagaagaagcaggagugcucugguag

SEQ ID NO: 22689 - RNA, 9876 nt, Artificial Sequence
  derived and/or modified CDS sequence (opt6) from DENV-2__FJ390385__SS-prME
agugcgggaaugauuauaaugcucauuccaaccgugauggcauuccaccucacgacuagaaauggagaaccacauaugauaguagggauucaagagaaaggaaaaaguuuacucuucaaaacugaggaugguguaaauauguguacauuaauggcaauggaccugggcgaacuuugugaagauacaauuacuuacaaaugccccuuacuacgccaaaaugagccggaagauauagacuguugguguaauucuacgaguacuuggguaacuuaugggacuuguacaacaacuggggagcauagaagagaaaaacguucagucgcauuagugccacacgugggaaugggauuagaaacacguacagagacauggaugucuucugaaggcgcguggaaacaugcacaaagaauagaaacuuggauacuucgccauccgggauucaccauuauggcugcaauauuagcuuacacgauagguacaacucacuuccagagagucuuaauuuucauucuccugacugcaguugcaccguccaugacuaugcgauguauaggcauaucaaacagggauuuuguagagggcguaucuggagguucaugggucgauaucgugcucgaacacggaaguuguguaacaacuauggcgaaaaacaaaccuacucuugauuuugaacuaauuaaaacugaagcaaaacaaccggcaacccuucggaaauauugcauagaagcuaaacuuacaaacacgacgacagaaucacgaugccccacccaaggugaaccaucacuuaaagaggagcaagauaaacgguucguaugcaaacauaguaugguagauagaggauggggaaacgguugcgguuuauuuggaaaaggggguauugugacaugugcaauguuuacaugcaagaaaaacauggaaggcaaaauaguacaacccgaaaaccucgaguacacuaucguaguuacuccucauucgggugaggagcaugcuguuggaaaugauaccggaaaacacgggaaagagauuaaagucacaccacaaucgucaauaaccgaggcggaauugacaggauauggaacaguaacaauggaauguagcccccgaacagguuuagauuucaacgagaugguguuauuacaaauggagaacaaagcguggcuuguccacagacagugguuucuugauuuaccguuaccaugguuaccaggugcagauaaacaggaauccaacuggauacagaaagaaacucuuguuacuuuuaaaaauccgcacgcuaaaaagcaagacguagucgucuuaggaucgcaagaaggagcgaugcacacugcacuuacgggugcaacugagauucagauguccucuggaaaccuucuguuuacaggucaccuuaaaugucgucuuagaauggacaagcuccaguugaagggaaugucauauucaaugugcacaggaaaauuuaaaguagugaaagaaauugcggagacacaacauggaacuauagugauccgaguucaauaugaaggagacggaucuccauguaagauaccguucgaaauuauggauuuggagaagcgauauguucuuggcagguuaauaacagugaacccgauagcgacagagaaagacucuccagucaacauugaagccgagccaccuuucggggauucauauauaauuauaggcguagaacccgggcaacuaaaauuaaacugguuuaagaaaggaaguucaauuggucaaauguucgaaacgacaaugcgaggcgcaaaacgcauggccaucuuaggugauacugcaugggauuucgguaguuugggcggcguguuuacgucuauuggaaaagcgcuucaucagguuuuuggugcgauuuauggagccgcguuuucgggaguuaguuggacaaugaaaauccucauugguguaauaauuacauggaucggaaugaacuccagaucgacaucgcucucaguaagucuaguuuuaguaggcauaguaaccuuauacuuaggcguaaugguacaggccgauagcggaugugucguauccuggaaaaacaaagaacuaaaaugugggucuggcauuuuuauaacugauaaugugcauacuuggacagaacaguauaaguuucagccagagagucccuccaaauuagccagcgcgauucaaaaagcacaagaagaagguauuugcgguauucguucagugacacgucuagaaaacuuaauguggaagcaaaucacuccagaacuaaaucauauauuagcagaaaaugaggugaaacuaacaaucaugaccggggacauaaaggguauuaugcaagcggguaaacgaucauuacguccacaaccgacugaauuaaaguacaguuggaaaacaugggguaaagcaaaaaugcucucaacagagucauauaaucaaacauuuuuaauugacggacccgaaacagcggaauguccuaauaccaacagagcuuggaacucauuagaaguugaagauuacgguuuugggguauucacuaccaauauuugguuaaaauugaaagaaaaacaagaugcuuuuugugauaguaagcugaugagugcagccauuaaagacaaccgagcgguccacgcagauaugggcuacuggauagaaagugcuuuaaaugauacguggaaaauugagaaggcuucauuuauagaggucaaaaauugccauuggccaaaaucucauacauuauggucuaauggagucuuagaaucggaaaugauuauuccgaaaaaccucgcuggaccugugucccaacacaauuaucgcccuggauaucacacacaaauagcuggaccuuggcaccuagguaaguuagaaauggauuucgacuucugugacggaacaacaguaauaguaacagaagacugugguaauaggggacccagcuuacguacuaccacugccagugguaaacuaauuacugaaugguguugucgaucuuguacgcucccacccuuacgcuauaggggagaagacggguguugguauggcauggaaauucgaccucucaaagaaaaagaagaaaauuuaguuaauagccuagugacggcuggacacggacaaguagacaacuuuaguuugggcguucuagggauggcacuauuuuuagaagaaauguuaaggacuagaguaggaaccaaacaugccauucuacucguugcgguauccuucguaacuuuaaucacagguaauaugaguuucaaggacuuaggcagagucguaguaaugguaggcgccaccauggcugacgacauugggaugggagugacauauuuggcacugcuugcugcauuuaagguucgaccgaccuucgcagcagggcuuuuacuaagaaaauugacaaguaaagaauugaugaugacaacaauagggauaguauuauuaagucaaucaacgauaccagaaacuguucuagaacuaacagaugcauuagcuuuaggcaugaugguauuaaagauaguucgcaauauggaaaaauaucaacucgcaguaacaauaauggccauacuguguguaccgaacgcaguaauccuacagaacgcauggaaaguaggaugcacgauacuugccguugucaguguuucccccuugcuguugacaagcucucaacagaaaacagacuggauaccccuugccuugacuaucaaaggacucaacccaacggcgauuuuucucacaacauuaagcagaacaaacaagaaacguucauggccuuuaaacgaagcuaucauggcaguaggcaugguuagcauccuugcaucaagucuauugaaaaaugacauaccaaugacagguccguuaguagcaggaggguuacuuacaguauguuaugugcugacgggaagaagcgcugauuuagaguuagaaagagccacagacguaaaaugggaagaucaagcggaaauuagugguagcagucccauacuaucaauaacuauuagcgaagacggaucaaugaguaucaaaaaugaggaagaagaacaaacacuaacgaucuugauacgaacuggacuacucguaauaucagggcucuuuccuauuaguauucccauaacugcagcugcuugguaucuaugggaaguuaagaaacaacgugcgggcguauuaugggaugucccaucacccccgccuaugggaaaggcagaacucgaagauggugcauaucgaauaaaacaaaaaggaauacucggauauagccaaauaggcgcaggagucuacaaagaggguacauuccacacaauguggcacguaaccagaggggccguacuaaugcacaaagguaaaagaauugagccgucaugggccgauguaaagaaagauuuaauuuccuaugggggaggcuggaagcuggaaggcgaauggaaagaaggggaagaaguacaaguucuagcuuuggaaccggguaaaaacccuagagcgguacagaccaaacccggucuauucaaaacaaauaccggaacaaucggagcugucucacuugauuucagccccggcacaucggguucgcccaucauagacaagaaggguaaaguaguaggauuauaugguaacggaguugugacccgcucgggagcauacgucagcgcuauagcucaaacugagaaaucgauagaggacaauccagaaauugaggacgauauuuuuagaaaacgccggcuuacaauuauggaucuacaucccggagccgguaaaacaaaacgauauuuaccggcaauagucagggaagcaaucaaaagaggauuacgcacccucauauuagcucccacacgugucgucgcggcugagauggaagaggcucucaggggacuuccaauaagauaucaaacuccagcaauacgaagcgaacauacgggaagagagauugucgaucucaugugucaugcuacauuuacaaugagauuguuaucaccuguaagaguaccgaauuacaaccuaauuauuauggaugaagcacacuuuacugauccugcuaguauagcugccaggggauauaucucaacuagaguagagaugggcgaagcugccgggaucuuuaugacagcaacaccaccaggcucacgugaccccuuuccacaaaguaaugcaccuauaauagaugaggaacgagaaauucccgaaagaaguuggaacucagggcaugaauggguuacagacuuuaaaggaaaaacagucugguuuguuccaucaaucaaagccggcaacgauauugcugcuugccugaggaaaaauggaaagaaaguaauacaacuuucgcguaaaacauucgacagugaauaugucaaaacacgaaccaacgauugggacuucguuguaacaacagauauauccgaaaugggagccaacuuuaaggcagagagaguaauagauccaagaagauguaugaaaccaguaauccuuacagauggggaagaacgagucauauuagcugguccaaugccaguaacgcauucuagugcugcucagcgacggggaagaaucggcagaaaccccaaaaaugaaaacgaucaauacauuuauaugggcgaaccccuagaaaacgacgaagauugugcacacuggaaagaggcuaagauguugcuagacaauaucaauacuccagagggaauaauacccuccauguuugaaccagaacgggagaaaguagacgcaauagauggagaguaucgacugcguggggaagcucgcaaaacauuuguugacuugaugaggagaggagaucuuccggucugguuagcguauaaaguagcugcugagggaauaaacuaugcugacaggcgauggugcuuugacgguauaaagaacaaucaaauauuagaagagaacguagaggucgaaauuuggacaaaagaaggagaaaggaagaaauuaaaaccaagaugguuggaugcacgaauauacagcgauccguuagcucuaaaagaguucaaggaauuugcugcaggacguaaaagucucacucuaaaucuaaucacagaaaugggaaggcuuccuacuuucaugacgcagaaaaccagggaugcucuagauaaccuugcggugcuccacacagcugaggcaggaggacgugccuauaaccacgccuuaagugaauugccagagacacuggagacacuacuauuacugacccuacuagcaacagucacaggagggauauucuuauuucuaaugucgggucguggaauuggaaagaugacacuuggcauguguugcauaaucaccgccagcauuuuacucugguacgcgcaaauacaaccgcacuggaucgccgcuaguauaaucuuagaguucuuuuugauaguguuacuaauucccgaaccugaaaaacagaggacaccccaagauaaucaguuaacuuacgucguaauagcaauccuaacuguuguagcggcaacaauggccaaugagauggguuuucuggagaaaaccaagaaagaucuaggccuaggaaguauagcaacgcagcaaccagaaucaaauauauuagauauagacuuacguccagcuucagcauggacuuuauaugcggucgcgacgaccuuuguaacgccuaugcugcgacauaguauagaaaacucaucggucaauguaucacuuacagcaauagcaaaccaagccaccguucugaugggauuagguaagggauggccacucucaaaaauggacaucgggguaccgcugcuggcaauagguuguuacagccaggucaacccaauaacgcugacagccgcccuccuacuacugguagcacauuacgccauaauuggaccgggacuacaagccaaagcuacgagagaagcccaaaaacgcgcagcugcaggcauaaugaaaaauccaacuguugaugguauuacaguaaucgauuuagauccaauaccuuacgauccuaaguuugaaaaacagcucggacaaguuaugcuucucauuuuaugcguaacacaaguauuaaugaugcgcaccaccugggcauuaugugaggcauuaacacuagcgaccggaccaauuucuacuuuaugggaggggaacccggggagguucuggaacacaacaauagcuguaaguauggcaaauauuuucaggggcucuuauuuggccggugcagguuuacuauucaguauuaugaaaaauacaacgaacacucguagaggaaccgggaacaugggagaaacccucggugaaaaauggaaauccaggcuaaaugcauuaggaaaauccgaguuccaaauuuauaagagaagugggauucaagaaguagauagaacccuugccaaagaaggcauaaaacgaggcgaaacagaccaccacgcaguaagcagaggcucggcuaaauugagaugguuuguagaaaggaacaugguuaccccagaagggaaagugguggauuugggauguggaagagguggauggaguuauuacugcgguggucuuaaaaauguacgagaaguaaaaggauugacuaaaggcgguccaggucacgaagaaccgauaccuaugaguacuuauggauggaaccuaguucgacuacaaagcggaguugaugucuucuuuauaccgcccgagaaaugcgauacucuauugugcgauauaggggaaaguucuccaaacccuacaguagaagccggucgaacguugagaguacucaaucuaguagaaaauugguuaaacaauaauacacaauuuugcaucaaaguguuaaauccauauaugccaaguguaauugaaaagauggaagcacugcaacgaaaguauggcggcgcacucguaagaaauccauugucccgaaauuccacacaugaaauguacugggugaguaaugcuucaggcaauauagugucaagcgucaauaugauuagcaggauguuaauuaaucguuucacgaugagacacaagaaagcgaccuacgaacccgacguugauuuggguucggggacuagaaacauagguacggaaucagaaauaccaaacuuggacauuauaggaaagagaauagagaaaauaaaacaagaacacgagacaucauggcauuaugaucaagaccacccauacaagacaugggcauaucacggaagcuaugaaacuaaacaaacaggaucggcaucaucaaugguaaacgguguuguuagauuacuaacgaaaccuugggacguccucccgacgguaacccagauggcaaugaccgacacuacccccuuuggacaacagcgagucuucaaagaaaagguagauacgcgcacucaagaaccuaaagaagguacgaagaaauuaaugaagaucacagcggaauggcuuuggaaagaauuaggcaagaagaaaaccccacgcaugugcacucgagaagaauuuacucgcaagguucguucaaacgcagcguugggagcuauauucacugaugaaaauaaauggaaaagcgcacgcgaggccguugaagauucacgcuucugggaacuuguugauaaagaaagaaaucuacaccuugaggguaaaugugaaacuugcguuuacaauaugauggggaaacgagaaaagaaacucggcgaguucggaaaggcuaaaggaagcagagcaauuugguacauguggcuuggggcccgauuucuagaauuugaagcgcuagguuucuuaaaugaagaccacugguuuucaagagaaaauucacugaguggaguugaaggagagggacugcauaaauuaggauacauacugagggacgucagcaagaaagagggaggugcaauguacgcggaugauacagcuggcugggauacaagaauuacucuagaagaucucaagaaugaagagaugguuacuaaucacaugaaaggugaacacaagaaauuggcagaggcaauauuuaaacuuacguaccaaaauaaggucguacgggugcagaggccaaccccacgaggaacaguuauggauauaaucucacgcagagaucagcgaggaagcggacaaguaggaacauauggacuuaauaccuuuacuaacauggaggcacaacuaauacgacagauggaaggcgaaggaguauucaaaaacauccaacaucuaaccguaacagaagagguagcugugcagaacuggcuagcucgugugggucgugaacgacuaucgaggauggccauuucuggugaugauugugugguaaaaccacuugaugauagauuugcuaacgcgcuuacugcacucaaugacauggguaaaauaagaaaggauauacaacaaugggagccaaguaaaggauggaaugacuggacucaaguacccuuuugcucacaucauuuccaugaacuaaucaugaaagacggaagagucuugguugucccuugcaggaaucaagacgaacuaauuggucgagcccgaauuagucaaggugcagguuggaguuugagagaaaccgccugcuuagggaaguccuaugcccaaauguggucuuuaauguacuuucauagaagggaucuacggcucgcugcgaacgcuauuuguucagccgugccaagccauuggguuccuacgucgagaacaacauggucaauucaugcaaagcaugaauggaugaccacagaagauaugcuaacgguuuggaauagaguuuggauaagagagaacccauggauggaagacaaaaccccaguugagucgugggaggaaauacccuaucugggaaaacgagaagaucaaugguguggaucucuaauaggcuugaccaguagggcaacaugggcaaagaacauccaagcggccauuaaucaaguaaggucucuaauagggaaugaagaguauacggacuauaugccuagcaugaagagauucagacgagaggaggaagaagcaggaguuuuaugguag

SEQ ID NO: 22690 - RNA, 9876 nt, Artificial Sequence
  derived and/or modified CDS sequence (opt6) from DENV-2__FJ024458__SS-prME
ucagccggaaugauaauaaugcugaucccuacaguaauggcauuccauuuaacgacccgcaacggugaaccacacaugauuguggggauccaagaaaaagguaaaucucuacuuuucaaaaccgaagauggcguaaauaugugcacgcuaauggcgauggaccucggugaacuaugugaagacacaauaacauauaaauguccauuauuaaggcaaaacgaaccagaagauaucgauuguugguguaauagcacgucaacuuggguuaccuaugguacguguacaaccacaggagaacacaggagagagaaaagaucuguagcuuugguaccacacguuggaaugggccuggaaaccaggaccgaaacuuggauguccucugaaggcgcauggaaacacgcucaaagaauagaaacguggauacuccgacaucccggguuuacuauaauggcugcuaucuuagcuuauacaauagguaccacacauuuccaacgcguauuaauauuuauuuuacuaacggcaguggcucccucaaugacaaugcgcugcauagguauaucuaaucgggacuucguugaaggaguguccgguggcucuugggucgacauagugcuagaacaugguagcugcguuacaacaauggcgaaaaacaaaccuacguuggauuucgaacuaauaaagacggaagcaaaacaaccagcuacacuaagaaaauauuguauagaagcuaaacucaccaauacuacaacggaaagucggugcccaacccaaggggaaccuagccuaaaagaagaacaagacaagcgcuucguauguaagcacaguaugguagaucgcgggugggggaaugguuguggauuauucggaaaaggcggaaucguuacaugcgcaauguucacauguaagaaaaauauggagggaaaaaucguucaaccugagaauuuagaauacacgauuguggugacaccgcacucaggagaggaacaugcaguuggaaaugauaccggaaaacacggaaaagagaucaaaguuacaccacagucgucaauuacagaagcagaacugacuggguauggaacuguaacaauggaauguucuccgagaaccggauuagauuucaaugaaauggugcuuuugcaaauggaaaauaaggcguggcuaguccaucgacaaugguucuuagacuuaccgcuaccaugguuaccaggggcagauaaacaagaaucaaacuggauccaaaaagaaacauuaguaacauuuaagaauccacacgcuaagaaacaagacguagucguacuuggaucucaagagggugcgaugcauaccgcacuuacaggcgcuacagaaauacaaaugagcaguggcaauuuauuauucacaggacaucucaaaugucgauugcggauggauaaauuacaacucaagggaauguccuauuccauguguacagggaaauucaaaguagucaaagaaaucgcagagacccaacaugguacaauagucaucagagugcaauaugaaggggaugguaguccuugcaaaauccccuuugaaaucauggaucuggagaagcguuaugucuuaggccgauuaauuacaguaaauccuauagucacggaaaaagauagcccaguaaacauagaagcagaaccacccuuuggagauucauauaucauaauuggggucgaaccaggacaacuuaaguugaauugguuuaagaaagguucuucaauuggacaaauguuugaaacgacaaugagaggugcaaaacggauggcgauccuaggugauaccgcuugggacuucggaagucugggcgguguauuuaccaguauuggaaaagcguuacaccaaguauuuggcgccauauacggcgcugcuuucagcggcguaucauggacgaugaaaauccugauaggggucauaauaacauggauaggcaugaacagcagauccacuucacuaagcguuucucuagugcuagucgggauagucacauuauaucuuggaguuaugguacaagcagacucuggauguguaguaucauggaagaauaaggaauuaaaauguggaucaggcauauuuauaacggacaauguacacacuuggacugaacaauacaaauuucagccagaaucucccucgaaguuggcaucggcuauacaaaaggcccaagaggaaggaaucugcggcauacguucggucacucgauuagagaaucuuauguggaaacaaauaacaccagaauuaaaucauauucuagcggaaaaugagguaaaacucacaauuaugacuggagauauuaaaggcaucaugcaagcaggccggagaucacucagaccacagccaacugaauuaaaguauucauggaagacuuggggcaaagcuaaaauguugucaacagagagcuacaaccaaacauuuuugauagauggcccggaaacagcagaauguccuaauacgaacagagccuggaacucauuagaaguagaagacuaugguuuuggaguuuuuacgacgaauaucuggcuuaagcugaaggaaaagcaagaugcauuuugugacaguaaacuaaugagcgcagcaaucaaggauaaucgagccguccacgcagauauggacuauuggauagaaucugccuuaaacgauacauggaagauagagaaggcauccuucauugaagucaaaaauugucauugggcaaaaagucacacuuuauggaguaauggugucuuagaaucagaaaugauaauuccaaagaauuuagcaggaccagucucacagcacaauuaccguuuaggauaccauacacaaauagcgggacccuggcauuuaggaaaauuagaaauggacuuugauuucugugauggaaccacagucauaguuacagaagauugcggaaaccgaggaccaagucucaggaccacuacagcaucaggcaaauugauaacagagugguguugucgaaguuguacuuuacccccauuaagguauagaggagaggacggauguugguauggaauggaaauuaggccacuaaaggaaaaagaagagaaccucguaaauucccucguaaccgcgggacacggucagguggacaauuucucuuuaggaguacuagguauggcgcucuuucuagaagaaaugcugcgcacgcguguuggaacuaaacacgcaauucuauuaguagcaguaaguuuugugacccugauaaccggaaacaugagcuuuaaagaucugggacgugucguuguaauggucggggcaaccauggcggaugauaucggaaugggugucacauacuuagcacuuuuagcggcauucaagguucguccuacauucgcugcuggucuacuacuucgcaaacuaacuuccaaagaacucaugaugacaacaauuggcaucguauuauugucccaaagcacgauuccggaaacggugcuagaacuaacugaugcacuugcucucgggaugaugguuuuaaaaauagucaggaauauggaaaaauaucaauuagcaguuacgauaauggcaauauuaugcguaccuaaugcagucaucuuacaaaaugcguggaagguuucuuguacuauuuuagcuguagugucagucagcccauuguuacuuacauccucacagcagaaaaccgauuggauuccauuggcacuaacgaucaagggucuaaaucccaccgccauauuucucacuacccuuagcagaacgaauaagaaaagaucguggccacuuaacgaagcuauaauggcugucggaaugguuucaauuuuggccucgucacuauugaaaaaugacaucccgaugacaggcccacuuguagccggaggcuugcuuaccguauguuacguuuuaacggggagaucggccgaccuugaacuagaacgggcgacagacguaaaaugggaagaccaagcagagaucuccgguaguucuccgaucuuaucuauaacuaucagcgaagacggcucuaugaguauuaaaaaugaagaggaagaacaaacucuaacuauuuugauuagaacgggcuuacucguaaucucaggauuauucccuauaaguauaccaauaacagcagcugcaugguaccuaugggagguuaagaagcaaagagcaggaguauuaugggauguuccaucgccgccaccaaugggcaaagccgaacuagaagauggugcuuacaggauaaagcaaaagggcauccucggauacagucaaaucggggccgguguuuacaaggaaggaacuuuucauacgauguggcauguaacacgcggggcggugcuaaugcauaaaggaaaacguaucgaaccuucaugggccgacguuaagaaagaccuaauaucauauggagguggauggaaguuagaaggugaauggaaagaaggcgaagaaguacaaguuuuagcauuagaacccggcaaaaauccgcgagcaguacaaacaaaacccggguuauuuaaaacuaauacaggcacgauuggagcgguuaguuuagauuucucuccaggaacaagcgguagucccaucauugauaagaagggaaaaguagucgggcuuuaugguaauggcgucgugacaagaucuggugcuuauguuagugcuauagcccaaacggagaaaucuauugaagacaauccagaaauagaagaugacauauucaggaaaagacgacucaccaucauggaucuccacccaggugccggaaaaacaaaacgcuauuugccugcaauugucagagaagcgauuaaaagaggcuuacgaacauugauucuugcuccuacgaggguaguagcggccgaaauggaagaagcacuacgaggcuugcccauucgcuaccaaacucccgcaaucagggcagaacauaccggucgugaaaucguggaucugaugugccaugcuacauuuacgaugagacuacugucgccuguuagaguacccaauuacaauuuaauaauuauggaugaagcucauuucacagacccagcaucaauugcggcccgagguuacauauccacgcgcguugaaaugggagaggcagccggaauauuuaugaccgcaacuccgcccggaagccgagacccuuucccucagaguaacgcuccgauaauagacgaagagagggaaauaccggagagaucauggaacagcggacaugaauggguuacugacuuuaagggaaaaacagugugguuugucccauccauaaaagcaggcaaugauaucgcugcaugccuaagaaagaacgguaagaaaguaauacagcugucucgaaaaaccuucgacucagaauauguuaagacacgcacaaacgauugggauuuuguuguaacaaccgauauaagcgaaaugggggcuaacuucaaagcggaaagagucauugaucccagacguugcaugaaaccaguaauauuaacagacggugaggagaggguuauuuuagcagguccaaugccugucacucacagcucagcggcccaacgacgagguaggauaggaagaaaccccaaaaaugaaaaugaucaguauauauauaugggcgagccguuagaaaaugaugaagacugugcucauuggaaagaagcgaaaaugcuacucgacaauauaaauacccccgagggaaucauaccgucaauguucgaaccugagagagaaaagguagaugcaauagacggcgaauauagguugcgaggggaagcccgaaaaacauucguagaucuuaugagaagaggagaccuaccuguauggcuggcauacaaaguugccgcugagggaauuaauuacgcggaucgaagauggugcuuugauggaauuaagaacaaucaaauuuuagaagaaaauguugaaguggagauuuggacuaaggagggcgaacgcaagaaguuaaagccucguuggcuugaugcacguauauauuccgacccauuagcucucaaagaauuuaaagaauuugcagcuggacguaaaucgcucacgcuaaauuuaauaacagaaaugggacgauuaccgacguuuaugacccagaaaacaagggacgcgcuugauaaccuugcaguacuacacacagccgaagcaggaggccgagcauacaaucaugcgcucagugagcuaccagagacguuagaaacucuuuugcuguuaacguuguuggccaccgucaccggagggauauuccuuuucuuaaugucagggaggggaauaggcaaaaugacccucgguauguguugcauaauaacagcaucgauuuuauuaugguacgcccaaauacaaccacacuggauagcugcgucaauaauauuagaguucuuucugauaguauuauuaaucccugaaccagaaaagcaacggacaccacaagacaaucaguugacauaugugguuauagcgauauuaacaguaguagcagcaacaauggcuaaugaaaugggauuuuuagaaaagacgaagaaagauuucggacuuggcucaauugcuacccagcaacccgagucgaauaucuuagacauagaucuaagaccugcaucugcauggacacucuacgcuguagccacaaccuuuguaacucccaugcuaagacacuccauagagaacucuaguguaaaugucucgcuaacagccauagcuaaucaggcuacuguuuuaaugggguuaggcaagggauggccguuaagcaaaauggauauuggcguaccauugcuagcaauugguuguuauucacaaguuaauccuauuacuuugaccgcugcuuuacuccuuuugguagcgcauuaugcuauaauuggaccaggucuucaagccaaagccacuagagaagcgcaaaagagggcggcugcuggaaucaugaaaaauccuacagucgacggaauuacgguaaucgaccuagauccuauaccauacgauccuaaauucgaaaagcaauuaggacaaguaauguugcuaauacuuuguguaacacaagucuuaaugaugcgaacaacaugggcuuuaugugaagcccugacucuagcaacaggccccauaucaacucucugggaagguaaucccggucgcuuuuggaauaccacaauagccguaaguauggcaaacauauuccgggggaguuacuuagcaggcgcuggauuguuguucucaauuaugaagaauacuaccaauacaagaagaggaacaggaaauaucggagagacacuaggagaaaaauggaaaucacgauuaaaugcguugggaaaaagugaauuucaaauauacaagaaaagcgguauacaagaaguugacagaacauuagcaaaagaagggauuaaaaggggcgaaacagaccaccaugcaguuucaagggguucagcuaaacuuaggugguucguagaacgaaacaugguaacaccagaaggcaagguaguagaccuuggguguggacgagguggauggucauacuauuguggcgggcucaaaaaugucagggaaguaaaaggacuaacgaaaggagggccuggacacgaagaacccauaccuaugaguaccuauggauggaaccuaguccgcuugcagucuggcguugacguauucuuuauuccaccggaaaagugugacacacuccucugcgauaucggagaaucgucuccgaauccuacuguagaagcagggaggacacuacgggucuuaaaccuaguagaaaauuggcuuaauaacaauacgcaauucuguauaaagguucucaacccguauaugccaucaguuauagagaaaauggaagccuuacagcgaaaauauggaggugcauuaguaagaaaucccuugucucggaacaguacgcacgagauguacuggguuucaaacgcuucagguaauaucguuucaagcgucaauaugauuucaagaaugcuaauaaaccguuuuaccaugcggcauaagaaagcgacauaugagccugauguagaccuaggcagugggacuagaaacauaggaauagaaagugaaauaccaaaccuugauaucauugguaaaaggauagagaaaauaaaacaagagcacgaaacuucauggcauuacgaucaagaucaucccuauaaaacuugggcuuaucacggauccuaugagacaaaacaaacugguucggcaucaagcaugguaaaugggguagucagacugcuaacaaaaccgugggauguacuaccaacugucacucaaauggccaugacggauacuacaccuuucggucaacagcguguauucaaagaaaaaguagauacgcgaacacaagagcccaaagaaggaacuaaaaagcuaaugaaaauaaccgcugaguggcuauggaaagaauuggggaagaagaaaacaccgagaauguguacuagagaagaauuuacgcgaaaaguacguucuaaugcugcacuaggagcaauauucaccgaugagaauaaauggaaaagugcaagggaagcaguagaagacagccgauucugggaguuagucgauaaagaaagaaauuuacacuuggaggguaaaugcgagacauguguauauaacaugauggggaaaagagagaagaaacuaggggaguucggaaaagccaaagggucaagagcuauaugguauauguggcuuggcgcucgcuuuuuagaauuugaagcacuuggauuccugaaugaagaccacugguuuuccagggaaaacucuuuaucgggagucgaaggagaaggcuuacauaaauugggguauauacuucgcgauguuaguaagaaagaagguggugcaauguaugcggaugauacugcaggaugggacaccagaauaacauuagaagaucucaaaaaugaagaaauggucacuaaucacauggaaggggaacauaagaaacuagcagaagcuauauucaaacuaacauaccagaauaaaguagucagaguucagaggcccacuccucggggaacaguuauggauauuauuucgagacgcgaucaaagaggcaguggucaagucggaacguauggucuuaacacauuuacuaacauggaggcucaacuaauuaggcaaauggaaggagaaggcguguuuaaaaacauucaacauuuaacaguuacagaagagguagcaguacaaaacuggcuggcuaggguugguagagaaagauuaucuagaauggcuauaagcggggaugauugcgucguaaagccguuggaugacagguuugcaaacgcuuuaacugcguugaaugauaugggaaaaauuaggaaagacauacaacaaugggaaccgaguaaaggauggaaugauuggacacagguaccuuuuugcagucaucacuuccaugaauugauaaugaaagauggacgaguguuggucguacccugcagaaaucaagacgaacuaauuggacgggcccggauuucccaaggagcggguuggaguuugagagaaacggcuuguuuagggaaaaguuaugcccaaauguggucacugauguauuuucaccgaagggaucugagauuagcagcaaaugcaauaugcuccgccguuccgagccauuggguuccuacuucaagaacaacauggaguauucaugccaagcaugaauggaugacuaccgaggauaugcugacuguauggaauagaguauggauacgcgaaaacccuuggauggaagauaaaacaccgguagagaguugggaagaaauacccuaucuagggaagcgcgaagaccaaugguguggcuccuugaucggacuuacaagccgcgcuacaugggcgaaaaauauucaagcagcaauuaaccaaguuaggagcuuaauuggcaaugaagaauacacagauuauaugccguccaugaaaagauucaggcgagaagaagaggaggcuggggugcucugguaa

SEQ ID NO: 22691 - RNA, 9876 nt, Artificial Sequence
  derived and/or modified CDS sequence (opt6) from DENV-2__FJ205880__SS-prME
agcgcaggcaugauuauaauguuaauaccaaccguuauggcuuuucaucuaacuacgagaaacggugaaccacauaugauuguaggaauacaagaaaaaggcaaaucucuacuauucaaaacagaagacgggguuaacaugugcacacucauggcuauggacuuaggggaacuuugcgaagauacgauaacguacaaaugcccucucuuacgucaaaaugaaccggaagacauagauuguugguguaauuccacuuccacuuggguaaccuauggaaccugcacgacuacgggggaacaucggcgagagaaaagaaguguugcauuaguaccacauguagguaugggucuagaaacucguacagaaacuuggaugucaagcgaaggagcuuggaaacaugcucaaaggauugaaacauggauccuaagacauccagguuuuaccauaauggccgcaauucuagccuauacgauaggcacgacucacuuucaaaggguacugaucuuuauuuuauuaaccgcaguagcuccgucgaugacgaugcgauguauagggauaucaaacagagacuuuguagaaggcguguccggaggaucauggguggauauugucuuagaacaugguucuuguguuacuacgauggccaaaaauaaaccuacuuuagacuuugaauugauuaaaaccgaagcuaaacaaccagcuacacuuagaaaauauuguauagaggcuaaauuaacuaauacuacaacggaaagccgcuguccaacucaaggagaaccuagucuuaaagaagaacaagauaaaagauuugucugcaaacauucaaugguagacagaggaugggggaacgguuguggcuuauucggaaaagguggaaucgucaccugugcaauguuuacauguaagaaaaauauggaaggaaaaauuguucaacccgagaauuuggaauauacuauagucguaacuccacauucaggugaggaacaugcaguuggaaaugauacaggaaaacauggccaggagauaaaaguaacuccacaaucuaguaucacagaagcagaauuaacaggauaugggaccguaacaauggaaugcucaccucguacagggcuagacuuuaaugagaugguacuauuacagauggaaaauaaagcauggcuuguccacagacagugguuucuugauuuaccucugcccugguuaccgggugcugauaaacaagagaguaacuggauccaaaaagaaacauuagugacauucaaaaacccccacgccaagaaacaagauguagugguauuaggaucgcaagaaggggcaaugcacacagcacucacuggugcuacggaaauacagaugaguucaggaaauuuauuauucaccggacaucuuaaaugccgucuacguauggauaaacuacaguugaaaggaaugagcuauaguaugugcacggggaaauuuaaagucgucaaagaaauagcugaaacucaacauggcacaaucguaaucagaguacaguacgaaggagacgguucacccugcaaaauaccguuugagauaauggaccuagagaaacgauauguacuaggucgauuaauaaccguaaauccgauagucacggaaaaagauucaccaguaaacauugaagccgaaccgccauucggagacaguuauauuauaauaggaguggaaccgggacaacuaaaauugaacugguucaagaaagguuccucuauaggacaaauguucgagacuaccaugagaggggccaaacgaauggcuauacuaggcgacacagcaugggacuuuggaagccuuggaggcguuuuuacaucuaucgggaaggcacuucaccaaguuuuuggagcaauauauggcgcagcauuuagcggggugaguuggacgaugaaaauacugauuggaguuaucaucacguggauaggaaugaacucucgaaguaccucauugaguguuaguuuaguucuaguaggaauaguaacucuauaccucggcguaauggugcaagcugauucagguugcguagugucauggaaaaauaaagaauuaaaaugcgguuccggaauauuuauaacagauaauguacauacguggacagaacaauauaaguuccaaccagagucaccuagcaaacuugccagcgccauacaaaaggcucaagaagaaggaauuugugguauaaggagugugaccagacuugagaacuuaauguggaagcaaauaacacccgaacuaaaucacauacucgcagagaacgaagucaaauuaacgauaaugaccggagauauuaagggcaucaugcaagcagguaaaaggucauugaggccacaaccaacagaacuuaaauauaguuggaaaaccuggggaaaagcaaagaugcucuccacggaaagcuauaaccagacauuuuugauugacgguccggagacagcggaaugucccaacaccaauagagcuuggaacucucuugaaguugaggacuauggcuucggaguauucaccacuaauauaugguuaaaauuaaaagaaaaacaagaugcgucaugugauaguaaacugaugucugccgcaauuaaggacaaucgagcaguucacgcggauaugggguauuggauagaguccgcauuaaaugauacauggaaaauugagaaggcuucauuuauagaggugaaaaauugccacuggccaaaaucucauacccuauggaguaauggugugcuugaaucugagaugauaaucccgaaaaaccuagcuggaccaguuagucaacauaacuacagaccuggauaucauacucaaauugcaggucccuggcaucuaggaaaacuagagauggauuucgauuucugugacggcacgacaguaauugugacugaggacugugguaauagggggcccucauuaagaacaacaacugcaucugguaaacuaauuacagaaugguguuguagaucuugcacucugccaccucuuagauaucgaggugaggauggaugcugguauggaauggagauacgcccauuaaaggaaaaagaagaaaaucuuguaaacucacucguaacugcuggacauggccaaguugacaacuuuucucuaggcguuuugggaauggcgcuauuccuggaggaaaugcugaaaacaagaguaggcacaaaacaugcaaucuuauuagucgcagucagcuuuguaacacuaauaacaggaaauaugaguuuuaaagaucuuggacgcguaguaguuaugguaggugccacaauggcagaugauaucgguaugggaguaacuuaccuggcacuacuugcugcguuuaaaguuagaccaacauucgccgccgguuuauugcugagaaaacugaccucaaaggaacuaaugaugacaacuauuggaauagugcuguuaagucaaagcacuauucccgaaacagucuuagaguuaacugacgcucuggcacuagggaugaugguauugaaaauaguacggaauauggaaaaauaccagcuggccgugacaauaauggcaauacucugcguuccuaacgccguaauauuacagaaugcguggaaagucucaugcacaaucuuagcaguuguuagugugucgccguuauuauugacaaguagucagcagaaaaccgacuggauacccuuagcccuaacaaucaaaggauuaaacccaaccgcuauauuucuaaccacucuuucaagaacaaauaagaaaagaagcuggccauuaaaugaagccauaauggcggucggaaugguaucaauacuagcgucuuccuuacuuaaaaaugauauuccgaugacuggcccccuaguagcuggggguuugcuaaccgucuguuacguacuaacugguaggagcgcugaucuggaacucgagcgagcgacagauguuaagugggaagaucaagcagaaauaucuggaucaucuccaauacugaguaucaccauuucagaggacggcagcaugucgaucaaaaacgaagaggaagaacaaaccuugacuauuuugauuagaacaggcuuauuaguaauaucuggacuauucccuauuaguauaccgauuacagccgcagcaugguaucuaugggaggucaagaaacagcgugcugggguuuuaugggaugugccgaguccaccuccaauggggaaagccgaauuagaggauggcgcuuaucgcaucaaacagaagggcauacucggcuauucccaaauuggagcggggguguacaaggaagguacauuccauaccauguggcauguaacccggggagcaguauuaaugcacaagggcaagcgcauagaaccauccugggcagaugucaagaaagaccugauaaguuacgguggaggauggaagcuagaaggcgaguggaaagagggggaagaaguacaaguauuggcucuugaaccaggcaaaaauccgcgugcggugcagacuaagccaggcuuauucaaaaccaauacuggaaccauaggcgcaguaucacuagacuuuucacccggaacaucuggaaguccuauuaucgauaagaagggaaaaguaguaggacuauacggaaauggugugguuacacgcaguggugcauauguuuccgcaauagcacagacugagaaaaguauagaagauaauccagaaauagaagacgacauauuucgaaagagacgauuaacaauaauggauuuacauccaggggcaggaaaaacaaaacgauauuuaccggcuauaguucgugaagcaaucaaacgagguuuaagaacccugauacuugccccaacuagaguuguagcagccgaaauggaagaagcauuacguggauugccuauuagauaucaaacaccagcaauucgagccgagcauacugguagggaaaucgucgaccuaaugugccaugcuacauuuacgaugagguuacucucaccuguccgcguuccaaacuauaaccuaaucauaauggaugaagcacacuuuacggauccagcaucgauugcagcuagggguuacauaucaaccagggucgagaugggcgaagcugcagggauuuucaugacagcgacgccgccuggaucccgugaccccuuuccacaaaguaacgcuccuaucauagacgaagaaagggaaauaccugaaagaaguuggaacucaggucaugaauggguuacggauuuuaaagggaaaacaguaugguucgugccaucuauuaaagcuggaaaugacauugcugcgugccuacgcaagaauggaaagaaagugauacaacuuucaagaaagacuuucgauucagaauauguaaaaacacguaccaaugauugggauuuuguuguaaccacagauauaagugagaugggagccaauuucaaagcagaacgagugauugauccacgaagguguaugaagccaguaaucuuaacagacggcgaagaacggguaauccuagcagggccaaugccugugacacacuccucagcagcucaaagacgaggacgaauaggucggaacccuaaaaaugaaaacgaucaauauauauauaugggagaaccauuagagaaugaugaagauugcgcacauuggaaggaagccaagaugcuauuagacaacauuaacacacccgagggcauuauaccaaguauguucgaaccagaacgcgagaaaguggaugcaauugauggagaauauaggcuacgcggagaagcccgaaaaacauucguugaucugaugcggaggggcgaucuaccaguaugguuagcuuauaaaguugccgccgaaggcauaaacuacgcagauagacguugguguuuugacggaauuaaaaauaaucaaauuuuagaagaaaauguagaaguugaaauuuggacuaaagagggggaaaggaagaaauuaaaaccgcgaugguuagacgcaaggaucuauucggacccacucgcucugaaagaauuuaaagaauuugcugcaggcagaaaaaguuuaacucucaacuuaauaacggagaugggacgcuuacccacuuucaugacccagaaaaccagagaugcucuggauaacuuggcgguacuacauacagcugaagccgggggucgcgcauacaaucaugcacuaucugaauuaccagaaacgcuggagacucuauuauuauuaacauuauuagcuacaguuacaggggguauauuuuuguuccuuaugaguggaagggggauaggcaaaaugacucuagguauguguugcauuauaacagcuucuauauuguuaugguaugcucaaauucaaccacauuggauagccgccagcauaauacuggaguucuuuuugauaguucucuuaaucccagagccagagaagcaaagaacgccacaagauaaucaauugacuuaugucgucauagcaauauugacgguugucgcugccacaauggcgaaugaaaugggauucuuagagaaaacuaagaaagaucuaggucuagggagcauugcuacucagcaaccagaaaguaauauucuggacauagaccuuagacccgcgucugcauggacucuuuacgcugucgcgacaacauuuguaacaccgauguuacgacacaguauugaaaauucgagugucaaugugagccuaaccgcaaucgcuaaucaagcaacuguuuuaaugggucucgggaaaggauggcccuuaucaaaaauggauaucggggugccuuuacuagcuauuggguguuauucucagguuaauccgauaacccuuaccgcagcuuugcugcuuuuaguagcacacuacgcaauuaucggaccugggcuacaggcgaaagcaacucgagaagcgcaaaaacgcgcugcagcuggcauuaugaaaaacccuacaguagauggaaucacaguuauagacuuagauccaauuccguacgacccaaaauucgagaaacaacuugggcaaguuaugcuauuaauccuguguguaacacaagucuuaaugaugagaacaacaugggcccuaugcgaggcacugacauuagcuacagguccaaucaguacacuuugggaagggaauccuggccgauuuuggaauacaacaaucgcaguuucaauggccaauauuuuuagaggaagcuaucuggccggagccggauuacuauuuaguaucaugaagaacacuaccaacacgagaagagggacuggcaauaugggcgaaacacuaggugaaaaauggaaaucucggcugaaugcgcuaggaaaaucugaauuucaaauauauaagaaaucggggauccaagagguagauagaacuuuagcaaaagagggaauaaaaaggggagagacagaucaucacgcggugucuagaggaucagccaaguuaagaugguucguugaacgcaauaugguaacaccagaagguaaaguaguggaucuaggaugcggccgaggggguuggucauauuauugcggcggguugaaaaauguccgugaaguaaaaggauuaacuaaaggaggaccaggccaugaagaacccaucccgaugucuacguacgguuggaaucuaguacgacuccaaucaggaguugauguauucuucaucccaccggaaaaaugugauacauuacucugugauauuggagaguccucgccuaaucccacuguugaagcuggacgaacccuuagaguacucaaucuuguugaaaacugguugaauaauaacacacaauucuguauuaagguauugaauccuuacaugcccaguguaauagagaagauggaagcguugcagcgcaaauaugggggagcgcucgugaggaauccucuuaguaggaacaguacgcacgaaauguacugggugagcaaugcaaguggcaauaucguaucuaguguaaacaugauaucacgaauguuaauuaaucgguuuacgaugcgacauaagaaagcaacuuaugaaccagauguagaccuugggaguggaacccgaaauaucggaauagaaucagaaauuccaaaucuggauauaauaggaaaacggauugaaaagauaaagcaggaacacgagaccucuuggcacuaugaucaagaucacccauauaaaacaugggcguaucaugguucguaugaaacaaaacaaacuggaagcgcuucaucuaugguuaaugggguaguaagauuguugacaaaaccaugggaugugcuaccuacugucacacaaauggcuaugacagauacuaccccuuuuggacagcagcgaguguucaaggaaaaaguagacacacguacacaagagccaaaagaagggacuaagaaauuaaugaaaauuacggcagaaugguuguggaaagaacuggguaagaagaaaacaccgagaaugugcacuagggaagaauuuaccagaaaagucagaucaaaugcagcauuaggugcuaucuucacugaugaaaacaaauggaaaucagcucgcgaagcuguagaagauagcagauuuugggaacuggucgacaaagaaagaaaucuacacuuagagggcaaaugugaaacauguguauacaauaugaugggaaaaagggaaaagaaauuaggugaguucggaaaagcaaaaggaaguagagcgauuugguacauguggcuaggugcuagguuuuuggaguucgaagccuuaggguuccuaaacgaagaccauugguucucaagagaaaauagcuuaucuggcguggaaggagaagguuuacacaaguugggauauauuuuaagagacguuagcaagaaagaagguggggcaauguaugcggaugauacagcugguugggacacucguauuacacuagaagaucuuaaaaacgaagaaauggucacaaaccacauggaaggagaacacaagaaacuugcagaagcgauauuuaaguuaaccuaucaaaauaaagucguacgaguacaaagaccaacgccacgagggacagugauggacauaauuuccagaagggaccagagaggaagugggcaaguaggcacauauggauuaaauaccuuuacuaauauggaagcacaauugauacgccaaauggaaggggaaggaguuuuuaagaauauucaacaccuuacugucacagaagaaguugccguacagaacugguuagcgcgaguuggaagggaacgucuuaguaggauggcaauuucuggcgaugacugcgugguuaagccacuggacgaucgcuuugcuaaugcgcuaacggcucuaaaugacauggguaaaaucagaaaagacauccaacaaugggagccuaguaaaggguggaacgacuggacccaaguuccauuuugcagucaucauuuccacgaauuaauuaugaaagacgggagagucuuagucguaccaugcagaaaccaagaugaguugauuggcagggcaagaauaagccaaggugcaggauggucuuugagggaaaccgccugccuggggaaaucauaugcucaaauguggaguuugauguacuuccauagaagagaucuaaggcucgcagcuaaugccauaugcagcgccguuccuucccacugggugccaacaucacggaccacauggucuauacaugcaaagcaugaauggaugaccaccgaagauauguuaacgguauggaaccgcgucuggauucgagaaaauccauggauggaagauaaaaccccaguggaaucaugggaggagauaccauaucuagggaaacgugaagaucagugguguggaucuuugauaggguugacgucgagagcaacaugggcaaagaacauacaggcagcaauuaaucaaguacguucucucauagggaaugaagaguauacagauuacaugccuucaaugaaacgauuuagaagggaagaagaagaggcaggcguccuaugguga

SEQ ID NO: 22692 - RNA, 9876 nt, Artificial Sequence
  derived and/or modified CDS sequence (opt6) from DENV-2__FJ390387__SS-prME
ucggcugguaugaucauaaugcuaauuccuacaguaauggcuuuucauuugacuacacggaauggcgaaccccacaugauuguagguauacaagaaaaaggcaagucguuauuguuuaaaacagaagauggggugaacauguguaccuuaauggcaauggaucuaggugaacuaugugaagauacuauuacauauaaauguccuuuauugcgacaaaaugaacccgaagacauagacuguugguguaauagcaccagcacaugggucacuuauggcaccugcacuacuaccggugaacacaggagagaaaagcgauccguagccuugguuccacacguaggcaugggucuggaaacuagaaccgaaacauggaugucaucagaaggcgccuggaaacacgcacagagaauagaaacauggauccuucgucaucccgguuucacaauaauggcugcuauacuggccuacacaauuggaaccacucauuuccaacggguauuaauauuuauacucuuaaccgcaguugcuccgaguaugacuaugcgaugcauagguauaucgaaucgcgauuucguagaagguguuucugguggaucauggguagauauaguucuagaacacggaucauguguaacuacuauggcuaaaaauaaaccuaccuuagauuucgaacuuauuaaaacugaagcaaaacaacccgccacauuacggaaauauugcauagaagcaaaacuaaccaauacaacaacggaaagcaggugcccgacacaaggagaaccgucgcuaaaagaagaacaagauaaacgguuugucuguaaacacagcaugguagaucgagggugggguaauggaugcgguuuauuugggaaaggaggcauugugacaugugccauguuuacauguaaaaaaaauauggaaggaaaaauaguccagccggagaacuuggaauauacaauaguagucacaccacauucaggagaagaacacgcugucggaaaugacacgggaaagcauggacaagaaauaaaaguuacaccacagagcucuauuacagaagcagaguuaaccggauacggaacaguuacgauggagugcaguccaagaaccggacuugauuucaaugaaaugguauuauuacagauggagaauaaagccuggcuaguccaccgacaaugguuucuagauuuaccucugccauggcuacccggcgcugauaaacaggaaucaaacuggauacagaaagaaacgcucguaacuuuuaaaaacccacacgccaaaaaacaagacguagugguguuaggcucgcaggagggggcaaugcauacagcgcuaaccggagccacugaaauccagaugucaucaggaaacuuauuauuuacgggacaucucaaguguagacugagaauggacaaauugcaacuuaaggggaugucguacagcauguguacagguaaauuuaaaguaguuaaagaaauugcagagacgcaacaugggacuauagugauacggguccaauacgaaggcgacgggucacccugcaaagucccguuugaaauaauggacuuagaaaaaagguacguacuagguagguuaaucacaguaaacccaauuguaacagaaaaagauucccccgucaacauagaagcggaaccgccguuuggcgacaguuacaucauaauaggagucgaaccagggcagcucaaacuaaauugguuuaaaaagggaagcucgauuggacaaauguucgaaacaacaaugcgaggugcaaaaagaauggcgauuuuaggagauacagcaugggauuuugguagcuuaggaggcguuuuuacuaguauaggcaaagccuuacaccagguauuuggagcaauauauggagcagcuuucucaggcgucaguuggacaaugaaaauucuaauaggaguuauaauaacauggauaggaaugaacaguagaaguacauccuuauccguuucucuaguguuagucggaauuguaacucuauauuuaggggucaugguccaagccgacagcgggugcguuguaucauggaaaaacaaggaacuaaaguguggcucaggcaucuuuauaacagauaacguucauaccuggacugaacaauauaaauuccagccugaaucuccaucgaagcuagccagcgccauacaaaaggcacaagaggaaggaaucugugggauacggucugugacaagacuugaaaacuuaauguggaaacagaucacaccagagcuaaaccauauacucgccgagaaugaagucaaacuaaccauaaugacuggagauauaaaaggcauaaugcaagcaggaaaaagaucauuaagaccccaaccaacugagcugaaauauagcuggaaaacauggggaaaagccaagauguuaaguacggaaucuuauaaucaaaccuuucuaauagauggaccagaaacggcagaaugccccaauacaaauagagcauggaauuccuuagaagucgaggacuacggauucggaguauucaccacuaacaucuggcugaaacuaaaagaaaaacaagacgcuuucugcgacagcaaacuuaugucagcugcgaucaaagacaauagggcuguacaugcugacauggguuauuggaucgaaucagcauugaacgacacguggaaaauagaaaaagcgaguuuuauagaaguuaagaauugucacuggcccaaaagucacacacugugguccaauggaguccuggaaucugagaugauaauacccaaaaacuuagcggguccagugagccagcauaauuacagacccggcuaucauacacaaauugcaggaccauggcauuuaggaaaauuagaaauggauuucgacuucugcgacggaacuacaguuauagugacggaagauugcgggaacagggggcccagccugagaacaacuacagccaguggaaaacugaucacagagugguguuguagaucuugcacucuuccuccucuaagauaccgaggagaagauggaugcugguauggcauggagauacgaccacucaaagagaaagaagaaaaccuaguaaacagucugguuacagcuggacacggccaaguugacaauuuuagccuagggguccucggaauggcacucuuccuagaagaaaugcuccgcacaagggugggcacuaagcaugccauuuuauugguggcuguaucuuucguaacauuaauaacagggaacaugucauucaaagaccuaggccguguagucguaaugguuggagcgacaaugaccgaugacauugggaugggaguaacuuauuuagcgcuuuuagcagcuuuuaaagugagaccuacauucgcagccgggcugcuauugagaaaauuaacaaguaaggaacuuaugaugacuaccauugggauugucuuacucucucagucgacuauuccugaaacaguguuagaauugacugaugcacuagcacuagggaugauggugcuaaaaauaguaaggaauauggaaaaauaucaacuggcugugacuauaauggcaauauugugcguacccaaugccguaauuuuacagaaugcauggaaagucagcugcacgaucuuagcgguuguaagcgugucgccucuguuacuaaccucaagccagcaaaaaacagauuggauuccgcuugcccuaacaauaaaagggcuaaaccccacggccauuuuucuaacuacccuaucacgaacaaauaaaaaaagaagcuggccucuuaacgaggcaauaauggcggugggaaugguaaguauauuagcuuccagcuuacuaaaaaaugacauuccuaugaccggaccgcuuguggcuggaggucuauuaacagugugcuacguucuuacaggacggucagcagaccucgaguuagaacgagcuaccgauguaaaaugggaagaucaagcagaaauaucggguagcagucccauauuaagcauuacuauuucugaagaugggagcaugaguauaaaaaacgaagaagaggaacagacgcucaccauacuaauuaggacagggcuucucgucauaagcgggcuauuuccaauaucuauaccuauaacagcagcugcuugguaucugugggaaguuaaaaagcaacgagcaggagucuuaugggauguaccgucgccgccgccuaugggaaaggcggaacuugaagauggagcuuaucggaucaagcagaaagguauauuagguuacucacagauuggugcgggggucuacaaagaaggaacguuccacacuauguggcacgucacacggggagcaguauuaaugcacaaggguaaaagaauagagccuaguugggcagauguaaaaaaagaccuuauaucauauggaggagguuggaagcucgaaggggaauggaaagaaggagaagaagugcaaguccucgcauuagaacccggaaagaauccacgagcagugcagacuaaaccaggccuauuuaagaccaacacggguacgauaggcgcaguaucauuggauuuuaguccaggcacuuccggcucuccgaucaucgacaagaaaggaaaaguaguaggucucuacgggaacggagucguaacgagaucaggagcuuauguauccgcaauagcccaaacagagaagucaauagaagauaauccagaaaucgaggaugauauauuuaggaaacgacgcuuaacaaucauggauuuacauccgggugcaggcaaaacaaaaagauauuuaccugcuauaguacgagaagcuaucaaaagagggcuucggacuuugauacuagcacccacgagggugguagccgccgaaauggaagaagcuuuaagaggacuaccuauucgauaucaaacacccgcaauaagagcugaacauacuggcagagaaauaguagaccugaugugucaugcaacauuuacaaugagacuuuuaagccccguucgugugccaaauuacaaccucauuaucauggaugaggcccacuuuacagaccccgcuucuaucgcagcuagaggauacauuaguacucggguggaaaugggagaggcagccggaauuuucaugacagcaacuccacccgguucccgggacccuuuuccccaaagcaaugcaccgaucauagacgaggaacgagagauuccagaaagauccuggaacucaggucaugagugggugacagauuucaaggguaaaaccguaugguuuguaccuaguauaaaggcgggcaacgauauagcagcuugcuuacgaaaaaauggcaaaaaagugauacaacucucucgaaagacguuugauucugaauaugugaaaacgagaacaaaugauugggauuuuguagucacaacagauauaucugaaaugggagcuaacuuuaaagcggaaaggguaauugacccgagaagaugcaugaaaccaguaauacucacugauggagaagagaggguaauacuggcugggccuaugccgguaacgcacuccucugcggcccaacggcgagggcgaauagguagaaaucccaagaacgaaaacgaccaauauauauauaugggagaaccgcuagaaaacgacgaagacugugcgcacuggaaagaagcaaaaaugcucuuagauaauaucaacacgccggaaggaauaauuccguccauguucgaaccagagcgagaaaaaguagacgcuauagacggagaguacagauuacggggcgaggcgaggaaaacuuucgucgaucugaugcgcaggggggauuuaccuguauggcuagcguacaaagucgcggcugaaggcauaaacuaugcagaucgaagaugguguuucgacgggauaaaaaacaaccaaauucuagaagaaaauguagaaguagaaauauggaccaaggaaggagaaagaaagaagcucaaaccccgcuggcuugacgcgcgaauauauagcgacccauuagcuuuaaaagaguuuaaagaauuugcagcaggaagaaaaagucuuacucuuaaucuuauaacggaaaugggaagacuaccgacuuuuaugacacagaaaacgagagaugcgcuugacaaccuugcaguauuacauacagcugaagcaggagggagagccuauaaccaugcacuuucagaauuaccagagacacuagaaacucuuuuacuuuuaacgcugcuagcaacggugacuggugggaucuuccucuuccuaaugucggguagggguauaggaaaaaugacucuaggaauguguuguauuaucacagccagcauacuacuaugguaugcccaaauccaaccccauuggauagcggcaaguauaauauuagaauuuuuucucauuguacuuuugauaccagaaccugaaaagcaaaggacuccucaagauaaucaauugacuuauguaguaauugcaauacuuacuguaguagcagcaacgauggcaaaugagaugggguuucucgaaaaaacgaagaaagacuugggucucgguaguauagcaacacaacaaccugaaaguaauauccuagauauugaccuaaggccagcaucggcauggacguuauaugccguagccacaacuuuugucacacccaugcuaaggcacucuauugagaacuccucaguaaacguaucucucacagcaauagcaaaccaagcgacggucuuaauggguuuaggaaaagguuggccccucucaaaaauggauauaggcguuccacuccuggcgauagguugcuacagucaaguuaauccaaucacgcuaacagcggcauuacucuuacuaguggcacauuacgccauuauagguccgggucuucaagcuaaagcgacacgcgaggcucagaaacgagcugcggccggaauuaugaaaaacccaacgguagauggaaucacaguaauagauuuggauccgauaccauaugacccgaaguuugaaaagcagcuuggacaaguaaugcuauuaauuuuaugcguuacgcagguacucaugaugagaacuaccugggcgcuaugugaggcucuaacacuggcaaccggaccaauuucaaccuuaugggaaggaaauccuggucguuucuggaauacuacuauugcaguaucaauggcaaacauauuucgaggauccuaucuggcaggagcuggauuauuauuuucgauaaugaaaaacacgacuaacacccgacgaggaacaggcaauaugggagaaacauugggagaaaaguggaagagucgguuaaaugccuuaggcaagagugaguuccagauuuacaaaaaaaguggaauccaagaaguagaccguacucuggcaaaagaaggcaucaagagaggagagacugaccaccaugcaguaagccgggguucagcaaaguugcguugguuugucgaacgaaauaugguaacgcccgaaggaaagguuguagaucuugguuguggucgaggcggauggaguuacuauuguggagggcucaaaaacguuagagaggugaaagguuuaacaaaagguggcccaggucacgaagagccuauaccuaugucgacguacggauggaaucugguacguuugcaaagcgggguugauguuuucuuuauaccuccagagaagugugauacacuguuaugugauauuggugaaaguucaccuaauccaacagucgaagcaggaaggacacuacggguacuaaaccuaguagaaaauugguuaaauaauaacacgcaauucugcauaaagguccuaaauccguacaugcccagcguuauagaaaaaauggaagcuuugcaaagaaaauacggcggugcucuaguaagaaacccgcuaucuagaaacaguacacacgaaauguauuggguauccaaugcuucgggaaacauaguaucgagcguaaacaugauaucccgaauguuaaucaacagguuuacgaugagacacaagaaagccacuuacgaaccugauguugaccugggaucaggaacuaggaacauaggcauugagucagaaauaccgaacuuagauaucauagggaaaagaauagaaaagauaaaacaagaacacgaaacgagcuggcacuacgaccaggaccacccauauaaaacgugggcguaccaugguuccuacgagacuaaacaaaccggaucagcgucaucuauggugaaugguguagucagacuuuuaacuaaaccuugggauguuuuacccacuguaacgcaaauggcuaugacggacaccacacccuuuggucagcaaagaguguucaaggagaaaguagacacaagaacucaagaacccaaagaagggacgaaaaaacuaaugaaaauuaccgcggaaugguuauggaaagaacuaggaaaaaaaaaaacaccuaggauguguacuagagaagaguuuacucguaaagucagaucuaaugcagcguuaggagcgauuuuuacagaugagaauaaauggaaaagugcccgugaggcggucgaagacagcagauuuugggagcuaguugauaaagagagaaaucuucaucuggaaggaaaaugcgaaacgugcguuuacaacaugaugggaaaacgcgaaaaaaaacuuggcgaguucggaaaagcgaaaggaucacgcgccauaugguacauguggcuaggcgcucgauuuuuagaauuugaagcuuugggauuccugaacgaagaccacugguucagccgagagaauucgcuaagcggaguugaaggcgaggguuuacacaaauuaggauacauacuaagagauguuaguaaaaaagagggaggggccauguaugcggacgacacagcuggaugggacacuaggauaacucuugaggaucuaaaaaaugaagaaauggucacuaaccacauggagggugaacauaaaaaauuagccgaagcgauauuuaaguuaacuuaucaaaauaaaguaguacguguccaaagaccaacuccgcgggguacaguuauggauaucauaaguagaagggaucaaaggggcucuggucagguagggaccuauggauugaauacuuuuacaaauauggaggcucaauugauuagacagauggagggugaaggaguauuuaagaauauacaacaucuaacaguaacugaagaaguagcagugaaaaauugguuagcacgugucggccgcgaaagguuaucaagaauggcuauaucgggcgacgacugcguaguaaagccauuagaugauagauuugcaaacgcguuaacugccuuaaacgacaugggaaaaauuagaaaggacauacaacaaugggaaccgagcaaaggcuggaaugauuggacucaaguaccauuuugcagucaucacuuucaugaauuaauaaugaaagacggacgcguacuagucguacccugcagaaaccaagacgaacucguuggcagagcucgaauuagucaaggagcaggcuggucguuaagagagacagcgugccuuggaaaaaguuacgcccagauguggucccuaauguauuuucaccggcgagaucucagacucgccgcaaacgcaauaugcucggcaguacccucacauuggguaccaacaucccgcaccacuuggucuauucacgcuaaacaugaauggaugacaacagaagacauguuaacuguguggaauagaguauggauaagagaaaauccguggauggaagacaaaaccccaguagaaucuugggaagagauacccuaccugggaaagcgagaggaccaauggugugguucuuuaauuggccugacaagucgcgcgaccugggccaaaaauauacaagcagcaauuaaucaaguccgaagcuugauagguaacgaagaauauacggauuauaugcccaguaugaaacgcuucaggcgggaagaagaagaggccgggguucucugguaa

SEQ ID NO: 22693 - RNA, 9876 nt, Artificial Sequence
  derived and/or modified CDS sequence (opt6) from DENV-2__FJ024461__SS-prME
agcgcugguaugauaauaauguuaauaccgacaguaauggcauuucaccuaacaacgcgcaauggagaaccacauaugauuguggguauacaagaaaaagguaaaagccuccucuuuaaaacagaagacggaguuaacauguguacgcuaauggcuauggauuuaggcgaacuuugugaagacaccauaacuuauaaaugccccuuacugagacaaaacgaaccggaagauauugauuguuggugcaacagcacaagcacguggguuacuuacggcacuugcaccacaaccggugaacaucgucgugaaaaacgauccguagccuuagugccucacguggguaugggacucgaaacgagaacugaaaccuggaugucuucagaaggggcauggaaacaugcacaaagaauugaaacuuggauacuacgacacccaggcuuuacgaucauggcagcaaucuuagcauauacaauaggaacuacgcauuuccaaagaguauuaauauuuauucuacuaacagcaguagcgcccaguaugacuaugcgauguaucgggaucucaaauagagacuuuguagaaggcguaagcggaggaaguuggguagauauaguauuagaacauggauccugcgugacaacaauggcuaaaaauaaaccaacucuggacuuugaauuaauaaaaacagaagcaaaacaaccugcaacccuaagaaaauauugcauugaagcaaaauuaacgaauacaacaaccgaaucuagaugcccgacacaaggagaaccuagucuaaaagaagaacaagacaaaagauuuguaugcaaacauaguaugguggacagagggugggguaacggguguggacuauucggcaaaggagggauuguaaccugugcaauguucaccuguaagaaaaauauggagggaaaaauugugcaaccugaaaauuuagaguauacuauugugguuacgccucauuccggcgaagaacaugcuguuggaaaugauaccggaaaacaugguaaagagauaaaagugacgccccaaagcaguauaaccgaagcggaacuaacaggauacgguacgguuacgauggaguguucgccaagaaccggacucgauuucaacgagaugguauuauuacaaauggaaaauaaggcuuggcucguucauagacaaugguuucuagaucucccucuaccauggcugccuggcgcagauaagcaagaaaguaacuggauacaaaaagagacccugguaaccuuuaaaaauccacacgcuaagaaacaagacguaguggucuuagguucucaagagggagcaaugcauacugccuugacuggugcaacagaaauccaaaugucaucaggcaaccugcuauuuacugggcaucugaaauguagacuaagaauggauaaacuucaauuaaaagguaugucauauucuaugugcacuggaaaauucaaaguaguuaaagaaaucgccgaaacucaacacggcacaauaguaauuagaguacaauaugaaggggaugguucaccaugcaagauuccauucgaaauaauggaccuggagaaaagguauguccuaggucgucuaauaacaguuaauccgaucgucacagaaaaagacucaccaguuaauauagaagcagaacccccauuuggagacagcuacauaauaauagguguagaaccagggcaacuaaaauuaaacugguuuaagaaaggauccucaaucggacaaauguuugagacuacgaugagaggagcuaaacggauggcaauucugggugacacagcaugggauuuuggaucuuugggugggguuuuuacaucaauagguaaagcacugcaucaaguguuuggagccauauacggugcagcuuucagugguguuucuuggacgaugaagauauuaaucggcguaauuauaaccuggauaggaaugaauagccgaagcaccucauuaucuguaagccugguccuaguuggaauaguaacuuuauaucuugggguaaugguacaagcagacucaggauguguuguaucguggaaaaauaaagaauuaaaaugcggaucagguauuuucauaacugauaaugugcauacauggacagagcaguacaaauuucaaccugagagcccuucaaaacuggcaagugccauacaaaaagcucaagaagaagggauaugcggaaucagaaguguaacacguuuagagaaucucauguggaagcagauuacuccugaacucaaccacauacuugcugaaaaugaaguuaaacuaacaauaaugacaggagacauuaaaggaauaaugcaagcugggaaacgaucacuuagaccucaaccuacugagcuaaaauacucguggaaaacuugggguaaagcgaaaaugcugaguacagaaaguuacaaucaaacauuuuuaaucgauggaccugagacggcagaauguccgaacacuaacagagcauggaacagucuugagguugaagauuauggauucggcguauucacaacaaauauauggcuuaaauuaaaagaaaaacaggaugcauucugcgauucaaaauuaaugucugcggcgaucaaagauaaucgggcaguacaugcagauaugggauacuggauagaguccgcacuaaacgauacauggaaaauagaaaaggccagcuuuauagaagucaaaaauugccauuggcccaaaucucacacauuauggaguaacggaguucuagaauccgaaaugauaauuccuaagaacuuagcggggccugucucgcaacauaacuaucgguuaggauaucacacccaaaucgcugguccguggcauuuggguaaacuugaaauggauuucgauuuuugugacgguacaacagugauaguuaccgaagauuguggaaauagagggccaucgcugaggacaacuacugcaagugguaagcuaauuacugaauggugcugcagaagcuguacauuaccgccauuacgauauagaggagaagacggcugcugguacgguauggagauaaggcccuuaaaggaaaaggaagaaaaccuuguaaauucauuagugacugccggacauggucaaguggauaacuuuucguuagguguucuuggaauggcauuauuccuagaggaaaugcuacggacuagaguaggaacuaaacacgccauccuucucguugcugucaguuucguaacacuuaucacuggaaauaugucguucaaagaucuagggagaguagucguaaugguaggggcaacaauggcagacgacaucggaauggggguaacauaccucgcauuguuagcagcauucaaagugaggccaaccuuugcggcuggacuauuguuaagaaaauuaacgagcaaagagcugaugaugacuacaauugguaucguacuauuaucgcagucaacaauaccggaaacuguacuagaacugacagacgcacuagcauugggaaugaugguacuuaaaaucgugcgcaacauggaaaaguaccaacucgcaguaacuauuauggcgaucuuguguguccccaacgccguaaucuuacaaaacgcauggaaaguauccugcacaauucucgccguaguuuccgugaguccacuuuuacucacauccagucagcagaaaacagacuggauccccuuggcauuaacgauuaaaggauuaaacccuacugcaaucuuccuuacaacacugagcaggacuaauaagaaaagauccuggccccugaacgaagcaauuauggcuguggggauggucucuauucuagcaagcucacuccucaaaaacgacauacccaugacagguccccuagucgcgggagggcuucucacagucuguuauguauuaaccggucgaucugcggaccucgaauuagagagagcaacugauguaaaaugggaagaucaggcagagauaucagguucgaguccaaucuuaaguaucacaauuucggaggacggcuccaugaguaucaaaaaugaagaggaagaacaaacauuaacaauacugauccguacaggauuguugguuauaucaggacucuucccaauaagcauuccaauaacagccgcagcaugguaucuaugggaaguaaagaagcagagggccggggucuuaugggauguaccaaguccaccuccaauggggaaggccgaacucgaagauggcgccuauagaauuaaacaaaaaggaaucuuagguuauucucagauaggggcaggaguuuacaaagaaggcacauuucacacuauguggcauguaacaaggggagccguuuugaugcauaaaggaaaacggaucgaacccucuugggccgaugucaagaaagaccuaauaaguuacggaggaggauggaaacuagaaggcgaauggaaggaaggggaggaaguccaaguacuagcauuggaaccuggcaaaaauccaagagccguucagaccaagccuggacuguuuaaaacgaacacuggaacaauaggggcuguauccuuggacuuuucaccagguaccucgggaagcccaaucauugacaagaaaggcaaggucguuggccuauauggaaauggaguuguaaccagaaguggcgcuuaugucucagcgauagcucaaacagagaaagggauugaagacaauccagagauugaggaugacauauucagaaagcgaagguugaccauaauggaucuccacccaggugcagggaagacuaaacgauaccucccggcaauagucagagaggcaauaaaacguggucuucgaacuuuaauucuagcaccaacuagaguaguagcggcagaaauggaagaggcucucaggggauugccaauuagauaccaaacaccagcaauucgugcugagcauacaggacgagaaaucguggaccucaugugccacgcgacuuuuaccaugagacuacuaucaccaguacgaguuccaaacuauaaucuaauaaucauggacgaagcucacuuuacagauccugcgucuauagcggcgaggggguauauaucgacccgcguugagaugggugaagcagcaggcauauucaugacggcgacuccaccagggucacgggauccauucccccaaagcaacgcacccauaauagaugaggaacgcgagauuccggaacgaaguuggaacucaggacacgaauggguaacugacuuuaaaggcaaaacuguaugguuuguaccgaguaucaaggcaggcaacgauauugccgcuuguuuaaggaaaaacggcaagaaaguaauucagcuuagcaggaaaaccuuugacucagaauauguuaaaacacguacaaacgauugggacuuugucguaacaacggauauaucugaaaugggcgccaauuuuaaagcggaaagggugauugauccuagaagguguaugaaaccaguaauccucacugacggagaagagagaguuauauuggcggggccaaugccaguaacacauagcucagcagcccagcgcaggggucgaauugggcguaaucccaaaaacgaaaacgaucaauauauauacaugggcgagccauuggagaaugacgaagauugcgcacacuggaaagaagccaagauguuacuugacaauauaaacacacccgaaggcauuauaccuaguauguuugagccagagcgagagaaaguugacgcaauugauggagaauacagguuaagaggagaagcccgaaaaacuuucguagaccuaaugagacggggagauuuaccuguaugguuggcuuauaaaguugcugccgagggaauaaauuacgcagaucguagaugguguuucgacgguaucaaaaauaaccaaaucuuagaggaaaacgucgagguagaaaucuggacaaaagaaggagaaaggaagaaauuaaaaccgcgaugguuggacgcccgcauauacucugacccauuagcuuuaaaggaguucaaagaauuugcagcaggaagaaaaucccuaacauuaaauuugauaacagaaaugggacgcuuaccuacuuucaugacucagaaaacacgugaugcucuagacaaucuagcgguauuacauacagcugaagcagggggacgugcuuauaaccacgcucuguccgaacucccagaaacgcuugagacacuccuacuccugacucuuuuagcaacaguaaccggcgggauuuuucucuuuuuaaugucaggcagaggaaucgggaagaugacccuugguauguguugcauaauuacugcaucuauuuuacugugguacgcacaaauccaaccccauuggauugcagccucaauaauacuagaguucuuccugauaguucuauugauaccagagccugaaaagcagagaaccccacaagacaaccaauuaacuuauguuguaauagcaauucuuacagugguagcugcaacuauggcuaaugaaaugggcuuucuugagaaaacaaagaaggauuucggauuaggcucuaucgcaacucagcaaccggaaaguaacauuuuagauauagauuugcgaccggcuagcgcuuggaccuuauaugcaguggcaacgacauuuguaacgccaauguugagacacaguauagagaauaguagcguaaauguuuccuuaacugcaauagcaaaucaggcgaccguauugauggguuuagguaaagguuggccucugucgaagauggacauaggaguaccauuauuagcuauaggcugcuauucacagguaaauccgauuacacugacagcagcauuauugcuacuuguagcacauuaugcuauaauugguccagggcuacaagcaaaagcuacgagagaggcccaaaaacgugcugcagcagguauaaugaaaaauccgacuguagauggaauaaccguaauagauuuggacccgauuccauaugauccuaaauuugaaaaacaauugggccaagugauguuauuaauucuauguguuacucaaguacuaaugaugagaacuacgugggcuuuaugcgaggcgcuuacacuagcaacaggaccgauuucaacucuuugggaagguaacccaggacgauuuuggaauacgacaauagcaguaucaauggcaaauaucuuccgaggaucguaucuugcaggcgcggggcugcuuuucagcauaaugaagaauaccaccaauaccagacguggaacaggaaacauaggugaaacuuuaggcgaaaaauggaaaucacgcuuaaaugcccugggaaaaucugaauuucagauauauaagaaaucgggaauccaagagguugaucgaacucuggccaaagaaggcauuaaaagaggcgagacugaccaucacgcgguaucaaggggauccgcaaaacuacguugguucguggaaaggaacaugguaaccccggaagguaaggucguagauuugggaugugggcgaggaggauggagcuauuauugcgguggacucaaaaacguacgugagguuaaaggacuaacaaagggaggucccggacaugaggaaccuauucccaugucaacguauggauggaaccuuguucgauuacaaucuggaguggaugucuuuuucaucccaccagaaaaaugugauacguuacuaugugauauuggagaaagcagcccaaaccccacuguagaagccggcagaacguugagggugcuaaaccuuguagaaaauuggcuaaacaauaacacucaauuuuguauaaaggucuuaaauccauauaugccaucggucaucgagaaaauggaggcacugcaacguaaauacgguggagccuugguccgcaauccauuaagccgcaauagcacacacgagauguacugggugucuaaugcauccggaaauauaguaucaucagucaauaugauaucuagaaugcugaucaaccgcuucacaaugcggcacaagaaagcaacauacgaaccagauguugaccuugguaguggaacucguaauauaggaauugaaagcgaaauccccaaucuagauauaauagggaaacguaucgagaaaaucaagcaggaacacgagaccaguuggcacuaugaccaagaucauccuuacaagacaugggcuuaucacgguuccuacgagacaaaacaaacagggucagcuucgucaaugguaaaugguguugucagauuacuuacaaagccgugggacguauuaccaacaguaacucaaauggcaaugacagacacgacucccuuuggccaacaacggguuuuuaaagaaaaaguggacacaagaacucaagaaccaaaggaagguacuaagaaacuaaugaagauaacagcagagugguuguggaaagaacuagggaaaaagaaaacuccaagaaugugcacacgugaagaauuuacgagaaaaguacgcaguaaugcugcguuaggcgcaaucuuuaccgaugaaaacaaauggaagucggcccgagaagccguugaagacagccgauucugggaacuuguugauaaagaaagaaaccuccacuuagaagguaaaugcgagaccugcgucuacaacaugaugggaaagagggagaagaaacuaggagaguucggaaaagcaaagggaucaagagccauuugguacauguggcugggagcuagauuccuagaguuugaggcuuuaggcuuucuuaaugaagaccauugguuuaguagagaaaauucgcuaucaggaguagagggagaagggcuccauaaacuaggauacauucuucgagauguaaguaagaaagagggaggagccauguacgcagacgacacggcaggaugggauacucgaauaacguuagaggaucucaaaaaugaggagaugguaaccaaccacauggaaggugaacacaagaaacuggcagaagcaauauucaaacuaacauaucaaaauaaagugguacgaguacaacgaccuacaccaagagguacuguuauggacauaauaucgagacgagaucaaagagguucuggacaggugggaaccuauggcuuaaauacuuuuacaaauauggaagcacagcuuauacgacaaauggagggagaagggguauuuaagaauauacaacauuuaacugucacagaagaaguggcgguccaaaauuggcuagcaagagucggccgugaacgauuauccagaauggcaauaucaggagaugacuguguagucaaaccuuuagacgaucgcuuugcaaaugcacuuacggcauuaaaugacaugggaaagaucaggaaagacauacaacaaugggaaccuaguaagggguggaaugacuggacacaggucccuuuuugcucacaccacuuccacgaauuaauaaugaaagaugggcgaguucuagugguuccuuguagaaaucaagaugaacuuaucgguagagcaaggauaucgcagggagcgggauggucacuacgugaaacggcaugucuaggaaagaguuaugcucaaauguggagcuugauguauuuccauaggcgugaucuacguuuagcggccaaugcgauaugcagugcaguaccaucucauuggguuccaacaagcagaacgacauggucaauucacgcaaagcacgaauggaugacaacggaagauaugcuuacggucuggaaccguguguggauuagagagaauccauggauggaggacaaaacuccuguggagaguugggaagaaauacccuaucuuggaaaaagagaagaccaauggugcggcucccuaauaggccucacaaguagagccacaugggcgaagaauauacaagccgcaaucaaccagguuagaucguuaauuggcaaugaagaguacacagauuauaugcccaguaugaaacgcuuuagacgugaggaagaagaagcugguguacuaugguaa

SEQ ID NO: 22694 - RNA, 9876 nt, Artificial Sequence
  derived and/or modified CDS sequence (opt6) from DENV-2__FJ373299__SS-prME
ucagcggggaugaucauaauguuaauccccacgguuauggcguuucaucugacgacucgaaacggugaaccccacaugauuguagguauacaagaaaaaggaaaaucacuucuuuuuaaaacugaagauggcguaaauaugugcacuuuaauggcgauggaccuaggugaauuaugcgaagauacaauaacauauaaauguccgcuuuuacgccagaaugaacccgaagacauugauuguuggugcaacagcacuuccaccuggguuacuuaugggacaugcacuacaacuggugaacaccgccgggagaaaagaucaguggcgcuaguuccucacguugguaugggucuagaaacacgaacagaaaccuggaugucaucugaaggugcauggaaacaugcacagagaauagaaacauggauacuucgacaucccggauucacuauuauggcagcaaucuuggccuauacaauugguacgacgcacuuucaacgaguauuaauauuuauauuauuaacugcaguugccccgucaaugacgaugagaugcauagguauuucaaaucgagauuuuguagaaggcguuagugguggcaguuggguagauaucgugcuagaacaugguagcuguguaacaacaauggccaaaaauaaaccgacucuagauuuugaacuaauaaaaacagaagcaaaacaacccgcaacuuuacgcaaauacugcauagaagcgaaacugacaaacacaacuaccgaaucuagaugcccuacucaaggagaaccaucauuaaaagaagaacaagauaaaagauucguuuguaaacauaguaugguagaucgaggauggggaaacggauguggcuuauuuggcaaaggugguauuguaaccugcgcuauguuuacaugcaagaaaaacauggaggguaaaauaguucagccagaaaauuuagaauauacgauuguaguuacaccgcacucgggcgaagaacaugcaguagguaaugauaccgguaaacauggucaagaaauaaaaguaacuccucaaucaucuauaacugaagcagaacuaacgggauacgguacuguaacgauggaauguucuccacguacgggcuuagacuuuaaugaaaugguuuugcuucagauggagaauaaagcaugguuaguacacagacagugguuccuggauuuaccucuccccuggcuuccgggggcagauaaacaggaaagcaauuggauucaaaaagaaacccuaguaacauuuaaaaauccacaugccaagaaacaagauguuguaguacuuggaagccaagaaggggcaaugcacaccgcgcugacaggcgcgacagaaauacaaaugucuucugguaauuuacuguucacaggacaucuaaaaugucgucuucguauggacaaacuacaauuaaaagguaugucguacaguaugugcaccgguaaauucaaaguugucaaagagaucgcagaaacacaacauggaacaaucguaauaagaguucaauaugaaggggacggcagcccauguaaaauaccguucgagauuauggaccuugaaaagcgcuauguauuagggagacuaauaacgguaaaccccauaguuacugaaaaagauagcccaguaaacaucgaagcugagccaccauuuggagauucguacauuaucaucggagucgagccggggcaauuaaaguuaaacugguucaagaaaggcucaucuaucggacaaauguuugagacuacuaugagaggagcgaaacgaauggcaauauuaggagacacagcaugggacuuugguaguuuaggaggaguuuucacuucaauaggaaaagcacugcaucagguuuucggugcaauuuacggugcggcuuuuuccggcgugagcuggacaaugaagauauuaauugguguaaucaucacauggauuggaaugaacucccgaaguacgucacuaaguguaucuuuaguccuaguagguaucguaacucuguauuuaggggucaugguccaagcggauucugggugcguagucucguggaagaauaaagaauugaaaugcggaucaggcauuuuuauaacagacaauguccauacuuggacggaacaguacaaauuccagccugaguccccuucgaaacuugcguccgcaauacagaaagcccaagaagagggaaucugcgggauuagaagugugacaagacuugaaaauuuaauguggaaacagauaaccccagaguuaaaucacauauuagcagaaaacgaaguaaagcuaacuauuaugacuggugauauaaaggguauaaugcaagccggaaagagaagucugcgaccccaaccgaccgaacucaaauauucauggaaaacguggggcaaagcgaagauguuaucaacugaaucuuacaaucaaacauucuuaauugacggaccagaaacugcagaguguccaaauacaaauagagcauggaacuccuuagaaguagaagauuacgguuuugguguuuuuaccacaaauauuugguuaaagcuaaaagaaaagcaagaugcguuuugugauagcagacuaauguccgcagcaaucaaagacaauagagcagugcacgccgauauggguuauuggaucgaaagcgcuuuaaaugacacauggaagauagaaaaagcgaguuuuauagaaguuaaaaauugucacuggccuaaaucucacacuuuauggaguaauggaguuuuggagucagaaaugauaaucccgaaaaaucuagcuggaccaguaucucagcauaauuaucgaccggguuaucauacacagauugcuggaccuuggcauuuaggaaaacucgaaauggauuucgauuuuugugauggaaccacagugauagucacggaagauuguggaaacagaggucccucuuugaggacuacuacagccucgggaaaauuaauuaccgagugguguugccggagcuguacgcuaccgccccugagauaccggggugaagacggauguugguaugguauggaaaucagaccccucaaagaaaaagaagaaaauuuaguuaacucauuaguuacagccggacauggccaaguagauaauuuuucgcuugguguacuagguauggcauuauuccuagaagaaauguugcgcaccagaguuggcacuaaacacgcgauacugcuaguagccgugucuuucguaacuuuaauaacggguaauaugucguuuaaagaucuuggacgcguagugguaaugguaggggcuacaauggccgacgacauugguaugggaguaacuuaccuugcacuacuagcggcuuuuaagguacgaccaacuuucgcggcaggacuguuacuaagaaaacuuacuagcaaagaauuaaugaugaccacaauugguaucguauuauugucucaaagcaccauaccagaaacaguacuugaguuaacagaugcuuuggcauuagguaugaugguucuuaagauuguucggaacauggaaaaauaccaacucgcuguaaccauuauggcaauucuuugcgugccaaaugcaguaauacuacaaaacgcauggaaaguuaguugcacuauccuagccguggucuccgucagcccauuauuauuaacaucaucucaacagaaaacagacuggauaccuuuagcacuaacuaucaaaggccugaaucccacagccauauuuuuaacgacccuguccaggacuaauaagaaacguaguuggccuuuaaaugaagccauaauggcagugggaaugguauccauacucgcuucaagucuacugaaaaacgauaucccaaugacuggcccacuuguggcaggaggcuuacucacaguaugcuacguucugacuggcagaucggcggacuuggaauuagaaagggcaacagacguaaaaugggaagaucaagcagagauaaguggaagcucccccauacugucaaucaccaucucagaagacggaucaaugagcauuaagaaugaggaagaagaacaaaccuugacaauuuuaauaagaacugggcuuuuagucaucagcgggcuuuucccgauuagcauaccuauuacagcugcggcaugguaucuaugggaagucaagaaacaacgugccgguguacuuugggauguuccuagcccacccccgaugggcaaagcagaauuagaagacggggccuaucgaauaaaacaaaagggaauacuuggcuauagucagauaggagcugguguauauaaagaagguacuuuccauacaauguggcauguaacacgcggcgcaguacugaugcauaaggguaaaaggauagaaccuucaugggccgaugucaagaaagaucucauaucauacggaggaggauggaaacuugaaggagaauggaaagaaggcgaagaaguucaaguauuagcacucgagccaggaaagaauccgagagcuguccaaacuaagcccggucucuuuaaaaccaacacugguacgauaggagcaguguccuuggacuuuaguccaggcacaucugggucaccaaucauagauaagaaaggaaagguaguuggauuauaugguaauggaguaguaacccguucuggagcuuaugucucagccaucgcacagacagaaaaaucuauagaagacaauccugagauagaggaugacauauuucguaaaaggagacuaacgaucauggaucuccauccaggcgcugguaagaccaaaagguaucucccggcgauagugcgcgaagcuauaaaaagaggacuaaggacacuaauacucgcuccaacgagaguaguagcugcagaaauggaagaggcauuaagagggcuaccaauccgauaucaaacuccagcgauuagagcagaacacacaggccgagaaaucguggaucugaugugccaugcaacauuuacaaugagacuauugagcccuguuagagucccaaauuauaacuuaauuaucauggaugaagcucauuuuacggauccggcgaguauagcagcaagggguuacauuucaaccagaguagagaugggugaagcugccgguauuuuuaugaccgcuacucccccaggcucaagggacccuuuuccccaaucaaaugcgccaauuauagaugaggaacgugaaauacccgaaagaagcuggaauaguggucaugagugggucacugacuuuaaaggaaaaaccguuugguucguacccucaauaaaagcuggaaaugacauagcagcgugccuaaggaaaaaugguaagaaaguaauucaauuaaguaggaaaacuuucgauagugaauauguaaaaacaagaacuaaugacugggauuucguaguuacaacugacauaucugaaaugggagccaacuucaaagcagaacgaguuaucgacccucggagaugcaugaaaccagucauauuaacugauggugaggaaagaguaauacuugcgggcccgaugccagucacgcauucgucagccgcgcaaagaagaggacgaauagggcgaaaucccaaaaacgaaaacgaccaauauauauacaugggugaaccguuagagaacgacgaggauugcgcacacuggaaagaagcaaagauguugcuugauaacaucaauacuccggagggaauuauccccucaauguuugaaccugagcgugaaaaaguagacgcaauagacggggaguaucggcuuagaggagaagccagaaagacauuugucgaccucaugagaagaggugauuuaccagugugguuagccuacaaaguagcggcugguggaaucaacuaugcagaccgccgauggugcuuugacgggauuaaaaauaaucaaauauuggaagaaaauguugaaguugaaauuuggaccaaagaaggggagaggaagaaauuaaagccgagaugguuggaugcgcgaauauacucugauccacucgccuuaaaagaguuuaaggaguuugcagccggcagaaagagcuuaacccugaaucuaaucacagaaaugggacgauugccgacauucaugacucagaaaacacgagacgcacuagauaacuuggcgguucuccauacagcggaagcuggaggacgagcauauaaccacgcucuuagugaacuacccgaaacauuagaaacacuucuacuucucacuuuguuggcuacgguaacugggggaauauuuuuauuccuuaugagcgggagaggaauuggaaaaaugacauuagguauguguugcauuauaacagcaaguauuuuguuaugguaugcucaaauccaaccgcauuggauugcggcaucgauaauccuugaauuuuucuuaauuguucuacucauaccagagccagaaaaacagcgcacaccgcaagauaaucaauuaacauacguaguaauagcuauauuaacggucguggcagcaaccauggcaaacgagaugggauuucuagagaaaaccaaaaaggacuuaggauuaggcucaauugcgacccagcaaccagaaucuaauaucuuggauauagauuuacguccugcuucugcuuggacccuauaugcaguugccacuacauucgucacgccaaugcuacgacacaguaucgaaaauagcucagugaacguuucuuuaacagccauagcaaaucaagccaccguccuaaugggccuagggaagggguggccucugaguaaaauggacauuggaguuccuuuacuagccauuggaugcuacucucaagucaauccgauuaccuuaacugcagcgcuucuauuauuagucgcacauuaugcgauaaucggaccuggacuacaggcaaaagcaacucgagaagcgcagaaaagagccgccgcaggaauuaugaaaaauccuacaguugacggaauuacugucauagaucuagauccaauuccuuacgauccuaaguucgagaaacaauuagggcagguaauguuacucauccuaugcguaacacagguacuaaugaugcggaccacaugggcccugugcgaggcacugacguuagcgacaggcccuauaagcacuuuaugggaagguaaucccggcagauuuuggaacacaacuauugcaguaagcauggcaaauauauuucgggguuccuauuuggcaggagcgggucuacuauucucuauaaugaaaaacacuaccaauacacgcagaggaacggguaacaugggagaaaccuuaggagaaaaauggaaaaguagauugaacgcuuuaggaaaaagugaauuucaaauuuauaagaaaucagguauucaagaggucgacaggacucuagcaaaagaaggaauuaagcgcggcgaaaccgaucaucaugcaguaagucgcggaucggccaagcuccgaugguucguugaacguaauaugguuacaccagaaggaaagguagucgauuugggauguggcagagggggcuggucauacuacugcggaggauuaaagaacguucgagaaguuaaaggucuaacaaaagguggacccggacacgaggaacccauaccgaugucaacauacgguuggaauuuaguucgucuacagucaggcguagacguauucuuuauaccaccagaaaaaugcgacacucuauuaugcgacauaggcgaaaguucacccaaccccacaguggaggcuggacguacauugagaguacuaaaucuuguugaaaauugguuaaauaauaauacccaauuuuguauaaagguuuugaauccauacaugccguccguaaucgagaaaauggaagcacuacagagaaaauacggcggggcccuagugagaaauccauugucaagaaacucaacccacgaaauguauuggguuagcaaugcuaguggaaacaucguuucuucuguaaacaugauauccaggauguuaaucaauagauuuacuaugaggcacaagaaagcgacauacgaaccagacguagauuuaggaucggguacuaggaacaucggcauagagagugaaacuccuaauuuagacauaaucggaaaaagaauugagaaaauuaagcaagaacacgaaacuagcuggcauuacgaucaggaucauccauacaaaacuugggccuaucaugggucauaugaaacaaaacaaacggggagcgcaucaucaaugguaaauggugugguacguuugcuaacuaagccaugggauguguugccaacuguaacucaaauggcuaugacggacacaacuccauuuggucaacaacgggucuucaaggaaaaaguagauacgcgaacacaagaaccaaaagaaggcacuaagaaauuaaugaaaauaaccgcggaguggcuguggaaagaacuagguaaaaagaaaacuccacguaugugcacacgcgaagaguucacacguaaaguacgguccaaugcagcauuaggcgcaauuuuuacugaugaaaauaaauggaaaagugcaagagaagcgguagaagauucgcgauuuugggagcuuguagauaaagaacgaaaucugcaucuugaagggaaaugugaaacaugcguuuacaauaugaugggcaaacgagagaagaaauuaggcgaguucggcaaagcaaaaggcucacgagcaauuugguacauguggcuuggagcucgguuccuagaauuugaggcuuuaggauuucugaaugaagaccauugguucucgcgcgaaaauagccuaucggggguugaaggugaggggcuacacaaacuagguuacauucuacgggauguuaguaaaaaggaagggggagccauguacgcugaugauacagcaggaugggauacaaggauuacauuagaggauuuaaagaacgaggagaugguaacaaaccauauggaaggagagcauaagaaauuagcugaagcaaucuucaaacuaacuuaccaaaauaaaguaguaagaguacagagaccaacuccacguggaacggucauggauauaauaagccgaagggaccagagaggaucggggcaaguaggaacauauggacuaaauacauuuacaaacauggaagcccaauuaauucgacagauggaaggagagggaguguuuaaaaauauucaacaucucacaguaacggaggagguagcuguucaaaacuggcuugcucgaguaggacgagagagacuuucacgcauggcuauaucgggugaugauugugugguaaaaccauuggaugaccgauucgcaaaugcccugacggcacugaacgauaugggaaaaauucgaaaagauauucaacaaugggagccaucuaagggguggaaugauuggacccaggugccguucugcucacaucacuuucaugaauuaauaaugaaggauggaaggguacucgugguaccaugcagaaaccaggaugaacuaauuggcagagcgcguauaucacaaggcgcgggauggucguugcgcgaaacagcauguuuggguaaaucuuaugcgcagauguggagucuaauguacuuccacaggcgugauuugaggcucgcggcaaaugcaauuuguucagcaguucccagucacuggguaccaacaucgagaacgacauggaguauacaugcuaaacacgaauggaugacaacagaagacaugcuaacuguauggaacagagucuggauacgagaaaaucccuggauggaggacaaaacuccuguagaaucaugggaagaaauaccauacuugggaaagagagaggaccaauggugcggaagucuuauaggauuaacaagucgagcuacaugggcuaaaaauauacaaguugcaaucaaucaaguucgaagccugauuggcaacgaagaauacacagauuauaugccuucaaugaaaagguuuagacgagaagaagaggaagcaggaguauuaugguaa

SEQ ID NO: 22695 - RNA, 9876 nt, Artificial Sequence
  derived and/or modified CDS sequence (opt6) from DENV-2__FJ410193__SS-prME
uccgcaggaaugauaauaaugcugauaccaacuguaauggcuuuucaccugacaacaagaaauggggaaccccacaugauaguugggauacaagaaaaaggaaagagcuuauuauuuaaaacugaggacgggguaaauaugugcacuuuaauggcgauggauuugggugaacuaugcgaggauacgauaacauacaaaugcccccugcuuagacaaaaugaaccagaagacauagacuguuggugcaacagcacaucuacaugggugacauauggcaccuguaccacaacgggggagcaccgucgcgaaaaacgaucuguggcauuaguuccacaugugggaaugggacuagagacaagaacagaaacauggaugucuucugagggagcauggaaacaugcacaaagaauagaaacuuggauuuugcgacaccccgguuuuacaauaauggcugcuauacuggcuuacaccauagggacaacacacuuucaaaggguacugauauuuauuuuauuaacggcaguugccccgucuaugacaaugagauguauagguauaucaaacagagauuuuguggaagguguaucgggaggaaguuggguagauaucguacuagaacaugggaguugugugacaacaauggcuaaaaauaaaccaacccuagauuuugaacuaauuaaaacggaggcaaaacaaccagcuacauuaagaaaauacuguauagaggcuaaacuuaccaacacaacaacagaaagcagaugccccacacaaggagaacccaguuuaaaagaggaacaagauaaaagguuuauuuguaaacacagcaugguggaucgugguugggguaaugggugcggguuauuugggaaaggcggcauaguaacaugugcuauguucacgugcaagaaaaauauggaggggaaaauaguucaaccugaaaacuuagaauacacaauuguugugacaccccacucgggagaggaacaugcaguagguaacgacaccggcaaacaugguaaagagauuaaagucacaccucaaucaaguauaaccgaagcagaacugacaggauauggaacgguuacuauggagugcaguccaagaacagggcucgauuuuaacgaaauggugcuguuacaaauggagaauaaagcguggcucguccaucgacaaugguuucuugaccuuccacuucccugguuaccgggagcagauaaacaagaaaguaauuggauucaaaaagagacgcucgugacauuuaaaaauccccaugcgaagaaacaagacguaguaguacuagguucccaagaaggcgcaaugcacaccgcuuuaacgggcgccacugaaauacaaaugagcucaggaaauuuacuauucacagggcauuuaaaaugucgguugaggauggauaaauugcagcugaaaggaaugucauacagcaugugcacgggcaaauuuaaagucguaaaagaaauagcagaaacacaacaugggacaauagucauuaggguacaauaugagggagacgggucuccguguaaaauuccauuugaaauaauggaccuagagaaacgauacguuuuaggccgucuaauuacgguaaauccaauaguaacugaaaaagacucaccaguaaacaucgaggcugagccgcccuucggugauaguuauauuaucauaggagucgaaccagggcaauuaaaauugaauugguuuaagaaaggaucuucaauaggacaaauguucgaaacuacaaugagaggugcuaaacgaauggcaauacucggagacacugcaugggauuuuggcucauugggaggaguauucaccaguauaggaaaggcuuuacaucagguauuuggagcaauuuacggagccgcauuuucuggaguaaguuggacuaugaaaaucuuaaucgguguuaucauaaccuggaucgguaugaacucuaggucaacaagccuaucaguaucuuugguauugguagggauaguaacgcuauacuuaggugucaugguacaggcugacagcgggugcguaguguccuggaaaaacaaagaacucaaaugcgguagugggauauuuauaaccgacaauguacauacauggacagaacaauacaaauuucaacccgaaucccccaguaaacucgcgagugcuauacaaaaggcacaggaagaagguauaugcggaauccgcaguguaacaagacuagaaaaucugauguggaagcaaauaacaccugaauuaaaucauauauuagcugagaaugaggucaaacuuacaauaaugaccggugauauuaagggaauaaugcaagcaggaaagaggucucuuagaccgcaaccaacugaauuaaaguauaguuggaaaacgugggggaaagcaaaaauguuguccacagaaaguuauaaucaaacuuuucuaauugauggcccggaaacagccgagugucccaauacgaaucgggcguggaacagcuuggagguugaagauuacggcuucggcguauucaccacgaacauuugguuaaaauugaaagaaaaacaagacgccuuuugugauaguaaacuuaugucugcugcaauaaaagauaaccgugcgguacaugcugacaugggcuacuggauagaaagugcauugaaugauaccuggaaaauagaaaaagcaucuuuuauugaagucaagaauugucacuggccaaaaucacauacucuguggucaaauggugugcuagaaucagaaaugauaauacccaaaaaucuugcggggccaguaucccaacauaauuaucguccuggcuaucauacccagaucgcugguccauggcauuuagguaaauuggaaauggacuuugacuuuugugauggaaccacugugauuguuacggaggacugugggaauaggggaccaucucuacggacgacuacggcauccgggaaacuaauaacugaauggugcuguagaaguugcacucuuccaccuuuacgauauaggggcgaagacggauguugguauggaauggaaauuagaccauuaaaagaaaaagaggagaaucuaguaaacucucugguaacagccgggcacggacaaguggauaauuucagccuaggagucuuaggaauggcgcuuuuccuagaagaaaugcuaagaacccgaguaggaacaaaacaugcaauuuuguuggucgcuguuuccuuugugaccuuaaucacaggcaauaugaguuucaaggaucuaggaagagugguagugaugguuggagcgacuauggcagaugauauuggaaugggugugacguaucuagcacuacucgcggccuuuaaaguacgaccaaccuucgcugcuggacuucuauuaaggaaacuuacuucaaaagaacugaugaugacaaccaucgggauuguucuacuaagccaauccacgauucccgaaacgguauuagagcuuacugaugcauuagcacucgguaugauggugcucaaaauaguaaggaauauggaaaaauaucaauuagcagugacaauaauggccauacuuugcgucccgaacgcuguaauuuugcaaaacgcguggaagguaaguuguacaauacuggcuguaguaagcgucucaccacuauuacuaacaagcucacaacagaaaaccgauuggauuccguuagcauuaacaauaaaaggauuaaacccaacggcuaucuuccucacaacucuaucgagaaccaacaagaaacgaaguuggccauugaaugaagcuauuauggcgguaggaaugguaagcaucuuggcaaguagcuuacuaaagaaugacaucccaaugacaggaccguuaguagcaggaggauuacuuacuguuuguuacguacuuacaggucgaucagccgaccuagaauuggagcgggcgaccgauguuaaaugggaagaccaagcagagauauccggaagcaguccaauacuaagcauuacaauauccgaggaugguaguaugucaaucaaaaacgaagaagaagaacaaaccuuaacaauauuaauccggaccggacuauuaguaauuucuggcuuauuuccaaucucuauuccaauaacugccgcugcuugguaucucugggaagucaagaaacaacgcgcgggaguacugugggacguaccaucaccaccgccaauggguaaagcggaacuagaggacggcgcauaucgaauuaaacagaagggaauacuaggguauagucaaauaggugcuggaguauacaaggaagggacguuucacacaauguggcauguuacacguggugcugucuuaaugcacaaaggaaaaagaauugagccaucaugggccgaugucaaaaaggaccuaauaaguuacgguggaggguggaaauuagagggugaauggaaagagggagaagaaguccagguccucgcuuuagagccuggcaaaaauccuagagcgguucaaacaaagccaggccuguuuaaaacaaauacgggcacuauaggcgccgugucucuugauuuuucgccagggacaucggguaguccaauuauagauaagaaaggaaaaguagugggauuauaugguaacgggguaguaacaagaucaggagcauauguaagcgcaauugcacaaacugaaaaauccauagaggacaacccagaaauugaggaugacauauuccgaaagcgaagacuaacaaucauggacuuacaucccggcgcuggaaagacaaagcgauaccuaccagcuauugugagggaagcuauaaaacgaggacuucggacguuaauauuagcaccuacucguguugucgccgccgaaauggaagaggcuuuacgcgggcuacccauaagauaccaaacgccagcaaucagggccgaacauacagggcgcgaaauuguagaucuaaugugccaugccacguuuacuaugagacuauuauccccuguuaggguaccaaacuacaauuugauaauuauggacgaagcacauuuuacugaucccgccucuauagcagcacgaggcuauauuaguacgagaguagaaaugggcgaggcagcgggaauauuuaugacagccacaccacccgguucaagagacccauuuccucaaaguaaugccccuauuaucgacgaagaacgagaaauaccugaaagaagcuggaacucagggcacgaguggguaacugauuuuaagggaaaaacggucugguuuguuccuucuaucaaggcgggcaaugacauugcagcuuguuugcguaaaaaugguaaaaaggucauccaacucagcagaaaaacauucgauagugaguauguuaaaacuaggacgaacgauugggauuucguaguuacuacagauauauccgaaaugggggcaaacuucaaagccgagagagucauagacccacgaagaugcaugaaacccguuauuuuaacugauggagaagaacgaguaauacucgccggucccaugccuguaacacauucaucugcggcacagcgucgaggucgcauuggacgaaauccaaagaaugaaaacgaucaauacauuuauaugggugaaccguuagaaaaugaugaagacugugcacauuggaaagaagcgaaaaugcugcucgauaauauuaacacaccagaagguauaauuccguccauguucgaaccagaaagagaaaaagucgacgcaauagacggcgaauauagguuaagaggagaagcuagaaagacauuugucgaucuaaugagaaggggcgaucucccgguauggcuagcauacaagguagcagcagaagguauuaauuaugcugaucguaggugguguuuugauggcauaaagaauaaucagauucuagaagaaaauguagaaguagaaauauggacuaaagagggugaacgaaagaaacuaaaaccaagguggcuggacgccagaauuuacagugacccacucgcacuaaaagaguucaaagaauuugcagcgggaagaaagagucuuacguuaaaucugauuaccgaaaugggaagacucccuacauucaugacucagaaaacuagagaugcccuagacaaucuagccgucuuacauacagccgaggcugguggacgcgcauauaaucacgcauuaucagaguugccagaaacucuagaaacuuuguuguuacucacuuuauuagcaacggugacagguggcauauuucuauucuuaaugagcgguagagguaucgggaagaugacacuaggaauguguugcaucacaacugcaaguauacuacuaugguaugcucaaauucagccccacuggauagcagcaaguauuauauuagaguucuuuuuaauaguuuuacuuauaccugagccugaaaagcaacgaacaccccaagacaaccaauuaacauauguaguaauagcaauucucacagugguugccgcgacgauggcaaacgaaaugggauuuuuggagaaaacuaagaaagauuuaggauuagguuccauugccacccaacaaccugaaucuaacauucuagauaucgauuuaaggccagcauccgcguggacacuuuaugcaguagcgaccacguucgugacgcccaugcuuagacauuccauagaaaauucaucuguaaacgucagcuuaacggcaaucgccaaccaagccaccguccucaugggacuaggaaaaggguggccguugaguaaaauggauauugguguuccacugcuagcuauaggauguuauucucaagugaacccaauuaccuuaacagcugcuuuguuacugcuaguagcacauuacgccauuaucggaccgggucuacaagcaaaagcuacaagagaagcacagaaaagagcugcugccgggauuaugaaaaacccuacgguagacggaauaacuguuauagaccuagauccuauaccauaugacccaaaauuugaaaaacaauugggacagguuauguuacuuauacuuugcguaacacaaguacuuaugaugaggaccacaugggcccuaugcgaagcccuaacuuuggcuacuggcccaaucucuaccuugugggagggaaacccugguagauucuggaacacgacaauugcagugucuauggcaaauauuuuuagaggcuccuaucuagcuggcgcaggauugcuauuuuccauaaugaaaaacacaacaaauacccguagaggcaccggcaacaugggagaaacccucggugaaaaguggaaaagccgccuaaaugccuuggguaaaagugaguuccaaauuuacaaacguagcgggauacaggaggucgaucgaacucuggcaaaagaagggauaaaaagaggcgagacagaucaucaugcaguaagcagaggauccgcuaaguuaaggugguucguggaaagaaauaugguaacgccugaggguaaaguaguggaccuugguuguggcagaggaggcuggucguauuacugugguggacuuaaaaauguuagggagguaaaggguuuaacuaaagguggcccaggacacgaggagccaauaccaaugaguacuuaugguuggaaucuagugcgacuucagucuggcguugacguuuucuuuauuccaccagaaaaaugugauacgcuacuuugcgauauaggagaaagcucuccaaacccaacuguugaggccgguagaacacuacguguuuuaaauuugguagaaaacuggcucaauaauaauacacaauucugcauaaagguucuuaacccuuacaugccgucagucauugagaaaauggaagcacuacaacgaaaauauggaggagcguuaguaaggaacccacucagcagaaauucgacccaugagauguacugggugaguaaugccucugguaauauaguuucaucagucaacaugauaagccgcauguuaauaaauagauuuacgaugagacauaagaaagcaacuuacgaacccgauguagacuuaggaucaggaacaagaaacaucggcauugagucugaaaucccaaauuuagauauuaucggaaaacggaucgagaaaauuaagcaagaacaugaaacaaguuggcacuacgaucaggaucaucccuauaagacaugggcuuaccauggaucguaugagacaaaacagacagguucagccucaucaaugguaaaugguguagucagauuguuaacuaagcccugggauguacugcccaccguaacucaaauggcuaugaccgacacuacgccuuuuggacagcaaaggguauucaaggagaaaguagauacucgcacgcaagaaccaaaggagggaacuaagaaacuaaugaaaaucacagcagaauggcuauggaaagaacuagggaagaagaaaacgccucggaugugcacuagagaagaguuuacuagaaagguacgaaguaaugcagcucugggagcaauauuuacggacgagaauaaauggaaaucagcaagagaagcuguugaagacaguagauuuugggaacugguagauaaagaaagaaacuuacaucuagaaggcaaaugugaaacuugcguuuauaauaugauggguaaaagggaaaagaaacucggagaguucggaaaagcaaaaggcagcagggccauaugguauauguggcugggagcgcgguucuuagaauuugaggcccuaggauuucuuaaugaggaucacugguuuucuagagaaaauucuuuaaguggcguggagggagaaggucuacacaaauuaggauacauacugagagacgucucaaagaaagaagguggugcaauguacgcagaugacacagcagggugggacacgcguauuacuuuggaagaucuaaagaacgaagagaugguuacaaaccauauggaaggggagcacaagaaauuagcagaagccauauuuaaauuaacauaucaaaauaaaguugugaggguacagagaccagcgccaagaggcacagugauggacauuauaucaaggagagaucaaagaggaucaggacaaguggguacauacggguugaacacuuucacaaauauggaagcgcaguuaauaagacagauggaaggagagggaguauucaaaaauauacaacaucuaaccguaacggaagaggucgcaguccagaacuggcuagcuaggguugguagggaaaggcuguccagaauggcuaucuccggagaugacugcguaguaaaaccuuuggaugauagauucgcuaacgcgcuuacagcucuaaaugauaugggcaaaauuagaaaagauauacaacaaugggaaccaucaaaaggcuggaacgauuggacacaaguaccauuuuguucacaucauuuccacgaacuuauaaugaaagacgggagaguacuggucgucccaugccguaaucaagaugaacuaauagguagggcucgaaucagucaaggagcgggauggagucuacgagaaacagcuugucuuggaaagaguuaugcacaaauguggagucuuauguacuuucaucguagggauuuaagacucgcggcuaacgccaucugcucagccguuccuucucacugggucccgaccucacgcacgacauggagcauacacgcaaaacaugaauggaugacaacugaggauaugcuaacaguauggaauagaguauggauucgagaaaacccauggauggaagacaaaacuccaguugagucgugggaagaaauccccuacuuagggaaaagggaagaccaauggugcggcucauuaauaggacuuacgagccgugcgacgugggccaaaaacauccaggcugcaauuaaucaaguuagaucuuuaauaggaaacgaagaguacacagauuacaugccuucuaugaagagauuccgcagggaagaagaggaggcggggguucuuugguga

SEQ ID NO: 22696 - RNA, 9876 nt, Artificial Sequence
  derived and/or modified CDS sequence (opt6) from DENV-2__FJ410195__SS-prME
agugcuggaaugauaauaaugcuaauaccgacuguaauggcauuucaccuaacgacgaggaacggagaaccucauaugauuguuggcauacaagaaaaaggcaaaagccuacuguuuaaaacagaagacggaguuaacauguguacauugauggcuauggaccuaggcgaauuaugugaggauacaauuaccuacaaaugcccguuacugagacaaaacgaaccagaagauauugauuguuggugcaauuccacgucgacuuggguaacuuauggcacaugcacaacgacaggugagcaucggcgugagaaaagaucaguugcauuagucccacauguaggaauggguuuagagacuaggaccgagacauggaugucuucagaaggagcuuggaaacaugcacaacgaauugagacauggauacucagacaucccggauuuacgauaauggcagcuauauuggcuuauacuauaggcacaacacauuuccagcgaguauuaauauucauauuauugacagcaguggcaccaaguaugacaaugagaugcauaggcaucagcaauagagacuuuguagaagggguuagcggaggauccuggguagauauuguauuagaacacggcuccugugucacuacuauggccaaaaacaaaccgacccuggacuucgaguuaauaaaaacugaagcgaaacagccagcaacacuacgaaaauauugcauagaagcaaaauuaacaaacacaacgaccgaaucccguugcccuacacaaggagaaccaucacuaaaagaagaacaagauaaaagauuuguuuguaaacauucuaugguagauaggggaugggguaaugggugcggucuguuuggaaaaggaggaauaguaacgugugcuauguuuacaugcaagaagaacauggaggggaaaauuguacagccggaaaacuuagaauacacgaucgugguaacuccccauaguggugaggaacaugcgguuggaaaugauacgggaaaacacggaaaagaaauaaaagucacaccccaaucaagcaucacugaagcagaacuaacaggauaugggaccguuaccauggaauguagcccaagaacuggacuagauuucaaugagaugguauuacuccaaauggaaaacaaagcauggcuaguacacagacaaugguuuuuggauuugccccuacccuggcucccaggggcagauaaacaggagaguaauuggauacaaaaagagacauuaguaaccuuuaaaaacccacaugcuaagaaacaagacguagugguuuuagguagccaggaaggcgcuaugcacacugcacuuaccggugcuacagaaauccaaaugucaucagggaacuugcuguuuacuggacauuugaaauguagauugagaauggacaaauugcagcuaaaaggaaugagcuauucgaugugcacaggaaaauucaaaguuguaaaagaaauagcugagacucaacacggaacaauagucauuaggguacaauacgaaggagacggaucaccguguaaaauaccauucgaaauuauggaucucgagaaaagauauguccuuggaagauuaauaacggucaauccaaucgugacagaaaaagauucuccgguaaauaucgaagcagaaccaccauuuggcgauucguacauaaucauaggcguagaaccagggcaauugaaauugaauugguucaagaaaggaaguuccauuggacaaauguuugagacaacaaugcgaggagcuaaaaggauggcuauacuuggugacaccgcaugggauuucgguaguuugggaggcguguuuaccaguauugguaaagcucuacaccagguuuuuggugcaauauauggcgcugcauuuaguggcgucucauggacuaugaaaauauuaaucggagugauaauaacuuggauuggaaugaacuccagaagcacuucauuaucgguuucgcuaguacugguaggaauaguaacacucuaucuggguguuaugguacaagcagacagcggcuguguaguuucauggaagaauaaagaacuaaaauguggaucuggaauauucauaacagacaacgugcacacauggacugagcaauacaaauuucagccugaaucgccauccaaauuagcauccgcaauacaaaaagcccaagaagaggguauaugugguauccguucgguaacgcgacuagaaaacuuaauguggaagcaaauuacacccgaguuaaaccacauuuuagccgaaaaugagguuaaauugacuauaaugacuggggacaucaagggaauaaugcaggcaggaaaacguucucuucgaccacaaccaacugagcucaaauacucauggaaaacguggggaaaagcaaaaauguuaaguacagagucuuauaaucagacauuuuugauagacgguccggagacagcggaauguccuaauacaaacagagccuggaacagcuuagaaguagaggacuauggguuugguguauuuacgacuaauaucuggcuuaaauuaaaggaaaaacaggacgcauucugugauucgaaacuuaugucggcggcuauaaaagauaaccgugccguccacgcggacaugggguacuggauagaaucagcucuuaacgauacuuggaaaauagagaaagcgaguuuuauagaagucaaaaauugucauuggcccaaaucacacacacuguggucgaauggaguacuagaaagcgaaaugauuauaccgaaaaacuuagccggaccagucagucagcauaauuauagaccugguuaucacacccaaauagcaggcccauggcaccucggaaaguuggaaauggauuucgauuuuugcgacggcacuacuguuauuguaaccgaagacugugggaaucgcggccccagcuuacgaacgacgacugcuuccggaaaauugaucacggagugguguugccgaucauguacucuaccaccgcuaagauaucgaggagaagaugguugcugguacgguauggaaauacgaccucuuaaagaaaaagaagagaauuugguuaacucauugguuaccgcagggcauggucaaguugauaacuuuagcuuaggaguccuagguauggcuuuauuccucgaggagaugcuccggacuagaguuggcacuaaacacgccauacuauugguggcaguuucuuuuguaacucucauaacuggcaacauguccuucaaggacuuaggucggguaguaguaauagugggagcaacuauggcugacgauauaggaaugggcguaacauaccucgcgcuuuuggcagcuuuuaaaguacgcccaacguuugcugcaggauugcugcuacgaaaacucaccucuaaagaguuaaugaugacgaccauagggauaguauuguuaucucaguccacuaucccagaaacuguuuuagaacugacagaugcauuggcucuaggcaugaugguucugaaaaucgugcggaauauggaaaaguaucaguuagcaguaacaauaaugacuauacuaugcgucccaaacgcaguuauucuacaaaaugcauggaaaguaagcuguacaauuuuagcagucguaucagugaguccacuacuacuaacuucaucuaggcaaaagacagauuggauaccguuagcauugacaauaaaaggauugaaccccacugcaauauucuuaacgacucuaagccggacuaauaagaaaagguccuggccguuaaacgaagcaauaauggccguagguauggugucaauacuagcaaguucauuacuuaaaaacgauauccccaugacuggcccucuuguagccggugguuuauuaacagucugcuauguacuaacuggucgcagcgcggauuuagaacuggaacgcgcaacagauguuaaaugggaagaucaggcagagauuagugguucaagcccaauccuuaguauuacuauauccgaagauggaagcaugucuaucaaaaaugaagaggaagaacaaacauugacaauccucauuagaacagggcugcuaguuaucuccgguuuauuaccaauaagcaucccaaucacggcagccgcaugguaucugugggaaguaaagaagcaacgcgccgguguacuuugggauguuccuucuccaccaccuauggguaaagcagaauuagaggauggagcguauagaaucaaacagaaagggauacugggguacucgcaaauaggagcggguguauauaaagaaggaacuuuccacacaauguggcaugucacaagaggagccguguuaaugcacaaaggaaaaagaauagaaccgucgugggccgacgucaagaaagauuuaauaucguaugggggaggcuggaaacuggaaggagaauggaaagaaggugaggaaguacaaguacucgcacuagaaccuggcaaaaauccacgagcuguccaaaccaaaccuggauuauucaaaaccaacacagggacaauaggugcuguaucauuagauuucucaccagguacaagugguagucccaucauugacaagaaagguaaaguagucgggcuauauggaaacgggguuguaacacguucaggggcuuacguuucagcaauagcucaaacagaaaaaucuauagaggauaauccagagaucgaagaugauauuuucagaaagcguagacugacgauuauggaccuucacccaggggcugguaaaacaaaaagauaucugcccgcaaucguaagggaagcaauaaaaagaggucuacguacauuaauacuugcuccuacgagaguuguagcagcagagauggaagaagcauugcggggacuuccuaucagauaucaaacaccagcaauuagggcugaacauacaggaagggaaaucguggaucuaaugugucacgcuacauucacgaugagauuacucucuccagucagaguuccgaauuacaauuuaaucaucauggaugaagcacacuuuacggacccggcaaguauugcugcgaggggauauauaucaacgagaguagaaaugggcgaagcugcgggaauauucaugaccgcaacuccucccgggaguagagaccccuuuccacagucuaaugccccaauuauugaugaagaaagagagauaccugaaagaucuuggaacucggggcacgaaugggugaccgauuucaaaggaaagacuguuugguucguaccaaguaucaaagcugguaaugacauagcagcaugccugaggaaaaauggcaagaaaguaauacaauuaaguaggaagaccuucgacagcgaauacguuaagacccgaacaaaugauugggauuuuguaguuacuacagauauaucagaaaugggggcaaauuuuaaggcagaacgggugauugauccaagacguuguaugaaaccuguuauccuuacugacggggaagaaagaguuauacuugcaggaccaaugcccgugacucacucaagugcggcacaacggcgaggucgaaucgggcgaaauccgaaaaaugaaaaugaucaguauauuuacaugggggagccucucgagaaugacgaagacugcgcgcauuggaaagaggccaaaauguuacuugauaauauuaauacacccgagggaauaaucccuaguauguucgaaccagaaagagaaaaaguagaugcuaucgauggagaauaucgccugcguggagaggcacguaaaacuuucgucgaccucaugagacguggagaucuaccggucuggcucgcuuauaaagucgcugccgaagguauuaauuaugcugauagaagaugguguuuugacggcaucaaaaacaaucaaauacuugaagaaaauguagagguagaaauauggacaaaagaaggggaaagaaagaaacucaaaccgagauggcuggacgcaagaauauauucagauccacuagcauugaaagaauuuaaagaguuugccgcaggacgcaaaucacucacacuuaacuugauuaccgagaugggcagacucccaacauuuaugacucagaaaacacgugacgcauuggauaaccuagcuguccuccacacagcggaagccgguggacgugcguacaaucacgcacugucugaacuuccugaaacacuugaaacuuuguuauuauuaacauuauuggccaccguuacaggcggaauauuuuuauucuuaaugucugggcgaggaauaggcaaaaugacguuaggaauguguugcauuauaacagcuucuauccucuuaugguaugcgcaaauccagccucacuggauagcggcaucuauuauccuugaguucuuuuuaaucguucuccuuauuccggaaccggaaaagcaaaggacaccucaagacaaccaguuaacuuauguaguaauagcuauuuuaacaguaguggcagcuacuauggcaaaugaaaugggauuucucgagaaaaccaagaaagacuugggucuagggagcauugcaacgcaacaaccagagucaaacauauuagacauugaccuucgaccagcuagugccuggacucuuuaugcuguugccacgacauucguaacuccgaugcucaggcauaguauagaaaacaguagcgugaacguuucguugacugccauagcuaaucaagcaacgguguugauggguuuggggaaaggguggccgcucucuaaaauggacauaggaguccccuuguuggcaauaggauguuauucccaagugaauccuauaacucuuacugccgcacuauuauuguuaguagcucacuacgcgauuauaggaccuggacuccaagcaaaagccaccagagaagcgcagaaaagagcugcugcuggaauaaugaaaaauccaaccguggaugguaucacaguaauagaccuugacccuauaccuuaugacccaaaauuugaaaaacaacugggccaagucauguuauuaauacuaugcguaacccagguccugaugaugagaacuacaugggcucuaugugaagcgcuuacauuggcuacaggucccauaaguacgcugugggaaggcaaccccggaagauucuggaacacgaccaucgcggugaguauggcuaauauuuuccgcggaucuuauuuggcuggugcgggauuauuauuuucuauaaugaagaacacaacaaacacucgaagaggaaccgguaauaugggagaaaccuuaggggaaaaauggaaaucuagauugaaugcuuugggaaagaaugaguuccaaaucuacaagaaaucuggcauucaagaaguugauaggacguuagcaaaagaagguauaaagagaggggaaaccgaucaccacgcaguaucacgagguagcgcgaaguugcguugguuuguagaaagaaacaugguaacucccgaagguaagguuguagaucuuggaugcgguagagggggaugguccuacuacugcggaggguuaaagaacguacgagaagugaaaggacugacgaaaggcggcccagggcaugaagaaccaauaccuaugaguacuuauggauggaacuuaguacgucugcaaagugguguagauguauucuuuauaccgccagaaaaaugugacacacuauuaugcgauauuggagaaucuucgccuaauccgaccguagaggcuggaagaacacuacgagucuuaaaccuaguggagaauugguuaaauaauaacacucaguuuugcauaaaagugcuaaauccguauaugccuuccguuauagagaaaauggaagcccuucaacggaaauacggaggugcacugguacguaauccucuuucaagaaacaguacacacgaaauguauuggguuucaaaugcaucagguaauauagugaguucaguaaacaugauaucacgaaugcuaauaaauagauucacaaugcggcauaagaaggcaacguaugaaccugauguagaccuugguagugguacacggaauaucggcauugaauccgaaaucccgaaccuugauauuauuggcaaacguauagagaaaauuaaacaagagcaugaaaccuccuggcacuaugaccaagaucaccccuauaaaacgugggcuuaccacgggucauacgaaaccaaacagacgggaagcgcgaguucgaugguaaauggaguaguacguuugcucaccaaaccaugggauguacuacccacggugacgcaaauggcuaugacagauacaacaccauuuggacaacaaaggguauuuaaagaaaagguagauaccagaacgcaagagccaaaagaaggaaccaagaaauugaugaagaucacagcugaaugguuguggaaggaauuagguaagaagaaaacuccuagaaugugcacacgcgaggaauuuaccagaaaaguucgaucaaaugcagcuuugggcgcaauauucaccgaugagaauaaauggaaaagugcaagagaagccguagaagauucaagauucugggaauuaguagacaaagaacgaaaucuacauuuggaaggaaagugcgaaaccuguguuuacaacaugaugggcaaacgagagaagaaauugggcgaauuuggaaaagcaaaagggagccgagcaauaugguauaugugguuaggugcgcguuuccucgaauuugaagcguuagguuucuuaaaugaggaccacugguuuucaagagaaaacagccuaagcggaguagaaggcgaaggacuucauaaauuaggguauauauuaagagacgucaguaagaaagaaggaggagcuauguaugcagaugacacggcuggaugggacacaagaauaacauuagaagaucucaagaaugaggaaaugguaacaaaccacauggagggcgaacauaagaaacuggcggaagcuauauucaaacuuacauaucagaacaagguuguaagggugcaaagaccuaccccgagaggaacugugauggacauaauuucaagaagagaccaacguggaucaggucaggucggaacuuacggguuaaacacauucacuaauauggaagcgcaguuaauacgacaaauggaaggugaaggagucuuuaaaaacauccagcacuugacuguuaccgaggaaguugcgguacaaaacuggcuggcgagaguuggaagagaacgguuaucuagaauggcaaucaguggagaugauugcgucguaaagccauuagaugauagguucgcuaaugccuuaacagcucugaacgauaugggaaaaaucagaaaggauauccaacaaugggaacccucaaagggguggaaugacuggacacaaguacccuuuuguucccaccauuuccacgagcuuaucaugaaggauggucguguucuaguagugccaugcaggaaucaagaugaacucaucggacgugcgagaauaagucaaggugcgggguggaguuuaagagaaaccgcaugccuaggaaagucguaugcacaaauguggucuuuaauguauuuccacagaagagacuugcgcuuagcagcaaaugcuauuugcagugccguaccgagucauugggucccaacaucacgcacuacuuggagcauucacgcaaaacaugaguggaugacaacugaggacauguuaacgguuuggaaccggguguggauccgugaaaauccauggauggaggauaagacccccguugaaucaugggaggagaucccuuaucugggaaaaagagaagaucaaugguguggaucauugauaggauuaacaucaagagcaaccugggccaaaaauauucaagcugcaauuaaucaagugagaagccugauagguaacgaagaauauaccgauuacaugccaucuaugaaacgauuccgaagagaagaagaggaagccggugugcucugguag

SEQ ID NO: 22697 - RNA, 9876 nt, Artificial Sequence
  derived and/or modified CDS sequence (opt6) from DENV-2__FJ432726__SS-prME
ucugcagguaugauuauaaugcuuauaccaaccgugauggcuuuccaucuaacgaccagaaauggcgaaccacacaugauaguaggaauacaagaaaaaggaaaaucuuuauuguuuaaaaccgaagauggaguaaacaugugcacgcugauggcaauggaccuaggagaacuaugcgaagacacgauaacauauaaaugcccacuacuacgacaaaacgaaccagaagauauagacuguugguguaauagcacuagcacauggguaacauauggaaccuguacaacuacuggagaacaccgaagagagaaaagaucuguagcauuagugccgcacguggggaugggacucgaaacaagaaccgaaacauggaugagcuccgaaggagcauggaaacaugcucaaagaauagaaaccuggauauuaagacauccaggcuuuacaauaauggcagcaauucuagcguacacaauagguacaacacauuuucagagaguucuuauauucauauuacuaacugcaguagcucccaguaugaccaugcgcugcauuggaauuagcaauagagacuucguagaaggugucagcgggggaucuuggguagauauuguacuagaacaugguucaugcguuacuaccauggccaaaaauaaaccuacauuggauuuugaacucauaaaaacagaagccaaacaacccgcaacauuaagaaaauacuguauugaagcaaaacuuacgaauacaacaaccgaaagccgcugcccuacucagggggaaccuucauuaaaagaagaacaagauaaacgcuucguaugcaaacauucgauggucgaccguggcugggggaacggaugugggcuuuuuggcaaaggaggaauaguaacuugcgcuauguuuacuugcaagaaaaauauggaagguaaaaucgugcaaccagaaaaucuugaauauacgauugucguaacuccgcacucuggagaagaacacgcuguagguaacgauacggguaaacacgguauggagauaaaaguaaccccucaaagcucuauaaccgaagcugaguugacuggauacgggaccguaaccauggaauguucaccacgcacuggacuggacuucaacgagaugguccuccuacagauggaaaacaaagcauggcucgugcaucgacaaugguuuuuagaucucccacucccaugguugccaggagcggauaaacaggaaucuaacuggauucaaaaagaaacccuuguaacauucaaaaauccacaugccaagaaacaagacguaguaguucugggaagccaggaaggcgcuaugcacacagcccuaacaggugcaacugaaauacagauguccucaggcaaccuuuuguuuaccgggcaucuaaaaugcagguuacgcauggacaaauuacaauuaaaagguauguccuauagcaugugcacgggcaaauuuaaaguuguaaaagagauagcagagacccaacacgggacuauaguaauccgugugcaauacgagggagauggcucacccugcaaaauacccuuugaaauuauggacuuagaaaaacguuaugugcuugguagacuaauuacagucaacccgauuguuaccgaaaaggauaguccuguaaauauugaagcagagccuccauucggcgauaguuauaucauuaucggugucgaaccaggccaauugaaacuaaauugguucaagaaagggucgucaaucggucagauguuugaaacaacaaugcguggcgccaaacgcauggcgauuuuaggggacacggcaugggacuucggaucgcuaggagguguuuucacuucaauagggaaggcuuuacaccaaguuuuuggugcaauauauggagccgcauucaguggaguaucauggacgaugaaaauccucauuggaguuauuaucacuuggauagguaugaacucaagaaguaccucuuuaucaguaagucuugucuuaguaggaauugucaccuuauaucuaggagugauggugcaagcagacucaggcugugugguauccuggaaaaauaaagaacuaaaauguggaucagguauauuuauaaccgauaauguucauaccuggacagaacaauacaaauuccaacccgaaucaccuucaaaacuugccucggccauccagaaagcccaggaagagggcauaugugguauaagaucaguaacccgacucgagaacuugauguggaagcaaaucaccccagaacugaaccauauacuugcggaaaacgaggugaaacugacaauuaugacaggugauauaaggggaaucaugcaagcuggaaagcguucccuucggccacaaccaacggagcuuaaauauagcuggaagacuugggggaaagcuaaaauguuaucaaccgaaucauauaaccaaacuuuccuuauagauggaccagaaacugccgaaugccccaauacuaauagagcauggaacucauuagaaguagaagauuaugguuuuggcguauuuaccacaaacaucugguugaaacuaaaagagaaacaagacgcauuuugugauucaaaauuaaugagcgcugccauuaaagauaacagagcuguacacgccgauaugggauacuggauagaaagugcccuaaaugauacauggaaaaucgagaaagcaucauucauugaggucaaaaacugccacuggccuaaaucacauacacuaugguccaauggcguauuagaaagugaaaugaucauuccgaaaaauuuagcagguccggcaucgcaacacaauuauagaccaggguaucauacacagauugccggccccuggcaccuagguaagcuagaaauggacuucgauuuuugugauggaacaaccguaauagugaccgaggauugugguaacagggguccaucuuuaaggacuacaacggccaguggaaaacucauuacagaaugguguuguagaagcugcaccuuaccaccacuacguuacagaggagaagacgguugcugguaugggauggagaucagaccacuuaaagaaaaagaagagaaucuuguaaacaguuuaguuacagcaggacacggacaaguagacaauuucucccuagguguauuaggaauggcacuguucuuagaggagauguugcgaacaagagucggaacuaaacaugcaauuuuauugguagcuguaaguuuuguaacacuuaucacuggcaauaugagcuuuaaggaccuuggacgaguagucguuauggucggagcgaccauggcagacgacaucgggaugggaguuaccuacuuagcauuauuggcagccuuuaaaguccgacccacauuugcagcaggccuauuacuccguaaauugacgucaaaagaauugaugaugacaacuauuggcauuguucuauuaagccagucaacuauaccagaaaccguuuuggaauugacugacgcucuagcacuagggaugaugguauuaaagauagugaggaauauggagaaauaucaauuggcuguuacaauaauggcuauacuuuguguaccaaacgcugucauccugcagaacgcuuggaaaguaucguguacuauuuuagcgguaguuagugugaguccauuacuccuaacaucaucccaacagaaaacggauuggauaccacuagccuuaaccauaaaagguuuaaauccuacagccauauucuugacgaccuuaucaagaacaaacaagaaacgcuccuggccuuuaaacgaagccaucauggcuguggguaugguuuccauacuggcuucuucguuacugaaaaacgacauuccaaugacagggccucuaguagcagggggauuauuaacggucugcuaugugcucacgggcaggucagcugacuuagagcuggagagagcgacugauguuaaaugggaagaucaggcagaaauaagugguucuucuccaauacuuucaaucacaaucucagaagaugguagcauguccaucaaaaacgaagaagaggaacaaacccuaacgauuuuaauccgaaccggacuuuuaguaauaucaggccuguucccaaucucaauuccaauaacugcggccgcaugguauuuaugggaaguaaagaagcaacgagcaggaguacugugggauguaccaucacccccuccuaugggaaaggcugaauuggaggacggggcauaccgaauuaaacaaaaagguauauugggauauucucagauuggagccgguguuuauaaagaaggaacauuucauacaauguggcauguaacgagaggugcagugcuaaugcauaaaggaaagagaaucgaacccaguugggcugaugucaagaaagacuuaauuucauauggggguggauggaaacuagaaggugaguggaaggagggcgaagaaguacaaguacuagccuuagaaccugguaaaaaccccagggcaguacagacaaaacccggcuuauucaaaaccaacacagguacaauaggagccgugucguuagacuuuucaccggggacaagcggguccccgaucauagauaaaaagggaaaggucguuggcuuauacgguaaugguguugugacacgaagcggagcauacgucuccgcuauugcgcaaacggaaaaaucgauagaagauaacccagaaauagaagaugacauauuucguaaacgccgacuuacuauaauggauuugcaccccggcgcuggaaaaacgaagagguaccuaccagccauagugagagaagccauuaaaagaggacuaaggacauuaauauuagcaccuacgcgcgucguggcggcagaaauggaagaagcguugagaggauuacccauaagauaucagacaccagcuauaagggcagaacacacaggcagggaaauaguggaccugaugugccaugcgacuuucacgaugcgauuauuaucgccaguaagaguacccaauuauaaucuuaucaucauggacgaagcucacuucacugacccugcuaguaucgcagcaagagguuauauuucuacacgaguagaaaugggagaagcagccgguauauucaugaccgcaaccccaccugguaguagagauccauuuccgcagucgaaugcgccaauaauagaugaggagcgugaaauuccugaaagaaguuggaacucgggacaugaguggguaacagauuuuaaagguaaaaccguuugguuugucccaucaauuaaggccggcaaugacauugcggcaugucucaggaaaaaugggaagaaaguaauacaacuaagccgcaaaacuuuugauagcgaauacgucaaaacgagaacaaaugauugggacuucguaguaacuacugauaucuccgaaaugggcgcgaacuuuaaggcggaacgaguuaucgacccaagaagaugcaugaaaccuguaaucuuaacggacggugaagaaagagugauuuuggcuggaccuaugcccguuacacacuccucugcggcucaaagaaggggaagaauuggucggaaccccaaaaacgagaaugaccaguacauauauaugggagagccacuggaaaaugaugaggacugugcgcauuggaaggaagcaaaaaugcuauuagauaauauuaacacaccagaagguauaaucccaagcauguucgaacccgagcgagaaaaaguugaugcuauugacggagaauaccgccuaagaggcgaggcgaggaaaacauucgucgaucuuaugagacgaggagacuugcccguuugguuagcauauaagguagcagccgaagguauuaacuaugcagauagacgaugguguuuugauggcaucaaaaauaaccaaauacuggaggaaaacguagagguggaaaucuggacuaaagaaggagaaaggaagaaacuuaaaccaagguggcuagaugcgcgaaucuauagugacccacuagcucucaaagaauuuaaggaauuugcagcaggacgaaaaagucugacucuaaaucuuauuaccgaaauggggcgucuaccgacguuuaugacucaaaagacacgugacgcucuagacaauuuggcugucuuacauacggcugaggcggguggucgagcauacaaucacgcacucucagaacuuccagaaacccuggagacucuauuauuauuaacucuacucgccaccguuacuggaggaauuuucuuauuucucaugagugguagaggcauaggcaaaaugacauuaggaauguguugcauaaucacagcgucuauacuauugugguaugcacaaauacagccacauuggauugcagccucuauuauuuuagaguucuuucuaaucguucuacuaauaccugaaccugaaaaacaaagaacgccacaagacaaccaacucacuuacguaguuauagcuauauuaacgguuguagcagcaacaauggcuaacgaaaugggguuuuuggagaagacaaagaaagauuuaggucugggaagcaucgcaacucaacagccagaaaguaauauacuagacauagaucuacgaccugccagcgcuuggacacucuacgcaguagcaacaacuuuuguuacacccauguugaggcauucuauugaaaacaguagcguuaacguuagccuaacagcgauugcaaaucaagcaaccguacuuaugggauuagguaaaggauggccuuuaucaaagauggauauaggaguaccuuuauuagcaauaggcugcuauagccaagucaaccccauaacuuuaacugcagcauuguuacugcuaguggcgcauuaugcaauaauuggaccuggccuacaagcaaaagccacgcgugaagcacaaaagcgagcugcagcuggaauuaugaagaacccuacagucgauggaauuacaguuaucgaucuagauccuaucccuuacgacccuaaauucgagaaacaacuaggucaagugauguugcuuauucuguguguuacacaaguauuaaugaugcgaacgacaugggcacuaugugaggcacucacacuugcgacagguccaauaaguacuuuaugggaaggcaauccugguagguuuuggaacacaacaaucgcuguuuccauggcuaauauauucagaggaucauacuuggccggugcuggccuacucuucucaauaaugaaaaauacaacaaacacaaggagagguacgggaaacauaggggaaacacuaggcgagaaauggaagucuagauugaacgcauuaggaaaaagugaguuccaaaucuacaagaaaucaggcauacaagagguugaccgcacccuggcaaaggaaggaauuaagagaggggaaacugaucaucaugcgguuagcagagggucugccaaauuaagaugguucguagagagaaacaugguuacucccgaagguaaaguaguagacuugggcuguggcagaggagguuggucauacuacuguggagggcuuaaaaauguccgcgaaguaaaaggacucaccaagggaggacccggucaugaggaaccgaucccaaugucaacuuacggguggaacuuggucaggcugcaauccggagucgacguauucuuuauuccgccugagaagugugacaccuugcugugugacauuggcgaaucgagcccgaacccaacaguagaggcgggaagaacucuccguguccucaauuuaguugaaaauugguugaauaauaacacccaguucuguauaaagguauuaaacccauauaugccaagcguaaucgaaaagauggaggcuuugcaacguaaauacgggggcgcacucguccgaaacccacucagccgaaacucaacacaugaaauguacuggguuagcaacgcaucggggaacauaguguccucagucaauaugauuagccguaugcuaauaaacagauuuacuaugcgucacaagaaagcuacuuaugagccugacguagaccuaggauccggaacaagaaacaucgguauagaaucagagauuccuaauuuggauaucauuggaaaacguauugagaaaauaaagcaagaacaugaaaccucauggcacuacgaccaggaucacccauacaaaacgugggccuaucaugguagcuaugaaaccaaacaaacuggaucugcauccucuaugguuaauggcgucguucgauuauugaccaaaccaugggacguccuucccaccguaacccaaauggcgaugaccgacacaacccccuucggacaacagaggguauucaaagaaaaaguagauacaagaacacaagaaccaaaggaggguacgaagaaacuuaugaaaauaacagcugaguggcuauggaaagaguuaggcaaaaagaaaacuccucguaugugcacaagagaagaguucacaagaaaagugagaucaaaugcugcauugggggcaauuuucacugacgaaaacaaauggaagucggcccgugaagccguagaggacucgagguucugggagcuaguugauaaggaaagaaaucugcacuuagaggggaagugugaaacaugugucuacaauaugaugggcaaaagagagaagaaauuaggagaguuugguaaagcuaaaggaagucgagcaauaugguacauguggcuaggagcucgguuucucgaguuugaagcacuaggauuccugaacgaagaucauugguucaguagggaaaauucucuaucaggaguagagggcgaaggucuccauaaauuaggauauauauuacgugauguaagcaagaaagaagguggagccauguaugcugaugauaccgcugggugggauacacguauaacacuagaagaccuuaagaacgaagaaaugguaaccaaccacauggaaggcgagcacaagaaacuugcggaagcgauuuuuaaauugacauaccaaaauaaagucgugcgcguucagaggccgacuccgagaggcacaguaauggacauaauaucacgucgggaucaaagagguaguggucaaguggguaccuauggcuuaaauacuuuuacuaauauggaagcacaacugauacgacaaauggaaggcgagggagucuucaaaaacauacagcaccuuacgguuacagaggaaguagcaguccacaauuggcuagcucgagucggacgagaaagacuaagcagaauggcuauaucgggagaugacugugucguaaaaccucuugaugaucgguucgccaaugcccuaacagcucugaaugacaugggaaaaauucgaaaagacauacagcaaugggaaccuucaaaaggguggaaugacuggacucaaguaccauucuguucccaccauuuccaugaauugauaaugaaggaugguagaaucuuaguagucccaugucggaaccaagaugaauugauagggagagcaagaauaagccaaggagcagguuggucacuacgagaaacugcuugccuaggaaaaagcuacgcacaaauguggucccugauguacuuucaucgucgugauuugagacuagcagcuaacgcaauuuguucagcagucccaagucacuggguacccacaucaaggacuacguggaguauacacgcaaaacacgaauggaugacaacugaagacaugcuaaccguuuggaaucggguguggauaagagagaaucccuggauggaagacaaaaccccuguggaaucuugggaagagauccccuacuuagguaaaagagaggaccagugguguggcucucucauaggauuaacgagucgggcaacaugggcgaagaacauucaagcggcaauuaaucaagucaggagucuuaucgguaacgaagaauauaccgauuauaugccaaguaugaaaagauucagacgagaagaagaagaagccgguguauuaugguaa

SEQ ID NO: 22698 - RNA, 9876 nt, Artificial Sequence
  derived and/or modified CDS sequence (opt6) from DENV-2__JF730049__SS-prME
ucugcgggaaugauuaucaugcuaauuccaacuguaauggcauuccauuuaacaacaaggaauggagaaccacacaugaucguagguauucaggaaaaaggaaaaucauuacuuuuuaaaacagaagacggagugaauauguguacguuaauggcgauggacuugggugaacuuugcgaagacacgauuacguauaaauguccauuacuacgucaaaaugaaccugaagacauugauuguugguguaauucuacuagcacuuggguaacuuauggaacauguacaacuacaggagaacacagaagagagaaaaggucaguagccuuaguaccacacguagggaugggacuugaaacacgaacugaaacauggaugucuuccgaaggagcauggaaacaugcacaacgaauagaaacauggauacuaaggcaucccggcuuuacaauaauggcagcaauuuuagcuuacacaaucggcacgacucauuuccaacguguguuaaucuucauacuauuaacggcaguugcaccaaguaugaccaugcggugcaucggaauaucaaaucgcgacuuuguggaagguguuucgggcggaucguggguagauauaguauuagaacauggaucauguguuacaacuauggcuaaaaacaaaccgacgcuagacuucgaacuaauuaaaacagaagcaaaacaacccgcaacuuuacgaaaauauuguauagaagcaaaauuaacuaauacuacuacugaaaguaggugcccaacccaaggagaaccgucucuaaaagaagaacaggacaaaagauucguuuguaaacacucgaugguggauagagguuggggaaacggaugcggccuuuuuggaaaaggcggaauugugacgugcgcaauguucacauguaagaaaaauauggaagguaaaauuguacagccagaaaacuuagaauacacgauaguagugacaccucauaguggagaagaacauguugucgguaacgacacaggcaaacaugggcaagaaauuaaaguuacgccacaaaguaguaucacugaagcagaacuuacgggauauggcacaguaacuauggaauguucaccgagaacaggucucgauuuuaaugaaaugguauuguuacaaauggaaaauaaagcaugguuaguacaccgccaaugguucuuagauuuaccgcuaccauggcuacccggagcagauaaacaagaaucaaacuggauacagaaagaaacgcuaguaacguucaaaaacccacaugcuaagaaacaagacguuguugugcuagguucucaggaaggagcgaugcacacugcccuuaccggggcaacugagauccaaaugucuucugggaauuuacuauucacuggucauuuaaaauguagauuacgaauggacaaauugcagcugaaaggaaugagcuacucaauguguacgggaaaauucaaaguaguuaaagaaaucgccgagacucaacauggaaccauagucauacgaguucaauaugagggugauggaucuccuuguaaaauucccuucgaaauaauggauuuagaaaagcgauauguacuuggacggcugauaacaguaaaucccaucgugacugaaaaggauucucccguuaauaucgaagcggaaccucccuucggugauagcuacauaauaauugguguggagccgggacagcuaaagcuaaauugguuuaagaaagguucgucaaucggacaaauguuugaaacaacaaugcggggcgcuaaacggauggcaauucuaggagauacagcaugggacuucgguucuuuaggcggaguauuuacgucaauuggcaaagcauuacaucaaguuuuuggugcgaucuauggggcagcguuuagcggcguauccuggacuaugaaaauauugauuggcgucauaauuacguggaucggaaugaacaguagaucuacgagucucagugugucauugguuuuaguugguauagugacauuguaucucggcguaaugguccaagcagacagcggguguguaguuuccuggaaaaacaaggaauugaagugcggaucaggaauauucaucacagacaacguucacacauggacugaacaauacaaauuccagccugagucuccaucaaaacuugcauccgcuauucagaaagcccaagaagaagguauaugcgguauacguucugugacucgauuggaaaauuuaauguggaaacagauaaccccggaacuaaaccauauucugaccgaaaacgaagucaaacuuacgaucaugacuggugauaucaaaggaauaaugcaagcgggaaaaaggagucuaaggccgcagccgacugaauuaaaauacucguggaagacaugggggaaagcaaaaauguuuaguaccgaaucguacaaucaaacauucuuaauagauggaccagagacugcugaauguccaaauacgaacagagcauggaacucuuuagagguagaagauuauggcuuugguguauuuacgacaaacauuuggcuuaaacuuaaagaaaaacaagacgcuuucugugauuccaaacuuaugucggcagcaauaaaagauaacagagcaguucacgcugauauggguuauuggauugaaucugcucuaaaugauacauggaaaauagagaaagcgaguuucauagaaguaaagaacugucacuggccuaaaucacacacccucuggucgaauggaguauuagaauccgagaugauaauccccaaaaaucuagcugguccggugagccagcacaacuauagaccugguuaucauacacaaauagcugggccuuggcaccuagguaaauuagaaauggauuuugauuuuugugacggaaccaccgucauaguuaccgaagauugcggaaauaggggcccuucguuacgaacaaccacggccagcgggaaacucauaacagaaugguguuguaggagcugcacgcuacccccacuacgcuaccgcggagaagauggcugcugguacgggauggaaauacggccacugaaggagaaagaggaaaacuuagucaauagcuuaguaacagcagggcauggucaaguggacaauuuuucacuggggguauuaggcauggcucuauuuuuagaagaaaugcuuaaaacacguguaggaacgaagcacgcaauucucuuaguagccgucagcuuuguaacucuuauuacggguaacaugaguuucaaagaucuaggaagaguaguuguaaugguaggagcgacaauggcugacgacauaggcauggguguaacguaccuagcauuauuagcagcauucaaaguaagaccaacauuugccgcaggucuucuacuaagaaaguuaacaucgaaagaauuaaugaugaccacaauugguauaguauugcuuagucaaucaacaauaccagaaacaguauuggaauugacagaugccuuagcucucggcaugaugguacugagaauuguucguaacauggagaaguaucaauuagcaguuacuauaauggcaauucuauguguucccaaugcgguuauccuacaaaaugccuggaagguuucgugcacuaucuuggcugucguaaguguaucgccguuauugcuaacgucuucucaacaaaagacggauuggauaccuuuagccuuaacaauaaaaggauuaaacccuacggcuauauuuuuaacuacacucucccggacgaacaagaaaagaagcuggccauuaaaugaggcaaucauggcaguugggaugguuagcauacucgcaucaucacuucuuaaaaaugauauaccaaugaccgguccucuagucgcaggaggauuacucacuguaugcuauguauuaacuggucgcagugccgaucuagaacuagagagagcaacugacguaaaaugggaggaucaggcugaaauuagcggcaguucacccauuuuauccauaacgauaucagaagauggcaguaugucaauuaaaaaugaagaagaagaacaaacgcugacuauacugauaagaacggguuugcuugugaucucuggauuauuuccaaucucaauuccuauuaccgcagcagcgugguauuuaugggaagugaagaaacagcgugcugggguguuaugggaugucccuucaccaccgccaaugggcaaggccgaacuagaagacggagcuuauagaauaaagcaaaaaggaauuuuaggguacucucagaucggcgcaggcguauacaaggagggaacuuuucauacuauguggcauguuacaagaggcgcuguuuugaugcacaaagggaaaagaauagaacccuccugggccgacgucaagaaagaccuaauauccuauggagggggauggaaacuagaaggcgaauggaaagaaggggaagaagugcaaguucuagcgcucgaaccuggcaaaaauccaagagcggugcaaacaaaacccggauuguuuaaaaccaguacaggaacaauaggggcagugucgcuagacuuuucgcccgguaccucggguucaccuauaauugauaaaaagggaaaaguaguagggcuuuacgggaacggagucgugacucguucuggugcauacgugagcgcaauagcacaaacagagaaaagcauagaagauaacccggagauugaagaugauaucuuucgcaaacguagguuaacuauaauggaucuucaucccggcgcagguaagacaaaacgauaccugccugcuaucguucgagaggcuauaaagcgaggccuacggacccuaauuuuagcaccgacucgagucguggccgcggaaauggaagaggcuuuaagaggucuacccauccgauaucaaacgccugccauaagagccgaacacacuggaagagaaaucguagauuuaaugugucaugccacguuuacaaugagacugcuuucuccuguucguguaccgaacuauaauuuaaucaucauggacgaagcccacuuuacagaucccgcuucuauagcugcgcgcggauacauuaguacccgaguugaaaugggagaagcagccggaauuuucaugaccgcgacacccccaggaucacgugacccguuuccccaaagcaaugcgccaauaauagacgaagaacgugaaauuccagaaaggucauggaacucaggacacgaguggguaacagacuuuaaagggaaaaccguuugguuuguacccagcauuaaagcagggaaugauauagcggcaugcuugaggaaaaauggcaagaaaguaauucaauuaagcagaaagacuuuugacuccgaauacgucaagacucgcacaaaugacugggacuucguagugacuacagauauuucggaaaugggcgcuaacuuuaaggcagaaaggguaauagauccacgccgauguaugaaaccagugauacuaacagacggugaagaacggguuauacuggcagguccuaugccugugacacacucaagcgcugcucaaagaagggggcgaauaggacgaaacccuaaaaaugaaaacgaccaauacaucuauaugggagaaccguuagaaaacgaugaggacugugcacauuggaaagaggcuaagaugcucuuagacaauauaaacacuccggaagggauaauacccagcauguuugaaccggaaagagaaaagguagacgcaauugauggagaauaccgacugaggggugaagcaagaaaaaccuuuguagauuuaaugcgaagaggugaccucccuguauggcuagcauacaagguagcggcagagggaauaaauuaugcugaucggcgaugguguuucgaugggaucaagaacaaccaaauacuagaggaaaauguagaagucgaaaucuggaccaaagaaggagagcgaaagaaacugaaaccgcgguggcuggaugcgcgcauuuauucugauccacuagcccuaaaagaauuuaaagaauuugccgcuggacgaaagaguuuaacuuuaaauuuaauaaccgaaauggggaggcuuccgacauuuaugacacaaaagacacgagaugcgcuagauaaucucgccguacuacauacugcagaagcugggggccgggcuuacaaccaugcucuuagugaguuaccagaaacccuggaaacgcuacuacucuugacgcuauuagcuacaguuacaggugguauauuuuuauuuuugaugucaggacgcgguauaggcaaaaugaccuugggaauguguugcauaauaacagcuucaauucuucuuugguaugcacaaauucaaccacauuggauagcagcaucuauuauauuagaguucuuuuuaauuguauugcucauccccgaaccagaaaaacaaagaacaccacaggacaaucaauugaccuauguaguuauugcaauauugacgguaguagcugcuaccauggcaaacgaaaugggcuuuuuagagaaaacuaagaaagauuuaggucuaggaucaauugcuacacaacaacccgaaucgaacauacuugauauagacuuaagaccagcaagugccuggacacuguaugcaguugcuacgacuuucguuacuccaauguuacgucauuccauagaaaacucaucgguuaaugugaguuuaaccgcaauugcuaaucaggcaaccguuuuaaugggacuuggaaaaggauggccucucagcaaaauggacauagggguaccguuacuagcgauaggauguuauucacaagugaauccgauuacucucaccgcggcacugcuucuccugguggcacacuaugcuauuauaggaccgggauuacaagcaaaagcuacacgagaagcucaaaagcgagccgcugcaggcaucaugaagaauccgacaguagacgguauuacuguaauagaccuggauccuaucccuuacgacccgaaauuugaaaagcaacuaggucaggucauguuacucauacuauguguaacacaagugcugaugaugagaaccacuugggcucuaugugaagcccucacacuugcuacuggaccaauuucaacucuaugggaaggaaacccaggaagauuuuggaacaccacuauagcaguaagcauggcuaauauauucagggguucguaucuugcaggagccggacuguuauuuucaauaaugaagaacacaacuaauacacggcggggaacaggaaacaugggcgaaacucuaggugaaaaauggaaaagucguuuaaaugccuugggcaaaagugaguuccagauuuacaaaaagaguggcauucaagaaguugaccggaccuuagcuaaggaaggcauaaaaagaggugaaacugaccaucaugcugugucacgagguucagcaaaauuacgaugguucguggaaaggaacaugguaacaccagaaggaaaaguuguagaucuaggaugcggacgggguggcugguccuauuacuguggaggacuaaagaauguacgggaaguaaaaggguuaacuaaaggaggaccaggucacgaagaaccuauucccaugaguacauacggcuggaaucucguacgcuuacaaucugguguugauguauucuuuauacccccagaaaaaugugauacauuauuaugcgauauaggcgaaagcucuccuaacccuacagucgaagcaggccgaacauuaagagucuuaaauuuaguugaaaacuggcuaaacaacaacacccaauucugcauuaaaguccuaaaucccuauaugcccaguguaauugaaaagauggaggcauuacaaagaaaguauggaggugcauugguaagaaacccauugagucgaaauucgacgcaugaaauguauuggguaaguaacgcauccggaaacaucguaucaucaguaaauaugauaagucgcaugcucauuaauagauucacaaugagacauaagaaagcuacuuaugaaccagauguagaucuagguaguggcacuaggaacauagguauugagucagaaauuccaaaccuagauauaauaggaaagagaauagagaaaauaaaacaagaacaugagacuuccuggcauuacgaccaagaccauccuuauaaaacaugggcauaccacggcucuuacgaaacuaaacaaaccggaagugccagcucuaugguaaacgggguuguacgccuucuaaccaagccgugggacguguugccaacuguuacucaaauggcuaugacagacacaacaccuuuuggacagcagcgagucuuuaaagagaaagucgacacuaggacacaagaaccgaaggaggguaccaagaagcucaugaaaauaaccgcagaauggcucuggaaggagcuagguaagaagaaaacaccuagaauguguacacgagaggaauuuacaagaaagguucgaagcaacgccgcauuaggagcgauauucacugaugaaaauaaguggaaaucagcucgcgaggcuguugaagacagccguuucugggaauuggucgacaaagaaaggaacuuacauuuagaaggaaaaugugaaacauguguauauaauaugauggggaagagggagaagaaacuaggagaguucggaaaggcaaaagguucccgggcaauuugguacaugugguugggugcuagauucuuagaguucgaagcacuuggguuucuuaacgaggaccacugguuuucacgugagaauagcuuaucgggcgucgaaggcgaaggauuacauaaguuaggcuauauauuacgugaugucucuaagaaagaagguggggcgauguaugcggaugacacagcagguugggauacacggauaacguuagaggaccucaaaaaugaagaaaugguaacaaaucauauggaaggagagcacaaaaagcucgcagaagcaauauucaaacuaacauaucaaaauaaaguagugcgagugcagcgaccaacaccgcgcggaacugucauggauauaauuagucguagggaccaaagaggaaguggacaagugggaacuuauggucuuaauacguuuacaaacauggaagcacaacuuauacgacaaauggaaggugaggguguguucaagaauauacaacacuuaacagucacugaagagguagcuguacaaaacugguuggcuaggguagguagagagagguuaagucgaauggcaaucucaggcgacgacuguguaguaaaaccucuggaugauagauuugcuaaugcacuuacggccuuaaacgacaugggaaagaucagaaaggacauccaacagugggagccuaguaaaggauggaaugauuggacacaagucccauucuguucccaucauuuucaugagcuaaucaugaaagacgguagaguacucguaguacccugucgcaaccaagaugaauuaauagguagagccaggaucucccaaggcgcgggcugguccuugcgagagacagcauguuuaggaaaaucuuacgcacaaauguggucucuuauguacuuccacagaagagaccuacgucuugcagcgaacgcuauuugcucagcugucccgagucacuggguaccgacaucuagaacuacauggucgauacacgcuaaacacgaguggaugacaacagaagauaugcuuacgguauggaacagaguuuggauaagagaaaauccauggauggaagauaaaacgccggucgaaucgugggaagagauuccuuaccuaggaaagagagaggaucaauggugcggcucauuaauaggacuuacaagucgugccacaugggccaaaaauauucaagcugcgaucaaccaaguccgaucgcuaauugggauagaagaauacacggacuacaugccaaguaugaaaagauuucgaagagaagaagaggaggcgggaguacugugguag

SEQ ID NO: 22699 - RNA, 9876 nt, Artificial Sequence
  derived and/or modified CDS sequence (opt6) from DENV-2__FJ562098__SS-prME
ucagcagggaugauuauaauguuaauaccuaccgucauggcauuccacuuaacuaccagaaauggagagccacauaugauaguuggaauccaggagaaagggaaaucauuacuuuucaaaacugaggacggaguuaauauguguacgcucauggcuauggaucuuggcgaacuaugugaagauacaauuacauauaaauguccacuguuaaggcaaaacgaaccagaagauauugauugcuggugcaauagcacaaguacauggguaacauauggcacauguacuacaaccggagagcaccggagggaaaaaagaagcguugcacucguuccacacguggguaugggucucgaaacgaggacagagacuuggauguccagcgagggcgcuuggaaacacgcccaaaggauugagacuuggauacuucgacauccaggguucacaaucauggcggcgauauuagcguauacuauugguaccacccacuuucaaaggguucuaauauuuauacuacuuacggccguagccccuagcaugaccaugcgguguaucgguauuagcaauagagacuucguugaggguguuaguggugggagcuggguugauauagugcucgaacacggaucauguguuacgacaauggcgaaaaauaaaccgacucuagacuuugaacugauuaagaccgaagcuaagcagcccgcaacucuacguaaauauugcauagaagcgaaacucacgaauacaacaacugaaagcagauguccgacucaaggagaacccucccuaaaagaagaacaagacaaacgcuuuguaugcaagcauuccaugguggacagaggaugggggaauggguguggucuauuuggaaagggagguaucguaacaugugccauguuuacuuguaaaaaaaauauggaaggaaaaauagugcaaccggaaaacuuagaauauacuauuguaguaacuccacacucaggagaagagcacgcaguaggaaacgauacgggaaaacacggaaaggagaucaaaguuacaccccaaagcucaaucacugaagccgaauuaacuggauauggaacaguaacgauggaauguagcccuagaacgggccuugacuucaaugagaugguguuauuacaaauggaaaauaaagcuugguugguacaucggcaaugguucuuagaucuaccccucccguggcuuccaggagcugauaaacaagaauccaauuggauucaaaaagaaacuuuaguaacauucaaaaacccccacgccaagaaacaggauguuguaguucuagggucacaagagggugcaaugcauaccgcacuaacgggagcuacagaaauacaaaugucaucugguaacuuacuauucacuggacaucugaaaugucggcuaagaauggauaaacuacaacugaaggggaugucguacucgauguguacggguaaauucaagguuguuaaagaaauugcugaaacacaacaugguacuauugucauuagagugcaguaugaaggagacggaucgccuuguaaaauuccuuuugaaauuauggauuuagaaaagcgguacguguugggccguuugaucacaguuaaccccaucgcuacagaaaaggacaguccgguaaacauugaagcggaaccucccuuuggugacucguauauaauaauagguguugaaccgggucaacucaaauuaaauugguucaaaaaaggcucuucgauaggacagauguucgaaaccacaaugcgaggagccaaaaggauggcaauuuugggagacacugcaugggacuucggcucucuagggggugucuuuacaucuaucggcaaagcacuacaccaaguauuuggcgcgauuuacggagcggcuuuuaguggaguuucguggacuaugaaaauacuaauaggaguaauaaucacuuggauuggaaugaacagucgaagcacauccuuaagcguuaguuuagugcuuguggggauagucacucuauauuuaggcguaaugguacaagcggacaguggcugcguaguauccuggaaaaauaaagaacugaaguguggaucaggaaucuuuauuacagauaacguucauacauggacagaacaauacaaauuucaaccugagucaccaagcaaauuggcaucugcaauccaaaaagcacaggaagagggaauuugugggauacguagugucacgcggcuagaaaaucuaauguggaaacagauaacuccagaauuaaaucauauacuugcugaaaaugaaguaaaauugacuauaaugacaggugauaucaagggaauuaugcaggcaggaaagagaucucuacgaccacagccaauagagcuuaaauauagcuggaagacguggggaaaggcgaaaaugcucaguacagaaucacauaaucaaacuuuucugauagacgggcccgaaaccgcagaguguccaaacacaaaccgugcauggaacucacuugagguagaagacuacgguuucgguguauucacuaccaauaucuggcuccgauuaaaggaaaaacaagaugcuuuuugugacucgaaguugaugagcgccgcaaucaaggacaacagggcgguacaugcugauaugggauauuggaucgaaagcgcacucaaugacaccuggaaaauugaaaaagcuaguuuuauagaaguaaagaauugucacuggcccaaaucccauacucucuggagcaaugguguuuuagaaagugaaauggugauacccaaaaauuuagcaggcccaguuagucaacacaacuauaggccaggauaccauacucaaauagcugguccuuggcaucuuggaaaacuagagauggauuuugacuucugcgacgguacuacaguaauuguaacagaagauugcggaaaucgaggacccucccuuagaacaacaacagcuagcgguaaacuaauuacugaauggugcugcagaaguugcacauuaccuccauuaagauacaggggcgaggaugguugcugguauggaauggaaauuaggccgcucaaagagaaggaagaaaacuuaguaaacucucuaguaacggccggucauggccaaguugacaauuuuagucuaggcguuuuagggauggcgcuauuucuugaggagaugcucagaacucgcguugguacuaagcaugcaauuuugcuagucgcuguaaguuuuguuacccucauaaccggcaauaugucguuuaaagaucuugggagaguaguaguaauggugggugccaccauggcggacgauauuggcaugggaguaacauauuuggccuuacuagcagcauucaagguaagacccacuuuugccgcaggcuuguuauuacguaaauuaacaaguaaggaauuaaugaugacgacgauaggaaucguacuccuaucucaaucgaccauucccgaaacaguuuuagagcucacugaugcauuggcauuaggaaugauggugcugaaaauagugagaaauauggaaaaauaucaauuagcagucacaauaauggcaauauuauguguuccuaacgcuguaauccuccaaaaugcauggaagguaucaugcacaauuuuagcaguaguuagugucucaccuuuauuacugaccucaucacaacaaaaaacugacuggauaccacuugcauuaacaauuaaaggauuaaaucccacagcuaucuuucuaaccacacucuccagaacuaauaagaaaagaucuuggccacugaacgaggcaaucauggcugucgguaugguaaguauuuuagcuucuaguuugcuaaaaaaugauauaccuaugacuggaccauuaguagcaggaggccugcuuacuguauguuacguucuuacuggucggucagcugaucuagaauuagaacgcgcuaccgauguuaaaugggaagaccaagccgaaauuagugguucaaguccaauccuaucgauuacuauaucugaagaugguaguaugucaauaaagaaugaagaagaagaacaaacacuaacaauacucaucaggacuggacugcuaguuauaaguggccuauuuccaaucucuauaccuauaacagcggcugcaugguacuuaugggaaguaaaaaaacaaagagccggaguccucugggacguacccaguccuccaccuauggggaaagccgaauuagaagauggugccuauagaauaaaacaaaaaggcaucuuaggauacucccaaauuggagcaggaguuuauaaggaaggaacauuccacacaauguggcacguaacgcguggagcagugcuaaugcacaaagguaaaagaauagagccaucuugggcugauguaaaaaaagaccuaauuaguuaugguggaggguggaaauuagaaggagaauggaaagagggugaagaaguucagguacuugcuuuagaaccuggaaagaauccucgugcaguacagaccaaaccaggacuuuucaaaacgaauaccgguacaaucggugcgguaucauuagacuuuucccccggcacaucaggauccccaauaauagauaagaaaggaaaaguaguaggauuauacgggaaugggguugugacgcgauccggagcauacguuucugcgaucgcacaaacugaaaagagcauagaagacaauccugaaauagaagaugauauuuucagaaagaggcguuugacaauaauggacuuacaccccggagccggaaaaacaaaaagguaccucccagcgauuguacgugaggcuauuaaaagaggacuaaggacguuaaucuuagcaccaacuaggguuguggcagcugaaauggaggaagcacuuagaggguuaccuaucagauaccaaacuccagcaaucagagcugaacacacgggaagagaaauuguagauuuaaugugccaugcuacuuuuacaaugcgacuuuuguccccgguaaggguuccuaauuauaaucuuauuaucauggacgaagcucacuuuaccgauccugcaucgauagcagcuagaggguacaucucgacaaggguugaaaugggagaagcagcggggauauucaugaccgcaacaccaccugggucacgagauccuuucccacaaaguaaugccccaauaauugacgaggaaagagaaauuccagaaagaucauggaacucuggccaugaaugggugacugauuucaaaggaaagacuguuugguucguuccuucaauaaaagcaggaaaugauauagcagcuugccuucgaaaaaaugguaaaaaagucauacaacuaucccgaaagaccuucgacuccgaguauguaaagacacgaacaaaugauugggauuuugucguuacaacggauauaucagaaaugggggcgaacuuuaaagcugaacgcgucauagacccucgucguugcaugaagccaguaauacuuacugauggagaagaaaggguuauauuagcaggaccaaugccuguuacucauucgucagcagcacaaaggcgaggcaggauaggacgcaacccuaagaaugaaaacgaucaauauauuuauaugggagaaccucuggaaaaugacgaagauugugcacacuggaaggaggcaaaaaugcucuuagauaacauuaauacaccagagggaaucauuccaaguauguuugaaccagaaagagagaagguagacgccauagacggggaauauagacuuaggggggaagcaagaaagacauucguagacuuaaugagaagaggugaucucccaguauggcuggcauauaaaguagccgcugaggguauaaauuacgcggaccggagaugguguuucgacgggaucaaaaauaaccaaauacuggaagaaaauguugaaguggaaauauggaccaaagagggagaaagaaaaaaauuaaaaccgcgaugguuagaugcgcgcauauauucagacccuuuagcguuaaaggaauucaaagaauuugccgcggggcgaaaaucauuaacacuaaaucucaucaccgagauggggagguuacccacuuucaugacacaaaaaacccgugaugcccuagauaauuuggcgguucugcauacugcagaagcaggaggaagagcuuacaaucaugcauuaucagaguuacccgaaacacuagaaacuuuacuuuugcugacguuauuagcaacagugacggguggaaucuuuuuguuucuaaugucagguagagggauaggaaaaaugacuuuggggaugugcugcauaauuacugccuccauacugcucugguaugcucagauucaaccgcauuggauugcggccagcauuauacuagaguucuuucuaauaguuuuacuaaucccugagcccgaaaagcaaagaacaccccaagauaaccaauuaacauauguagugauagccauauugaccguaguugcggcgacuauggccaaugagaugggcuucuuagaaaagacaaaaaaagaucuaggacugggaaguauagcaacacaacaaccagaauccaauauacucgauaucgaucuccgcccggccucagcauggacgcuguaugcaguagcaacuacauucguaacaccgaugcuuagacacaguauagaaaauucaucagucaacguaucguugacagccaucgcgaaucaggcgacaguucuaaugggcuuaggcaaaggauggccccucucuaaaauggacaucggcgugcccuugcuagccauaggcuguuauucacaaguaaaucccaucacacuaaccgcagcuuugcuuuuacuuguugcccauuacgcgauaauagguccuggacuacaggcgaaggcaacccgggaagcccagaaacgcgcugccgcggguauaaugaagaauccaacgguagauggaaucacuguaauugacuuagauccuauaccauacgaucccaaguucgagaaacaacucggacaaguaauguuacuaauauuaugugucacucagguacuaaugaugaggacaacaugggcucugugugaagcacucacuuuagccacaggaccgauaagcacacugugggaagggaauccaggacguuuuuggaauacaacaaucgccguaucaauggccaacauauuuagaggaaguuaucuagcgggagcagggcuacuauucucaauaaugaaaaacaccacgaauacacguagaggaacaggcaauaugggugagacacugggagaaaaauggaaaucacgauuaaacgcguuaggaaaaagugaauuucagauuuacaaaaaaucaggcauacaagaagucgaccggacguuagcgaaagaggggaucaagagaggggagacagaccaccaugcaguuaguaggggaagcgcgaaacuaaggugguucguugagagaaacauggucaccccggaaggaaagguuguagaccuggguugugggagaggagguuggucguacuauugcggaggacugaaaaacgucagagaagucaaaggccuaacuaaaggcgguccuggucaugaagaacccauacccaugagcacuuauggauggaacuuaguaagacuacaaagcggcguugacgucuucuuuauuccaccugaaaaaugcgauacuuuauugugcgacauaggagaauccucuccaaauccuaccguugaggcaggacgcacgcuuagaguauuaaaucucguggaaaauugguuaaacaacaauacacaauuuugcaucaaagucuuaaauccauauaugccgaguguaauugaaaaaauggaagcacuucaaagaaaauauggaggcgcgcuuguccguaauccccuaucaagaaacaguacacaugaaauguauuggguaucgaacgcuagcggaaauauaguaucuuccgucaacaugaucagucgcauguuaauuaauagguuuaccaugaggcauaagaaagcgaccuaugaaccugauguagaucuaggaucaggaacaagaaacauagguauagaaucagagauuccgaaccucgacaucaucggcaaacgaauugaaaagauaaaacaagaacacgagaccagcuggcauuacgaucaagaucacccauacaagaccugggcauaucacgguaguuaugaaacaaagcagacuggaucagccucaagcauggugaacggagugguaagacugcuaaccaaaccuugggauguacuaccaacaguuacacaaauggcuaugacugacacaacucccuuugggcaacagcgcgucuuuaaagaaaaagucgauacaaggacccaggaaccuaaagaaggaacaaaaaagcugaugaaaauuacggcggaguggcuauggaaagaauuaggcaaaaaaaaaaccccucguaugugcacaagggaagaauucacccgaaagguuagaucuaaugcggcuuuaggugcuauauuuacagacgaaaauaaauggaagucggcacgggaagcaguagaagacagucgcuuuugggaacucgucgauaaagaaagaaaccuucaucuugaaggcaagugugaaacaugugucuauaacaugaugggaaaacgcgaaaaaaaacugggcgaauuugguaaagcaaagggguccagagccaucugguauauguggcuaggcgcaagauuuuuagaauuugaagcuuuaggauuuuuaaacgaggaucacugguuuucaagggagaacagccuaucaggaguggagggggagggauuacacaaacucggcuacaucuuaagagauguuagcaaaaaagaagguggcgcaauguaugcggacgauacagcgggaugggacacuaggaucacacuagaggaucuaaaaaaugaggaaaugguaacuaaucauauggaaggagaacauaaaaagcuugcagaggcaaucuucaaauuaacuuaccaaaauaaagugguaagaguacagcgaccuacuccccgcgguacuguaauggauauuauaucgaggagggaucaacgugguucaggacaagucggaacguaugggcuaaauacauuuacuaauauggaggcucaacuuauuaggcaaauggaaggggagggaguauucaaaaauauacaacaucuuacgguuacggaggaaguagcaguucagaacuggcucgcgagagucggaagagagagauugaguaggauggcuauuagcggugacgauugcguuguaaaaccuuuagacgaucguuucgcgaaugcguuaacagcauuaaaugauaugggaaaaauacgaaaagauauacaacagugggagccuucaaaggguuggaacgauuggacacaagucccguuuugcucccaucauuuucaugaauuaaucaugaaagacggcagagugcuaguuguaccaugucgaaaccaagaugaacuaaucgguagagcaaggauuagccaaggugcgggguggagcuuaagagaaacggcaugucuugggaagaguuaugcucaaauguggagucuaauguauuuccaccgcagggaucuccgcuuagcagccaacgcgaucugcucagcaguuccgucgcauuggguuccgacuuccagaacuacuuggucuauacacgcaaaacaugaguggaugacaacagaagacauguugacagucuggaaccgaguauggaucagagaaaauccauggauggaggacaaaacuccuguagagaguugggaagaaaucccauacuugggcaaaagagaggaccaauggugcgggagccuaauuggauugacuagucgagccacaugggcaaaaaauauacaggcagcaauuaaucaagucaggucuuugauagguaaugaagaguauacugauuacaugccuagcaugaagcguuuuagacgagaagaagaagaagccggaguuuuaugguag

SEQ ID NO: 22700 - RNA, 9876 nt, Artificial Sequence
  derived and/or modified CDS sequence (opt6) from DENV-2__FJ859028__SS-prME
agcgcggguaugauuauuauguuaaucccaacuguaauggcuuuucauuugacaacaagaaauggugaaccacauaugauaguugguauucaagaaaaaggaaaaaguuugcuuuucaaaacggaagacggcguaaacauguguacauugauggcaauggaccuuggugaauugugugaagauacuauaacguauaaaugcccucuacuacgucaaaacgaaccagaagacauagacuguugguguaauucaacaucuaccuggguaacauacgguacauguacuacuaccggagaacacagaagggaaaaacgaagcguagcuuuaguuccucauguggggauggguuuagaaacccgcacagagacuuggaugagcucugaaggugcauggaaacacgcucaacgcauagaaaccuggauacuuaggcauccaggguucacgauuauggcagcaauuuuggcguacacgauagguacgacacacuuccaacgugugcucauauuuauccuacugacugcaguagccccgucgaugacuaugagauguauagguaucuccaaucgcgauuuuguagaggguguuaguggaggaucauggguagacauuguacuagaacacgggucuuguguaacaacaauggcgaaaaauaaacccacccuagacuuugaauuaauaaaaacagaagcuaaacaacccgcaaccuuacguaaauauugcaucgaggcaaaauuaacaaauacuacaacagaaucuagaugccccacucaaggagaaccgucauuaaaagaggagcaagauaaaagguuuguaugcaaacauucaaugguugaucgagguugggggaauggcuguggucuuuuugguaaagggggaauuguaaccugcgcaauguucacuugcaagaaaaauauggaaggaaaaauuguucaaccagagaaucuagaguacacgauaguagucacuccucacucgggagaggagcacgcaguuggaaaugauacagguaaacauggacaagaaauuaaaguaacgccucaauccucuaucacugaagcugaacugacaggauaugguacagucacaauggaaugcuccccacgaacaggcuuggauuucaacgagauggucuuacuacaaauggaaaacaaagccugguuaguacauagacaaugguuucuagacuuaccuuuacccuggcuacccggagcugacaaacaagaaucgaauuggauucaaaaagagacauugguaaccuuuaaaaauccacaugccaaaaagcaagauguuguuguacucggcucacaagaaggagcaaugcacacugcacucacaggcgcuaccgaaauccaaaugucgagcgguaaccuucucuucaccggacauuugaaguguagacuacgaauggacaaguugcaauuaaaagguaugaguuauagcaugugcacgggaaaauuuaagguggugaaagaaaucgcagaaacgcaacauggcacaauuguuauuaggguacaauaugagggagauggcucaccauguaaaauaccauuugagauaauggauuuggagaaaagguacgugcucggacgauuaauuaccguaaaucccauuguuacggagaaagacucgccuguaaacauagaggccgaacccccauucggagauagcuauauaauuauaggcguagaacccggacaacuaaagcugaauugguuuaagaaagguaguucaauuggacagauguucgaaacaacaaugagaggagcuaaacggauggcaauauuaggagacacugcaugggacuuugguucauugggaggaguuuucaccucaaucgggaaagcguuacaucaagucuuuggggcaaucuauggugcugcauuuucgggugucagcuggacuaugaaaauauugauuggagugauaauuacuuggauaggaaugaacucccguucuacaagucuaucgguaagucuagucuuggucggaauagucacacuauauuuaggagucaugguacaggcagauagcggguguguuguaucuuggaagaacaaagaauugaaaugcggcagcgggauuuuuauuacagacaacguacacacauggaccgagcaguacaaauuccaacccgagagucccaguaaauuagcgagugcuauccagaaggcucaagaggaagguauuugcgguaucagaaguguaacccgacuagaaaaccucauguggaagcaaaucacaccagaacuaaaccauauacuugcagagaaugaaguaaaacucacgaucaugacuggagauauaaaagguauaaugcaagcgggaaaaaggucacuucgaccacaacccaccgaguuaaaauauagcuggaagacauggggaaaagcaaagauguuaaguacagagucauacaaucaaacauucuuaaucgacggucccgagacugcagaauguccaaacacaaacagagcauggaacucucuggaaguggaagauuauggauuugggguauuuacaacaaacaucuggcucaaacugaaggagaaacaagaugcuuucugugauucaaaacuaaugucagcggcaauuaaaaauaauagagcaguacacgcagauaugggguauuggauagagagugcacuaaaugacacauggaaaauagagaaggcuucauuuauagaagugaaaaauugucacuggccuaaaucacacacgcuauggucaaacggaguccuagagucagaaaugauaauacccaaaaauuuagcaggcccgguuucgcaacacaauuaccggccgggauaccauacucaaauagcuggacccuggcaccuuggaaaauuggagauggauuucgauuuuugcgacgggaccacugugguuguaacggaagauugcgguaaucguggcccaucauugcgaacaaccacagcuucgggaaaauugaucacugaauggugcuguaggucaugcacccuaccgccacuuagguaccguggagaagacggauguugguauggaauggaaauccgcccuuuaaaagaaaaggaagagaauuuaguaaauucauugguaacagcaggccacggacaaguggauaacuuuucauugggagucuuaggaauggcuuuauuucuagaagagauguuacgcacgaggguggggaccaagcacgcuauucuauuagucgccguaucauucguaacccuuauuacagguaacaugucguuuaaagaccuuggcaggguaguugucaugguuggcgcuacaauggccgacgacauugguauggguguaaccuaucuggcccuguuagcggcuuuuaaagugcgaccaacauuugcagccggucuauuacuucguaaauuaaccucaaaagaauuaaugaugacuacuauugguauaguacuccuaucccaaaguacuauaccugaaacaguauuagaacugacugacgcuuuagccuugggaaugauggucuuaaaaauuguucgaaauauggaaaaguaccaauuagcuguuacaauuauggcaauccucugcgugccaaacgcaguaauacugcaaaaugcauggaaagucucuugcacaaucuuagcaguugugagcguaagcccacuucuauugacaucaucgcaacagaaaacagauuggaucccacuggcauugacaauuaaaggccuaaacccaacggcaauauuuuuaacuacacuuuccaggaccaauaagaaaaggucguggccuuugaacgaagcuauuauggcaguaggaaugguguccauacuagcgagcucgcuacuaaagaaugacauaccaaugaccgguccgcuaguggccggcggauuacuuacggucugcuauguacuaacuggaagguccgcagaucuagaacuugaaagagcaaccgacguaaaaugggaagaccaggcagaaauuaguggaaguagcccuauauuaucaauuacaaucucagaagaugggucaaugagcaucaagaacgaggaagaggagcaaacauuaacgauauuaauaaggaccggacuucuagucauaucaggacuauuccccauaagcaucccaauaacggcugcggcuugguauuuaugggaagugaaaaagcagagagcuggggucuuaugggaugucccaagcccaccaccuaugggaaaagccgaacuagaggacggagcguauagaauaaaacaaaaagguauauuaggauauucacaaauaggggccgggguauauaaggaagggacguuccauacgauguggcauguaacuaggggugccgugcuaaugcacaaaggaaaaaggauugaaccaagcugggccgauguuaagaaagaccuaauuucuuauggcggaggguggaagcuagaaggagaguggaaagaaggugaagagguucagguauuagcucuagaaccagguaaaaacccacgagcagugcaaacgaaaccaggauuauuuaaaacaaacacugggacgaucggcgcuguuucauuagacuuuucacccggaacaaguggaagcccaaucauugauaagaaaggaaaaguugucggucucuauggaaauggagucguaacaagaucaggagccuacgucucagcgauagcucaaacugagaaaaguauagaggacaacccagagauagaagaugauauauuuaggaaaaggcguuugacuauaauggacuuacauccgggugcagggaaaacaaaaagauaccuaccugcuauagugagagaagcuauuaaacgagguuuacgaaccuuaauccuggccccuacaagaguuguggcagcagaaauggaagaggcauuaagagggcugccuauucguuaucaaacacccgcaauaagagcugagcacacuggacgggaaauuguagauuugaugugucaugccacauuuacaaugagacuucuaucaccuguaagggugcccaacuacaaucuaauuauuauggaugaagcacacuucacggaucccgccuccauugccgcucguggcuacauuaguacucgaguagagaugggugaagccgcaggcauuuuuaugaccgcuacgccaccaggaucacgugacccuuucccucaaucuaacgcgccuauaaucgacgaagaaagagaaauaccggaaagaaguuggaacucaggacacgaauggguaacagauuucaagggaaagacuguaugguuuguaccuuccauaaaagccgggaacgauauugcugcuugccuaaggaaaaauggaaagaaaguuauacaguuaucaagaaaaacauucgacagcgaauacguaaaaacaagaacuaaugacugggauuucguaguaacuacagauauaucagaaaugggcgcaaauuuuaaagccgaaagaguaauugauccucgcagauguaugaaaccaguuauuuugacugauggagaagaacgagugauccuagcaggcccaaugccuguaacucacucuagugcggcccaaaggcguggacguauaggaagaaauccuaaaaaugaaaacgaucaguauauauacaugggcgaaccauuggaaaaugacgaagacugugcacauuggaaggaagcaaagaugcucuuagacaauauaaauacaccugaaggaauaauaccgaguauguucgagccggaaagggaaaaaguggaugcgaucgauggggaauaccgauuaaggggagaagcucgaaaaacauuuguugaccuaaugcgccgaggagaucugccaguuugguuagcuuacaaagucgcagcagaaggaauaaacuaugcagacagaagguggugcuuugauggaaucaagaacaaccaaauacuggaagaaaacguggagguagaaauauggacuaaagaaggagaacgaaagaaacuuaaaccuagauggcuagacgcaagaauauacucugauccauuggcacuaaaggaauuuaaagaguuugcagcaggcaggaaaucauuaacacugaacuuaauaaccgagaugggucgauuaccuaccuuuaugacacagaaaacgcgagacgcacuagacaaccuggcaguauuacauacagcggaggcagggggacgggccuauaaccaugcguuaucagaguuaccugaaacccucgagacacuacuuuuacucacauuacuugccacagugacuggcgguauauucuuauucuuaaugucaggaagagguauuggaaaaaugacucuugggauguguuguauaaucacagcaucaauauuauuaugguaugcacaaauccaaccgcauuggauugcagcaucuauaauuuuagaguucuuuuuaauaguacuacuuauaccagaacccgagaaacagcggacuccccaagauaaucaauuaacuuacguuguaauugcaauauugacuguaguagcggcuacgauggccaaugaaaugggauuuuuagaaaagacuaagaaagaucugggacucggaucuauagcuacacaacaaccugaaaguaauauauuagauaucgacuuaagaccagcaagcgcuuggacacuuuaugcuguagcuacaacauuuguaacaccuaugcugcggcacucaauagaaaauucaaguguuaauguuaguuuaaccgcaauagccaaucaagcgaccguacuaaugggacuggguaaaggauggccccuauccaaaauggacauuggcgucccacuucuggcuauuggaugcuauucacaaguuaauccgauaacuuuaacagcagcauuguuauugcuaguggcucauuacgcgauuauuggcccaggcuugcaggcuaaggcuacuagagaggcccagaaaagggcugcggcggguauaaugaaaaauccaaccguagacggaaucacaguaauagaccucgauccgauacccuaugaccccaaauuugagaaacaguuaggacaagugaugcucuuaauccugugcgucacacaaguucuaaugaugaggaccacaugggcguuaugcgaagcacucacacuugcaacugggccaauaagcacauuaugggaaggaaacccuggacgcuuuuggaauacaacaauugcaguaucaauggcaaacaucuuucgugguucauaccucgcuggugcagggcuuuuauuuucuauaaugaaaaacacaacaaacacucgaaggggaacugggaauaugggagaaacacucggggaaaaauggaagucucggcucaaugcucucggaaaaagcgaauuucaaauauauaagaaaaguggaauacaagaaguagaccgcacauuggccaaagaaggaauuaagagaggcgaaacugaccaccaugcuguaucaaggggaucugccaaauugcgaugguuuguugaaagaaacaugguuacuccggaaggcaaaguaguggaucuagguugugguagagguggcugguccuauuauugcggcgggcucaaaaauguucgugagguuaaaggacucacaaaaggaggucccggccaugaagaacccauuccaaugucaacguauggauggaauuuaguccgccuccaaagcgguguggauguauuuuucauuccgccagaaaagugugacacacuuuuaugcgauauaggagaaucaucaccgaacccaaccguagaagcaggaagaacccuuagagucuugaaucuuguugagaauuggcugaacaacaacacucaauucugcauaaaaguacuuaauccauacaugcccuccguaauagagaaaauggaagcauuacagcggaaauacggaggggcacugguacguaauccucuaucgcgaaacucaacgcaugaaauguauugggugucaaaugcuuccggcaauauaguaagcucuguuaauaugauaucucgaauguugauaaacagauucaccaugagacauaagaaagcuaccuacgaaccagauguugaccucggcucagggacuagaaacauuggaauagagagugaaauuccuaacuuggacauaauuggaaaaagaauagagaaaauaaaacaggaacacgaaacgucauggcauuacgaucaggaccacccuuauaagacgugggcauaccauggaucguaugagacaaaacaaacaggaucagcauccucaaugguaaauggaguuguccgacuacuuacaaaaccuugggaugucuuaccuacgguuacacaaauggcuaugacggacacaaccccuuucggacaacagcguguuuuuaaggagaaaguagacacaagaacucaggaaccaaaagaaggcaccaagaaauugaugaaaauaacagcagaaugguuguggaaagagcuaggaaagaagaaaacgccacguauguguacacgggaagaauuuacaaggaaaguccgaucuaaugcagcguuaggcgcaauuuuuaccgaugagaauaaguggaaaagugcacgggaagcuguugaagauucacgguucugggagcucgucgauaaagaaagaaacuugcaucucgaagggaaaugugaaacauguguguauaacaugauggguaagcgagagaagaaacuaggugaguucggaaaagccaaagguucucgugccauaugguauauguggcucggugcacgauuucuugaguuugaggcauugggauuccuaaacgaggaccauugguucaguagagaaaauagucuuucaggcguugaaggugagggucuacacaaacucgguuacauucuccgagacguaagcaagaaggaagguggugcuauguacgcagaugacacagccgggugggacacacguauuacauuggaagaccuuaagaaugaggaaauggucaccaaccacauggaaggcgaacauaagaaacuagccgaggcaauauucaaauuaacguaucagaauaaaguuguuagaguacagcgcccuacaccgaggggaacuguaauggacauaaucagucgccgcgaccaacguggaucagggcagguaggaacuuaugggcugaacacauuuacgaacauggaggcacaacucauaagacaaauggagggagagggaguguuuaaaaauauacaacaccuaaccgucacugaagagguggccguucaaaauuggcuugcacguguuggaagagaaagguuaucccgcauggcaaucucgggagaugauuguguagucaaaccacuugaugacagauuugccaaugcccucacagcucuuaaugacauggggaaaauccguaaagacauccaacagugggaaccgucaaaagguuggaacgacuggacucaggugcccuucugcucucaccauuuucaugaauuaauuaugaaagauggacgaguacuuguugucccaugucguaaucaagacgagcuaauuggccgcgcucgcaucagucagggugcaggauggucacuuagagaaacugcgugcuuaggcaaaucguacgcgcaaauguggucucugauguacuuucaccgacgagacuugcguuuggccgccaacgcaauuugcucugcaguacccagucacuggguucccacgucuagaacaaccuggucgauccaugcuaaacaugaauggaugacaacggaagacauguuaaccguauggaaucgaguauggauuagagaaaaucccuggauggaagacaaaacgcccguugaaucuugggaagaaaucccauaccuuggaaaaagagaggaccaauggugugguagucuaauuggacuuacuucaagggcaacaugggccaaaaauauacaaguugcgauaaaccaaguaagaaguuuaauaggaaacgaggaguacacugauuacaugccaucaaugaaaagguucagacgagaagaagaagaagccgguguucuaugguaa

SEQ ID NO: 22701 - RNA, 9876 nt, Artificial Sequence
  derived and/or modified CDS sequence (opt6) from DENV-2__FJ410200__SS-prME
ucagccggcaugauuauuaugcucaucccuacgguaauggccuuucacuuaacgacaagaaauggagaaccgcauaugauaguagguauccaagagaaggguaaaagucuauuauuuaagacagaggauggagucaauauguguacgcuuauggcuauggaucuaggagagcuuugugaagauacgauuacuuauaaaugcccauuacugagacaaaacgagccagaggacauagauugcugguguaauucuaccaguacauggguaaccuaugguacauguacaacuacuggugaacacagaagggaaaagagaucaguggcgcuggugccacaugucggaaugggguuggaaacaagaacggaaacauggaugucaucagaaggugcuuggaaacaugcacaacgcaucgaaaccuggauucuccgacauccuggauuuaccauaauggcagcuauauuagcauauacaauaggaacaacacacuuccagaggguacucaucuucaucuuacuaacagcaguagcuccaucgaugacaaugagauguauagguaucaguaauagggauuucgucgaagggguuucagggggcucauggguagacauuguuuuagagcauggaaguugcguaacaacaauggcaaaaaauaaaccgacguuagacuucgaacuaauaaaaaccgaagcgaagcaaccagcuacucugcggaaauauuguauagaagcaaaacucaccaauacaacaacagagagucguugccccacacaaggagaaccuucguugaaagaagaacaagauaaacgguuugucuguaaacauucaaugguugaucgaggcugggguaacggaugcggauuauucggcaaaggugggaucguaacaugcgccauguuuacuugcaaaaaaaauauggaagggaaaauagugcaaccugaaaacuuggaguauacaaucguaguuacgccucacucuggugaggaacacgcgguugguaacgauaccgggaaacaugggcaagaaauaaaaguaacaccucaaaguaguauuacggaagcagaauuaacggguuauggaacaguaacaauggagugcucaccaagaacuggcuuggauuucaacgaaaugguauuacuacagauggaaaauaaggcauggcuuguacaucgacaaugguucuuagaccucccccuaccuugguugccgggagcagauaaacaggagaguaauuggauucaaaaagagacauugguuacauucaaaaauccucaugcuaagaaacaggauguagugguauuagguagucaagaaggagcaaugcacacugcucuuacuggagcaacugagauacaaaugucgucggguaaccuauuauucacuggacaucucaaauguagauuaagaauggacaaauuacaacugaaagguaugucauacucaauguguacgggaaaguuuaagguuguuaaggaaauagcggagacgcaacacgguaccauagugauaagaguccaauaugagggagaugguucaccauguaagauaccauuugagauuauggaccuugaaaaaagauauguacucggaagacucauuacaguaaacccuauugugacugaaaaagacucaccuguaaauauagaagcagagccgccauuuggagauaguuauaucauaauaggaguugagcccggucagcuaaaauuaaacugguuuaaaaaaggcaguucuaucggacaaauguucgaaacaacaaugagaggugcaaaacgaauggccauacuuggugacacggcaugggauuucggaagccuugguggaguauuuacgucaaucgggaaggcauuacaucaagucuuuggugcaauuuacggggcagcguucucaggaguuaguuggacaaugaaaauauugauaggaguaauuauaacauggauagguaugaacucgagaaguacuucucuuuccguuagccucguacuuguugggauugugaccuuauacuugggagucaugguacaagccgacucaggauguguagugaguuggaaaaacaaagaacuaaaauguggaucgggaauauucauaacugacaauguucacacauggaccgaacaguacaaauuccaaccagagucacccucaaaacuggcgucagcaauccagaaagcucaagaagaggguauaugugguauucggucaguaacuagacuagaaaacuuaauguggaaacaaauaacgcccgaacuuaaccacauacuugcagagaacgaagucaaauuaacaauaaugaccggcgacaucaaggguaucaugcaagcggguaaaagaucccuacgaccgcagccuacugagcuuaaauauucauggaaaacaugggguaaggcgaaaaugcucagcacagaaaguuauaaccaaacauuuuugauugaugggccugaaacagccgaguguccuaacacuaauagggccuggaacucgcucgaaguugaagacuauggauuuggagucuuuacuacgaauauauggcuaaaauuaaaagagaagcaagacgcguuuugugauaguaaauuaaugagugcugcaaucaaggauaacagagccguccaugcggacaugggguacuggauugaaucggcauuaaaugauacauggaaaauagagaaagcgaguuuuaucgaaguuaaaaacugucacuggcccaaaucccacacucuuuggucuaauggaguauuggaaucagagaugauaauucccaaaaauuuggcagguccugucucccagcacaacuauagaccuggauaucauacucaaauagcugggcccuggcaucuaggaaagcuagaaauggacuucaacuuuugugacgguaccaccguaauaguaacagaagauugcgggaaucgcggcccgucauugaggacuacaaccgcaucugguaaacuuauaacggaaugguguuguagaaguugcacacuuccgccucuacgauacagaggagaggacgguuguugguacggaauggaaauacgaccucuaaaggaaaaggaagaaaaucucgugaauucccuaguuacugccggacaugggcaggucgauaacuuuucacuugguguucuaggaauggcccuuuuccuugaagagauguuacgaacacgagucggaaccaaacaugcaauacuauuaguugcuguuucauuugucacuuuaauaaccggaaauaugucauuuaaggaucuaggaagaguaguuguaaugguuggugccacgaugacugacgacauugguaugggugugacauauuuagcauuacuagcagcguucaagguucguccgaccuucgcggcggguuuguuacugagaaaauuaacaucuaaagaguugaugaugacaacuauaggaauaguacucuuaagucaaucaacaauaccugaaacagucuuggagcuuacggaugcauuggcauuaggaaugauggucuugaagauaguccguaauauggaaaaguaucaguuagccguuacaaucauggcuaucuuaugugugcccaacgcaguaauauuacagaaugcguggaaaguuaguugcacaaucuuagcugucgucucaguuucgccauuauuacuuacaucaucucagcagaaaacagauuggaucccccuagcucuaacaauaaaaggauuaaauccuacugcaauuuuucucacaacccugucaagaacuaacaagaagagaucauggccccuaaaugaggccaucauggcuguagggaugguuaguauccucgcaucuucauuacuuaagaaugauauacccaugaccggcccguuaguugcaggaggcuuauuaacagucuguuacguauuaaccggaagaucugcugaucuugaauuagagagggcgacugauguuaaaugggaggaccaagcagaaauaucgggcucuaguccuauccucaguauuacgauuucggaggauggaaguaugucaauuaaaaaugaagaagaagaacaaacucuuaccauucuaauaaggacggggcuccuaguaauaucaggccuguuuccgauuaguaucccuauuacggcugcugcuugguaccuaugggaaguaaaaaaacagagagcaggugucuuaugggauguucccaguccaccuccuauggguaaagcugaacuagaagauggggcauaucgcauuaaacagaaaggaauccuaggauauucacaaaucggggcaggcguauauaaagaagguacuuuccacacuauguggcacguuacaagaggggccguacuuaugcacaaaggaaagagaaucgaaccaaguugggcggaugugaagaaagaccuuauuucauacggcggaggauggaaacuagaaggcgaguggaaagaaggggaagaaguucaaguccuagcgcuagagccaggcaaaaacccacgagcaguucaaaccaagcccggucuauucaaaacaaauaccgguacuauaggagcgguaucuuuagacuuuucaccagguacgucugguucacccauuauugauaaaaagggcaaaguagugggucuguaugguaauggaguggucacacggucuggagcauacgugucggcuauagcgcagacugaaaagucuaucgaaaauaacccggaaauagaagaugauauauuccggaaaagaagauuaaccauuauggaucugcauccgggagcuggcaaaacgaaaagauaucucccggcaauuguaagagaagcgauuaaacgaggauuaagaacacuaauccuagcaccuacaagaguuguagccgcugaaauggaagaagcauuacgaggacuaccgauacgauaucaaacccccgcgaucagggcagaacacacagguagggaaaucguagaucucaugugucaugcaacauuuacaaugcgacuacuaucgccaguaagaguaccaaacuauaaucuuaucaucauggaugaagcucacuuuacugacccggcaucgauugcugcuagaggauacauaucuacucgaguagaaaugggcgaagcagcaggcauuuucaugacagcuacaccaccggggaguagagauccauuuccacaaucgaaugcuccaauuauagacgaagaacgagaaauacccgaacguagcuggaauucaggacaugaauggguaacugacuuuaaagguaaaacggugugguuugugccaucuauaaaggcuggaaaugauauugccgcaugucuaagaaaaaacgggaaaaaagugauccagcucucccgaaaaacauuugacucggaauauguuaagacaaggaccaacgauugggauuuuguagucaccacagacauaagcgaaaugggagcaaacuucaaagcggaaagaguuauagauccgagacguuguaugaaaccggucauuuuaacggauggagaagaaagaguaauuuuagcaggucccaugcccguuacgcauucaucagcagcccaacgcagggguagaauuggacgaaacccaaaaaaugaaaacgaccaauacauauauaugggagaaccucuagaaaaugacgaggacugcgcucacuggaaagaggcgaaaaugcuacuugacaacauaaauacaccugagggcauaauccccagcauguucgaaccagaaagggagaaaguugacgcaauugauggugaauaccgacuuaggggugaggcuagaaaaacguuugucgacuuaaugcgacggggugaucucccaguuuggcuagcuuauaaaguagcagcagaaggaaucaacuaugccgaucggcguugguguuuugauggcauaaaaaauaaccaaauucuugaggaaaacauggaaguagaaaucuggacaaaagaaggggaacggaaaaaacuaaagcccagauggcuugaugcacggauauacuccgauccauuggcauuaaaagaauucaaagaauuugcagcaggucgaaaguccuuaacauugaaucuaauuacagagauggguagauuaccaacguucaugacacaaaaaacaagagaugcccuugacaacuuagcaguacuccacaccgcagaagcaggagggagggcauacaaccacgcacuaagcgaauuaccagaaacucuugaaacuuuacuuuuacugacauuauuagccacagucacuggaggcauauucuuauuccuuaugucuggcaggggaauuggaaagaugacccuagggauguguugcaucauuacagcuucuauucucuugugguaugcgcaaauacagccacacuggauagcggcaucuauaauacuagaauucuuucuuauagucuugcuaauaccagaaccagagaagcagcgcacgccacaagacaaucaacugacguauguagugauugcgauacuaacggugguagcagcaacaauggcuaacgaaauggguuuuuuagaaaaaacgaaaaaagaccugggcuugggcaguauugcaacaagacaaccggaaucgaauaucuuagauauagacuuacggccggcgagugcauggacacuuuacgcaguagccacaacguuuguaacaccaauguuacgacauuccauagaaaacucaaguguaaauguuagucuaacagcaauagcaaaucaggcuacugugcugaugggacugggaaaagguuggccuuuaucaaaaauggacaucgguguaccucuacuggcaauaggauguuauagccaaguuaauccuaucacguuaacugccgccuuauugcuucugguagcccauuacgcuaucaucggacccggguuacaagccaaagcuaccagagaagcucaaaagagggcagccgcgggaauaaugaagaacccgacaguugacggaauaaccguuaucgaccuagaucccauaccuuacgauccaaaauucgaaaagcaacuaggucaaguuauguuacuagugcuauguguaacacagguacuuaugaugcgcacgacaugggcucuuugugaagcucuaacauuagccaccgguccgauaucgacauuaugggaaggaaauccugguagauuuuggaacacaaccauagccguaaguauggcaaauauuuuccgcgguucauauuuagccggugcaggacuacuauuuaguaucaugaaaaauacgacgaauaccagaaggggcacaggaaacaugggagaaacgcuuggcgaaaaauggaagucaagauuaaacgcccucggcaaaucugaguuucagaucuacaaaaaaucagguauucaagaaguagacagaacccuagcgaaagaaggaaucaaaagaggagaaacagaccaccacgccguuucccgaggaucggcuaaacuucgaugguuuguugaacgaaacaugguuacgcccgaaggcaaaguggucgaucuaggauguggccguggagguuggaguuacuauuguggaggucugaaaaacgugcgagaaguaaagggacuaaccaaaggcggucccggccaugaagagccuauuccaauguccacguacggcuggaaucucguaagacuacaaagcggggucgaugucuuuuucaucccuccagagaaaugugacacgcuguuaugugacauaggggaaagcagcccuaauccgacuguugaagcuggaaggacccugaggguacugaaucuagucgaaaauugguuaaauaacaacacacaguuuuguauuaaaguucuaaacccuuauaugccaagcguaauugaaaaaauggaggccuuacaaagaaaguacggcggcgcgcuuguaagaaacccauuaucaagaaacucaacccaugaaauguauuggguaagcaacgccuccgguaacaucguuucgucggugaacaugaucucuaggauguuaauuaauagauuuacuaugaggcacaaaaaagcuacauaugagccggauguagaucuaggaagcggaacucggaacauaggaauagagucagagauaccaaacuuagacauuauugguaaaaggauagaaaaaauuaaacaggaacaugagacuucauggcauuaugaccaggaucaccccuacaaaacaugggcauaucacgguagcuacgaaacuaaacaaacuggcucagcuucaucaaugguaaauggugucgugcgacuauuaacuaaaccaugggacguucuaccaacuguuacacaaauggcaaugaccgauacgaccccauucgggcaacaaagaguguuuaaggaaaaaguagauacccgaacccaagaacccaaagaagggacgaaaaaauuaaugaaaaucacugcagaauggcuauggaaggaacuagggaaaaaaaaaacuccuagaagauguacaagagaagaguuuacaagaaaaguacguaguaacgccgcuuugggagcaauauuuacagaugaaaauaaauggaaaagugcuagagaagcaguagaggacagccgcuuuugggaauuaguggauaaagaaagaaauuugcauuuagaagguaaaugugaaacaugcgucuauaauaugaugggcaaacgggaaaaaaaauuaggggaauuuggcaaagcaaaagguagcagagcaauaugguauaugugguuaggugcgcgcuuucuagaauuugaagcguugggauuucucaaugaggaccacugguucucgagagaaaauucucuaucaggaguagaaggggaggguuuacacaaguuaggauauauuuugcgugauguuucaaaaaaagaaggaggagcaauguaugcugaugacacagccggaugggauacccguauaacacuugaagauuuaaaaaacgaagaaaugguaacaaaucauauggaaggcgaacacaaaaaguuagcggaagcaauauucaaauuaacauaucaaaacaaaguuguuaggguacagagaccuaccccaaggggaacagucauggauauuauaucccgaagggaucaacguggcucuggacaaguuggaacauacggauugaacacguuuacuaacauggaagcacagcucauucggcaaauggaaggugagggaguuuucaaaaacauucaacaucugacuguaaccgaagagguagccguuaaaaauuggcucgcuagaguggggagagaacguuuaaguagaauggccauuuccggggaugauuguguuguaaaaccuuuggacgaccgauucgcuaaugcuuuaacugcuuuaaacgacauggggaaaauacgcaaagauauacaacaaugggagccaagcaaagguuggaaugauuggacgcaggucccuuucuguagccaccauuuucaugaauugaucaugaaagacggucgaguacuugucgugccgugcagaaaucaagaugaauuaauaggcagagcccgcaucucacaaggagcuggauggagucuccgagaaacugccugucuaggcaaaagcuaugcacagauguggagccucauguauuuucauagacgugaucuuaggcuagcagcaaacgccauuugcagcgcagugccuagccauuggguacccacauccagaacuacuuggaguauacacgccaagcacgaauggaugacaacugaagacauguugacuguuuggaauagaguuuggauaagagagaacccauggauggaagacaagacccccgucgaaucaugggaggaaauacccuaccuagguaaacgagaagaucaguggugugggucauuaaucggguuaacuucgagagccacaugggccaaaaacauacaagccgcgauuaaccaaguccgcucacugauaggaaaugaagaauauaccgacuacaugccaagcaugaaaagguucagacgagaagaggaagaggcaggcguguugugguaa

SEQ ID NO: 22702 - RNA, 9876 nt, Artificial Sequence
  derived and/or modified CDS sequence (opt6) from DENV-2__FJ410202__SS-prME
agcgcaggcaugauaauuauguuaauucccaccguaauggcauuccaccucacuacgagaaauggugaaccacauaugauaguaggaauacaagaaaaaggaaagagcuuacuuuucaaaaccgaagauggcgucaauauguguacauuaauggcaauggauuuaggagaauuaugugaagacacaauaacguauaaaugucccuuacuucgccaaaaugaaccagaagauaucgacuguugguguaacucaacgagcacguggguuaccuacggaacauguacaacgacaggugaacaccgccgggaaaaacgcucaguagcguuaguuccacauguaggcaugggauuagaaacacggacugaaaccuggaugucaucagaaggagcuuggaaacaugcucaaagaauugaaaccuggaucuugagacaccccggauucacuaucauggcggcaauacuggcuuacacuauuggaacaacucacuuucaacgaguucuaauuuucauacuucuuacugcagucgccccuucaaugacaaugcgcugcaucggaauuaguaacagagacuuuguugaaggugucucaggugggaguuggguagauauaguacucgaacacggcaguuguguuacuacaauggccaaaaauaaaccgacauuggauuuugaacucauuaaaacagaggccaaacagccagccacacuaagaaaauauugcauugaagcaaaauuaacuaacacgacaacugaaucacguuguccaacucagggcgaacccagcuuaaaagaagaacaggauaaacgcuuuguauguaaacacucaaugguugaucguggaugggggaacggaugcggauuauucgggaaaggaggaauuguaacgugcgcuauguuuaccuguaagaaaaauauggaaggaaaaauaguucagccugagaauuuggaauauacuauugucguaacaccacauuccggugaagaacaugcgguugguaaugauaccgggaaacacggcaaagaaauuaaaguuaccccgcagaguuccauuacugaggcagaguugaccgguuaugguacaguaacgauggaguguaguccaagaacgggccucgauuuuaaugaaaugguguuauuacaaauggaaaacaaagcguggcuaguacaucgucaaugguuccuagauuugccauuacccuggcuaccaggugcagauaaacaagaaaguaacuggauccaaaaagaaacccuagucaccuucaaaaauccacaugccaagaaacaagacgucguaguccucggcucacaagaaggugcgaugcauacugcgcuaacaggagcuacugaaauccaaaugucaucagguaaccuccuauuuacaggacacuugaagugccgucugcguauggauaaguuacaauuaaaaggcauguccuauucuauguguacagggaaguucaagguagucaaagaaauagcagaaacacaacacggcacuauaguaauacguguucaguacgaaggagacggaucuccauguaaaauuccauuugaaauuauggacuuagaaaaacgcuacguucuuggcagacuaauaacgguaaacccaauagucacugaaaaggacuccccgguuaauauagaagcggagccuccauucggcgacaguuacaucauaauaggugucgaaccugggcaacucaaauugaacugguuuaagaaaggaucaucgauuggacaaauguuugaaacgacaaugagaggcgccaagagaauggcaauccuuggagacacagcaugggacuuuggaaguuugggaggaguguuuacgaguguaggaaaggcacuucaccagguuuucggagcuaucuauggugcugccuuuuccggagucaguuggacaaugaagauccucaucggugugauuauaacauggaucgguaugaacaguaggaguacgucacuguccguuuccuuaguuuuaguaggcauaguaacguuauaucuagguguaaugguacaggcagauuccggcugugucgucucguggaaaaacaaagaguuaaaaugcggcucaggcaucuuuaucacggacaacguccauacuuggacugaacaauacaaauuccaaccugagaguccuucuaaguuggcaucagcaauacagaaggcccaagaagaaggaauuuguggaauccguaguguuacccgccuggaaaaucuuauguggaaacaaauuacccccgaacugaaucauauucuggccgaaaaugaaguaaaauuaaccauaaugacaggcgauaucaaaggaauuaugcaagcaggcaaacgaagucuaagaccacaacccacagaauuaaaguauagcuggaaaacguggggaaaagcgaagaugcuuucuacagagucuuacaaccagacuuuccucaucgacggucccgagacagcugaauguccgaacacuaauagagcuuggaauagcuuagaaguugaagauuauggauuugggguuuuuacaacaaacauuugguuaaagcucaaagaaaaacaagaugcauuuugugacuccaaguugaugucagcagcuauuaaggacaaccgggcaguacaugcugauaugggauauuggauugaaucagcauugaaugauacuuggaagaucgaaaaagcuaguuucauagagguaaagaauugucauuggccaaagucgcauacucuuuggucgaauggaguauuagagucagagaugauaauucccaaaaaucuugcaggacccguuucccaacauaauuaucguccggguuaccacacucaaauagccggaccauggcauuugggaaaguuagaaauggacuuugauuucugcgauggaaccaccguaaucgucaccgaagauugcgguaaccgagggcccagcuugaggaccaccaccgcgucagguaaauugaucacugagugguguugccguaguuguacgcugccaccccugagauaucgaggugaagauggauguugguauggaauggagauuagaccacugaaggaaaaagaagaaaauuuaguaaacucauuaguuacagcuggacauggacagguagauaauuuuucacuaggagucuuaggaauggcccucuuucuagaagaaaugcuucggaccaggguaggcacaaaacacgccauauuauuaguagcagugucauuuguuacauuaauuacagguaauaugucauuuaaagaccuuggaagaguaguaguuaugguuggugcgacgauggcagacgacauugguaugggaguaacguaucuagcacuauuggcagcauucaaaguaagaccgacuuucgccgcaggauuacucuuaagaaaacuaacuuccaaagaacugaugaugacaacgauuggaaucgucuugcuaucacaaucaacaauaccugaaacaguauuagaauugacugaugcgcuggcucuaggaaugauggugcuaaaaauaguaagaaacauggaaaaguaucaacuugccguaacaauuauggccaucuugugcguucccaacgccgucauucugcagaaugcuuggaaaguguccuguaccauuuuagcuguuguaucgguuucaccucuuuuacuaacgucaagccaacagaaaacggacuggauaccacuugcucuuacgauuaaaggguuaaaucccacugcaauauuucuuacaacccuaucacgcacaaacaagaaaagaaguuggccgcugaacgaggccauaauggcugucggcauggugaguauacuugcaucuaguuuauugaaaaacgauauacccaugacagguccauuaguggcaggagggcuacuuacuguaugcuaugugcuaacaggacgcucagcagaucuagaacuagaaagggcuacugauguuaagugggaagaccaagcagagauuucaggaucuucaccaauucugucgauaacgauuucagaggacgguucaaugucuaucaaaaaugaagaggaagaacagacuuugacaaucuuaauaagaacaggucuucucguaauaucgggucucuuuccgauaucaauaccaauaacggcugcagccugguauuuaugggagguaaagaaacaacgagccggcguuuuaugggaugugccuucaccaccaccaauggggaaagccgaauuggaggacggcgcuuauaggauaaaacagaaagguauauuaggguauagucaaauaggggcaggcguuuauaaagaaggcacuuuucacaccauguggcauguaacaaggggagcaguucuaaugcacaaggguaaacgaauagaaccaucaugggccgacgucaagaaagaccuaaucucguauggcggaggguggaaacuagagggugaguggaaggagggagaagaaguucagguuuuggcacuagagccggguaagaauccacgugcaguacaaacaaaacccggcuuauuuaaaacuaacacaggcacaauaggggcagugagucucgauuuuagccccggcacaucaggcagcccaauuaucgacaaaaagggaaaaguugugggccuuuauggcaaugguguagugacaagaucaggugccuauguaucggcuaucgcacaaacagagaagucaauugaagacaauccugaaauugaagacgauauauuuaggaaaagacgauuaacgauuauggaucugcacccgggagcaggaaaaacuaaacgauaucuuccggcaauaguccgagaagcaauaaaaagaggauuaagaacucuuauacucgcgccaaccaggguggucgcagccgaaauggaagaagcauugcgaggacuuccaauaagauaucaaacacccgcgauucgggccgaacacacuggacgagaaaucguagaucuuaugugucacgccacauuuaccaugcgcuuacuaucaccggucagagucccuaauuacaaccuuauaauuauggaugaagcucauuuuacagacccagcuuccaucgcagcgcgaggauacauuuccacucgaguugaaaugggcgaggcagcaggcaucuuuaugacagcaacacccccagguagucgggacccuuucccacagaguaacgcaccuauaauagaugaggaacgggaaauuccagagagaucauggaauagcggacaugagugggucacagauuuuaaagguaagacaguaugguuugucccuagcaucaaggcuggaaaugacaucgccgcuugcuuaaggaaaaacggaaagaaaguaauccagcuaucucguaaaaccuuugauucagaauacguuaagaccaggacaaaugacugggauuuuguuguaacaacugauauaucagagaugggcgccaauuucaaagcugaacgaguuauugacccaaggagaugcaugaaacccguaauacuuacagacggcgaagaaagaguaauccuggcaggacccaugccuguuacucauucaagugcugcccagagaagagguagaauagggcggaaucccaaaaacgaaaaugaccaauacaucuauaugggcgagccguuggagaaugaugaagauugugcacauuggaaagaagcaaaaaugcuauuagacaauauuaauacacccgaagggauuaucccaagcauguuugaaccggaaagagaaaaaguggaugcaauugacggagaauacagauuacgaggugaggcacgaaaaacuuucguagauuugaugcgacgaggugauuuaccaguuugguuagcauauaaaguagcagcagaagggauaaacuaugccgacagaagaugguguuuugaugguaucaaaaauaaccaaauucuggaggaaaauguugagguggagguauggacaaaagaaggcgaaaggaagaaacuuaaaccacgauggcuagaugcaaggaucuauucggacccguuggcacuaaaagaauuuaaggaauuugcugcuggaagaaagagcuuaacauugaaucuaauaacagaaaugggacgauugcccacauucaugacacagaaaacuagagacgcacuagacaauuuagcagucuuacacacugcagaggucggaggcagagcauauaaucacgcauuaucagaguuaccugaaacacuagagacucuccuucuucuaacgcuuuuagcuacgguaacaggugggauauuuuuauucuuaaugucaggacgaggaauagguaaaaugacacuggggauguguuguauuauaacggcuaguauucuuuuaugguaugcacaaauacagccgcacuggauagcagcgucaaucauacuagaguucuuucuaauuguuuuauugauuccagaaccggaaaaacaacgaacgccucaagauaaucagcuaacauauguugugauugcgauauuaaccguaguagcagcaaccauggcaaaugagaugggauuucuagagaaaacaaagaaggaucuaggauuagguucgauagcgacacaacaaccugaaucuaauauacuggauauagauuuaagacccgcuagcgcuuggacccucuaugcaguagcaacgacauuugucaccccuaugcuucgacauuccaucgagaacucaagcguuaaugugucacuaaccgcuauugcaaaucaagcgaccguacuaaugggauugggaaaagguuggccucuuucaaaaauggauauaggugucccauuacuugcaauaggauguuauucacaaguuaacccaauuacauuaacagcugcauuauuacuauuaguugcgcacuaugccaucauaggaccaggauuacaagcaaaagcaacaagagaggcccagaaacgcgccgcagcaggaaucaugaaaaauccaaccgucgacgggauaacaguaauagaucuagauccaaucccguacgacccuaaguuugaaaaacaauuaggacaaguuauguuacucauuuugugcgucacccaaguucugaugaugcgaacuaccugggcucuuugcgaggcuuuaaccuuagcaaccgguccgaucagcacccucugggaaggaaauccaggacguuucuggaauaccaccauagcaguaucuauggcaaacaucuuuagagguaguuauuuggcuggugccggauuauuauuuucuauuaugaaaaacacaacaaauacgagacgaggaacuggaaacaugggagaaacccuuggagaaaaauggaaaagcaggcuaaaugcucuugggaaaucugaauuucagauauacaaacggucaggaauacaggaagucgauagaacucucgcgaaagaaggcauuaaaaggggagaaacagaucaucaugcgguaucaagggguucagccaaguuaaggugguuuguagaacggaauaugguaacuccggaagggaagguuguugauuugggaugcggcagaggcggauggagcuauuauugugguggccuuaaaaacguacgcgaaguaaagggacuaacuaaaggaggcccaggacaugaagaaccgauaccuaugucuaccuacggauggaaccuuguucgguuacagagcgguguagauguuuucuucauaccaccagaaaaaugcgauacauuacuaugcgacauaggugaaucuaguccgaacccaacgguugaagcugggagaacacuccgaguacucaaccuaguagaaaauuggcuuaacaauaacacucaguuuuguauaaaaguucuuaauccuuauaugccaucgguuauagaaaagauggaggcacuacagaggaaguaugguggagcgcugguaaggaacccucuaucccgaaacaguacacaugaaauguauuggguaagcaaugccuccgguaacauuguaaguucaguuaacaugauaagucggauguuaaucaauagauuuacgaugagacauaagaaagcuacuuaugaaccugauguagacuuagguucgggaacaagaaauauagguaucgagucugaaauccccaaucuagacauuauuggaaaaagaauugagaaaauaaaacaagaacaugaaacaagcuggcauuaugaccaagaccacccuuauaaaacaugggcauaccacgggucauacgaaacaaagcaaacaggaucugccuccucaaugguaaacggugugguccggcugcuaaccaaacccugggauguccuaccaacgguaacacagauggcaaugacggauacuacuccuuucggacaacagagaguauucaaggagaaaguagauacucggacccaagagccuaaggagggcacaaagaaauuaaugaaaauuacugccgaguggcuauggaaagaacuaggcaaaaagaaaacaccaagaauguguacaagggaagaguucacccgaaaagugagaaguaaugcagcacucggcgcgauauuuacugacgaaaauaaauggaaaucagcuagagaagccguugaagauucucguuucugggaauugguagauaaggaaaggaaccugcaccuagaaggaaaaugugagacaugcguguauaacaugauggguaaacgggagaagaaacucggugaauuuggcaaagcaaaagggaguagagcgaucugguacaugugguuaggagcucgcuuuuuagaauuugaggcuuugggguucuugaaugaagaucacugguucagucgggagaacucucuaucuggaguggagggugaaggacuccauaaauuggguuauauuuuaagagauguuucgaagaaagaagggggagccauguacgcugacgacaccgcaggaugggacacacggauaacacuugaagauuugaaaaaugaggaaauggucaccaaccauauggagggagagcauaagaaacuggcagaagcuaucuuuaaacuaaccuaccaaaauaaaguuguaagaguacagcgccccacaccgcgagguacuguaauggacauuauaucucgcagagaccaaagaggcucaggacaaguuggaacguauggacuaaauacguucacgaauauggaggcgcaauugaucagacaaauggaaggagaaggaguuuuuaaaaacauucagcauuuaacagugacugaggaaguagcuguucaaaauuggcuagcacgcguaggcagagaacgauuaucacguauggcgauaagcggggacgacugcgugguuaaaccccuagaugaucgauucgcaaacgcccuaacagcucucaacgacaugggaaaaauccgcaaagacauucaacaaugggaaccuagcaaaggauggaaugacuggacgcagguaccauuuuguagucaucauuuucacgaacuaauuaugaaagauggaagaguacuuguaguuccgugccgaaaucaggaugaguugauaggacgagcuagaaucagccaaggggcugguuggagccuccgagaaaccgcauguuuaggaaaaucuuacgcucaaauguggagcuuaauguacuuucacagaagggauuuacggcuugcagcuaacgcgauauguagugcaguaccuucgcacugggucccgacgucucguacgacuuggucaauccacgcgaaacacgaauggaugacaacagaagauauguugacagucuggaacagaguuuggauaagagaaaaucccuggauggaagauaagacaccaguagaauccugggaagaaaucccuuacuuagguaaaagagaagaucagugguguggaucauuaauaggcuuaacaucccgagcuacgugggcaaagaacauucaagcagcaaucaaccaaguaagaucccucauugggaaugaagaguacaucgacuauaugccuucaaugaaacgauuccgacgagaagaggaagaagcggguguccugugguaa

SEQ ID NO: 22703 - RNA, 9876 nt, Artificial Sequence
  derived and/or modified CDS sequence (opt6) from DENV-2__FJ410208__SS-prME
agcgcugggaugauaauaauguuaauaccaacaguaauggcauuccacuuaacuacucguaacggugaaccccacaugauuguaggaauacaagaaaaaggaaaaagucuauuauucaaaacagaagauggaguuaacauguguacacuuauggcaauggaccucggagaacucugugaagacacaauuacguauaaauguccccuacuaagacaaaacgaaccagaagacauugauugcugguguaauagcacaucuacauggguaacauacgggacauguaccacaaccggagaacacagaagagaaaaacgaucgguugcucuagugccacauguagguaugggacuagaaacaaggaccgaaacauggaugucaagcgaaggagcauggaaacacgcacagcgcaucgaaaccuggauacuaagacacccuggguucacaauaauggcagcaauacuggcuuauacaaucggaacaacucacuuccagagaguucuuauauuuauuuuacuuaccgcaguagcucccagcaugacaaugagauguauaggaauaucuaacagagacuuuguagaaggaguaucaggaggcagcuggguagacauaguauuggagcaugggagcuguguaacgacgauggccaaaaauaaaccaacucucgacuuugaacucaucaaaacagaggccaaacaacccgcgacauuacgaaaauacuguauagaagcaaaacugaccaauacaacuacagaaagccgauguccaacgcagggagaacccagucuaaaagaggaacaagauaaaagguuugugugcaaacacagcaugguagacagaggguggggcaacgguuguggguuguuuggaaaaggaggaauuguuacgugugcuauguuuaccugcaagaaaaacauggagggaaaaauuguacaaccagaaaaccuggaguacacgauaguaguaacaccacauaguggugaagaacacgcaguuggaaaugacacagggaaacauggacaagaaauuaaaguuaccccacaaucaaguaucacagaagcugaacuuacaggauacgguacaguaacaauggagugcucaccccgaacuggauuggacuuuaaugaaaugguauuguugcagauggagaauaaagccuggcuaguucaccgacaaugguucuuagaucuaccccugccauggcuuccaggugcagacaaacaagaaucgaauuggauacagaaagaaacucuaguaacauucaaaaauccccacgcgaagaaacaagauguaguuguauuaggaagucaagaaggcgcaaugcauacggcuuuaacaggcgcgacagaaauacaaaugaguaguggaaauuuacucuuuacaggccaucugaaaugccgccugaggauggacaaauugcaacuaaaagguaugucauacucuauguguacuggcaaauuuaaaguaguaaaagaaauagcggaaacgcaacacggaacaauuguuauuagagugcaauacgaaggcgaugggagcccuuguaaaauacccuuugagauaauggaccuagagaaacguuacguauuaggucgcuuaauaacgguuaauccuauaguaaccgaaaaagauucaccgguuaauauagaagcagaaccaccuuucggagauuccuacauaauaauugggguagaaccagggcaacuuaaacuaaauugguucaagaaagguucaucaauaggacaaauguucgaaacaacaaugagaggugcgaaaagaauggcuauacucggcgauacggccugggacuucgggagccuagggggaguguuuacaucaauugguaaagcauuacaccaaguuuuuggagcuaucuauggagcagcauuuagugggguaaguuggacaaugaaaauauuaauagggguaaucaucacauggauagggaugaacucccgaucuacaucucucagcguuucccuaguucuaguagguaucguuacuuuauaucucggaguaaugguccaggcugacagcgguugcgucguaucuuggaaaaauaaagaacuaaaaugcgguaguggaauauuuaucaccgacaacguucauacuuggacagaacaauacaaauuccaaccugaaucaccaaguaaauuggcaagcgccauacaaaaagcucaggaagaaggaauaugcggaauaagaucuguaacacgacuggagaauuugauguggaaacaaauaacgccggaacuuaaccauauucuagcugaaaaugaggucaaauuaacaauaaugacuggagauaucaaaggaaucaugcaggcaggaaaaaggagcuugaggccucagccgacagaauugaaauauaguuggaaaacuuggggaaaagcuaaaauguuaucaacugaaucauacaaccaaacguucuuaauugauggcccagagacagcagaauguccuaacacgaauagggcuuggaacucgcuagaaguagaagauuacggauucgggguauucacaaccaauaucuggcucaaacuaaaagaaaaacaggaugcguuuugugacaguaaacuaaugagcgcagcuauaaaggacaaccgagccguucacgcagacaugggcuacuggaucgagucugcccuaaacgacaccuggaagauagaaaaggcuucuuucauagaagucaaaaauugccacuggccuaaaagucauacauuauggucgaaugguguacuggagucagaaaugauuauaccuaagaaccucgcaggaccaguaagucaacauaacuacagaccgggauaucacacucagauugcugguccauggcauuuaggaaaacucgaaauggauuuuaacuucugcgacgguacgaccguuauaguuacugaagacugcggaaaucgagguccaucuuuacgaacaacuacagcgaguggaaaacuaauaacugagugguguugcagaucuugcacacuucccccucuacgcuaccguggagaggauggcuguugguacggaauggaaauaaggccuuugaaggaaaaggaagaaaauuugguuaacucacuugucacugcaggucauggacaaguggacaauuucagucuaggaguccucgggauggcauuauuccuugaagaaauguugaggaccagaguaggaacuaaacaugcaauauuauuaguagccguauccuuuguaacgcucaucacaggaaauaugaguuuuaaagaccucggucgugucguaguaauggugggcgcuaccaugacugaugauauugggaugggugucacguauuuagcccuccucgcggcuuucaaagugaggccgacauucgcugcuggccuccuucugagaaaacuuaccaguaaagaacuaaugaugacgacaauuggcauuguauuacuaucccaaucgacaauaccggagaccguuuuagaacuaacugaugcgcucgcucuagguaugauggucuuaaaaauagugcgaaauauggaaaaauaccaacuugcaguuacaauaauggccauacuaugcguaccgaaugcugugauauugcaaaacgcauggaaaguuucguguacuauauuagcaguugucagcguaagcccucuacuauugacuagcucucaacagaaaacagacuggauaccgcuugcccuuaccauaaaaggauuaaacccuaccgcgauauuuuugaccaccuugaguagaacaaauaagaaacgguccuggccacugaaugaggcuauuauggcuguagguauggucuccauauuggcuaguucgcuacucaaaaaugacauacccaugacuggacccuuaguggccggcggucuacuuacagucuguuacguucuuaccggacguucggcggaucuagaacucgaacgugcaacagauguaaaaugggaggaccaagcugaaauaagcgguucaucaccgauacuaaguauuacgaucucagaagacgguaguaugaguaucaaaaacgaagaggaagaacaaaccuuaacaauucucauacggacaggacuacucguaauuucaggauuauuuccaauuagcauaccgauuacggcagcagcuugguaccuuugggaagucaagaaacaacgagcuggcguacucugggauguucccaguccaccuccaaugggcaaggcugaacucgaagacggagcguacaggauaaaacaaaagggcaucuugggauacucccaaauaggagcuggagucuauaaagaaggaacauuucacacaauguggcauguaacacgcggcgcagucuuaaugcauaagggaaagcgaauagaaccaaguugggcagaugucaagaaagauuuaaucucauacgggggaggauggaaacuugaaggugaauggaaggaaggagaagaaguccaaguuuuggccuuagaaccgggaaagaauccccgggccgugcaaacaaaaccaggacuguucaaaaccaacacgggaacuauuggagcuguuagucuagacuucucaccaggaacaucgggaagcccuaucauugauaagaaaggaaaaguaguaggucuuuacgguaacggaguuguaacacgaucuggggcguacguaucggcgauagcacaaacugaaaaaucuauagaagauaacccagaaauagaggaugacauauuccguaaaagaagauugaccauuauggaucuucacccuggggcagguaaaacaaaacgcuaccuuccggcaaucgucagagaagccauuaaaagaggacucaggaccuuaauuuuagcuccuacacggguugucgccgccgaaauggaggaagcccugagagguuugccaauucgcuaucagacaccagcgauacgagcugaacauacggguagggaaauuguugaucucaugugccacgccacuuucacuaugagacugcucaguccaguacguguaccaaauuacaaucuuauaauaauggacgaagcucacuucacagacccugcguccauagcggcccguggauacauuaguacccggguugaaaugggcgaagcugccggcauuuuuaugacagcaacgccgccugguuccagagauccguucccucaaaguaaugccccaauuauugaugaagaacgagaaauaccugaaagaucguggaacucaggacacgaguggguaacugauuuuaaaggaaaaacagucugguuugugccaucgauaaaagcgggcaaugauauagccgcuuguuuacgaaagaauggaaagaaagugauacaguuaucaagaaagacguucgauucggaauauguaaaaacaagaacaaaugacugggacuucguuguuacgacugacauuucagaaaugggggcaaauuuuaaagcagaacguguaauugacccucgacgauguaugaagccaguuauauuaacagacggggaggagcguguaauacuugcagggcccaugccaguuacgcauagcucggcagcucaaaggcgaggaagaaucggacggaaucccaagaacgaaaacgaccaauacaucuauaugggugaaccacuagaaaaugacgaagacugugcacacuggaaagaagcgaaaauguuacuugauaauaucaauacuccugagggaauaauuccauccauguucgagccugaacgagaaaaaguagaugccauagacggagaguacagguuacgaggugaagcacguaaaaccuuuguagaccuaaugcgaagaggagacuuaccugucuggcuagccuacaagguagccgcagaaggcauaaacuaugcugacagacguugguguuuugacggaauaaagaacaaucaaauccucgaagagaauauggaagucgaaauauggacaaaagaaggagaacggaagaaacugaaaccacguugguuagaugcccgaauauacagugacccacuggcuuuaaaagaauuuaaggaauuugcagccggucguaaaucauugacacuaaaccuuauuacugaaaugggcaggcucccaacuuuuaugacccagaaaacacgcgaugcguuagauaaccucgcuguacugcauacagcagaagcugguggccgggcauauaaucacgcacugucugaacuaccagaaacuuuagagacauuacuacugcucacacuccuugccacaguaacaggcggaauauuccuuuuucuaauguccggaaggggaauuggaaagaugacccucgguaugugcuguauaauaacugcuagcauucuauuaugguaugcucaaauucaaccacacuggauagcagcaucgaucauacuagaguucuuucuuauaguucucuuaauuccggaaccggaaaaacaacguacuccucaagacaaucaacuaacuuacguagugaucgcuauacucacuguaguagcagcuacaauggcuaaugaaaugggauucuuggagaagacaaagaaggaucuagggcuugggucaauagcaacaagacaaccugagaguaauauacuugauauugaucucagaccagcguccgcauggacccuuuaugccguugcuacaacauucguuaccccuauguugcggcauucaauugaaaauucauccguaaacguuucacucacagcaauugccaaccaggcaacaguguuaaugggccucggaaaagguuggcccuugagcaaaauggacauaggagucccauugcuagccauaggaugcuacagucaaguaaauccaauaacccuaacggccgcgcuauuguugcuuguagcucacuaugcaauaauugggccggggcuccaagcaaaggcuacucgugaagcacagaaaagagcagccgcaggcauaaugaagaacccaacggucgaugguaucacuguuauugaccuagauccaauaccuuaugaucccaaguuugaaaagcaacuaggucaaguaaugcuacucguccuaugcguaacacaagugcuaaugaugcgaacgacaugggcgcuuugugaagcauugacauuagcgaccggacccauaucuacgcuuugggagggcaacccugggagauucuggaacacaacgauagcagugucaauggcuaauauauuuagagguaguuaccuagcaggagcuggacucuuauucuccauuaugaagaauacuacuaauacuagacgagguacgggcaacaugauagaaacuuugggagagaaguggaaaucaaggcucaaugcacuugguaaauccgaauuucaaauuuacaaaaagucuggcauacaagaaguagauagaacacuggcuaaagaaggcauaaaaagaggugaaacggaucaucacgcuguuagucgcgguucugcuaaacugcgaugguucgucgaaaggaauauggugacuccagaaggaaaaguaguagaucuuggcugcggaagaggcggcuggaguuacuacugcggaggucucaaaaauguaagagaaguaaaagggcuaaccaaaggaggaccaggacaugaggaaccaauaccgaugagcacauauggauggaaucuagugcguuuacagucaggaguggacguuuucuucauaccacccgaaaagugcgauacauuguuaugugacauuggagaaagcucaccaaacccuacaguugaagcuggucgaacguuacgcgucuuaaacuuaguagaaaacuggcugaauaacaacacacaauuuuguaucaagguacuaaacccauauaugccaucaguuauagagaaaauggaggcucuacaacgcaaauacggcggugcacucguaagaaacccacuaucuagaaauuccacgcacgagauguauuggguuucaaaugcaaguggaaacauaguaaguucaguaaauaugauuaguagaaugcuaauuaaccgauuuacuaugcgacauaaaaaggcaacauacgaaccagauguagaccuaggaucaggaacucgaaacauagguaucgaaagugaaauccccaaccuggauauaauaggaaaaaggauugaaaagauuaaacaggaacacgagacaucauggcacuacgaccaagaucacccauauaaaacaugggcauaccauggaaguuaugagacgaaacaaacaggaagcgcaucaucgauggucaacgggguaguuaggcuccucaccaagccaugggacguacuaccaacaguaacacagauggcaaugaccgauacuacgccauucggacagcagcgggucuucaaagaaaaaguagacacaaggacacaggaacccaaagagggaacgaaaaagcucaugaaaauaaccgcagagugguuauggaaagaauuagguaagaagaaaacaccgcggauguguacuagagaagaauuuacccgcaagguacgaaguaaugcagcauugggcgcaaucuucacagaugagaauaaauggaaaagcgcuagagaggcaguagaggacaguagguucugggagcuggucgauaaagaacgaaaucuacauuuagaagggaaaugcgaaacuugcguauauaauaugaugggaaaacgggagaagaaacuaggugaauuugguaaagcuaaagguagccgagcaauaugguacauguggcuaggagcaagauuuuuggaauuugaagcguuggguuuccugaaugaagaucauugguuuucccgugagaacucccuaagcggcguagaaggcgaaggucugcauaaguuaggauauauauugagagauguaagcaagaaagaaggaggugcaauguacgcugacgauacugcugguugggauacacgaauaaccuuagaggaucucaaaaacgaagaaaugguuaccaaucauauggaaggugagcauaagaaacuagcugaagccauuuucaagcuaacguaccaaaacaaaguaguucgggugcagagaccuacuccgaggggaacuguaauggacaucaucagucgaagagaccaaagaggauccggccagguaggaacauauggacuuaacacguucaccaacauggaagcacaacugauucgacaaauggaaggugaagggguauucaaaaacauacaacacuuaacgguuacagaagaaguagcugucaaaaacugguuagcgagggugggaagagaacgccuaucgaggauggccauaaguggggaugauuguguuguaaaaccuuuggaugaucguuuugcuaacgcauugacugcacuaaaugacaugggaaagauaagaaaagacauccaacagugggaaccaaguaaaggauggaaugauuggacccaaguaccuuucuguagccaccauuuccaugaauugauaaugaaagauggacguguacucgucgucccauguagaaaccaggaugaauugauugguagggcacgaauaagucaaggcgcggggugguccuuaagagagacagcaugucuagguaaaagcuaugcccaaauguggaguuuaauguauuuucauaggcgcgacuuaagguuagcugcaaacgcaauauguucagcuguucccucacauuggguaccaacauccaggacaacauggucgauccacgcgaaacacgaauggaugaccacggaagauauguuaacaguauggaauaggguauggauacgagaaaauccguggauggaagauaaaacaccuguugagucuugggaagaaaucccauacuuagguaagcgugaagaucaauggugcggaucuuugauuggauuaaccucuagagcuacaugggccaaaaauauacaggcagcaauuaaccaaguaagaucauuaauuggcaacgaagaauauacugacuauaugccaucgaugaagcgauuuagacgugaagaggaagaagcuggaguauuaugguaa

SEQ ID NO: 22704 - RNA, 9876 nt, Artificial Sequence
  derived and/or modified CDS sequence (opt6) from DENV-2__FJ461305__SS-prME
uccgcuggaaugauaauuaugcuaaucccaaccgucauggcuuuucauuuaacuacacgcaacggcgaaccacauaugaucgucggaauccaggagaaaggcaaaaguuuguuauucaagacagaagauggcgucaauauguguacauuaauggccauggaccuaggugaacuuugugaagauacaauaaccuacaaauguccauugcuacgucaaaacgaacccgaggacauagacuguuggugcaacucuacaaguacuugggugacuuauggaacauguacaacgacgggagagcacagacgugagaaacgaagcguagcucuuguuccacauguagguaugggauuggaaaccagaacggaaacauggaugucaagugaaggcgcguggaagcaugcucaaagaauagaaacuuggauccuacgucacccuggguuuaccaucauggcagcaauucuagcuuacacaauuggaacaacccacuuucaaagaguauugauauuuauauuacucacggccguagcuccauccaugacuaugagguguauaggaauauccaacagggauuucguggaagguguaaguggcggaagcuggguugacauaguuuuagagcauggaagcuguguaacaacuauggcuaaaaauaaaccaacauuggacuuugaguuaauuaaaacugaagcaaaacaaccggcaacacuacggaaauauuguaucgaagcuaaauuaacuaauaccacaacggaaucaagauguccuacucagggagaaccuucuuugaaagaggaacaagauaaacgguuuguaugcaagcauaguaugguagauaggggguggggaaacggauguggauuguuugggaaaggugguauagugacuugugcaauguucacauguaagaagaacauggaaggaaagaucguccaaccggaaaauuuggaauacaccauaguaguaacgccccauucgggugaggagcacgcuguaggcaaugauacggguaagcauggucaagagauaaaaguaacaccacaaaguucaauuacagaagcggaauuaacugguuacggcacuguaacgauggaauguaguccacguacaggauuagacuuuaacgaaaugguacuauuacagauggaaaauaaagcuuggcugguucaucggcagugguuccuggacuuaccgcuucccugguuacccggagccgauaaacaagagagcaacuggauccaaaaagaaacguugguuacauuuaaaaauccacacgccaaaaaacaggacguagugguauugggaucccaagagggcgcaaugcauacagcacuaacaggagcaacugaaauacaaauguccaguggcaacuuauuauuuacgggccacuuaaaguguagauuacguauggacaaacuucaguuaaagggaaugucuuauucaauguguacaggaaaauucaaaguugucaaagagauugcugagacacaacaugguacuauuguuauccggguucaauaugaaggcgauggaucgcccugcaaaaucccauuugaaauuauggaccuagagaaaagguauguacuaggaagacugauuacgguaaaccccauuguaacagaaaaagacucaccgguaaauauagaagcagagccaccauuuggagacucguauauaauuauagguguugagccaggucaacugaagcucaauugguuuaaaaaggggucaucuauaggacaaauguucgagaccacuaugagaggggccaaacguauggcaauauuaggagacacugcgugggauuucggaagucucggaggaguuuuuacaucaauuggaaaagcacuacaucagguauuuggugccauuuauggagcugcauucuccgguguaaguuggacaaugaagauauuaaucggagugauaaucaccuggaucgggaugaauagucggagcacgucccugagcgugucacuugucuuggucgguaucguaacacuguacuuagguguuaugguacaagcagauucgggauguguggugaguuggaagaacaaggaacuaaaaugcgguuccgggauauuuauaacugauaauguccacaccuggacugaacaauauaaguuccaaccggaguccccaucuaaauuagcuucagccauacaaaaagcacaagaagaagguauaugcggaauaagaagcguaacgcgguuagagaauuuaauguggaaacaaauuacgccggagcucaaucauauauuagccgaaaaugaagucaaacugacaauaaugacaggagauaucaaggguauaaugcaagcaggaaagagaucuuuaaggccacaaccuacggaauuaaaguauucauggaaaacgugggguaaagcuaaaaugcugucaacagaaucuuauaaccaaacauuccuaauagauggaccugaaacagcugaauguccaaacacuaauagagcauggaauucgcuagaaguugaggacuaugguuuuggaguauucaccaccaauauaugguugaaacuuaaagaaaaacaagaugcauuuugugacucuaaacuaaugagcgcagcgauuaaggauaaucgagcuguacaugcagacaugggauacuggauagaaucggcacuuaaugauaccuggaaaauagaaaaggcuaguuuuauagaaguaaagaacugccacuggcccaaaucccauacguuauggucgaacggggugcuagaaagcgagaugauuauucccaaaaaucuagcgggccccgucagucagcauaacuaucguccaggcuaccacacacaaaucgccggaccguggcauuugggaaaauuagagauggacuuugacuuuugcgacggcacuacagucauaguuacagaagacugugggaauagagggccuucauuacggacuacuacugccucaggcaaacuaauuacagaguggugcuguagaucauguaccuuaccgccacuucgauauagaggagaggacggauguugguauggaauggaaauaagaccgcuuaaagaaaaagaagagaauuuagucaacagucugguuacugcagggcauggacaaauagacaacuucaguuugggcgucuuaggcauggcacuguuuuuagaggaaauguuaaaaacuaggguaggcaccaaacacgccauucugcugguggccguaucuuuuguaacacuuaucacaggcaauaugaguuuuaaagaucuagguaggguaguggucaugguuggugcgacaauggcagaugacauaggaaugggcgugacuuaucuagcgcuacuagccgccuuuaagguaagaccaacauuugcagcuggucuuuuacuaaggaaauuaacaucaaaagaauuaaugaugacaacuaucggaauaguauuacuaagucaaagcacaauuccagaaacaguccuggaauuaacagaugcuuuggcauuagggaugauggugcucaagauaguaaggaacauggagaaauaucaacuggcagugacgaucauggcaauacuguguguuccuaacgccguuauacuccaaaacgcauggaaagugaguugcacuauacucgcaguuguaagcguuuccccguuguugcuuacaaguucccaacaaaaaacugauuggauacccuuagcucugacaauaaagggacuuaauccaacagcgauauuccuaaccacucuaaguagaacgaauaagaagagaucauggccucuuaaugaagcgauaauggcuguaggcaugguuaguauacucgcaucuagucuauuaaaaaaugauaucccuaugacgggaccucuaguugcgggcggauuacucacaguauguuauguauugacgggaagaagugccgacuuggaacuagaacgcgcaacugaugucaaaugggaagaucaagcugaaauaucgggaucaaguccuauacucaguauaacuauaagugaagaugguucaaugucaaucaaaaacgaggaagaagaacaaacuuugacaauacuuauucgaaccggauuacuuguaaucagcggacuauuuccaauaaguaucccuaucaccgcggcggcaugguaccucugggaaguuaaaaaacaaagagcugggguucucugggauguaccuagcccaccgcccaugggcaaagccgaguuagaggauggagccuaucgaauuaaacagaaagguauccuagguuauucacaaauaggugcaggagucuauaaagaagggacauuccacacgauguggcauguaacgagaggagcaguucucaugcauaaagggaagcggauugagcccucaugggcggacguaaaaaaagaucuuauuucauacggaggaggauggaagcuugagggggaauggaaggaaggagaagaaguucaaguccuagcucuagaaccagguaaaaauccaagggcugugcagacaaaaccuggucuauucaagacuaauaccggaacaauaggugccgugagucuagauuucucaccagggacuucaggaucaccaauaaucgacaaaaaggggaaagucguaggauuguacgggaaugggguaguuacgagaucuggagcuuauguaagugcaaucgcucaaaccgaaaaaucgauugaagacaauccagagaucgaggacgauauuuucagaaaaagacguuuaacaauuauggacuuacacccuggagccggaaaaacuaaaagauacuuaccagcgauaguaagagaagcgauuaagagaggacuaagaacgcuaauucuagcuccaacccguguuguagccgcagagauggaagaagcgcuuagaggauuacccauacgguaucaaacaccagcuauacgugcugagcauacagggcgcgagauaguagaucucaugugccacgcaacauucacaaugcguuuauuaucgccaguacguguuccaaacuacaacuugauaaucauggacgaagcacacuuuaccgacccugcaucaaucgccgcaagggguuauauaaguacucguguagaaaugggggaagcagcuggaauauucaugacugcaacucccccgggcucgagggacccauuuccucaaaguaaugccccgauuauugaugaagaaagagagauuccagaaagaagcuggaacucuggacaugaaugggucacugacuuuaaggggaagacaguaugguuuguaccaaguauaaaggcagguaacgauauugcggcauguuuaagaaaaaacggcaagaagguuauacaauugaguagaaaaacauuugacucagaauauguaaaaaccagaaccaacgauugggacuuuguuguaacuacagacauuucugaaaugggcgcaaauuucaaggcagaacggguuauagacccacgacguuguaugaaacccguaauuuuaacugauggugaagaaagaguaauucuagcuggaccaaugccagucacacauuccucagcugcacaaagaaggggacggauugguagaaauccaaagaaugaaaaugaucaauacauuuacaugggugaaccccuggaaaaugacgaagacugcgcccacuggaaagaagcaaagaugcuccuugacaauauaaauacacccgaagggauaauucccucaauguuugaaccagaaagggagaaggucgacgcgaucgauggagaauauagauugagaggcgaagcacgaaagacauuuguagacuuaaugcgacggggugaccuaccugucugguuagcguauaagguugcugcagaggggauaaauuacgcugauagaaggugguguuuugauggaauuaagaacaaucaaauucuugaggaaaauguggaaguagaaauauggacaaaagagggagagaggaagaaacuaaaaccaagaugguuagaugcucgaauauacucagacccucuugcauuaaaagaguucaaagaguuugcagcuggaagaaaaagucuaacucuuaaucuaauaaccgaaaugggaaggcugccaacguuuaugacgcaaaaaacacgggacgcccuagauaaccuagcaguacuucauaccgcagaagcggguggucgagcauacaaucaugcucucucugaacuaccugaaacgcuagagacauuguuauuacuuacgcuacuagcgacggugacaggaggcauuuuuuuauucuuaaugucggggcgaggaauaggcaaaaugacccuuggcaugugcuguauaauaacugcuagcauucuguugugguaugcacaaauucaaccucauuggaucgcagcaagcauaauacucgaguuuuuucuaauaguccuguuaauaccagagccagaaaagcaaagaacuccgcaggauaaccaauugacauaugucguuauagcaaucuuaacaguuguagcggccacuauggcaaacgagaugggcuuucuagaaaaaaccaagaaagauuuaggucuggggagcauagcuacacaacaaccggagucgaacauccuggauaucgacuuaagaccagccucagcauggacauuauaugcaguagcgaccacauucgugacacccauguugagacacucuauugaaaauuccucugugaauguaagccuaacagcgauugccaaucaagccacuguacuaaugggcuuaggaaaaggguggccacuuucaaaaauggauaucggaguaccuuuauuagccauaggaugcuacagucaaguaaauccaaucacuuuaacugcggcacucuuguuacuaguugcacauuaugcaauuauagguccugggcuacaggcaaaagcaaccagggaagcucagaaacgugcugcagcgggaauaaugaagaacccgacgguagacgguauuacagucauugaccuggauccaauaccauacgauccuaaguucgaaaaacaauuaggccaaguaaugcuauuaauacuaugugugacacaagugcuaaugaugaggacuacaugggcacugugugaggcacucacauuggcaacaggaccuauaaguacgcuuugggaggguaauccugguagauuuuggaauacaacuauagcagugagcauggcaaauaucuuuaggggaucauauuuggcuggcgcuggucuacuauuuucgauuaugaagaacaccacaaauacaagaagggguacugguaauaugggggagacucuaggugagaaauggaaaucuaggcuuaacgcacuaggcaaaucggaauuccagaucuauaaaaaaucagguauccaagaaguagaccgcaccuuagcaaaagagggaauaaagagaggagaaacagaucaucaugcagugagccgcggguccgcuaaauugaggugguucguagaaagaaacaugguaacaccagaagguaaagucguugauuugggauguggaagggggggguggagcuacuacugcggaggauuaaaaaauguacgagaaguaaaaggauuaacaaaaggggguccggggcaugaagaacccaucccaauguccacuuauggauggaacuugguucgccuccaaagcggcgucgacgucuucuuuaucccaccagaaaagugcgacacccuucucugugacauaggagaaucaucuccuaacccaacuguugaagcggguagaacacugagagugcuuaaccuuguagaaaacuggcuaaacaauaauacacaguuuugcauuaaaguucugaaucccuacaugcccagugugauugaaaaaauggaggcacuacaaaggaaauacggaggagcucucguuagaaauccccuaagcaggaauucaacccaugagauguacugggugucuaacgcuucgggaaacauaguaucuaguguaaacaugauaagccggaugcuaauaaaucguuuuaccaugagacauaagagggcuaccuacgagccagauguagaccuaggcuccggaacaagaaacauugggauagaaucugaaauuccaaauuuggauauuauaggaaagcgaaucgagaaaauaaaacaagagcacgaaacgucauggcauuaugaucaagaccauccuuacaaaacaugggcauaucauggcuccuacgaaacaaaacaaacaggcucggcaucuucaaugguaaacggcguaguacgacuguugacgaagccgugggaugugcuaccaaccgugacacaaauggcaaugacagauacgacuccuuuuggucaacagagaguuuuuaaagagaaaguugauacgagaacgcaagagccaaaagaaggaacaaagaagcucaugaaaaucacagccgaaugguuauggaaagaguuaggaaaaaagaaaacuccaagaaugugcacaagggaagaauucaccagaaaaguccggucuaaugcugcacuuggagccauauucacagaugaaaacaaauggaaauccgcacgcgaagcagucgaagacucaagguucugggaguuagucgauaaggaaagaaacuuacauuuagaagggaaaugugagacaugcguauauaacaugauggguaaacgggaaaaaaaauuaggggaauucggaaaggcaaaggggagcagagcgauuugguauauguggcuaggugcaagauuccuugaguuugaagcauuaggguuucucaaugaagaccacugguuuucgcgagaaaacaguuugucaggagucgaaggagaaggauugcauaaacuuggauauauacuucgugacguuagcaagaaagaaggaggcgcuauguacgcggacgauaccgccggaugggacaccaggauuacccucgaagauuuaaagaaugaggagaugguuacaaaccauauggagggggagcacaaaaaacuugcugaggcaauuuuuaaauugaccuaccagaauaaggugguaaggguucaaaggccaaccccgcguggcacugucauggacauuaucuccagacgagaucaaagaggaucuggacaaguugggacauauggauugaacacauuuacaaacauggaagcacagcuaauaagacaaauggaaggugaaggaguauucaaaaauauccaacauuuaacaguaacagaggaaguugcaguccaaaauugguuggcccguguugguagagaaagacuaucgaggauggcaauuucaggugaugauuguguaguaaagccccuagaugauagauuugcaaacgcauuaacagcacuaaacgauaugggaaaaaucaggaaggauauucaacaaugggaaccuucgaaagguuggaaugauuggacucagguaccauuuuguucucaucacuuucaugaacuuaucaugaaagaugggagaguccuuguaguuccauguagaaaucaagaugaacuuauaggaagggcgcgaaucagccaaggggcugguuggucacugagagaaaccgcaugccuggguaaaagcuacgcacaaauguggucuuuaauguauuuucauagaagggaucuacgauuggccgccaaugccauuuguucggcgguaccaucccauugggugccgacaagcaggacgacuuggagcauacacgcaaagcaugaauggaugaccacggaagacauguuaaccguuuggaacagaguauggauaagagaaaacccguggauggaagacaaaacgccaguagaaucaugggaagagauaccauacuuagguaaaagagaggaucaguggugcggcaguuugauuggauuaacauccagggcaaccugggcaaaaaauauccaagcagcaauaaaccaaguacguagucugauugggaaugaagaauauacagacuauaugccaaguaugaaacgguuccgacgagaggaggaagaagccggcguacuaugguag

SEQ ID NO: 22705 - RNA, 9876 nt, Artificial Sequence
  derived and/or modified CDS sequence (opt6) from DENV-2__FJ410215__SS-prME
ucagcagguaugauaauuauguuaauuccgacaguaauggcauuucauuuaacaaccagaaacggagaaccucacaugaucguugguauacaagagaaaggaaaauccuuacucuucaaaacugaggaugguguuaauauguguacgcucauggcaauggacuugggagaacuaugugaagauacgauuacauacaaaugcccauuacuucgucaaaacgaaccagaagacauagacuguuggugcaacucaacuucaacauggguaaccuauggaaccuguacuacgacaggagaacacagaagagagaaaagaucagucgcguugguuccacacguaggcaugggacuugaaacucguacugaaacuuggauguccagugaaggugcuuggaaacacgcacaacgaauagaaacuuggauccuaagacaucccgguuuuaccauuauggcugcaauacucgcauauacuaucggaacaacgcauuuccaacgcguguuaauuuucauauugcugacggcaguagcaccgucaaugacaaugagauguauuggaauuucuaauagagauuucguugaagggguaaguggaggguccuggguagacaucguucuagaacaugggucaugugucacaacuauggcgaaaaauaaacccacuuuggacuuugaacuuauaaaaacagaggcaaaacaaccagcaacucugcguaaauauuguauagaggcuaaacuaacaaauacuacaacagaaucacguugcccaacacaaggugagccaucauuaaaagaagaacaagauaaacguuuuguauguaaacacuccaugguggaccgggggugggggaauggaugcggacucuuuggaaaaggaggcauuguaacgugcgccauguucacuuguaagaaaaauauggagggaaaaauaguucaaccagaaaauuuagaauacacuaucgucguaacaccccauaguggagaagaacacgccguaggaaaugauacugggaaacauggaaaagaaauaaaagugacuccacaaucuaguauuacagaagcggaacugacagguuacggcacgguaacuauggaauguucacccagaacuggguuagacuucaaugaaaugguuuuacuacagauggagaauaaagccuggcuaguucaucgccaaugguuucuggaucuaccccuaccauggcugccaggagcagacaaacaagagucaaauuggauccagaaagagacucuaguuacguuuaaaaauccacaugccaagaaacaagaugucgucguacuuggaagccaagaaggagcaaugcacacugcacuaaccggcgcuacggaaauucagaugucaucugggaaccuguuauuuacaggacaucuaaaaugcagacuacgcauggacaaacuacagcuaaaagggaugagcuauucaauguguacuggaaaauuuaaagucgucaaagagaucgcggagacgcaacauggaaccauagucauaagaguccaauacgagggugacggcucaccaugcaaaauaccuuuugaaauuauggaucucgagaaacgcuauguacucggaagguuaauuacggucaauccuaucguaaccgaaaaagauaguccuguaaauaucgaagcagaaccaccuuuuggcgacucauauauuauuauaggagucgaaccagggcaauuaaaauugaauugguuuaaaaaggguucguccaucggacagauguuugaaacaacuaugcgaggcgcaaaacggauggcgauuuuaggugauaccgcgugggauuucgguucacuaggaggugucuuuacuucaaucggcaaggcauuacaccagguauucggagcuauauauggugcggcauucagcgggguaaguuggacuaugaaaauacuaauaggaguaaucauuaccuggauuggaaugaauagcaggucaaccucucuaaguguaucgcuuguuuugguagguaucguuacgcuauaucuaggcguaaugguucaagcagacuccggauguguuguguccuggaaaaauaaagaacuaaaaugcgggucuggaauauuuauaacugauaaugugcauaccuggacggaacaauauaaauuucaaccugaaucaccuaguaaauuggcaucagcgauacaaaaagcacaggaagaagggauuuguggaauaaggagcgugacucguuuggagaaccuuauguggaagcaaauaacuccagaacucaaucacauuuuagcggagaacgaaguaaaacuuacaaucaugacaggagauauaaaaggaauaaugcaagcuggaaaaagaagccuacgaccgcaaccgaccgaauuaaaauacaguuggaaaacuugggguaaggcuaaaauguuaagcacagaaucauauaaucaaaccuuucuaauagaugguccagagacagccgaguguccaaauacgaauagagcuuggaacucucuagaaguagaagauuacgguuuugguguauuuacuaccaacauaugguugaaacuuaaagaaaaacaggacgccuucugugacucaaaauuaaugucagccgcgauaaaagacaauagagcaguacacgcagauaugggauauuggauagaaucagcucuaaaugacacuuggaaaaucgaaaaagcauccuucaucgaggucaaaaacugucauuggccaaaaucucacacucuauggaguaacgguguccucgaaagugaaaugauaauacccaaaaaucuugccggcccaguuagucaacacaacuaccgaccaggguaucauacacagauagcuggcccuuggcaucuaggcaaacuugagauggacuucgauuuuugugacgguacuacaguaauaguuacggaagauugcgguaaccguggaccaucacugcgaacaacaacagcaucuggcaaauugauuaccgaaugguguuguaggucguguacguuaccuccauugagauaucguggcgaggacgguugcugguauggaauggaaauaagaccccuuaaggaaaaggaggaaaaccuuguaaauucauuagugacggcaggccacggacaagucgacaauuucucauuagguguauuaggaauggcucuauuuuuagaagaaaugcuuaggacucgaguaggaacaaaacacgcuauauuacugguugccgucagcuucgugacccuuauaacuggaaauaugucauucaaggauuuggggagaguaguuguuauggucggugcggcaauggcagacgacauaggaaugggaguaacauaccuagcauuacuugcagcauuuaaagugagaccgacauucgcagcaggacucuuauugcgaaaacucacaucuaaagaacuaaugaugacuacaauagguauaguuuuauugucgcaaucgaccauuccggaaacugugcuugaauuaacagaugcauuggcacuaggcaugauggucuuaaagauuguccguaauauggaaaaauaccaauuggcuguaacgauaauggcuauuuuaugugucccaaaugcggugauccugcaaaacgcuuggaaaguuagcugcacuauacuagccguagugucuguaagcccauuacuacuuacauccucacagcagaaaacagauuggauaccguuagccuugacuauuaaaggucuaaacccaacugcuauauuuuuaacuacauugagucguacgaauaagaaaagaucauggccauuaaaugaagcuauaauggcaguagguaugguauccauauuagcauccucguugcuuaaaaaugauauuccuaugacuggaccauuaguggcaggggguuuauuaacaguuugcuauguuuuaacaggaaggagcgcggaccuagaauuagagcgagcaacugacguaaaaugggaagaucaagcagaaauuucuggaucgucaccaauacuaucaauuaccauauccgaagacgguucuaugucuaucaaaaacgaggaagaagaacaaacuuuaacuauacuuauaagaacuggucugcuagucauaagugguuuauuuccgauuaguauaccuauuacggcagcagcuugguacuuaugggagguuaagaaacagcgugccggugugcuuugggacguacccucgccgccuccuaugggaaaggcggaauuagaagacggagcuuauaggauaaagcaaaaagguauuuuagguuacucgcaaauaggagccggugucuacaaagaaggcacuuuucacaccauguggcacguuacucguggggcaguccucaugcauaaaggaaaacguaucgagccgaguugggcggauguuaagaaagaucuaauuaguuauggagguggcuggaaauuagagggggaauggaaagaaggggaggagguccagguauuggcacuagaaccuggcaaaaaccccagggcaguccaaacgaaaccagggcuauucaaaacuaauaccggaacaauuggcgcugucaguuuagauuuuagccccgguacaucugguucaccaauuaucgacaagaaaggaaaggucguaggguuauauggaaauggaguugugacucggagcggggcauacgugagcgcaauugcucaaacugagaaaaguauagaagauaauccagagauagaagaugauauuuuccgaaaacgccgacucacuauuauggaccuacacccaggagcaggcaaaacuaagagauauuuaccagcuauuguacgugaagcaauuaaaaggggucuaagaacguuaauccuagcccccacaagagucguagcagcagaaauggaagaggcacuccguggucucccgauaagauaucaaaccccugcaauuagggcagagcauacggggagagaaauuguagaccuaaugugucacgcgacauuuacaaugcgccuguugucgccuguucguguuccaaacuacaauuugauuauaauggacgaagcccacuuuaccgauccugccagcaucgcggcuagaggcuauauaucaacaagaguggaaaugggagaagcagcaggaauauuuaugaccgccacaccaccaggcucccgugauccuuuuccucaaucuaaugcccccauaauagaugaagaacgagagauuccggagcgaagcuggaacaguggucacgagugggugacagauuucaaagguaagacugugugguuuguuccaucaauuaaggcggguaacgauauagcugcauguuugaggaaaaacgguaagaaaguaauacaacuaucgaggaagacauuugauagcgaauaugucaaaacacgaacaaaugauugggauuuugucguuacuacggauaucagugaaaugggagcgaauuucaaagcggaaagaguuauugacccacgucgauguaugaagccggucauuuugacagacggggaagaaagaguaauacuagcaggcccaaugccaguaacacacaguucagcugcacagcguagaggucguauaggaaggaacccgaaaaaugaaaaugaucaauacauuuauaugggugagccuuuagaaaaugaugaagacugugcacacuggaaagaagcgaaaaugcuauuagacaauauaaauacgccggaagguauaauaccuucaauguuugaaccagaacgagaaaaagucgacgcaauagauggagaauacagauuaagaggagaagcucguaagacauuuguagacuuaaugcguagaggagacuuaccaguuuggcuugcuuacaaaguagcugcagaaggaauuaauuaugcugauaggcguuggugcuuugaugguaucaagaauaaucaaaucuuagaagagaauguugaaguggagauuuggacaaaggaaggagaaaggaagaaauuaaaaccgagauggcuugaugcucgaauuuauucugauccuuuagcacuuaaagaauuuaaagaauuugcugcuggccgaaaaucguuaacauuaaaucuaauaaccgaaauggggagacucccgacuuuuaugacacaaaagaccagggacgcuuuggauaaccucgcgguacuacacacggcugaagcaggcggccgugccuacaaccaugcuuugagcgaacugccugaaacucuggaaacgcuuuugcuccuaacucuauuagcaacugucacgggaggaaucuuucuauuccuuauguccgguagagggauuggcaagaugacccuuggcauguguugcaucaucacugcaucaauacuacuaugguacgcgcaaauucagccgcauuggaucgcagcgucuauaauacuagaguucuuucuaauagugcuccuuauaccugaaccugagaagcaacguacaccucaggacaaucaauuaacuuacguuguaauagccauauugaccguaguagcagccaccauggcuaacgaaauggguuuucucgagaaaacaaagaaagauuuuggucuagguucuaucgcaacccagcaaccugaguccaacauuuuagacauugaccucagaccugccucggcuuggacacuuuacgcaguagcuaccaccuuuguaaccccaaugcuaagacacaguauugaaaauucuuccguaaacgugucauuaacggcuauugcuaaucaggcaacggucuuaaugggucuuggcaaaggguggccguuaucaaagauggacauaggaguaccauugcuagcaauuggaugcuauucacaagugaaucccaucacacucacagccgcccuauuacuauuagucgcacauuaugcgaucaucggucccggacuacaggcaaaggcuacuagagaagcacaaaaacgagccgcugcaggaauaaugaaaaauccuacgguagacggcauaacaguaauagauuuagacccaauacccuaugauccgaaguuugaaaagcaauuagggcaagucauguuguuaauucuuugcguuacucaaguacucaugaugcguaccaccugggcucuaugugaggcuuugacauuagccaccgggccaauaaguacauuaugggaagggaacccuggaagauuuuggaacacaacaauagccguuuccauggcaaacauauucagagggaguuaccuagccggugcaggccuuuuguuuuccauuaugaaaaauaccacuaacacucggcgagggaccgguaacauaggagaaacacuaggagagaaauggaaaucgcguuugaaugcauuaggaaagagcgaauuucagaccuauaagaaaucuggcauacaggagguugauagaacuuuagcaaaggaagggauaaagagaggggaaaccgaccaucaugcaguuucucguggaagugcaaaacuacgaugguuugucgaacguaacaugguaacaccagagggcaaaguggucgacuuaggcuguggaagaggagguuggucuuauuauugcgguggucugaagaauguaagagaggugaaaggacuaacgaaaggaggaccaggucaugaagaaccgauaccaaugaguacauauggauggaacuuaguaaggcuacaaaguggcguagacguauucuuuauuccaccugaaaagugugacacacuuuuaugugacauaggggaaucgucaccgaauccgacuguggaagccggacgaacccuaagagugcuaaacuuaguggaaaacuggcuuaauaacaauacacaguuuuguauaaagguuuugaauccuuacaugccuuccguaauagagaagauggaggcuuuacaacguaaguacggaggagcguugguuagaaauccuuuauccaggaauaguacccaugaaauguauuggguauccaacgcuucaggcaacaucguuuccucagucaauaugaucucacguauguuaauaaaucgguuuacaaugaggcauaagaaagccacauacgaaccugacguggauuuagguaguggaacuagaaauauaggaauugaaagugaaauuccuaaucuagauauaauuggaaaaagaauagagaaaauuaaacaggaacaugaaacaucuuggcacuacgaccaagaccaccccuauaaaacgugggcauaucauggaagcuacgaaacaaaacaaacagguagcgccucaaguaugguaaauggcguggugcguuugcuaaccaaacccugggaugugcuccccacggucacacaaauggcuaugacagauacaaccccguuuggucaacaaagagucuuuaaagaaaaagucgauacucggacacaagaaccuaaagaagggaccaaaaagcuaaugaagauaacagcggaaugguuauggaaagaguuagguaagaagaaaacaccacgaaugugcacacgcgaagaguuuacuaggaaggugcguuccaacgcugccuuaggagcaauuuuuacagaugaaaauaaauggaagucagcaagggaagcuguagaagauagccguuucugggagcuaguggauaaagaaagaaauuuacauuuggaaggaaaaugcgagacuugcguauacaacaugauggguaaaagagaaaagaaacucggugaauuugguaaagcaaaaggaucaagagcgaucugguacaugugguuaggugcucgcuucuuggaguucgaagcgcuuggguuuuugaaugaagaucauugguucucgagagagaauagucucucagguguagaaggugagggauuacauaaauuaggauacauacuccgggaugugaguaagaaagaagggggagcaauguacgcagaugacaccgcugggugggauacccguauuacuuuagaagacuuaaagaaugaagaaaugguuacaaaucauauggagggggaacacaagaaauuagccgaagccaucuuuaaauuaacuuaucagaauaagguaguacggguacaacgaccgacuccccguggaacgguuauggauauuaucaguagacgagaccagagagguuccggccaaguaggaacguacggacugaauacguuuacaaauauggaagcucaacuaauaagacaaauggaaggagaggguguuuucaagaacauacaacaucuaacggucacagaagaaguugcaguucaaaauugguuggcaagaguaggaagggaaagauuaagccgcauggcuauuagcggcgaugauugcguugugaaaccucucgaugacagauuugccaacgcacuaacugcucugaacgauaugggaaagaucagaaaagauauccaacagugggaacccucuaaaggcuggaaugauuggacucaagugccauuuuguucccaucacuuucacgaacuaaucaugaaagauggccgaguuuuaguaguccccuguaggaaccaagaugaacuaauuggacgagcacggauuucacagggcgcaggguggucuuuaagagaaacggccugucuagggaaaucuuaugcucaaauguggagucuaauguauuuucacagaagggauuugagacucgcugccaaugcaauauguucagccgucccaagucauugggucccgacaagucgaacgacauggucaauacaugccaagcaugaauggaugacuaccgaggacauguugaccguuuggaaccgcguauggauacgugaaaacccauggauggaagauaagacacccgucgaaaguugggaagaaaucccuuacuuaggaaaacgagaagaccaauggugugguagccuaauaggucuaacaucucgagcaacaugggcuaaaaacauucaagcggcaauaaaccaaguucggucucuaauaggaaacgaagaauacacagauuauaugcccucgaugaaacgguuucggagagaggaggaagaagcagggguucugugguga

SEQ ID NO: 22706 - RNA, 9876 nt, Artificial Sequence
  derived and/or modified CDS sequence (opt6) from DENV-2__FJ461309__SS-prME
uccgcugggaugauuauuauguuaauuccuacuguaauggcauuucauuugacaacgcgaaacggggaaccacacaugauaguagggauacaagaaaaagggaaaucguuauuauuuaaaacggaagacggcgugaauauguguacguuaauggccauggauuuaggcgaauuaugugaagacacaauuacguacaaauguccucuuuuacgucaaaacgaaccugaagauauugacuguuggugcaauucaacaaguacauggguaacauauggaacuugcacaacaaccggggaacaccgccgagagaaacgaucuguagcauuaguaccccauguaggaaugggcuuagaaacuagaacugaaacauggaugaguuccgaaggcgcauggaaacacgcacaaaggauugaaacguggauucugagacaucccggauuuacaauaauggcggcuauacuagcauacacgauagguacuacucacuuucaacguguacuuauuuuuauacuuuugacugcuguagcgccaucaaugacaaugcgcuguauaggaauuuccaauagggauuuuguggaagggguuucagguggaaguuggguagacaucguccuagaacaugggaguuguguuaccacaauggcuaaaaauaaacccacuuuggauuucgaacugauaaaaaccgaagccaaacaaccggcaacucuccgcaaauacugcauagaagcuaaauuaacuaauacgacuacagagucacggugcccaacccagggugaacccucuuuaaaagaggaacaagauaaaagguuuguuuguaaacacucaaugguggauaggggcuggggcaacggguguggucuuuuugguaaaggaggaauaguuacaugugcaauguuuacauguaagaaaaacauggaggggaaaauagugcaacccgaaaaucuagaauacaccauaguuguuacuccucauaguggagaagaacacgcuguaggaaacgacacugguaaacaugggcaggaaauaaaaguaaccccacagucaaguauaacggaagccgaacuuaccgguuauggaaccguaacaauggaauguucaccaagaacaggucuagacuuuaaugaaaugguucuuuuacaaauggaaaauaaagccugguuaguccaccggcagugguuucuagaucuaccucuaccguggcuaccaggcgcggacaaacaggaaucgaacuggauacagaaagagacucucguaacauuuaaaaacccacaugcuaagaaacaagauguaguaguguuagguucgcaagaaggagccaugcauaccgcgcucaccggagcgacagagauacaaaugucuagcggaaaucuacucuucacggggcaccuuaaaugcagacuucguauggauaaacuacaauuaaaaggaaugagcuauucuauguguaccgguaaauuuaaaguuguaaaagaaauagcagagacucaacaugggacaauuguaaucagagugcaauacgaaggggauggcucaccaugcaaaaucccguuugaaauaauggauuuggaaaaacgcuauguacuuggacgucuuaucacagucaauccaauaguuacagaaaaagacaguccaguuaacauagaagcggaaccacccuucggcgauucuuacauaauuauuggaguagaaccaggacaacucaaacuaaauugguuuaagaaaggcaguucaauaggacagauguuugagacgacaaugagaggggcaaaaagaauggcuaucuuaggugacaccgcaugggacuucggaucacuuggaggaguauuuacaagcauuggcaaagcacuacaccaaguuuucggcgcuauauacggagccgcuuuuagcgggguaucauggacaaugaaaauauuaaucgggguaaucauuacauggauagggaugaacucgagaucgacuucguuaucaguuucacucguauuaguaggaauaguuacauuguauuuaggagucaugguccaagcagauucaggcuguguuguuucguggaaaaacaaagaacuuaaaugugguagcggaauauucauaacugacaacguacacacguggacagagcaguauaaauuccaaccagagucaccaucgaaguuagcgucagcuauacaaaaagcacaagaagaagggauaugugguauacgaaguguaacacgacuagagaacuuaauguggaagcaaauaacuccggaauugaaucacauccuggccgaaaacgaggucaaacuaacuaucaugacuggugacauaaaagguauuaugcaggcggguaagagaucccuuagaccacaaccgacagaauuaaaauauaguuggaaaacaugggggaaagcaaaaauguuaucaacggaaagcuauaaccagacguucuuaaucgaugguccugaaaccgcagaaugcccuaauacuaaucgcgcauggaacagucuugagguagaagacuauggguuuggaguauuuacgacuaacauuuggcucaaacuaaaagaaaaacaagaugccuuuugcgacagcaaauuaauguccgcagccauaaaagacaaccgagcuguacaugcagauauggguuauuggauagaaucggcauuaaacgauacguggaaaauagaaaaagccucuuuuaucgaagucaaaaauugucauuggccgaaaucacauacauuguggucgaaugggguauuagaaucagaaaugaucauaccaaagaaucucgccgggccagugucccagcauaacuauagacccggauaucauacucaaauagcuggcccauggcaccucggaaagcuagaaauggauuucgauuuuugugaugggaccacagucauaguaacagaagacugcgggaaucgugggccuagcuuaaggacaacuacagcuagcggaaaacugauaacagaaugguguuguaggaguugcacccuaccgccguuacgauacagaggagaagauggcugcugguacgggauggagauacgaccacucaaggaaaaagaagaaaaccucgucaauucucuaguaaccgccggccauggccaagucgauaacuuuucacuggguguauuaggcauggcacuauucuuagaagaaaugcuuaaaacucgaguugggacuaaacacgcaauacuuuugguagccguaaguuuuguuacauugaucaccggaaauauguccuucaaagaucuaggacgagugguugucaugguaggcgcaacuauggcggaugacaucgguauggggguaacguacuuagcgcugcuagcagcuuucaaaguacgucccaccuuugcugcaggauuacuucuaaggaaacuaacaagcaaagaauuaaugaugacaacaauuggaauaguuuuacuaucucaaaguacaaucccagaaacuguucuagaauugacugacgccuuagcucucggaaugaugguguuaaagaucguacgaaauauggaaaaguaccaauuggcgguuacuauuauggcaauauuauguguuccaaaugcuguaaucuuacaaaacgcauggaaggugucauguacgauuuuagcuguuguaucaguuucacccuuauuauuaacaucaagucaacagaaaacggacuggauaccguuagcccuuacuaucaaaggccuuaacccgacugcuauauucuuaacaacccuaucacguaccaacaagaaaaggucauggccccuaaaugaagccauuauggcuguaggaauggucagcauauuagcaagcucacuacuaaagaaugauauaccaaugacaggaccguuaguggcuggugggcuucugacagucuguuacguacugacgggaagaucagcagaccuggaacuggaaagagcgacagauguuaaaugggaagaucaggccgaaauuagcggcaguucaccaaucuugucaauuacaauaucugaggacgguaguaugucgaucaaaaaugaagaagaagaacaaacacugaccauacuuauaagaacaggguuguuaguaauaaguggucuguuccccauuucgauacccauuacagcggcagccugguacuugugggaaguaaagaagcaacgugcgggcguauuaugggacguuccaagcccuccgccaaugggaaaggcagagcuagaggacggugccuacagaaucaagcaaaaagguauccugggauacagccaaaucggugccgggguguauaaggaaggaaccuuccacacuauguggcacguaacgagaggugcaguguuaaugcacaaaggcaagaggauugaaccaucaugggccgacgucaagaaagaucugauaucuuaugggggugguuggaaacucgaaggagaauggaaagaaggagaggaaguacaaguacuagcacuugaacccgguaagaacccacgagcgguacaaacuaagccaggacuauuuaaaacaaacacuggaaccauaggagcuguaucuuuagauuuuuccccagggacaucaggaagcccaauuauagacaagaaagguaaagucguaggauuguauggaaauggugucgucacaagaucaggugcguaugucagugcaauagcacagaccgagaaaaguauugaggauaauccagaaauagaagacgacauauuuagaaaaagaaggcuuacaaucauggaucugcauccuggugcugguaaaacuaaacgcuacuuaccugcaaucguaagggaagcaaucaagagaggucugaggacauuaauacuagcaccgacgcgagugguggcagcagaaauggaagaagcucucagaggauuaccaauucgguaccagacuccugcuauacgugcagagcauacaggucgggaaaucguugauuugaugugccaugcaaccuuuacaaugagauuacucucgccaguucgcguuccaaauuauaaucuuauaauuauggacgaagcacauuuuacggauccagcgucaaucgcagcaagaggauauauaucaacucgaguugaaaugggagaggccgcgggaauuuuuaugacugcaacgccaccagggagccgugacccuuuuccacaaucaaacgcaccaauuauugaugaggaaagagaaaucccugagagaaguuggaacagcggccacgaauggguaacugauuuuaaaggaaaaacgguaugguucgucccaucuauaaaggccggcaaugauauagcagcuugucucaggaaaaaugguaaaaagguuauacaauugagccguaagacauuugauagcgaauaugucaaaacacguacaaaugauugggauuuuguagugacaacggauauaagcgaaaugggagcaaacuucaaagcagaaagggucauagauccgagacguugcaugaagcccgugauucucacagauggcgaagagagagucauauuggcggggccuaugccgguaacacauuccucagcggcacaaagaagaggcagaaucgggagaaaccccaaaaaugaaaaugaucaauauaucuauaugggggaaccauuagaaaacgaugaggauugugcacacuggaaagaagcgaagaugcuacuugacaauaucaauacaccugaagggauuauaccaaguauguucgaaccugaacgagagaaaguugacgcaauagacggagaauauaggcugaggggcgaagcuagaaaaacguuuguagaucuuaugcgccguggugauuuaccaguuuggcuggcauauaaagucgcugcugaaggaauaaauuacgcagauagacggugguguuuugacggaaucaaaaauaaucagauauuggaggagaacguugaaguugaaauuuggacaaaagaaggcgaaagaaagaaacuaaagccgagguggcuagaugcccgcauauacucugauccacuagcacucaaagaguucaaagaauuugcagcuggacggaaaagucuaacucucaaccuaauaacagagaugggaagauuaccaacauuuaugacacagaaaacuagagacgcucuugauaaccuagcagugcuucauaccgcagaagcugguggucgggcuuacaaucaugcacuaagugaacucccggaaacguuggaaacccuauugcuuuuaacauuacuagcaacuguaacggguggaauauuuuuauuucuuaugucaggaagaggaaucggcaaaaugacucugggaauguguuguauuaucacagcuucgauccuauuaugguacgcacaaauucagccacacuggauagccgcaucgauaauucuggaauuuuucuugauaguauuauuaauaccagaaccagaaaagcagagaacuccgcaggacaaccaauuaacuuacguaguaauugcuauccuaacuguuguagcagccacuauggcaaacgagaugggauucuuggagaaaacuaagaaagauuugggucuuggcucaauagcaacacagcaaccugaaagcaauauauuagauauagaccuucgaccugcuagugcuuggacacuguaugcgguggcuacaacauucgucacgccgauguugcgucauucaauagaaaauuccagugugaauguuucccuaacagcaaucgcgaaucaagcuacgguacuuaugggacuagggaaaggguggccauugaguaaaauggacauaggugucccgcuacuagcuauaggauguuacagccaagucaacccuauaacuuuaaccgcagcacuucugcuauuaguagcgcacuacgcaaucauagguccgggacuacaagcgaaagcgacccgagaagcacagaaaagagccgcagcggggauuaugaaaaauccgacgguggauggcaucaccguuauugauuuagauccgauaccuuacgacccaaaguucgaaaaacaguuaggucagguaaugcuauugaucuuauguguaacacagguacuaaugaugagaacaacaugggcauuaugugaggcguuaacgcuggcaacuggccccaucaguacgcuaugggaaggaaaucccggacgcuucuggaacacuacuaucgcgguaucaauggcuaauauuuuccgugguucuuacuuagcaggggcaggcuuauuauucaguauaaugaagaacacaacuaauacgcgaagaggaacgggcaacaugggcgaaaccuugggugagaaauggaaaucacgucuuaacgccuuaggaaagagugaauuucaaaucuauaagaaaaguggaauccaagaaguagacaggacccuugccaaagaaggaauaaaacguggugagacagaccaccacgcugucagccguggaagugccaaacuacgaugguucguagaaagaaacaugguaacacccgaagguaaaguuguugaucugggcuguggacguggaggauggucguacuauuguggagguuugaaaaacguacgcgaaguuaaaggccugacuaaaggagggccuggacaugaagaacccauuccgaugagcaccuauggauggaauuuagucagauugcaaagcggaguagacgucuucuuuaucccaccagaaaagugugauacacuguuaugcgauauuggugaauccagccccaauccuacuguugaagcaggaagaacauuaaggguccuaaauuuaguagaaaacugguugaauaauaacacucaguucuguauaaaaguuuuaaauccauauaugccuucagucaucgagaaaauggaagcacugcaacguaaauaugggggugcucuuguucgcaauccauuaucacgaaauucaacgcacgagauguauuggguaucaaacgcaaguggaaauaucgugagcucugugaacaugauuucaagaaugcugauuaaucguuuuacuaugagacacaagaaagcaacauacgaacccgauguggauuuaggaucugguacccgaaacauuggaauagaaucagaaaucccaaaccuagauaucaucgguaagagaauagaaaagauaaaacaagaacacgagaccaguuggcacuacgaucaggaucacccauacaagaccugggcuuaucacggaucauaugaaaccaaacaaacgggaagugcuagcucaaugguaaaugguguugugcguuuauugaccaaaccaugggauguccucccgacugugacucaaauggccaugacagauacaaccccauucggccaacagagaguguucaaagaaaagguagauacaagaacacaagaaccuaaagagggaacgaagaaacuaaugaaaauaacggcagaauggcuuuggaaagaguuggguaagaagaaaacgccaaggaugugcacgcgggaggaauuuacuagaaaaguaagaaguaaugcagcauuaggagcaauauucaccgaugaaaacaaauggaagucagcuagagaagcggucgaggacggaagauuuugggaacuggucgauaaggaaagaaaucuacaccuagaggguaaaugcgaaacaugugucuauaauaugauggguaagcgggaaaagaaauugggagaauuuggaaaagcaaaagggagccgagcaauaugguacaugugguuaggcgcuagauuccuagaguuugaagcacugggcuuucuaaaugaggaucauugguucuccagggaaaacucauugucgggagucgaaggagagggucuccacaaauuaggguauauccucagagauguuagcaagaaagaaggaggggcuauguacgcagacgauacagcuggaugggauacaagaauaacucuagaagauuugaaaaacgaagaaaugguaaccaaucauauggaaggugaacauaagaaacuagcagaggcuauauucaaacuuacauaccagaauaaaguugugcgaguucagcguccaacaccaagaggaaccguaauggauauuaucucacgacgagaucaacguggaucgggccaaguggguacguaugguuuaaacacuuucaccaacauggaggcucagcuaauacgacaaauggagggggagggaguuuuuaagaauauccagcauuuaacgguaacggaagagguggccguacaaaacuggcuugcuaggguaggaagagagcgauugagcagaauggcaauuagcggggaugacugcgucguuaaaccacuggacgaucguuucgcaaaugcauugacugcauugaaugauauggggaagauaagaaaggacauacaacaaugggaaccgucaaagggcuggaaugauuggacucagguaccuuuuugcagccaucauuuccaugaauuaauuaugaaagaugggagaguauugguagugccauguagaaaucaggacgaauuaauaggccgagcuagaaucagccaaggcgcaggaugguccuuaagggaaacagcuuguuuaggaaagaguuacgcucaaauguggagccucauguauuuccauagacgagaccuaagacuagccgcgaacgcaauuugcucugccgugcccucacacuggguaccaaccucgagaacaacauggaguauucacgccaaacaugaguggaugacuacagaagacauguuaacugucuggaaucguguuuggauccgagaaaacccguggauggaggacaaaacucccguagaaucaugggaagagauacccuauuuaggaaaaagagaagaccaguggugcggaagucuuauaggucucacgagcagagcgaccugggcgaagaauauucaagcagcaauaaaucaaguacguucuuuaauuggcaaugaagaguacacugauuauaugccgagcaugaaacgcuuucggagagaggaagaagaagcugggguuuugugguaa

SEQ ID NO: 22707 - RNA, 9876 nt, Artificial Sequence
  derived and/or modified CDS sequence (opt6) from DENV-2__FJ461311__SS-prME
ucggcaggaaugauuauaaugcuaauuccuacaguuauggcauuccaucuuacgacucgcaauggagaaccacauaugaucguggggauucaagaaaaaggaaaaagucuucuauucaaaacggaagauggaguuaauauguguacucuaauggcaauggaucucggagaauuaugcgaagauacaauaacuuauaaauguccauugcuaagacaaaaugaaccagaagacaucgacuguugguguaauagcacuucaacauggguuaccuacggaacuugcacaacaacuggagaacaucgacgagaaaaacguuccguagcuuuaguaccucacguagggaugggguuagaaacacgaacagaaacauggaugucaagcgaaggugcauggaaacaugcgcaaaggauagaaacguggauauugagacauccaggauucacgaucauggcugccauuuuagcauauacgauagguaccacacauuuucaacgaguauuaauauuuauccuucucacugcaguagcgccaucaaugaccaugcguuguauaggaauuaguaaucgagacuuuguagaaggcguuucuggggguuccuggguagacauuguucucgaacauggcucuugcguaacaacaauggccaaaaacaaaccaacauuagauuuugaacugauaaaaacugaagcaaagcaaccggcuacuuugagaaaauauuguaucgaagccaagcuaaccaauacaacaaccgaaucaagaugcccaacucaaggagaaccgagcuuaaaggaggagcaagacaaacguuucgugugcaaacacucuaugguagauaggggaugggguaaugguuguggacuauucggcaaaggcgguaucgugaccugugcaauguuuacuugcaaaaagaauauggaagguaagaucguacaaccagagaaccuagaauauacaauagucguaacaccgcauucaggugaagaacaugcuguuggcaaugacaccgguaaacauggccaagaaauaaaaguaacuccacaaucgaguauaacugaagccgaauugacuggcuaugggacagucacuauggaauguaguccacguaccggacucgacuuuaacgaaaugguuuugcuacaaauggaaaauaaagcauggcuggugcaucgucagugguuuuuggaucuuccccugccuugguuaccaggcgccgauaaacaggaaucaaauuggauucaaaaagaaacccucguaaccuuuaaaaauccacaugccaagaaacaagaugucgugguccucggcagucaagaaggugccaugcacacggcucuuacaggugcgacugagauacaaaugucauccggcaaucuuuuguuuacuggccaccuaaagugucguuuaagaauggauaaacuccaacuuaaagguaugaguuauuccaugugcacaggcaaauucaaagucguuaaggaaauugcugaaacacaacaugguacuauugucauaagaguccaauacgaaggugauggaaguccguguaaaaucccauuugaaauaauggauuuagagaaaagauacguucucgguagguuaaucacugucaaucccauaguaacagagaaggacucaccagucaauauagaagcggaaccuccuuuuggggacaguuacaucauuauuggagucgaaccaggccaacuuaaauuaaauugguuuaagaaagguucuucuauuggucagauguuugaaacaacuaugaggggagcaaagcguauggcaauacuaggggauacagcaugggauuuugguucccuuggcggaguauuuacauccauaggaaaagcguuacaccaaguguuuggagcaauauauggugccgcguuuucagguguaucauggacuaugaaaauuuuaauuggagucaucauuacuuggauaggaaugaacucgagaagcacaucauuauccgugagucuaguauuaguaggcauagucacucuguauuuaggagugaugguacaagcagacagcggcugcgucgucucauggaaaaacaaagagcuaaaguguggaagcgggauauuuaucaccgacaaugugcacacauggaccgaacaauauaaauuucaaccggaaucgcccaguaaauuagcgagugcaauacagaaagcucaagaagaagguauaugcggcauaaggucaguuacuagauuagaaaauuuaauguggaaacaaaucaccccugaacuuaaccauauauuagcagaaaaugaaguaaaguugacuauaaugacgggugacauuaaagggauaaugcaagcggguaaaagaagucuacgaccacaaccaacagagcucaaauacaguuggaaaacuuggggaaaagcgaaaauguugucaacggaaucauacaaucaaacguucuuaauugaugguccagagacugccgaaugcccaaauacuaacagagcuuggaacucauuggagguugaggacuauggguuugguguuuucacuacaaauauauggcuuaaguuaaaagaaaaacaggacgcuuuuugcgauagcaaguugaugucugcugcuaucaaggauaacagagcgguucacgcagauaugggauauuggauagaaagugcauuaaacgacacauggaaaauagaaaaagccagcuucauagaaguaaagaacugccauuggccaaaaucgcauacauuauggucuaacggcguuuuagaauccgaaaugauaauaccgaaaaaucucgcgggcccagugucucaacacaacuaucggccaggguaccacacgcagauagcaggaccauggcauuuaggcaaacuugaaauggacuucaauuucugugaugggacuacugugaucguaacagaggacugcgguaaucggggaccuaguuugagaacgacaacagccucagguaaacuaauuacggaauggugcuguagaaguugcacacuaccaccccuccguuauaggggagaagauggcuguugguacggaauggagauacguccauugaaggaaaaggaagagaauuuaguaaauucauuaguuacugccggccauggacaaguggauaacuuuuccuuaggaguacuugguauggcauuauuucuagaagaaaugcuuagaacaagaguugguacaaagcaugccauacugcuaguugcuguaucauuuguaacacuuauaacgggaaauaugaguuuuaaggauuuagguagagucguagucaugguuggcgccacgaugaccgacgacauagggaugggagugacuuaccuugccuuauuagccgcguucaaaguacguccgacuuucgcagcgggauuguuguuacgcaaauuaacaaguaaggaguugaugaugacaacaaucggcaucguguuguuaucucagagcacgauacccgaaacuguacucgaguuaacggaugcacuugcgcuaggcaugaugguacuaaaaauaguaagaaacauggagaaauaccaguuagccguuacuauuauggcgauacucugcguaccaaaugcuguuauauugcagaaugcguggaaaguuucuugcacgauacuagcugucguauccguaucuccauuacucuuaacaucaucccaacagaaaacagauuggauaccuuuagcauuaacuauuaagggucucaauccuacagcaauauuucucacuacgcuuucacgcacaaacaagaaacggaguuggccgcuuaacgaggcaauaauggcaguaggcauggugaguauacuagcgucuagucuacucaaaaaugauauaccaaugacugggccuuuaguugcaggcggacuauugacaguauguuaugugcuaacugggagaagugcagaucuugagcuagagagagcuaccgaugugaaaugggaagaccaagcugagauaagcggaucauccccuauucuuuccauaacaauaagcgaagaugguuccaugaguaucaaaaaugaggaagaagaacaaaccuugacaauauuaauaaggacggguuuauugguaaucagugguuuauuuccuauuucaauaccuauaacagcagcagcaugguaucuuugggaagugaagaaacaaagagccggcgucuuaugggacgugccgucaccaccaccuaugggaaaggcagagcuugaagacggugccuacagaauaaaacaaaaagguauacucggguacagucagauuggagcugggguauauaaagaagguaccuuucauacuauguggcacguuacccgaggagcaguuuugaugcauaaaggaaaaaggauagaaccguccugggccgacgucaagaaagauuuaauaaguuacggcggaggauggaaguuagaaggggaauggaaagaaggagaagaaguacagguccuagcauuagaaccagguaaaaacccccgagcagugcaaacaaagccaggcuuauuuaaaacaaacacagggaccauaggagcuguaucccuagacuuuucaccagguacaucuggcucuccaauaauagauaagaaggguaagguuguaggguuauauggcaauggcguagucacuagaucuggagcauacguaagugcuauagcccaaaccgagaaaagcauagaagacaauccagaaauagaagaugacauauuccgcaaacgacgauuaacaauaauggaccuacauccuggcgcuggaaaaacuaagcgcuacuuaccugcuauuguaagagaggcaauaaaaagaggacuaagaacucucauacucgcaccuacuagaguaguagccgcggaaauggaagaggcauuaagaggacuccccauacgguaccaaacgccagcuauuagagcagagcacacaggacgagaaauaguagaucuaaugugucaugcuaccuuuacuaugagauuauuaaguccaguaaggguaccgaauuauaaccuuauaaucauggaugaggcacauuucacugaucccgcaaguauugccgcgcgcggauauauaucgacccguguagaaaugggagaagcagcggguauauuuaugacugcuaccccgcccggaagucgggauccguuuccgcaaucuaacgcaccuauaaucgaugaagagagagagauacccgagaggagcuggaacaguggccacgaauggguuaccgauuucaaagguaagacgguuugguuuguuccaaguauaaaagcugggaacgauaucgccgccuguuugaggaaaaacgguaaaaagguaauacagcuuagucgcaaaacuuucgauagcgaauauguaaaaacgagaacuaaugacugggacuuuguuguuacaacggauauaucugaaaugggcgcuaauuuuaaagcggaacgcguaauugauccaagaagauguaugaaaccaguaauccuuacugauggagaagagagggugauucuagcaggaccaaugccuguaacccacuccucagcagcgcaaagacgagguagaauaggacgcaaccccaaaaaugagaaugaccaauauauuuacaugggggagccccuagagaaugacgaagauugugcacacuggaaagaagcaaagaugcugcuugauaacauuaacacaccugaggguaucauaccaaguauguucgaacccgagcgagaaaaaguugacgccaucgauggcgaauaccgucuaaggggugaggcacgaaagacauuuguagaucuaaugagaagaggcgauuugccgguguggcuggcauacaaaguggcagcagaagguaucaacuaugcagauagacgaugguguuucgacggaauuaaaaacaaccaaauauuagaagagaacauggaagucgaaauauggacuaaggaaggagagaggaagaaauuaaagccacguugguuggaugccagaauuuauucagacccacuugcgcucaaggaguuuaaggaauuugcagcgggucgaaaaagucuaacguuaaacuuaaucacggaaaugggacgucugccaacauuuaugacucagaaaacucgggacgcccucgauaauuuagcaguguuacacacagccgaggcugggggcagagcuuauaaucaugcauuaucagaacuuccagagacccuugagaccuugcuacugcuaacucuacuugcaaccguaaccggcgguauauuccuuuuucuuaugucuggucgagguaucggcaagaugacucuagguauguguugcaucauuacagccucaauacucuugugguacgcacaaauucaaccccauuggaucgcagccucaaucauacuugaguucuuccuuaucguacuuuuaauaccagaaccggagaaacaacguaccccacaggacaaucagcuaacguauguagucauagcuauuuuaacaguuguggcugcaacuauggcaaacgaaaugggguuccuagaaaagacaaagaaagaucuuggacuggguagcauugcuaccagacaaccagaaagcaauauauuggauauagaucucagaccagcaucagcguggacccucuaugcaguagcuacaacauuugugacucccaugcugagacacaguauagaaaauucgucuguaaauguaucucuaacagccaucgccaaucaagcaacaguacucaugggacuagguaaaggauggccacugucuaaaauggacauuggcguccccuugcuagcaauuggguguuacagccagguaaaccccauaacacuaaccgccgcacuauugcuauuaguagcacauuacgcaaucaucggacccgggcuccaggcuaaggcuacaagggaagcacaaaaacgagcagccgcuggcauuaugaagaauccuacagucgaugggauuacaguaauagacuuagaucccauaccauaugacccuaaguucgaaaagcaacugggacaaguaauguuacucguucuaugcguaacucaaguauuaaugaugaggacaacuugggcauugugugaagcucuaacacuagccacgggcccaauauccaccuugugggaaggcaauccaggcagauuuuggaauaccacaauagcugugagcauggccaauauauuuagaggaagcuaccuagcuggugcuggccuacuauuuucaauaaugaaaaauacaacuaacacaagaagggguacuggaaauaugggggaaacauuaggagagaaauggaaaucgcaguuaaaugcgcuuggaaaaucggaauuucagauuuauaagaaaucaggcauccaggaaguugauagaacacuugcgaaagaagguauaaaaagaggugaaacagaucaccaugcugucagucguggaagugcgaaacuucgaugguuuguagaacgcaacaugguaacuccugaagguaaaguuguugaucuagguugcgguaggggugguuggucauacuacuguggcggacucaaaaauguucgcgaaguaaagggucugaccaaaggaggaccuggccacgaagaaccaaucccuaugucaacauaugguuggaauuuaguuagacuucaaucaggaguagauguauuuuucauaccuccugaaaagugugacacacuauuaugugacauaggugaaucgucaccaaauccgaccguugaagcaggacgaacuuugagggucuuaaaccuaguagagaauuggcuaaacaauaauacacaauuuugcauaaaagugcugaaucccuauaugccaucugugaucgagaagauggaagcccuccaaaggaaauaugggggagcucuaguacguaauccacugucccgcaauaguacucacgaaauguauuggguaucuaacgcgagugguaauauagucaguucaguaaauaugauaaguagaaugcuaauaaaccguuuuaccaugcggcauaagaaagcaacauacgagcccgacguugaccucggcaguggcacccgaaauaucggaauugaaagugaaauaccaaacuuagacauaauuggcaaaaggauagagaaaauaaaacaggaacacgaaacuagcuggcacuaugaccaagaucauccauacaaaacuugggccuaccauggaucauacgaaaccaaacaaacggguucggcuucauccauggucaauggaguaguucgccuauuaaccaagccuugggauguguugccaacagucacucagauggcgaugacagacacaacucccuuuggucagcaacggguauuuaaagagaaaguagauacgagaacacaggaaccuaaagaaggaacgaaaaaguuaaugaaaauaacagcugaauggcuguggaaagaguuaggcaagaagaaaacgccaagaauguguacucgagaagaguucacaagaaaaguuagaagcaaugccgcacuaggagccauuuuuacagaugaaaacaaauggaaaucugcccgugaagcuguugaagauagccguuucugggaguuaguagacaaagaaagaaaccuccaucuagaagguaaaugcgaaacuugcguguauaacaugaugggaaaacgugagaagaaguuaggugaguucggaaaagccaagggcagccgcgcuauaugguauauguggcuaggagcgcguuuucuagaguucgaagccuuaggcuuucuuaacgaagaccauugguuuagcagggagaauagccuaaguggcguggaaggcgaagguuugcacaaacuuggauacauauugagagauguuagcaagaaagagggaggugcgauguacgcagacgacacggcaggaugggacaccagaauaacauuagaggaccucaaaaaugaagaaaugguaacuaaucauauggaaggagagcauaagaaacuagcugaagcaauauuuaagcuaacuuaccagaauaaagugguuaggguucaaagaccaacuccuagaggaacaguaauggauauaauuagucgccgugaccagcggggaucuggucaaguaggaacuuacggacuaaacaccuuuacuaacauggaggcccaguuaaucaggcagauggaaggagagggcguauucaaaaauauacaacaucuuacgguaacagaagagguagcagucaaaaauugguuggcccggguuggacgugaacgucugucgcgcauggcaauuuccggugacgauuguguugugaaacccuuggaugaucgcuuugcaaacgcacuaaccgcuuuaaaugauauggguaagauacgaaaggauauucaacaaugggagccuuccaagggguggaaugauuggacacaaguaccuuucuguucacaucacuuccaugagcucauaaugaaagacggacgcgugcuagucgugccauguagaaaccaagacgaacuuauugguagggcaagaauaucacagggugcgggguggucacuucgagaaaccgcuugcuuggggaaauccuaugcacaaauguggucacuaauguauuuucacagacgugauuuaagacuagcugccaacgccauuuguagcgcugugccaagucacuggguaccuacaucacgaacuacuuggucaauacacgccaagcaugaauggaugacaaccgaagacauguuaacaguauggaauagaguauggauaagggaaaauccauggauggaggacaagacuccugucgaaucgugggaagagaucccuuaucuaggaaaacgugaagaucaauggugcggcucuuuaauaggacuuacgagcagagcgacuugggcaaagaauauacaagcagcaauuaaccagguaaggucgcuaauuggaaaugaagaauauacggacuacaugccaucaaugaagagguucagaagggaagaagaggaagcagggguucuuugguag

SEQ ID NO: 22708 - RNA, 9876 nt, Artificial Sequence
  derived and/or modified CDS sequence (opt6) from DENV-2__FJ410217__SS-prME
ucagcagggaugauaaucaugcuuauuccaaccguaauggcguuucaccugaccacucguaauggagaaccucacaugauaguagguauucaagaaaaagggaaaucauuauuauucaaaacagaagaugguguaaauauguguacccuuauggcaauggaccucggagaauugugugaagauacaauuacuuacaaauguccauuauuacgccaaaaugaaccagaagauauagauugcuggugcaauaguacgaguacauggguaacauauggaacauguacuacaacuggcgaacaucgucgagaaaaacguagcguagcacuugugccgcauguugggaugggacuagaaacccguacagaaacguggaugucuagugaaggugcauggaaacacgcacaaaggauagaaacauggauuuuaagacauccuggguucacuaucauggcagcaauacuugcuuauacuauaggaaccacacauuuccaaagaguauugauauucauuuuauugacagcugucgcacccaguaugacgaugagauguaucgguaucagcaaucgagauuucguugaaggcguaagugggggcaguuggguagacauaguacuagagcaugguucguguguaaccacuauggcuaaaaacaaaccgacuuuagauuuugaauuaaucaaaaccgaagcuaaacaaccagcuaccuuaagaaaauacugcauagaggcuaaauuaaccaacacgacgacggaaaguagaugcccgacccaaggagaaccuucacugaaagaggaacaggauaaacgauucguauguaaacacuccaugguugauagaggaugggguaacggguguggucuuuuugggaaaggcggcaucgugacaugugcuauguucacauguaagaaaaacauggagggaaaaauaguacaaccagaaaaucuugaauacacaaucguaguaacaccacacagcggagaggaacaugccgucgggaaugacaccggcaaacaugggaaagaaaucaaaguaacaccacaguccuccauaacagaagccgagcuuacagguuauggaacugucacgauggaaugcucaccacggacgggacucgacuuuaaugaaaugguuuuacuccaaauggagaauaaagcaugguuaguccaccgacaaugguuccucgacuuacccuuaccaugguugcccggagcggauaaacaagaguccaacuggauacaaaaagaaaccuuaguaacuuucaaaaauccgcaugccaagaaacaggacguuguuguacuagggucucaggagggagcuaugcauacagcauugacgggcgccacugaaauacaaaugagcucagguaaucuucuuuuuacuggacacuuaaaaugucgguuaagaauggauaaacugcaacucaaagggaugucauacucuaugugcacaggaaaauuuaaaguaguaaaagaaauagcggaaacucaacacggaacaauaguaauuagaguacaauaugagggagacggcagcccaugcaaaauaccuuuugaaauaauggaucuugagaaacgauauguacuagggcguuuaauuacaguaaacccgauuguaaccgaaaaagacucgccugucaauauagaagcagaaccaccguuuggagacucauauauuaucauaggcguugaaccagggcaauuaaaacucaauugguuuaagaaaggguccucuauuggacagauguuugaaacaaccaugaggggugcuaaacgaauggcaauuuuaggggauacagcaugggauuuuggaagucuaggagggguauucacgaguauagguaaagcacugcaucaaguauuuggugcuauauacggugcagcuuuuucaggcguuucauggacuaugaaaauucuaauuggagugauaaucacguggauagggaugaacucuagaaguacaucguuaucaguuagucuaguguuagugggaauuguaacucucuaucuaggcgugauggugcaggcagacucgggaugcauagugagcuggaaaaauaaagaacuaaaaugugguucaggcauuuuuguaacagacaaugugcauacauggacugaacaauacaaguuccaacccgaaucaccaaguaaacuagcaucagcaauucaaaaagcacaagaagagggaauaugugggauacgaucaguaacacgcuuggaaaaccugauguggaaacaaauuaccccggaauugaaccauauauuagccgaaaaugagguaaagcucaccauuaugacaggugauauaaaagguaucaugcaagcagguaaaaggucauugcggccccaaccuaccgaacuaaaguacuccuggaaaaccugggguaaggcgaagaugcucaguacagaaagucauaaucaaacuuuucuuauagacggccccgaaacugcugaaugcccaaauacgaaucgagcauggaacucauuggagguagaagauuaugguuuugggguauuuaccacgaacauaugguuacguuugaaggagaagcaagacgcuuucugcgacaguaaauugaugagugcagcaauuaaagacaaucgagccguucaugcggacauggguuauuggauugaaagcgcguugaaugacacauggaaaauagaaaaagcgaguuuuauugaagucaaaaauugucacuggccaaaaucgcacacgcuauggucgaauggaguccuagaaucugaaaugauaauacccaaaaaccucgccggucccguuagucaacauaauuacagaccaggcuaucauacgcaaauagcagguccuuggcaucucggaaaauuagaaauggauuucgacuuuugugacggcacaaccguuauagucacagaagauugcgggaacagagguccgagcuuacgaacaacaaccgccucgggaaaauuaauaacugaauggugcugccgaucauguacacuaccuccauuaagauauaggggagaggauggcugcugguauggaauggaaauuagaccauuaaaagaaaaagaagaaaauuuaguuaauucacucguaacagccggacauggucaaguugauaauuuuucuuuagggguccuaggaauggcucuauuuuuagaggaaauguuaaggaccaggguaggaaccaaacacgcuauucuucucgucgcagucaguuucguaacauuaaucacaggaaauaugagcuuuaaagacuugggacgugucguuguuauggugggagcgacaauggcugaugauauugggaugggcguaacuuaccuagcguuacuugcagcuuucaaagugagacccacuuucgcggccggcuuauuauugaggaaguuaacaaguaaagaacuuaugaugaccacaaucgguauaguauuauuaagucagucgacaauaccugaaaccguucuggaacugaccgacgcguuagcgcugggaaugaugguccucaagaucguaagaaauauggaaaaauaucaacucgcagugacaauuauggcgauacuuuguguaccgaacgcaguaauauugcaaaacgcuuggaaaguaaguuguacaauuuuagcgguaguaagcgucaguccacuacuuuuaaccucaucucaacagaaaacagauuggauaccacuugcgcuuacaauaaaagguuuaaaccccacagcaauauuuuuaacuacuuuaaguagaacaaauaagaaacgauccuggccauuaaaugaagccauaauggccguuggaauggucucgauucuagcuucaucauuacugaagaacgauauuccaaugacaggcccccucguggccggaggauuauugacagucugcuacgucuugacaggcagaucugcagaucucgaauuagaacgcgccaccgacguuaaaugggaggaucaagcggagauaagcggcucaaguccaaucuuaucaauuaccauauccgaagacggcaguauguccaucaaaaaugaagaagaagaacagacuuuaacuauacuaauaagaacaggauuacugguuaucucaggucuauuuccgauaaguauuccaauaacugccgcagcgugguaccuaugggaaguuaagaaacagagggcaggaguauuaugggacguuccaucuccaccaccaauggggaaagcggaauuagaggauggggccuacaggauaaaacaaaaaggaauuuuuggauacagccaaauaggcgccggaguuuauaaagagggaacauuccauacaauguggcauguaacacggggcgcaguacuaaugcauaaaggaaaacgaauagaaccauccugggcugacguuaaaaaggaucucauaagcuacggagggggauggaaauuagagggagaauggaaagaaggggaagagguacaagucuuagcacuugaaccgggaaagaacccaagagcgguucaaacgaaaccuggucuauuuaagacuaacacaggaacuauuggugccgugucauuggacuuuucaccagggacguccggcucuccaauuauagauaagaaaggaaaaguagucggauuauacggcaacggcgucguuacaagaucuggugcauauguaagcgcgauugcacaaacagagaaaucaauagaagauaauccugaaauugaagaugauauauucagaaaacggaggcucacaaucauggauuugcacccaggagcagggaaaacaaaaagauaccucccugcuauagugagagaagcaauaaagagaggucugaggacacuaauauuggcaccaacucgugucguugcugcagaaauggaagaagcguugagagguuuaccuaucagguaucaaacucccgcgauacgugcagaacauaccggccgugaaaucguagaccugaugugucacgcaacguuuacaaugagauugcuuucaccaguacgaguuccaaauuauaauuuaaucauaauggacgaagcucauuucaccgaccccgccaguauagccgcucgaggauacaucucaacaagaguugaaaugggugaagcagcuggaauuuuuaugacagcaacuccaccaggaucacgagauccuuuuccucaguccaaugcaccaauaaucgaugaggagagagaaauacccgaaagaagcuggaacuccggacaugaauggguaacagacuucaagggcaaaacaguaugguucguaccaagcauaaaagcaggaaaugauauagcugccugcuuacgcaaaaaugguaaaaaggucauacaauuaagucgaaaaacauucgacuccgaauauguaaaaacacgcacaaaugauugggacuucgucguaacuacugacaucagcgaaaugggugccaauuuuaaagcugaacggguuauugacccacgaagauguaugaaaccggugaucuuggcagacggagaagaacgcguuauccuagcaggucccaugccagucacacauucauccgcagcgcagagaagagggaggauaggucggaacccgaaaaacgagaacgaucaauacauauauaugggagaaccccuagagaaugacgaggauugugcucauuggaaggaagccaaaauguuauuggauaauauuaauacgccagaaggcauaaucccgucgauguuugaaccggaaagagagaaagucgaugccauagauggggaauaucgcuuacgaggggaagccaggaaaacauuuguugaccuuaugcgaagaggggaucugcccguauggcuagcauacaaaguagcggcggaggguauuaacuaugccgacagacguugguguuucgacggcauuaaaaauaaccaaauacuggaagagaacgucgaaguagagauauggacgaaagagggcgagagaaagaaacuuaagccuagauggcuugaugcacgcauauauucggauccacuagcacugaaagaauuuaaagaauuugccgcgggaagaaagagccuaacauuaaaccuuauaacggaaaugggcagacuaccaacuuuuaugacgcagaagacgcgagaugcacuagauaaucuagccguucuccauacagcagaagcagggggcagagcauacaaucacgcuuuaucggaauuaccggagacacuugaaacacuacuacuucugacacuucucgcuacuguaacaggaggaauauucuuguuccucaugagugguagaggaauagggaaaaugacacugggaaugugcuguauuaucaccgcgucgauuuugcuuugguaugcacaaauccaaccucacuggauagccgcaaguauuauuuuagaguucuuccuaauaguguuauuaauaccagagccagaaaaacaaagaacaccacaagauaaucaacuaaccuauguuguaauagcuaucuuaacaguaguagcagccacaauggccaaugaaaugggauuucuugagaaaacuaagaaagaucugggauuggggucaauugcaacacaacaaccugaaagcaauauacuugauauagaucuaagaccagcguccgcauggacuuuauacgcgguagcuacuacauucgugacacccauguuacgccauuccauugaaaauaguagugugaacgucaguuugacagcgauugcuaaucaggcuacgguuuuaaugggucucggcaaaggcuggccauugagcaaaauggauauuggagucccauuauuggcuauaggaugcuauagucaaguaaaccccauaacccuaacagcagcacuccugcuauuaguugcucauuaugccauuauugggccuggauuacaagccaaagcgacacgggaagcucagaaaagagcggcagcaggaauaaugaaaaauccaacaguggacggaaucacgguaaucgauuuggauccaauaccuuaugacccaaaguuugaaaaacagcuaggucaaguaaugcucuugauuuuguguguuacgcaggucuugaugaugcguacuacaugggcacuaugugaagcgcuuacauuagcaacagguccaauuucuacauuaugggaggguaauccuggucgauucuggaauacaaccauagcaguuaguauggcaaauauuuuuagaggaaguuacuuggcaggagcgggacuucucuucaguauaaugaagaauacaacaaaugcaagacgaggaacugguaauaugggagaaacccucggcgaaaaguggaaaucaagauugaacgcuuuggguaagagugaauuucagauauauaagaaaagugguauccaggaaguugaucguacuuuagccaaagagggcauuaagcguggagagaccgaucaccaugcaguaucccguggcucagcaaaauuaagaugguucguugaacggaauauggucacgccagaaggcaagguaguugaucuuggauguggucgaggaggauggaguuauuacuguggaggacugaagaauguaagagaaguuaaaggacuuacuaaaggaggaccagggcaugaagaaccaauaccaaugucaacguacggcuggaaucuaguaagacuucagucugggguugaugucuucuuuauaccaccugaaaaaugugauacauuguuaugcgacauaggugagaguucuccaaauccaacuguggaagcaggcagaacccuuagaguguugaaucugguagaaaauugguuaaacaacaauacucaauuuuguauuaaaguucuaaauccuuauaugccuagcguuaucgagaaaauggaagcacugcaacgaaaauauggcggugcuuugguuagaaacccguugagccgaaauaguacccacgaaauguauuggguaucuaacgcaucaggaaauauuguauccucagugaacaugaucagccgaauguugauaaacagauucaccaugagacauaagaaagccacauaugagcccgacguggaucucggcagcggcacgcguaacauuggaauagaaucggaaauaccgaacuuagauauuaucggaaaacggauugaaaagauaaaacaagaacaugagacuuccuggcauuacgaccaagaucauccauauaaaacaugggccuaccauggaucuuacgagaccaaacagacaggcagugcaaguucuaugguaaacggagucguacgauuacugacgaaacccugggacgucuuaccaacagucacacaaauggccaugacagauaccacuccauucggucaacagcgugucuuuaaagaaaagguagacacgagaacccaagaacccaaagaagggacgaagaaacuuaugaaaauuacggcugagugguuguggaaagagcuaggcaagaagaaaacuccaaggauguguacucgcgaagaguuuacaagaaaaguacggaguaaugcggccuugggagcaauauuuacagaugaaaauaaauggaaaucugcacgagaagcaguugaggacucaagguucugggaauuaguugauaaagaaagaaaucugcaccuagaaggcaaaugugaaacuuguguuuauaacaugauggguaaacgagagaagaaacucggcgaguucggaaaagcuaaagggucuagggcaauuugguauaugugguuaggugcuagauuucuagaauuugaggcccucggauucuuaaacgaggaucacugguuuucaagagaaaauagccuaagcggcguugagggagaaggucuacacaaacuuggauauauauuaagagacguaaguaagaaagaaggcggggcaauguacgccgacgauacagcuggcugggauacucguauaacauuagaggaccuuaaaaacgaagaaaugguaacuaaccauauggaaggagaacauaagaaacuagcagaagcaauauuuaagcucaccuaccaaaacaaagucguaagaguacaacgacccacaccuagaggaaccguaauggauauuauaucucguagagaccagagagggucagggcagguugguacauauggguuaaauaccuuuacgaauauggaagcccaauuaauacgucaaauggaaggggaaggaguauuuaagaauauacaacauuuaaccguaacggaagaaguggcaguccaaaacugguuagcccguguaggcagggaaagacuuucuagaauggcaaucucuggagaugacugcguaguaaaaccgcuagaugaccgauucgccaaugcacucacugcacuaaaugacaugggcaagauaagaaaagacauucaacaaugggaaccaucuaaaggauggaaugacuggacccaagugccuuuuuguucgcaccauuuucacgaacuaauaaugaaagauggacgagugcugguagucccaugucgaaaucaggaugaacuuaucggucgagcaaggauaucacaaggcgcgggcuggucucuccgugagacagccugcuuaggcaaaucauacgcucaaauguggaguuugauguauuuucaucgcagagaucuaagguuagcugcaaaugcaauuugcucugcaguaccaucccacugggugccaacaucuaggacaacguggagcauacaugccaaacacgaguggaugaccacagaggauaugcucacaguuuggaaucgaguauggauucgugaaaauccauggauggaagacaaaaccccagucgaaucuugggaagaaauaccauaccuagggaaacgagaagaccaauggugcgguaguuuaauaggucuaacaaguagagccacaugggccaaaaauauacaagcagcgauuaaucagguacguucauuaauuggaaacgaagaauauacagauuauaugcccucaaugaaaagauuucggagagaagaagaagaagcgggagugcuaugguag

SEQ ID NO: 22709 - RNA, 9876 nt, Artificial Sequence
  derived and/or modified CDS sequence (opt6) from DENV-2__FJ410219__SS-prME
ucugcagguaugauuauuaugcuuauacccacaguaauggcguuccaucuaacuacacguaauggagaaccucauaugauuguaggaauacaagaaaaaggaaagagccuacuuuuuaaaacagaagaugguguuaacauguguacgcuuauggcuauggacuugggagaacucugcgaagauacuaucacuuacaaauguccgcuguuacgccagaaugaaccugaagauaucgauuguuggugcaacagcacaagcaccugggugacauacggaacguguacuacaacaggugaacaccgucgugagaaaagaaguguagccuuaguuccacauguaggcaugggccuagaaacucgcacagaaaccuggaugaguagugagggggcauggaagcaugcacagcguauagagacguggauauugaggcaccccggcuuuaccauaauggcagcaauuuuagcauauacaaucgguaccacccacuuucaacgagugcuuauuuuuauuuuacugacggccguagcaccaucaaugacaaugcguugcauugggauaaguaacagagacuucguagaagguguuucagguggaucuuggguugauaucguauuggagcauggcuccuguguaacaacaauggcgaaaaauaaaccaacauuagauuuugaauugauaaagacggaggcaaagcagccugcuacucuacgaaaguacugcauagaagcaaagcuaacaaauacuaccacagagucgagaugucccacucaaggagaaccaucguugaaggaagaacaggauaaaagauuugugugcaaacauucgauggucgacagaggguggggcaauggauguggucucuuugggaaaggcggaauaguuaccugcgccauguuuaccugcaaaaagaacauggaggguaaaauagugcagcccgagaaccuugaguauacuauaguugugacgccacacucaggcgaagaacacgccgugggaaaugauacggguaaacauggccaagaaauaaagguuacgccgcaaaguagcaucacagaagcagaguuaacaggcuauggaacaguaacgauggaauguucccccagaaccgggcuagacuucaacgaaaugguccuguuacaaauggaaaauaaagcauggcuuguacacaggcaaugguuucucgaucuuccauuacccugguugccaggggcggauaaacaggaaucaaacuggauucaaaaagagacuuugguaacauuuaaaaauccacacgcuaaaaaacaggauguagugguuuuaggaagccaagaaggcgcaaugcacacggcuuuaacuggugccacggagauucugaugucuagugguaaccuuuuauucacaggucaucugaaaugucgcuugaggauggauaaacuccaguuaaaaggaaugaguuacuccaugugcacggggaaauuuaagguggugaaagagauugcugaaacacaacacggaacuauuguaauacgaguccaguaugaaggugauggaucaccauguaaaauuccauuugaaauaauggauuuggaaaaaagauacguacugggcagauugauaaccgucaauccgaucguuacagagaaggauaguccaguuaauauagaagcagaaccacccuuuggagacucauacauaauaauagguguagaaccuggccaauugaaacucaacugguuuaaaaaaggaucaucaauaggacaaauguuugagacgacuaugcgcggagcaaaaagaauggcaauuuuaggggauacagcgugggauuuuggaucauuaggaggcguuuuuacuagcauugguaaagcauuacaucaaguuuuuggugccaucuauggcgcugcguuuucuggcgucaguuggacgaugaaaauucuaauagguguaaucauaacauggauagggaugaacagucggucaacaagccuguccguuucauuaguacuagugggaaucgugacgcucuaucugggcguaauggugcaggcagacucaggauguguugucaguuggaagaacaaagagcuuaaaugcgguagcggcauauuuauuacggauaauguucacacauggacagaacaauacaaauuccagccugagaguccauccaaacuugcaucagcgauacagaaagcccaggaagaagggauaugugggaucagaaguguuacaagacuugagaaucugauguggaaacagaucacgccggaguuaaaucacauuuuggcagagaaugagguuaaacuaacaauuaugacaggagacauuaaagggaucaugcaagcggguaaaagguucuuaagaccacagccaaccgaacugaaauacucauggaaaacguggggcaaagccaaaaugcucucgacagaaucguacaaucaaacauuccuaaucgauggaccagaaacagcagaauguccuaauacuaaccgugcauggaauagucuugaaguggaagauuaugguuuugguguuuuuacaacuaauauuuggcucaaacugaaagaaaagcaagacgcguucugugauucuaaacucauguccgcugccauaaaggauaauagagcugugcaugcugauaugggguauuggauagaguccgcauuaaaugacacguggaagauugaaaaagcaucuuucaucgaggucaaaaauugccacuggccaaagagccacacacuuuggucaaaugguguccuugaguccgagaugauuauaccuaaaaaucuagcgggaccagugagucagcacaauuaccguccaggcuaucacacccaaauugcagggccguggcauuuagguaaacuagaaauggauuucgauuucugcgacggaacaacaguaauugugacagaggauugcggaaaucggggaccgucgcuuaggacgacaacggccucagguaaauuaauuacagagugguguugucgaaguuguacacuaccgccuuuaagguaucguggugaagaugguuguugguaugggauggaaauaagaccccuaaaagaaaaagaggaaaauuuagucaauagcuuaguaacggcaggacaugggcagguggauaacuucucauuaggaguacuaggaauggcuuuauuuuuagaggagauguuaagaaccaggguuggaaugaagcaugcaauacugcuuguagcgguaaguuucguuacacucauaacgggcaauaugaguuucaaagaucuuggccgcgucguuguaaugguuggcgcgacaaugacggaugauauagguaugggaguaaccuauuuagccuuauuggcugcuuucaaaguaagaccaacauuugcagcagggcuguuacuucguaaauuaacuagcaaagaacuuaugaugauaacuauaggaauugucuuguuaagucaaucaacgauucccgagacagucuuagagcugacagaugcuuuggcccucggaaugaugguauuaaaaauugucagaaauauggaaaaauaccaguuggcgguuacgauaauggcuauucuuuguguuccuaaugcugucauccuacaaaaugccuggaaaguaucauguacgaucuuggcagucguuucagugucacccuuauuguugacuucuucucagcaaaaaacugauuggauacccuuagccuuaacgauuaagggacuaaacccaaccgcgauauucuuaacuacucuaucaagaacgaauaaaaaaagaucuuggcccuugaaugaagcuauaauggcaguaggcaugguaucaauauuggcaaguucucuccuaaaaaaugacauaccgaugaccggaccauuaguagcgggaggauuacuaacaguuuguuacguauuaacugggagaucagcugauuuagaauuggagagaguaaccgauguaaaaugggaggaucaagccgaaaucagcgguagcucgcccaucuuaucuauaaccauaagcgaagauggcaguaugaguauaaaaaaugaagaggaagaacaaacgcucaccauauuaauaagaacgggacuauuaguuauuagcgggcuuuucccgaucaguauacccauaacagccgcugccugguaucuaugggaaguaaaaaaacaaagagcuggcguucuaugggacguaccuagucccccuccgaugggaaaagcugaguuagaagauggggcuuauagaauaaagcaaaaagguauauuaggauauucacagaucggcgcugguguauauaaggaaggcacauuucauacgauguggcauguuacaagaggagcaguauugaugcauaagggaaagagaauagaaccaucaugggcggaugugaagaaagaucugaucagcuacgggggaggcuggaagcuugaaggcgaguggaaggaaggcgaggaagugcaagucuuagcucuggaacccggaaaaaauccacgagcggugcaaacuaaaccuggccuuuucaaaaccaacacagguacgauaggugcuguaagucuagauuucucgccuggaacaucaggcucuccuaucauugauaaaaaagggaaagugguuggguuguauggaaacggugugguaacaagaucaggagccuaugugucagccauagcacagacagaaaagucaaucgaagauaaucccgaaauagaagaugauauauucaggaaaagacgauuaacuauuauggaucugcacccuggagcaggaaaaacaaaaagguaucucccugcgauaguccgugaagcaaucaaacgcgguuuaagaacauuaauauuagccccgacgcgugucguagcagcugaaauggaagaagcucuacgaggucugccgauuagauaucaaacuccugcgauacgagcagaacacaccgggagagaaaucguagauuuaaugugccaugccacguuuacaaugcgauuauuaagcccuguaaggguacccaauuauaauuuaauuaucauggacgaagcgcacuuuacugauccagcuuccauagccgcacgaggauacauuaguacccgcguugaaaugggagaggcggcaggcauuuuuaugaccgcuaccccacccggaucucgagauccauuuccacaaaguaaugcuccuauuauagaugaagagcgugagauaccagagagauccuggaauucaggacaugaaugggucacagacuucaagggcaagaccgugugguucgugccuucuauuaaggcaggcaaugauauagcugcguguuuaaggaaaaacgguaaaaaaguuauucagcuaucacgcaaaacguuugauagugaauaugugaaaacaaggacuaaugacugggauuucguuguuacgacugauaucucagaaaugggcgcaaacuuuaaagcugaaagaguaauagacccaagacguuguaugaaaccagugauucugacugacggagaagagaggguuauauuggcagggccaaugccaguuacacauucaucagcugcccagagaaggggaagaaucggucguaacccaaaaaacgagaaugaucaauacauauauaugggcgaaccauuagaaaaugaugaggauugcgcgcacuggaaagaagcaaaaaugcuacuggauaauauaaauacaccugagggcauuaucccaagcauguuugaacccgagagggaaaaaguggaugccauagacggugaguaccgcuuaaggggagaagcaagaaagacauuuguggacuuaaugcguagaggcgacuuaccggugugguuagcauacaaaguugcagccgaagggauaaauuacgcugacagacgaugguguuucgauggcauaaaaaauaaucaaauccucgaagaaaauguagagguagaaauuuggacuaaagagggugagagaaaaaaguuaaaaccuagauggcuugaugcaagaauauauucugacccacuagccuuaaaagaguuuaaggaguucgcagcaggccggaaaagcuuaacccuaaaucuaaucacggaaaugggaagacugccaacuuuuaugacccaaaaaacucgagaugcacucgauaacuuggcagucuuacacaccgcagaggcaggcgggcgugcuuacaaccacgcauugucagaacucccggaaacgcucgagacacuacuauuacugacacuguuagcaaccguaacuggaggaaucuuucuauuucugaugucgggacgaggaauagguaaaaugacuuuagguaugugcuguauaauaacugcuaguauuuugcuaugguaugcucaaauccaaccgcauuggauagccgcuucgaucauauuagaauucuuuuuaauaguauuacucaucccggaaccugaaaaacaaagaacaccgcaagacaaucagcucaccuacguagugauagcgauacuaacgguaguagcugcgacaauggcgaaugaaauggguuuuuuagaaaagacuaaaaaagaucugggucuugguucaauagcaacgcaacaaccagagaguaacauucuugacaucgaccuuaggcccgcaagcgcuuggacguuauacgcggucgcaacgacuuucguaacacccauguugagacauucaauagagaauucaaguguaaauguuucauugacagccauugcaaaucaagcgaccguacugaugggauuaggcaagggauggccgcucagcaaaauggauauaggaguaccccugcuagccaucggauguuauagucaaguuaacccaauuaccuuaacagcggcuuugcuauuauuaguagcacacuacgcuauuauuggaccuggguugcaggcgaaagcaacaagagaagcucaaaaacgagcagccgcaggaauuaugaaaaauccuacaguggauggaaucacgguaauugaccuagacccaauuccauaugauccuaaguucgaaaaacaacuuggccaaguaauguuacugaucuuaugugugacucagguucuaaugaugagaacgacaugggcauugugugaggcucuaacgcuagcuacaggcccuauaaguacgcuuugggaaggaaauccaggacgauuuuggaauacuacaaucgcaguaucuauggccaauauauuucgaggcucuuauuuggccggugcuggauugcuauucuccauaaugaaaaauacuacaaacacucggagagggacagggaacaugggugaaacuuuaggagaaaaauggaagucacgccuuaacgcacuuggaaaaucugaauuccaaauauacaagaagucagguauccaagaaguagaccgcacacuagccaaagagggaauuaagagaggagaaacggaccaccacgcaguuucacgaggaagugcaaaacucaggugguucguugaaagaaauaugguaacuccggaaggaaaaguuguugaucuagguugcgguagaggaggauggucauauuauugcggcgggcuaaaaaaugugcgggaaguaaaaggacuuacaaaaggaggaccgggucacgaagaaccuauuccaaugucaacauauggguggaacuuaguucgauuacaaagcggagucgauguguuuuucaucccgccugagaaaugugacacauuacuaugcgauauuggagaaucuagcccaaacccaaccguagaagcgggucggacauuaagaguauuaaauuuaguagaaaauuggcuaaauaauaauacccaauuuuguaucaagguauugaauccauauaugccuagcguuauagaaaaaauggaagcacuucaacggaaguaugguggcgcauugguaaggaauccucucucgagaaauuccacacacgaaauguauugggugucgaaugcguccgguaauauaguaucaagugucaauaugauaucuaggaugcugauaaaucguuuuacaaugagacauaagaaagcgacauaugaaccagauguugauuugggaagcggcacgcgaaacauaggaaucgaaagcgagauucccaauuuagacaucauaggaaaacguauugaaaaaaucaaacaggaacacgaaacaagcuggcauuaugaccaggaccauccauacaaaacuugggccuaucaugggagcuaugaaacuaagcaaacuggcucugccucgucaauggugaacggaguaguuagauuauuaacaaaaccuugggaugucuuacccaccgugacucaaauggcaaugaccgacacuacuccuuucggacaacagaggguguuuaaagaaaagguagauacaagaacccaagagccgaaagaaggaacaaagaaacuaaugaaaauaacagcugaauggcuauggaaagaacugggcaaaaaaaaaacaccuagaauguguacuagggaagaauuuacacgaaaaguaaggucuaaugcugcauuaggugcuauuuucacagaugagaauaaguggaagucagcaagagaagccguagaggauucaagauuuugggaguuaguugauaaggaaagaaaucuccaccuagaaggaaaaugugaaacgugcguuuauaacaugaugggcaaaagagaaaaaaaauugggugaguuugggaaagcaaaaggaucgagggcuauuugguacaugugguugggcgcaagauucuuagaauucgaagcacuaggauuccuaaaugaagaccauugguuuucacgcgaaaauagccuuucagguguggaaggugaaggacuacauaaguuggguuauauauugcgcgacguguccaagaaggaagguggugccauguacgcugaugauacugcgggcugggauacacgaauuacacuagaggauuuaaaaaaugaagaaaugguaacaaaccauauggagggagaacacaaaaaauuagcagaagccauauuuaaacuuaccuaucaaaauaaagucgucaggguucaacgaccuacaccucguggaacaguuauggacauaauaucccgacgugaucaaagagguucagggcaagugggcacauauggacuaaauacauuuacaaacauggaagcucaacugauuaggcagauggagggugaaggaguauucaagaauauacagcacuuaacuguuacggaagaaguagcuguuaaaaauuggcuagcaagaguaggucgcgaacgacugucaagaauggccauauccggcgacgauugcgucguuaagccacuugaugauagauucgccaaugcauuaacggccuuaaaugauauggggaagauaagaaaagauauacagcaaugggaacccucuaaaggauggaacgauuggacacaagucccguuuuguagucaucauuuucaugaguuaauaaugaaagauggucgaguauuaguagucccaugucgcaaccaagacgaacuuauuggaagagcucgcauaagucaaggagcaggcuggaguuuaagagaaaccgcaugucucggaaaaucguaugcgcagauguggagccuaauguauuuccaccgcagagaccuaagacucgccgcaaaugcuaucugcucugcgguaccaucucacugggugccaacaucaaggacgacauggucaauucaugcgaaacaugaguggaugacaacugaagauaugcucacuguauggaaucggguuuggauacgugaaaacccauggauggaagauaagacaccuguagagucgugggaagagauuccuuaccuggguaaacgagaagaccagugguguggaucucucaucggacuaaccagccgugcuacgugggcaaagaacauucaagcagcaauaaaucagguucgaucacuaauuggaaacgaagaauauaccgauuauaugccgagcaugaaacgauuccgacgagaggaagaagaagcgggaguacuaugguaa

SEQ ID NO: 22710 - RNA, 9876 nt, Artificial Sequence
  derived and/or modified CDS sequence (opt6) from DENV-2__FJ461314__SS-prME
uccgcgggaaugauaauaauguuaauaccaaccguaauggcuuuucauuugacaacgcgaaacggagaaccgcacaugauuguaggaauacaagaaaaagguaaauccuuacuuuuuaaaacagaagacgggguuaacauguguacacuaauggcuauggaucuuggugaauuaugcgaagauacaauaacauacaaaugucccuuauuacggcaaaaugaaccagaagauauagacugcugguguaauagcacaagcacuuggguaacuuaugggacguguacuacuaccggagaacauagacgcgagaaaagaagugucgcacugguuccacaugucgguauggguuuagaaaccagaacugaaacauggaugucaucggaaggcgcauggaaacacgcacaacggauugaaacguggauucuaagacacccgggauucacuaucauggcugcuauauuagcauauacuauagguacaacacacuuccaaagagucuuaaucuuuauuuuacuaacugcuguagcuccguccaugacaaugcguuguauaggaauuucuaauagagacuucguagaaggaguaagugguggaucuuggguugacaucguauuagaacauggguccuguguaaccacaauggcgaaaaacaaaccaaccuuagauuucgaacuaauaaaaacagaagcgaaacaacccgcuacauuacgcaaauacugcaucgaagccaaacuaacuaacacgacaaccgaaagccggugucccacacagggggaacccagcuuaaaagaagaacaagacaaacguuuuguauguaaacacucgaugguggacagaggcugggguaacggauguggauuauuugggaaaggaggcauaguuacuugcgcuauguucacaugcaagaaaaauauggaaggaaaaaucguacaacccgaaaauuuagaauacaccauagucgucaccccgcauaguggagaggagcaugcgguagguaaugacacaggaaaacaugggcaagaaaucaaagugacuccacaaucuucaaucacagaagcagaauuaacgggcuauggcaccguaacaauggaauguagcccuagaacuggacuggauuucaacgagaugguucuacuucagauggaaaauaaagccuggcuaguccacagacaaugguuccuagaucuucccuuaccuuggcuaccaggagcagacaaacaagagaguaauuggauccaaaaagaaacguuagucacauuuaaaaacccucaugcuaagaaacaagauguaguugucuuaggaagccaagaaggugccaugcacacagcacugacaggagcuacugaaauccaaaugucaucagguaaucuuuuauucacugggcaccucaagugcagacugagaauggauaaacuacaacuuaaggggaugucguauuccaugugcacuggaaaauuuaaagugguaaaggaaauugccgaaacgcagcacggaacaauagugauucgugugcaauacgaaggcgaugggucaccgugcaaaauaccauuugagauaauggauuuagaaaagcguuaugugcuaggucgccucauaacuguuaaucccaucgucacugaaaaagauuccccgguaaacauugaagccgagccgccauuuggagauagcuauauaauuauuggcguggaacccggccaacucaagcuaaacugguucaagaaaggauccagcaucggucaaauguuugagacaacaaugcgaggagcuaaaagaauggcgauucucggugacacagcuugggacuucgguucccucggcggcguauuuacaaguauaggcaaggcccuacaucaaguuuucggcgcaauauauggggccgcauuuucaggcgugucuuggacacuaaaaauauuaaucggaguaauaaucacuuggauagggaugaauagcagaucaaccaguuugucugucagucuaguccuaguaggaauuguaacguuguauuugggcguaaugguucaagcagauucgggaugcgucgugaguuggaaaaauaaggaacugaaguguggaagcggaauauuuauuacugacaauguacauacguggacggagcaauauaaguuccagcccgaauccccaucaaaacucgcauccgcaauacagaaggcucaagaagaggguauauguggaauaagaagcgucacuaggcuggaaaaccuuauguggaaacagaucacccccgaacucaaccacauauuggcggaaaacgaagugaaauuaacuauaaugacuggagauauaaaaggaaucaugcaagcaggcaaacgauccuuaagaccucaaccgacugaacuuaaauacucuuggaaaacauggggaaaagcaaaaaugcugagcacagagucauauaaccaaacuuuucugauagacggaccugagacagcugaguguccuaauaccaaccgagccuggaacucauuagaaguagaggauuauggauuugggguuuuuaccaccaacauuuggcuuaaauuaaaagaaaaacaagacgcauuuugugacucaaaauuaaugagugccgcaauaaaagacaaucgcgcaguucaugccgacauggguuacuggauagaaagcgcauugaacgauacuuggaaaaucgaaaaagcaucauucaucgaagucaagaauugucauuggccaaaaucccauaccuuauggagcaaugguguucuggaaucagagaugaucauucccaaaaaccuugcagggccgguuagucaacacaauuaucgcccagguuaucacacccagauugcaggaccauggcacuuaggaaaacuugaaauggacuuugauuucugugacggcacuacuguaauaguaacagaagacugugguaacagaggaccuucacuacggacaaccacggccucaggaaaguuaauaacagagugguguugcagaucauguacccuuccuccucuaagauacagaggcgaggaugguuguugguaugguauggaaauacggccacugaaagagaaggaagagaauuuagucaacucauuagugacagcuggacauggccaaguagacaauuuuucacuaggagucuuaggcauggcccuauuucuagaagaaaugcuccgcacacgagucgggacaaaacaugccauuuuacucguagcaguuagcuucgugacguuaauaacagggaauauguccuucaaagaucugggaagggugguugucaugguaggagcaacgauggcagacgauauagguauggggguaacguaucuggcauuacuugcggcauuuaaaguacggccuacauuugcugcaggucuauuacuacgaaaguuaacaucaaaagaacucaugaugacgaccaucggaauuguccuauuaucgcagaguacuauaccagaaacuguacuagaacuuacugacgcucucgcgcucgguaugaugguucuaaaaauagucagaaauauggagaaauaucaauuagccguuacaauuauggcaauauuaugcguaccuaaugccgugauccugcaaaacgcuuggaagguauccuguacuauauuagccguuguuaguguaucaccacuucuauuaacgaguagucaacagaaaaccgacuggauaccauuagcguuaacgaucaaaggauuaaauccgacagcgauauuucuaacaacgcuaaguagaacuaacaagaaacgauccuggccucuaaacgaagcaaucauggccguuggaaugguaucaauuuuagcgaguucacuccuuaaaaaugauaucccaaugacggggccauuaguagcaggagggcuucuaaccguauguuauguucuaacuggcagaucagcggaucucgaguuagaacgagccacagacgugaaaugggaagaccaagcagagauuucaggaagcagccccauacugagcauaacaauuuccgaagauggaucuaugucaaucaaaaaugaagaggaggagcaaacacuaaccauacugaucagaacuggccuucuaguaauuagugggcuauuuccuauaaguauaccgauuaccgcagccgcaugguaccugugggaaguuaagaaacaacgagcaggcgugcuaugggauguuccaucgccaccuccgauggggaaagcggaacucgaagacggagcauaccgaauaaaacaaaaaggaauuuuagguuauucacaaauaggagccgguguguauaaagaagggacuuuccauacuauguggcaugucacaagaggugcaguacuaaugcauaaaggaaaacguauagaaccuaguugggcggaugugaagaaagacuuaaucaguuauggugggggcuggaaguuagaaggggaauggaaagaaggagaagagguucaaguccuggcacuagagccaggcaaaaaucccagggccguacaaaccaaaccgggacucuucaaaacaaauacggggacuauaggugcaguaagccuggauuuuaguccuggcacaucaggcucaccgauaaucgacaaaaaggggaaaguuguaggacuauacgguaacggcguaguaacucgaucaggcgcauauguaucugccauagcacagacagaaaagagcaucgaagauaaucccgaaauagaagaugauauauuccgcaaacgaagguuaacuaucauggaccuacaccccggggcggguaaaacuaaaagguaucugccggcaauuguucgagaagcuauaaaaagaggacuuagaacccuuauccuggcgccuacucgagucguugccgccgaaauggaagaggcuuuaagaggccuaccuauaagauaucaaacaccagcaauacgagcagaacauacaggaagggaaauuguagacuugaugugucacgcaacguuuacaaugagacuguuaucaccuguaagggugccuaauuauaaccuaauuaucauggaugaagcacauuuuacugacccagcaucaauagcugcacggggguauaucuccacuagaguagaaaugggagaagcugcagguauuuuuaugaccgcuacaccgccagggucccgggauccauuuccacaaucaaacgcgccuauuauagaugaggaacgagagauaccugaacgaucguggaacucuggccaugaauggguaacggauuucaaaggaaagacugugugguuugucccgucuauaaaggccggaaaugacauugcagccugucuaaggaaaaacggcaagaaaguuauucaacugucacgcaaaacauuugacucagaauauguaaaaacgcguacaaaugacugggacuucgucguuacuacagacaucuccgaaaugggagcaaacuuuaaggcagaacgagugaucgacccucgacgaugcaugaaaccaguuauacuuacugauggggaagagagagugauacuugcagggccaaugcccguaacucacuccagcgcagcccaaagaaggggacgaaucggcagaaacccgaaaaacgaaaaugaccaguauauauacaugggcgaaccucucgaaaacgaugaagacugcgcccacuggaaagaagcuaaaaugcuacuagauaauaucaauacgccagaagggaucaucccaucgauguucgaaccagaaagggaaaagguggaugccauagacggcgaauaccgccuacggggagaagccagaaaaacauuuguugaccuaaugcgucguggggaucucccaguauggcuagcuuauaagguagcggcagaaggcauaaacuaugcggauagaaggugguguuuugacggaaucaaaaauaaccagauauuggaagaaaacguggaaguugagauauggacuaaagaaggagaaagaaagaaacuaaagccaagaugguuagacgcuaggauuuauucagauccucuagcauuaaaagaguucaaagaguucgccgcaggacgaaaaaguuuaacucuuaauuugauaaccgagaugggaagacucccgacuuucaugacacagaaaacacgagaugcacuugacaaucuagcaguauuacacacagcagaagccggugggcgagcauacaaucaugcacugagcgaauuaccagagacauuggaaacauuguuguuauuaaccuuacuagcaacuguaacuggaggaaucuuuuuauuucucauguccggcagggguauaggcaaaaugacuuuagggaugugcugcauaauuacagccucuauacuucuaugguaugcacaaauucaaccucauuggaucgcagccagcauuauauuagaauuuuucuuaauagugcuacuaauaccagaaccagaaaaacaacgcacuccacaagacaaucaacugacguacguagugauugcaauccuaacuguuguggcggcgacaauggcaaaugaaauggguuuucuagaaaagacuaaaaaggaccugggcuugggauccauagcuacacagcaaccugaaucaaacauucuagauauagauuuaaggccugccucagccuggacauuguaugcaguugcaacaaccuuuguaacucccauguuacgacauucuauugaaaacaguucagucaacgugagcuugacagcaauagcaaaccaggccacaguacuaaugggacuagguaaagguuggccauugagcaagauggauauaggaguuccgcuucuagcaauagguuguuauucacaaguaaauccuauaacauuaacugcagcguuacugcuauugguagcccauuacgcgauuauaggacccggacuacaagcaaaagcgacgcgugaagcacaaaagcgcgcagcugcggggaucaugaagaacccaacuguggaugguauaacgguaauagacuuggauccgaucccuuacgauccaaaauuugaaaaacaauuaggacaaguuauguuacuuauauuaugcguuacacaaguuuugaugaugagaacaacaugggcauugugugaagccuugacauuagcuaccggaccgaucucaacauuaugggaaggcaacccuggacgguuuuggaacaccacaauugcaguaaguauggcuaacauuuuuagaggaucguaucuagcgggggcaggauugcuguuuucuaucaugaaaaacacaaccaauacccgacgagggacagggaauaugggggagacuuuaggcgaaaaauggaaaucuagauuaaacacauuagguaaaucagaguuccaaaucuauaagaaaagcgggauucaagaaguagacagaacauuagcaaaggaagguauaaaacgaggagagacagaucaccaugcaguaucaagaggcagcgcaaaacuccgaugguuuguagaacgaaauauggugacaccagaagggaagguuguugauuuagguuguggacgaggcggauggucuuauuauuguggagggcuaaagaauguaagagaggugaaaggcuuaacuaaaggaggaccuggacaugaagaaccgauaccaaugagcacuuauggcuggaauuuaguaagacuucaaagcggcguugauguguucuuuauaccaccggaaaaaugcgacacgcuacuuugugacauaggagaaucuucgccaaacccaaccguggaggcuggccgaacgcuccgaguacugaauuugguagagaacugguuaaacaacaauacccaguuuuguauaaaaguauuaaauccuuauaugccaagugucauugagaaaauggaagccuuacaaagaaaauacggaggugcuuuagugcgaaauccucuaaguagaaauucaacucacgaaauguauuggguuuccaacgcaucaggaaauauuguaucaucuguaaauaugauaagccgaaugcucauaaaccguuuuacaaugagacacaagaaagcaacauacgagccggacguugauuuagguucggguacccggaauauaggcauugagucagaaaucccaaaucuagauauaauaggaaagaggauagagaaaauaaagcaagaacaugagacaucguggcauuaugaccaagaccauccauauaaaaccugggcuuaucauggaagcuacgaaacaaaacaaacagggucagcuaguucuaugguaaauggaguagucagacuguugacgaaacccugggaugugcuaccuaccguuacucaaauggcaaugaccgauacaacgccguucggucaacaaagaguauucaaggaaaagguagauaccaggacacaagaaccgaaagaaggaacaaagaaauuaaugaaaauuacugcagaauggcuuuggaaagagcuuggcaaaaagaaaaccccaagaauguguacaagagaagaauuuacacgaaaagugcggucuaacgcagcucuuggagcgauauuuacugaugagaacaaguggaaauccgcuagagaagcaguggaagacucgcgauucugggagcuuguggauaaggaacgaaacuugcauuuagaaggaaaaugugaaacuuguguguauaauaugaugggaaaacgagagaagaaacucggagaauuuggaaaagcgaaagguagucgggcaauuugguacauguggcugggagcgcgcuuuuuagaauuugaagcauugggauuccuaaacgaagaucauugguucucaagggaaaauucucucagcggugucgagggggaaggguuacauaaauugggcuauauuuuacgagacgucaguaagaaagagggcggcgcuauguaugcagaugacaccgcuggaugggauacacguauaacauuggaagaucucaagaaugaggaaaugguaacaaaucauauggaaggcgagcacaaaaaguuagccgaagccauauuuaagcuaacauaccaaaacaaaguaguaaggguccaacgucccacaccucgaggcacuguaauggauauaauuucgcguagagaccaaagagguaguggacaaguuggcacauacggucuaaacacauucacuaacauggaagcacaauuaauuagacagauggaaggagaaggcguauucaagaauauucaacauuugaccguaacagaagaaguugcagugcaaaauugguuggcuagagucgguagagagagguuaucaagaauggcaaucucuggggaugauuguguaguaaagccauuagacgauagauucgcaaaugcgcucacugcauuaaaugauaugggaaaaauaagaaaggacauucaacagugggaaccaucuaaaggcuggaacgauuggacacagguucccuucuguucacaccauuuccaugaauugauuaugaaagacggaaggguacuuguaguacccugccguaaucaagaugaguuaauaggcagagcacgaaucucacaaggcgcaggauggucucugagggaaacagcuugucucgguaaaagcuacgcacaaauguggucucuaauguacuuucauagacgggaucuacguuuggcagcaaacgcaauaugcucggccgugccuagucauuggguaccaacgaguagaacuacguggaguauucaugcuaaacacgaguggaugacgaccgaagacauguuaacaguuuggaauaggguauggauacgagaaaauccguggauggaagacaaaacaccuguagagaguugggaggaaauucccuaccuaggcaaacgagaagaccaguggugcggaaguuuaauuggguuaacauccagggcuacaugggcgaaaaacauacaagcugcaauaaaucagguaagaucacuuauagguaacgaggaauacacugauuacaugccaagcaugaaaagguuucgaagagaagaggaggaagcugguguccuaugguaa

SEQ ID NO: 22711 - RNA, 9876 nt, Artificial Sequence
  derived and/or modified CDS sequence (opt6) from DENV-2__FJ410221__SS-prME
uccgcagguaugauuauuaugcuaauaccgacaguuauggcguuucauuuaaccaccagaaauggugaaccacacaugauuguagguauucaagaaaaagguaaaaguuuguuauucaaaacagaagacggagucaacauguguacacuaauggcaauggaucuaggggaacuaugugaagauacaauaacuuauaaauguccguuauuaagacaaaaugaaccagaagauauagauugcuggugcaauagcacgagcacguggguuacuuacggaacuugcaccaccacuggugaacacagaagggagaaaagaaguguugcauuaguuccucacguagggaugggauuagaaacacguacggaaacauggaugagcagugaaggagcauggaaacacgcacaacggaucgaaaccuggauauuaagacauccuggauucacgaucauggcagcuauccuagcuuacacuauugggacuacucacuuucaaagagucuuaaucuuuauauuacuuacagcuguagcuccaagcaugacgaugagguguauagguauuucuaaccgugauuucguagaagguguaucugguggaaguuggguagacauuguacuagaacacgggucauguguuaccacaauggccaaaaauaaaccaacccuagauuuugaauugauaaaaaccgaagcgaaacaaccagcaacauuacgaaaauacugcauugaagcuaaauuaacuaacaccaccacugaaucuagauguccaacgcaaggcgaaccaagucuaaaagaggagcaagauaaacguuuugucugcaaacauucaaugguggaccguggcugggguaacggauguggccuauuuggaaaagguggaaucguaacgugugccauguucacaugcaagaaaaauauggagggaaaaauuguucaaccagagaaucuggaauauacaaucguaguuacaccacauucaggcgaagaacaugcaguggguaacgacaccgguaaacacggcaaagagauaaaaguuacaccacaaucgagcauuacugaagcagaacucacagguuaugggacaguuacaauggaaugcagcccaagaacgggccuugacuuuaacgagaugguccuauuacaaauggagaauaaagcauggcuuguacaccgacaaugguuucuagacuuaccuuuaccauggcuuccaggugcagauaaacaagaaucgaacuggauacagaaagaaacauuaguaacauuuaaaaauccgcaugcgaagaaacaagauguaguaguuuuagguagucaagagggagcgaugcacacagcacuuacaggagcaacugaaauacaaaugucaucuggaaauuugcuuuuuacugggcaucuaaaaugucgcuugagaauggacaaacuacaacuuaaaggcaugaguuauucuauguguacagguaaauucaaagugguaaaagaaaucgcagaaacacaacacgguacgauagugauuagaguucaauaugagggagacggaaguccuugcaaaauaccuuucgagauaauggaccucgagaaaagauacguuuuagguagacugauaacuguuaaccccauaguuacugaaaaagacaguccagugaacauugaggcagaaccaccauuuggcgacagcuauauuauuauuggagucgagccgggccaauugaaacuaaauugguuuaagaaaggcucuaguauuggccaaauguucgaaacuacuaugagaggcgcaaaaaggauggcaauucuaggugacacggcgugggacuuuggaucacuaggggguguauucacaaguaucggaaaagcauugcaucaaguuuucggagcaauauauggugcagcauuuaguggcguaucauggacuaugaaaauccucauagggguuauaauuacuuggauaggcaugaauaguagaaguacuucuuuaagcguaagccugguguugguaggcauaguaacacucuaccuaggagucaugguacaagccgacagcgguuguguagugaguuggaaaaauaaagaacucaaauguggguccggaaucuucauaacugauaauguacacacguggacugaacaguauaaauuccaaccugaaaguccaaguaaauuagcgucagccauccaaaaagcgcaagaagagggcauuugcgguaucagaaguguuacaagacuagaaaauuuaauguggaaacagaucacgcccgaacuaaaucauauuuuggccgagaacgaaguaaaacuaacuauaaugacaggggauauuaaaggaauuaugcaagcuggaaaaagaagucuaagaccgcaaccgacagaauuaaaauauuccuggaaaacauggggaaaagcuaaaaugcuaucuaccgaauccuauaaccaaacauucuuaauagacggaccagagacagcggaaugccccaacacgaaccgagcauggaacuccuuagagguugaggacuacggauuuggaguuuuuacuaccaacauuuggcuaaaauuaaaagaaaagcaagaugcuuuuugugacucgaaguuaaugucagcggcaauaaaagauaacagagccguccaugcugacauggguuauuggauagagucagcauugaaugacacauggaaaauagaaaaggccucuuuuauagaagugaaaaauugucauuggccaaaaagccauaccuugugguccaacggaguauuagaaucagaaaugauuauucccaaaaaucuugcgggcccagucucacagcauaauuauaggcccggcuaucacacacagauagcgggacccuggcacuuaggaaaauuagaaauggacuucgacuuuugugacggaacaacgguaauaguaaccgaagauuguggaaauagaggaccuucgcuaagaacaacaacagcuucaggaaaguuaaucacagaguggugcugucggucauguacacuuccaccucuucguuauaggggugaagauggaugcugguauggaauggaaauacgcccguugaaagaaaaagaagaaaaucuagucaacagccucguuacagcaggccauggucaggucgauaacuuuucccugggaguauuaggcauggcacuuuuccuagaagagauguugcggacucgaguaggaacaaaacaugcaauuuugcugguagcaguauccuucguaacgcuuauuacagguaacaugaguuuuaaagauuuaggcagaguaguaguuaugguaggcgcgauuauggcugaugauauagggauaggagucacauaccuggcacuucucgcugcauucaaaguaagaccaacguuugcggcgggauuauugcuacgcaaacuuaccucaaaagaauugaugaugacuacuauaggaaucguccuacuaagccaauccaccaucccagaaaccguucuagaacuaacagaugcguuggcacuggguaugaugguauugaagauuguuaggaauauggaaaaauaccaacuggcaguuaccauuauggccauacuguguguaccaaaugcaguaauacuucaaaacgcuuggaagguaucgugcacaauacuagcgguuguauccguuagcccacucuugcucacaucaagucaacagaaaacugacuggauaccucuugcgcugacgauaaagggacuaaaccccacugcaauauuccuuacgacacuaucacguacaaacaagaaaagaaguuggccacucaaugaagcuaucauggcaguaggaaugguaagcaucuuggcuuccagccuauugaaaaaugacauucccaugacagguccauugguugcugggggacuuuuaacaguuugcuacguucuaacuggcagaucagcggauuuggaacuagaaagagcuacagaugugaaaugggaagaccaagcagagauaucgggcucauccccaauacuguccaucacuauuucugaagaugguagcaugaguaucaaaaacgaagaagaggaacaaacguuaacuauccugauaaggacuggauugcuaguaauuucaggacucuuuccaaucagcauaccgaucacagcagcagccugguaucuaugggaagucaagaaacaaagagccgguguauugugggauguuccuaguccgccuccuaugggaaaagcugaauuagaggauggagccuacagaauaaagcaaaaagggauauuaggcuauucacagauaggagcaggcgucuauaaggagggaacguuucacacgauguggcacguuacccguggcgccguccuaaugcauaaagguaaaagaauagaaccaucgugggcugaugugaagaaagaccuaauuuccuacggcggcggauggaaauuagaaggugaauggaaagaaggugaggagguccaaguacuggcccuugaaccuggcaaaaauccacgugccguucagacaaaaccgggccuauuuaaaacgaauaccggaaccauaggagcaguaucacuagauuucuccccaggaacuucggggagcccuauuauugacaaaaagggcaaaguggucggauuauaugguaauggcgugguaacuagaucaggugcguaugucucggccauugcacaaucggaaaaaucuauugaagauaaccccgaaaucgaagacgacaucuuuagaaaacgaagacuaaccauaauggauuuacauccaggagcaggaaaaacaaagcguuauuugcccgcgauugucagagaagccauuaagcgggguuugagaacauuaauccuagccccgacuagagucguagcagcugaaauggaagaagcacuacguggauuacccaucagauaucagacuccagcaauacggguggaacacacaggcagagagaucguagacuuaaugugccaugcaacauuuacaaugagacuuuuaucccccguaaggguuccuaauuacaaccuuaucauaauggacgaagcacacuucacggauccagcgucgauagcugcuagagguuauauaucaacccgugucgagaugggagaagcggcggguauauucaugacugccacgccaccgggcagccgagauccuuuuccccaaucaaaugcgccuauaauugaugaggaaagagagauuccagaacggucauggaacagcggacaugaaugggucacagauuuuaaagguaagacugucugguuugugccgaguauaaaagccgggaacgacaucgcugcuugucucagaaagaaugggaaaaagguaauccaguugucaaggaaaacauucgauagugaauauguaaaaacucguacaaaugauugggacuucgugguaacaacagauauaucagagaugggagcgaauuucaaggcagaaagggugauugacccucgaagaugcaugaaacccguaaucuuaaccgauggggaagaacgaguuauccuggcaggaccaaugccggucacacauaguucugcagcacagcgccgaggacgaaucggacguaauccuaaaaacgagaaugaccaguacauauacaugggcgaaccacuagaaaaugaugaagauugcgcucacuggaaagaagcaaaaauguuguuagauaauauuaauaccccagaagggauaauccccuccauguuugaaccagaaagagaaaagguagaugcgaucgauggcgaauacaggcuaaggggugaagcacguaaaaccuucguugacuuaaugaggagaggggauuugccaguuuggcucgccuauaagguugccgcggaagguauaaauuaugcggacagaagaugguguuucgacgguauaaagaauaaccaaauauuagaagaaaacgucgaaguagaaaucuggacuaaggaaggugaaaggaagaaauuaaaaccucgaugguuagaugcucgaauuuauagcgauccucuggcgcuaaaggaauuuaaagaguucgccgcuggaagaaaaucauuaacccugaaccuaauaacugaaaugggaagacucccaacauuuaugacacagaaaacgagggacgcacuagauaaccuggcaguauugcauacugcagaagcaggaggucgcgcuuauaaucaugcgcugagugaauuaccggaaacuuuagaaacgcuucuacuacucacacucuuagcaacaguuacaggaggaauauuucuauucuuaauguccgggagagggaucggaaaaaugacuuuaggaaugugcuguaucauaacagcaaguauauuacuuugguaugcucaaauacaaccacacuggaucgccgcaucuauaauacuagaauuuuucuuaauagugcuacuuauucccgagccagaaaaacaacgaacaccacaagacaaucaauugaccuacguuguuauagccauauuaacaguaguugcagcgaccauggcuaacgaaaugggauucuuagagaagaccaagaaagaucuaggacucggcucaauagcuacccaacagccugaauccaauauacucgacauugaccugagaccagcuucugccuggacuuuauaugcaguggcuacgacuuucgucacuccaaugcugcgccacucuauagaaaacucaaguguuaaugucagccugaccgcgauagcgaaucaagccaccguucuaaugggucuaggcaagggcuggccauugagcaaaauggacauuggaguuccacuacuagccauuggauguuacucucaaguuaacccaauaacauuaacugccgcguuauugcucuuaguggcacauuacgcuauuauaggaccgggacuccaagcaaaagcaacccgagaggcccagaaaagagcagcugcuggaauuaugaagaauccaacuguagacgguauuaccguuauagacuuagauccgaucccauaugacccaaaauuugaaaaacaauugggucaagugaugcuuuuaauuuuaugcguuacccaaguucuaaugaugcgcacuacaugggcacuaugugaagcgcuaacacuggcaaccggcccaauaagcacuuuaugggaaggaaauccaggacgauuuuggaauacaacaauugccgucuccauggcuaauauauuucguggaucauaucuugcaggagccggacuacuguucucuauaaugaaaaacacgaccaacacuaggcgagggacugggaacauuggcgaaacgcuaggagaaaaauggaagucaaggcuaaacgcuuuaggcaagagcgaauuucaaaucuauaagaaauccggaauccaagaaguagaccguacccuugcuaaagaaggcauuaagaggggagaaacagaccaucacgcuguaucaagaggcagugcaaaguuaagaugguuuguugaacgaaauaugguaacuccggagggaaagguuguggaccuaggauguggacgagguggguggaguuauuauuguggcggucugaaaaauguucgagaagucaagggcuuaacuaaaggaggaccuggacaugaagaaccaaucccaaugucgacuuaugguuggaauuuggucagacuacagucgggugucgacguguucuuuauuccaccagaaaaaugugauacgcuccucugcgauaucggggaaucuaguccuaaucccacgguugaagccgguaggacucugagaguauuaaaccugguagaaaauugguuaaauaauaauacucaguucugcauaaaaguauugaauccauacaugccuagcguaaucgaaaagauggaggcacuacaaagaaaauacggaggagcucuuguccguaauccccugucaagaaacaguacacacgagauguauugggugaguaaugcaucugguaacaucguaucaucuguaaauaugauaucaagaauguugauaaacagauucacuaugcgacacaaaaaggcaacguaugaaccagaugucgauuuaggcucugguacucggaauguaggaauagaaucagaaauaccuaaucuggauauaauaggcaaacgcaucgagaagauuaagcaagaacacgaaacuucauggcauuaugaccaagaucauccauacaagacaugggcauaucauggaaguuaugaaacgaaacaaaccggaucagcgaguaguaugguuaacggcgucguacgauuacucacuaaaccgugggauguccuuccuacagugacacaaauggccaugacggacacaacuccauucggacaacaaaggguuuucaaagaaaaagucgauacaagaacgcaggagccaaaagaagggacgaagaaacuaaugaaaauuacugcugaauggcuauggaaagagcuagguaaaaagaaaacuccucgaaugugcacgcgcgaagaguuuacaagaaaaguaagaucaaaugcugcauuaggggcgauauuuacggaugagaacaaguggaaaagugccagagaggcgguugaggauucacgguuuugggaauuagucgauaaagaacgaaacuugcauuuagaggguaaaugcgaaacuuguguguacaacaugauggguaaaagagagaagaaauugggggaauuuggaaaagcgaaagguaguagagcuauaugguacauguggcucggugcacguuuccuagaguucgaggcuuuaggauuuuuaaacgaagaccacugguucucacgagaaaauaguuuaucagggguugaaggagagggacugcacaaacuugguuauauucuacgagacgugucaaagaaagaggguggggcuauguaugcugaugacacagcuggcugggauacuagaaucacgcucgaagaucucaaaaaugaagaaauggucaccaaucacauggaaggcgaacauaagaaacuagccgaagccaucuucaaauugacauaucaaaauaaaguagugagaguacaaagaccaaccccaagaggaaccguuauggacauaaucucuagaagagaucaacguggaagugggcaagucggaacauacggccuuaauacauuuacaaacauggaagcacaauuaauucgucagauggaaggggagggaguguuuaagaacauacaacaucuuacugugacagaagaaguggcuguacaaaauuggcucgcaagaguaggaagggagcgucugucgagaauggcaauaagcggagaugauugcguagucaaaccauuagacgaucgcuuugcaaacgcucuuacagcacucaacgauauggggaaaauaagaaaagacauccaacaaugggaaccgucuaaaggcuggaaugauuggacucaaguaccauucuguucacaccacuuucacgaacuuauaaugaaagauggacgcguuuuaguaguacccugucguaaucaggaugaauuaauaggccgagcuagaaucucgcaaggagcuggguggucacuucgagaaacggcuugucuaggaaaaucauacgcucagauguggagucugauguauuuucaccgaagagaucugagauuggcugccaacgcuauuuguucagccgucccaucacacuggguaccaacgucacguacgacuuggucaauacaugcaaaacaugaauggaugacaacagaagacaugcugacaguauggaauagagucuggauacgugagaauccauggauggaagauaagacaccaguagaaucuugggaagaaauaccauaccuaggaaaaagagaggaccaauggugcggcaguuugauaggucuaacgucacgugccacaugggccaaaaacauacaggccgcuauaaaucaagugagaagccuaauaggcaacgaagaguauaccgauuacaugccauccaugaaaagguuccgacgggaagaagaagaggccggaguacuuugguga

SEQ ID NO: 22712 - RNA, 9876 nt, Artificial Sequence
  derived and/or modified CDS sequence (opt6) from DENV-2__FJ547064__SS-prME
agugcagguaugauaauuauguuaaucccaacgguaauggcuuuucauuugacaacucguaauggggaaccacacaugguuguaggaauccaagaaaaaggaaagagcuuacuauucaaaacagaagauggaguaaauauguguacgcuaauggcuauggacuugggagaacuaugugaagauaccauuaccuauaaaugcccacuuuuacgucaaaaugaaccugaagacauugacugcuggugcaauaguacaaguacauggguaacauauggcacauguacgacaacgggagaacauagacgcgagaaaagaagcguggcccucgugccacauguggggauggguuuagagacacggacagaaacguggaugaguucugaaggggcauggaaacaugcucaacgaaucgaaacauggauacuucggcauccagguuuuacuauaauggcggcuauacuagcuuacacgauagguacuacccauuuccagcgcguauuaauauuuauuuuacuaacggccguugcaccaucaaugacgaugcgaugcauuggaauaucgaaucgugauuuuguagaaggaguuuccggaggaucuuggguagacaucguacuagaacauggcaguugcgugacaaccauggcuaaaaacaaaccaacacuugacuuugaacuuauuaaaacugaggcaaaacaaccggcaacauuacguaaauauuguauugaggccaaacuaacaaauacaacgacugaaucgcgaugucccacucaaggagagccgucauugaaagaggaacaagauaaacgauuugucuguaaacacaguaugguagaccgagguuggggaaauggcugcgggcuuuuuggcaaaggaggcauuguaacaugugccauguucacuugcaagaaaaauauggaaggaaaaauaguacagccugaaaacuuagaauacacgauuguagugacgccccacucgggugaagaacacgcuguuggaaaugauaccggaaaacaugggcaagaaauaaaaguuacaccucaaucuucaauaacagaagcugaauuaacuggauacggaacagugacaauggaauguaguccucgaacuggacuggacuucaacgaaaugguguuauuacagauggagaacaaagcaugguuagugcaccgacaaugguuucuagacuuaccacuuccuugguugccgggugcugauaaacaggaaucgaacuggauucaaaaagaaacucuugugacauuuaaaaauccgcaugcgaagaaacaggaugucgucguguuaggcucgcaagagggcgcuaugcauaccgcacuaacaggcgcaacagaaauucagaugucgagcgguaaucuacuauuuacuggacauuuaaaaugcagacugagaauggauaaacuacaacuaaaagggaugaguuacagcaugugcacuggaaaauucaaagucguuaaagaaauugcagaaacacagcauggcacaauugugaucagaguacaauaugaaggagauggaucgccguguaaaauaccuuucgaaauaauggaucuagagaagagguacguauuaggucgguuaauaaccgugaacccaauuguuacugaaaaagacucgccuguaaauauagaagcagagccuccuuuuggagauaguuacaucauaauaggcgucgagccuggacaauuaaaauuaaacugguuuaagaaaggauccuccauugggcaaauguucgaaacaacgaugagaggagcgaaacgaauggcaauccuuggugauacagcaugggacuuuggaucguuaggagggguauucacgucaaucggaaaagcacugcaccaggucuuuggagcuaucuauggagcagcguuuucgggagugagcuggaccaugaagauacuaauuggcguuauaauaaccuggauugguaugaacagcagguccacgagcuugucagucagucuaguauugguuggcauaguuacguuauacuuggggguaaugguacaggcugacucgggaugcguuguaaguuggaaaaauaaagaacuaaaauguggcagugggauuuuuauaacagacaaugugcauacauggacagaacaauauaaauuucaaccagaaucuccuaguaaauuagcuuccgcuauccaaaaagcucaagaggaagguauuugcggaauuagaucaguuacacgacuugagaaccugauguggaagcaaaucacucccgaguuaaaccauauucuagcagagaaugaagucaaacuuacaauaaugacaggagauauaaagggaauaaugcaagccgguaagcgaucccuuagaccccaaccaacggaauuaaaauacuccuggaaaacgugggggaaggcaaaaaugcuaucaacagaaaguuacaaccaaacauucuuaaucgacgggccagagacugcggaaugcccuaauacaaacagggcuuggaauagucuggagguugaagacuacggauucggaguauuuacuacgaacaucuggcuaaaguuaaaagaaaaacaagacgcuuucugugacucuaaauuaaugucugccgcgauaaaagacaaccgagcaguucaugcggauaugggauauuggauagagucugccuuaaacgacaccuggaaaauugagaaagcaucauucauagaagugaaaaauugucauuggccaaaaucacacacucucugguccaacggaguuuuagaaagugaaaugauaauacccaaaaaucucgcagggccagugucccagcacaacuacaggccuggauaccauacucagaucgccggcccauggcaucuugggaaacuagaaauggacuuugacuuuugugacggcacgacuguuauaguuaccgaagauugcggaaauagaggcccaagucuucguacuacuacagccucugguaaauuaauaacagaauggugcuguagaaguuguacauuaccuccacuacgauacagaggggaagacgggugcugguacgguauggaaauuagaccuuuaaaagaaaaagaagaaaauuuaguaaacaguuuggugacagcuggacacggacagguugauaacuuuucauuagguguucuaggaauggcuuuauuuuuagaagaaaugcuacgaacccgagucggaaccaaacaugccauacugcuaguagccgugucauucguaacauuaauaacaggaaauaugaguuuuaaagaucuagguagggucguugugaugguaggcgcuacaaugaccgaugauauaggcaugggcguuacauaccuugccuuauuagcugccuuuaagguccgccccacauucgcugcaggucuacuacuacgaaagcugacaucuaaagaguuaaugaugaccacaauagguauaguguugcucagucagucuacaauaccggaaacaguuuuagaacugacagaugcacuagccuuagggaugaugguacuaaaaauuguuagaaauauggagaaauaccaacuugcaguaacuauaauggccauucuaugugucccuaaugcagucauucuacaaaaugccuggaagguaucuuguacgauacuugcaguagucuccguaucuccucuacugcuuacaaguucccaacagaaaacagacuggauccccuuggcguuaacaauuaaagguuugaauccuacugcuaucuuuuugacgacauugagucgcacgaauaagaagaggucauggccgcuuaaugaagcuauuauggccguugguaugguauccauauuggcuucuaguuuacucaaaaacgacauucccaugacaggaccuuugguagcugguggacuauugacgguaugcuacguucuaacuggaaggagcgcagauuuagaauuggaaagagcaacggacguaaaaugggaagaucaagcagaaaucucgggaagcagccccauucucagcauaacuauauccgaagaugguagcaugucuaucaagaaugaagaagaagaacaaacacugacgauauuaauccgaaccggguuguuagucauuucaggauuauuuccaauuucaauaccuaucaccgcugcagccugguauuuaugggaaguuaagaaacagcgagcuggaguauuaugggacguacccaguccuccgcccaugggcaaggcggagcuggaagacggcgcauauagaaucaaacaaaaaggcauucucgguuauagucaaauuggagcgggaguuuaccgagagggaacuuuucacacgauguggcacguaacccggggugcuguacucaugcauaaaggcaaacgcaucgagcccucaugggccgaugucaaaaaggauuugauauccuauggaggcggauggaaacuagaaggcgaauggaaggaaggugaagaaguucaaguacucgcucucgaaccugguaaaaauccacgcgcuguucaaacuaaaccgggacuguuuaaaacgaacacagguacaauaggcgccguaucuuuagauuuuaguccugguacuucaggaagcccaauuauagauaagaaagguaaaguaguaggucucuacggcaaugggguaguuacuagaagcggagcguacgucagugcgauagcacaaaccgaaaagucaauagaagauaauccagagauugaagaugacauauucaggaagcgacgucugacaauaauggauuugcauccuggggcaggaaaaacuaaaagguaucuucccgcaaucguucgagaagcaauaaaaaggggucuaagaacacuaauacuagcgcccacuagaguugucgcggcugagauggaggaagccuuaagagggcuuccuauucgcuaucaaacuccugccauaagagcagaacacacugguagagaaauuguagaucuaaugugucaugcuacguuuacaaugcgcuuacuauccccuguacgaguaccgaauuacaaucuuaucaucauggaugaagcacauuuuaccgauccagcaucuauagcagcucgaggauacauaucuaccaggguagaaaugggagaagcggcagggauauuuaugacugcgacgccacccggcucgcgcgauccuuucccgcaaaguaacgccccaauaauagaugaggaaagggaaauaccagagcgcagcuggaacucgggucaugaauggguuaccgauuucaaggguaaaaccguaugguucguaccaucaauaaaggcuggaaaugacauaguugcuugucuaaggaaaaauggcaagaaaguaauucaacugucaagaaaaacuuuugacagugaauacguaaaaacgaggacaaacgauugggacuucguuguuacaacugacauuagcgaaaugggagcaaacuuuaaagcagagaggguuauagauccaagaagaugcaugaaaccagucauauuaacugauggcgaagaaagaguuauuuuggcaggaccgaugccuguaacgcauucaagcgcagcacagagacgaggccgcaucggaaggaaccccaaaaacgaaaacgaccaauauauuuacaugggggagccacuggagaaugacgaagauugugcucacuggaaagaagcaaaaauguuacuggauaacauaaacaccccugaaggaauaaucccaaguauguuugagccagaacgggaaaagguugaugcuauagacggcgaguacagacuuaggggagaagcgcgaaagacauuuguggacuuaaugcgcagaggagauuuaccaguauggcuagcauauaaaguagcggcagaagguauuaacuaugcggaucggagaugguguuucgacggcauuaaaaauaaucaaauuuuagaggaaaacguugaagucgaaauuuggacaaaagaaggagagagaaagaaacuuaaacccagauggcuggaugcuagaauauacucugauccacucgcuuuaaaggaauuuaaagaauuugcugcaggacgaaaaagccugaccuugaaucuuauaacagagaugggacgacucccuacauuuaugacacagaaaacucgagacgcuuuagauaacuuagccguacugcacacagcugaagcugguggacgagcauacaaucacgcauuaagugaacugccggaaacauuagagacucugcucuuauuaacguuacuagcuacaguuacgggcggaauauuuuuguuucuuaugucuggaaggggaauugguaagaugacucuuggaaugugcuguauuauaacagcaagcauccuacugugguaugcacaaauucaaccacacuggaucgccgcaaguaucauucuagaauuuuuccuaauuguguuguuaauaccagaaccagaaaagcaaagaaccccucaggauaaucaauugacauaugucguaauugcaauccuaacgguaguggcugcuacgauggcgaaugaaaugggcuuucuagagaaaacgaagaaagauuuagggcuaggaucaauagcuacacaacaaccagaaagcaauauauuagauauugaccuccguccagccucugcguggacacuuuacgcuguagcuacaacguuuguaacgccgaugcuucgucauaguauugaaaauucaucaguuaacgucagcuugacugcuaucgcuaaucaggcaacaguucugaugggacugggaaaggguuggccacuaagcaaaauggacauaggaguccccuuacuggccauugguuguuacucacaaguaaauccgauuacauuaacugcggcacuauugcuauuaguggcgcauuaugcaauuaucggcccaggacugcaggcaaaggcaacaagagaagcucaaaaacgagccgccgcagguauaaugaaaaacccuacaguugauggaauaaccguuauagaccuggauccuauaccuuacgacccuaaauucgaaaaacaauuggggcaagucauguuacucauauugugcguuacacaaguacugaugaugcggaccacuugggccuuaugcgaagcacuuacgcuugcuacaggacccauaucaacguuaugggaaggaaacccuggaagauucuggaauaccacaauagcaguaucuauggcaaacaucuucagggggucuuaccuagccggagcaggauuauuauuuagcauaaugaagaauacgacaaacacaagacgagguacaggcaacaugggagagacacuaggugagaaguggaaaucacggcuuaaugcguuggguaaaucugaauuucaaauuuacaaaaagagugggauucaagagguugaccgcaccuuagcaaaagaagggaucaagcgaggagaaacggaucaccaugccguauccagaggcucagcuaaauuaagaugguuuguggaaaggaacaugguaacaccagaagggaaaguuguggauuuaggguguggcaggggcggguggucguauuauugcggaggucucaaaaauguaagagaaguaaaaggguuaacuaaaggagguccaggacaugaggaaccaaucccuaugucaacuuacggauggaaccuaguaagacuacaaagugguguugacguguucuuuauaccaccagaaaaaugugauacacuguugugcgacauaggggaaaguucuccaaacccaacgguagaagcagggcggacuuuaaggguuuuaaaucucguggaaaacuggcuuaacaauaauauacaauuuuguaucaaaguccuaaauccauauaugccuaguguaauagagaaaauggaagccuuacaacggaaauacggaggugccuugguaagaaauccucuaaguagaaacuccacacaugaaauguacuggguaucuaacgccucuggaaauauaguuuccucgguaaauaugaucucucgaaugcucauaaacagauucacaaugcgucauaagaaagcuacuuaugaaccagacguggaccuuggaucagggacaaggaauauagguacggaaagcgaaaucccaaauuuagauauuauaggaaaaagaauagagaaaauaaaacaggagcacgaaacaucauggcacuacgaucaagaucauccauacaaaacuugggcauaccauggauccuacgagacaaaacaaacaggcucugcaucgucuaugguaaacggaguaguacgacuacuaacuaaaccuugggauguccuccccaugguaacucaaauggcaaugaccgacacuacaccuuuuggacagcaaagaguauucaaagagaaaguagacacaagaacucaagagccaaaagaagguacuaagaaauugaugaaaaucacugcugaauggcuauggaaagaauuaggcaagaagaaaacuccuagaaugugcacucgggaggaauuuacaagaaaagucagaagcaaugcggcacucggcgcgauuuuuaccgacgaaaacaaguggaaaucagcgagggaagcuguggaggacaguagguuuugggaguugguugacaaagagagaaaccuacacuuagagggaaaaugcgaaacgugcguauauaauaugaugggaaaacgcgagaagaaauuaggagaauuuggaaaagccaaaggaucgagagcaauaugguacauguggcucggggcgagauuucuggaguuugaagcucuaggauuuuuaaaugaagaucacugguucuccagagagaacucccuaucggggguagagggugagggauuacacaaacuaggguacauccuacgagacguuucaaagaaagaagguggagcaauguacgcagaugauaccgcggguugggauacccguauuacacuagaagaucugaaaaacgaagaaaugguuacuaaucauauggaaggagaacacaaaaaguuggcagaagccauuuucaaacuuacauaucaaaauaagguagugcgaguucaaagacccacuccccguggcaccguaauggacaucaucucuagaagagaccaaagaggaagcggucagguagguacauauggccuaaauacauucacuaauauggaggcacagcuaauuagacaaauggaaggugaaggcguauucaagaauauucaacauuuaacaguuacggaagaaguugccgucaaaaacuggcuugcaagaguagggcgugaaagguuaucacggauggcuauaaguggcgaugauuguguugucaagccucuagacgaucgauucgcaaacgcacuaacugcauuaaaugacaugggaaaaauccggaaagauauucaacaaugggaaccgucuaaaggguggaacgauuggacacaaguaccauuuugcucacaccauuuucaugaacuuauaaugaaggacggucgaguauuaguuguaccuugcaggaaucaagaugaauuaauagggagagcccguauuucucaaggagcagguuggucccuacgugaaacagccugucuuggcaaaucauacgcccaaauguggucuuugauguauuuucacagaagagaccuaagacuugcagccaaugcaauauguagcgccgucccaucucacuggguaccaacaaguagaacuacuuggucaauacacgcaaaacaugaauggaugacgacagaggauaugcucacuguuuggaacagaguauggauacgagaaaacccguggauggaagacaagacgccgguugaaaguugggaggaaauaccauaccucgggaagcgagaagaccaauggugcggaaguuuaauaggauuaacaagccgugcgacgugggcaaagaauauccaagcagcgauaaaucagguucgaaguuuaauuggaaacgaagaauacacagauuauaugccaucuaugaagagauuucgacgagaagaagaagaggcuggcguucugugguag

SEQ ID NO: 22713 - RNA, 9876 nt, Artificial Sequence
  derived and/or modified CDS sequence (opt6) from DENV-2__FJ410223__SS-prME
ucugcagguaugaucauuauguugauaccuacagucauggcauuucacuuaacgacgcgaaacggagaaccccacaugauaguagggauccaagaaaaagggaaaucauuauuauuuaaaaccgaagauggaguaaauauguguacauuaauggcuauggacuuaggcgaauugugugaagauacuauaacauauaaauguccacuauuacggcaaaaugaaccagaagacauagacugcuggugcaauucgacgucaacuuggguuacuuaugguaccugcacaaccaccggcgaacauagaagggagaaaagaucaguagcauuaguaccacauguggggaugggauuagaaacuaggacagaaacuuggaugagcucagaaggggcauggaaacaugcgcagaggauugaaacuuggaucuugcgucauccaggauucaccaucauggccgcgauauuagcauacacuauagggaccacgcacuuucaacgcguucucauauuuauacuucuuacggcuguagcgccuagcaugacaaugcguuguaucgggauauccaaccgggauuucgucgaaggcgugagcggaggaaguuggguggacauaguacuggaacauggaucguguguaacuaccauggccaaaaacaaaccgacauuagacuucgaauugauaaaaacugaggcaaaacagccagcuacauugcguaaauauugcauugaagcaaaacuuaccaacacgacaaccgaaucgagauguccuacacaaggcgaaccuucacucaaagaagaacaggacaaacgcuucgugugcaaacauucaaugguagacagaggcuggggaaaugggugcggguuauuuggaaaaggagguaucguuaccugcgcuauguucacuugcaagaaaaacauggaagguaaaauaguacaaccugaaaaucuugaguauaccauaguaguuaccccucauucaggagaggaacaugcaguagguaaugacacuggcaaacacggacaggaaauuaaaguuacaccccaaagcucuauuaccgaagcagaacuuacggguuaugguacaguaacgauggaaugcagcccgcgaacaggucuggauuuuaaugagaugguauuacugcaaauggaaaauaaagccuggcuuguucaucgacaaugguuuuuagauuuaccacuaccaugguuacccggcgcugacaaacaagaaucuaauuggauacagaaagagacauuaguaacauucaaaaauccucaugcuaagaaacaagaugucguaguucuaggaucacaagagggagcaaugcauacagccuuaacuggagcaaccgaaauacaaaugucgagugguaaccuauuauuuacuggucaucuuaaaugcagauuacgcauggauaaacuucaauuaaaaggaaugaguuauagcaugugcacagguaaauucaaaguugucaaagaaaucgcugagacacaacaugguacgauaguaauuaggguacaauaugagggcgacggaaguccgugcaaaauaccguuugaaauaauggaccucgaaaaacgauauguucucgguagauuaaucaccgucaauccgauaguaacugaaaaagauaguccagugaauauagaggcagagccaccauucggggauucuuauauuauaauuggcgucgagccuggccagcuuaagcucaacugguucaagaaaggaagcucaaucgggcagauguucgaaaccacuaugcgcggugcgaaaagaauggccauacuaggcgauacugccugggauuuuggaagucuaggagggguuuucaccucaauagggaaagcauugcaucaaguauucggagccauauauggagccgccuuuucagggguaaguuggacaaugaaaauauuaauagguguaauaaucacguggauuggcaugaauagucgaucaacaucacuaucaguaucccugguacucguaggaaucguuaccuuauaucuagguguuaugguacaagcggacuccggaugugugguaaguuggaaaaauaaagaauugaaaugugguucagguauauuuaucacggacaauguucacacuuggacagagcaguauaaauuccaacccgagagcccuucuaaauuggcaucagcuauacagaaagcgcaagaagaaggaauauguggaauaaggucaguaacccgccuagaaaacuugauguggaaacagauuacuccagaauuaaaccauauacuagcagagaaugagguaaaacuuacaaucaugacuggagacauaaagggaauuaugcaagcgggcaaaagaagucuucgaccccaaccaacagaacuaaaauauuccuggagaacuugggggaaagcaaaaauguuaucgacugaaucuuacaaccaaacauuccucaucgauggcccagaaacggcagaguguccaaauacaaauagggcauggaauagcuuagagguagaagauuauggauucggcguuuuuacuacaaauauauggcuuaaguugaaagaaaagcaagaugcauuuugugacaguaaauuaauguccgcugcgaucaaggauaaccgagcuguccaugcggauaugggguauuggauagagucugcuuuaaaugauacuuggaaaaucgagaaggcuucauuuauugagguuaaaaauugccauuggcccaaaucucauacucucuggucaaaugguguucucgaaagcgaaaugauaauucccaaaaauuuagccggacccguaagccaacacaacuauaggcccgguuaucacacacaaauugcaggaccguggcaucuugggaaacucgaaauggauuucgauuuuugcgacgggacuacaguaauaguuacagaagacuguggaaaccgggggccaucucucagaacuacuaccgcuucagggaaauugaucacugaaugguguuguagaaguugcacacuuccgccacuaagguaccgcggagaggauggaugcugguauggaauggagauacggcccuugaaagagaaagaagaaaaccuaguaaauucgcucguaacugccggacauggccaaguggacaauuucucucucggaguuuuaggaauggcauuauuucucgaggaaaugcuaagaacacguguuggaacuaaacaugccauacuucuaguggcaguuucguuuguaacuuuaauuacgggaaauauguccuucaaggaucuagggcguguaguaguaaugguaggugccacaauggcggacgacauaggaaugggcguaaccuaucuagcguuacuugcugccuuuaaaguacguccuacguuugcagcuggacuguuauuacggaaauuaacgucaaaagaauuaaugaugaccacgauaggaauuguacuguuaucacagucaacaauaccagaaacaguauuagaacucaccgacgcacuagccuuagguaugaugguucugaagauaguaagaaauauggaaaaauaccaacuagcugugacaaucauggcaauuuuaugcguaccaaaugcaguaauccuccaaaacgccuggaagguuucuugcacaauacuagcuguaguaucaguaucccccuuauuguuaacuucaucgcaacagaagacggauuggauucccuuagcucuaacaauuaaagguuugaacccaacggcaauauuccuaacaacacuuucacgcacuaacaagaaacggucuuggccccucaaugaagcuauaauggcgguugggaugguaagcauacuagcuucgucgcuccuuaaaaacgauauccccaugaccgggccucuaguugcaggaggacuacuaacgguaugcuauguucugacaggaaggagugcagacuuagagcuggaacgcgccaccgaugugaagugggaggaucaagcagagauaucaggaucgucucccauauuaaguauaacaauaagugaagauggaucgaugucuauuaaaaacgaggaagaggaacaaacuuuaacuauacuaauucggacaggguuauuagucaucuccggacuauucccuaucucaauaccuaucacagcugcugcuugguaucuaugggaagucaaaaagcaacgagcaggaguucugugggauguacccaguccacccccuauggguaaggcagaacucgaagauggagcguaucgaauaaaacagaaaggaauacuagguuauagccaaauaggugcagggguauacaaagaagggacuuuucauacaauguggcauguuacccgaggugcagugcuuaugcauaaaggaaaacgaauagaaccauccugggcagacguuaagaaagaccuaauuuccuacgguggcggauggaaauuagagggcgaguggaaagaaggagaagagguacaaguucucgcccuugaaccagggaaaaacccuagagcgguacagaccaagccagguuuguuuaaaacaaacacgggaacuauaggagccguuagccuggacuuuucaccagguacauccggaucgccaauuauagauaagaaaggcaaagugguaggauuguauggaaacgggguuguaacacggaguggcgcauacguuuccgcaauugcgcaaacugagaaaagcaucgaggauaauccagaaauagaagaugacauuuucagaaagaaaagacucacuaucauggaccuucauccuggagcaggcaaaacaaaaagauaucuaccugcuauaguaagagaagcaauuaagcguggacuaagaacgcuuauacuagcaccuacgagaguugucgcugccgaaauggaagaagcauuaagggguuugccgauuagauaucagaccccugcgauuagagcggagcacacagggcgugaaaucguagauuuaaugugccaugcaacuuuuaccaugagauuacuaagcccggugagggucccgaauuauaaucuaauuaucauggacgaggcucauuuuaccgacccggccucaauagcggcaagaggguauauaucaacuagggucgaaaugggugaagccgccggaaucuuuaugacagcuacuccacccggaucucgagacccauuuccccaaucuaaugcaccuaucauagaugaggaaagggagauaccggaaagaucguggaacucagggcacgaauggguaacggauuuuaaaggcaagacaguaugguuuguaccuucaaucaaagcugggaaugauauugccgcuuguuuacggaaaaauggcaagaaaguaauacaacuaucgcggaaaaccuucgauagugaauauguuaaaacgagaacaaacgacugggacuuuguuguuacaaccgauauuagugaaaugggcgcgaacuucaaggccgaaaggguaauugauccaaggagguguaugaaaccgguuauucuaaccgacggcgaggaacggguuauacuagcugggccaaugccugugacucacucaucagcagcccagaggcgaggaagaauaggacgcaaccccaaaaaugaaaaugaucaauauauuuauaugggagaacccuuagaaaaugacgaagauugugcacacuggaaagaggcgaagauguuguuagacaauauuaauacuccugaaggaauaauccccagcauguucgaaccagaaagagagaaagucgacgcuauagauggugaguauagauuaaggggugaagcaagaaagacauuuguagauuugaugaggcgaggagaucugccuguuuggcuugcauauaaagucgcagcagaggggauaaauuacgcugaccguagaugguguuuugauggaaucaagaauaaucagauacuagaagaaaauguugaggucgaaauauggaccaaagaaggagaacguaagaaauugaaaccucgcugguuagaugcucguauauauagcgauccucuugcauuaaaagaguuuaaggaguucgcagcaggucgcaaauccuuaacucuaaauuuaauaacagagauggguagauuaccaacauucaugacacaaaagacaagagacgcacuagauaacuuggccguauuacauacugcagaagcgggaggucgugcuuauaaucaugcguuaagugagcuacccgaaacccuagagacuuuacuuuuguuagcacuccucgcuacuguaaccgguggaaucuuucuuuuucuaauguccgggagaggcauugguaaaaugaccuuagggaugugcugcaucauuacugcuaguauacuacuaugguaugcacagauacaaccucacuggauagcggcaaguauuauucuagaguucuuucuaaucguucuacuaauaccagaaccagaaaaacaacgaacuccgcaagacaaccaacugacuuacguuguuauagcaauacucacugugguagcugcaaccauggcgaaugaaaugggauucuuagaaaagacuaagaaggauuuaggauuaggaaguauugcaacccaacaaccugaaagcaauauucuagacauugacuuaagaccugcaucagcauggacucuuuaugcaguugcuaccacauuuguuacaccaaugcuucgucacaguauugaaaauagcagugugaauguaagccuaacagcaaucgcaaaccaagcuacaguacucauggggcuugguaaagguuggccccuuagcaaaauggacauagguguaccauuauuagcuaucgggugcuacucucagguuaauccuauaacacucacugcagcauuauuauuacucguagcucauuaugcaauaauagguccuggucuccaagcuaaggcuacacgagaagcacagaaaagagcagcggcaggcauaaugaaaaauccaaccguagaugguauaacuguuauagaucucgauccaauaccauacgauccaaaauuugaaaagcaauugggacaggugaugcuccuaauacuuugcgugacacaaguauuaaugaugcggaccacaugggcucugugugaggccuugacacuggcaacgggaccaaucucaacguugugggaagggaacccagggcgauuuuggaauacuacuauagcggucuccauggccaauauuuuuagagguuccuaccuagcuggugcaggacuauuauuuaguauaaugaagaacacaacaaauacacggaggggcacgggcaacaugggagaaaccuugggcgaaaaguggaaaucuaggcuaaaugcauuaggaaaaagugaauuucaaauauauaaaaagagcggcauccaagaaguagaucgaacguuagcaaaggaaggcaucaaaagaggcgagacugaucaccacgcgguuaguagaggaagugcuaaguugaggugguuuguggaaagaaauaugguaacuccagaagguaaaguaguggaucuaggauguggaaggggaggauggucuuauuacugugggggacuuaaaaacguacgagagguaaaaggcuugacaaaagguggaccaggacaugaagaaccgauacccaugucaacauacggauggaaucuggugagauuacagagugguguagauguguucuuuauaccgcccgagaagugcgacacuuuacuaugugauauaggggagagcucgccgaauccaacggucgaagccgguagaacccuccgaguuuuaaaucuggucgaaaauugguuaaacaauaauacgcaauucugcauaaaaguguuaaacccauauaugccaagcguaauagagaaaauggaagcacuucaaaggaaauaugguggugcacuuguccgcaauccucugagcggaaaucucaaaaacgaaauguauuggguaucaaaugcaaguggcaacauugugagcagugucaacaugauaaguagaaugcuaauuaaucgcuuuacaaugagacacaagaaagcaaccuaugaaccugauguugauuuggggagugggacgaggaauauagguauagaaucagagacaccgaaccuggauauaauugguaaaaggauugagaaaauaaaacaggaacacgaaacaagcuggcacuaugaccaagaucauccguauaaaacgugggcauaccauggaagcuacgaaacuaaacaaacaggaagugccaguaguauggucaacgguguaguuagguuacugacuaagcccugggaugucuuaccaacaguaacucagauggcaaugaccgauaccacaccuuuuggacaacagaggguauucaaagagaaaguugauacgcgaacucaggaacccaaagaggguacuaagaaacuaaugaaaaucaccgcagaaugguuauggaaagaauuagguaagaagaaaaccccacgaauguguacgagagaggaguucacucgaaaaguuagaucuaacgcugcacuuggagcaaucuuuacagaugaaaacaaguggaaaagcgccagagaagcaguagaggacaguagauucugggaguuaguugacaaggagcgaaaucuccaucuugaaggaaagugcgaaacaugcguauauaauaugaugggaaaacgagagaagaaacugggcgaguucgguaaagccaaaggaagucgagcuauuugguauaugugguugggcgcucgcuuccuagaguuugaagcauuaggauucuugaaugaagaucauugguuuagcagagaaaauucauugagcggugucgaaggcgaaggucuacacaaacuaggcuacauacuaagggauguuaguaagaaagaagguggagcaauguacgcagaugauacugcugguugggauacucguauaacuuuagaagauuugaaaaacgaagaaaugguaaccaaucacauggaaggagaacacaaaaagcuagcagaggcgauauuuaaacucaccuaucaaaacaagguaguaagaguccaacgacccacgccccgcggaacagucauggacauuaucagcagaagggaccagagaggaucaggacaagucggcacuuauggacucaauacauucacaaacauggaagcgcaacuaauaagacaaauggagggagaagguguuuuuaaaaauauucagcacuugaccguaaccgaagaaguggcaguacagaauugguuagccaggguaggcagggaaagguuaagucguauggcgauaucaggcgaugacuguguaguaaaaccccuugacgacagguuugcaaacgcgcugacggcucuaaacgacauggguaagauacgaaaagacauccagcaaugggaaccaagcaaaggauggaacgauuggacucaaguaccauucuguucacaccauuuucacgaacuuauuaugaaagauggcagaguguugguaguaccuuguagaaaucaagacgaacuaauaggcagagcgcgaauuagucagggagcaggauggagucuaagggagacagcaugucuuggaaaaagcuacgcucagauguggaguuuaauguauuuucacagaagagaccuuagacugguagccaacgcaauauguagugcuguuccaucacauuggguaccaacaagcagaaccacguggucgauacacgccaaacaugaguggaugacaacagaagacaugcugaccguauggaaucguguguggauacgggaaaacccauggauggaggauaaaacuccaguugagagcugggaagaaauacccuauuuaggcaaaagagaggaucaguggugcggaucuuugauaggcuuaacuuccagagcgacaugggcuaaaaacauacaagcggcgaucaaccagguacgaagucugauagggaaugaagaauacacugauuacaugccgaguaugaagagauuucggcgcgaagaagaggaagccgggguucuaugguga

SEQ ID NO: 22714 - RNA, 9876 nt, Artificial Sequence
  derived and/or modified CDS sequence (opt6) from DENV-2__FJ410224__SS-prME
ucagcgggaaugauaaucauguuaauuccaacgguuauggcuuuccaucuuacuacuagaaauggugaaccacauaugauuguaggcauucaagaaaaagggaaaucguugcuauucaaaacugaagauggcguuaauauguguacauuaauggcgauggaucuaggugaacuaugcgaagauaccguaacuuauaaaugcccuuuacuacgucaaaaugaaccugaggauauugauugcuggugcaauaguacgucuacguggguuacauauggaacaugcacaacaacgggagaacauagacgugaaaaacggucaguagcucuagucccucauguuggaauggguuuggagacuagaacagagaccuggaugagcagcgagggugcuuggaaacaugcacaaagaaucgaaacuuggauuuugagacacccgggauucaccaucauggcagcuauauuggcauacacaauugggacuacacauuuccaaagaguauuaaucuuuauauuguuaaccgcgguugcaccuucaaugacaaugagauguauuggcauaucaaauagggauuucguagaggguguuaguggagggucauggguagacauaguuuuagaacaugguaguugugucacgaccauggcgaaaaacaaaccaacuuuagacuuugaauugauaaaaacugaagcgaaacagccagcaacacuacguaaauacuguaucgaggcuaaacucacaaauaccacuaccgaaagccgaugcccaacacagggugaaccuucacuaaaagaagaacaagauaaaagauucguauguaaacacucgaugguagaccggggauggggcaacgguuguggauuguuugguaaaggaggaauaguaaccugcgcgauguuuaccugcaagaaaaauauggaggguaaaaucguacaaccagagaauuuagaauacacuauaguuguuacgccacacucuggggaggaacaugcaguagggaaugauacuggcaaacauggaaaagaaauuaagguaacaccucagagcucuauaaccgaagcugaacucacugguuauggaacagugaccauggaguguucaccaaggacagguuuggauuucaaugaaaugguucuacuacagauggaaaacaaagcgugguuaguacaccgacaaugguucuuagaccucccacuacccuggcugccaggcgcagacaagcaagagucuaacuggauacaaaaggagacacucgugacuuucaaaaauccucaugccaaaaagcaagacguaguagugcuaggaagucaagaaggagcaaugcauacagcauuaacuggggcuacagagauccaaaugaguucuggaaacuuauuauucacgggccaccuaaaaugcagauuaagaauggacaaacuacaacuuaagggaauguccuacucaaugugcacagguaaguuuaagguuguuaaggaaauugcagaaacacaacacggcacuauaguuauuaggguucaauaugaaggugaugguaguccauguaaaauuccuuuugagauuauggaucuugagaaaagauauguccugggucggcugauaacugugaacccaauaguaacugaaaaggauucccccgugaauauagaagcagaaccuccguucggcgacagcuauaucauaauuggaguggaaccagggcaguugaaauuaaauugguuuaagaaaggaaguaguauaggucaaauguuugagacgacaaugagaggagcgaagcgaauggcgauacuaggcgauacagcaugggacuuuggaagucuaggaggcguauucacuucaauaggaaaagcccugcaucaaguguucggugcaauuuauggagcagcuuucuccggcguaucauggacgaugaaaauuuugaucggggugaucaucacuuggauuggaaugaacucuaggucuacuagcuuaagcgucagcuuaguauuaguuggaacagucacacuauacuuaggggugaugguccaagcagacucgggaugcgugguuaguuggaaaucaaaagaacugaaaugugguagcggcauauuuaucacagauaauguccauacauggacagaacaauauaaauuccagcccgaaucaccuaguaaauuggcauccgccauccaaaaagcacaagaagaaggaaucugcgggauacggaguguuaccagacuagaaaacuuaauguggaagcaaauaacucccgaguuaaaucacaucuuagcugagaacgaaguuaagcugacaauuaugacaggagacauaaaagguauuaugcaagcaggaaaacgauccuuaagaccucagccaaccgaauuaaaauauaguuggaagaccugggggaaagcgaaaaugcucucaacggaaucauauaaccaaacauucuuaauagacggccccgaaacugcagaauguccuaauaccaauagagccuggaauagccuagaaguugaagauuauggauucgggguguucacaacaaacauaugguuaaaacuaaaagagaaacaagaugcauuuugcgauaguaaacuaaugucagcggcuauaaaagacaauagggcuguucaugcagauaugggguauuggauugaaagcgcacugaaugacacuuggaagauagaaaaggcaaguuucauugaagucaaaaacugucauuggcccaaaagccauacacuuuggaguaacgguguccuagaaucugaaaugauaauacccaaaaauuuagcgggaccaguaucucagcauaauuauagaccuggguaccacacacagaucgcuggaccauggcaucuaggcaaacuugaaauggacuuugacuucugcgacgguacaacuguaauuguaacggaagauuguggaaaucguggaccaucucuaagaacuacuacagcgagcggaaaacuuauaaccgaaugguguugcagaucaugcacacucccaccguuaagauacaggggcgaagaugguuguugguaugggauggaaauacggccguuaaaggagaaagaagaaaaucuugucaauucucuagucacagcagggcacggacaaguugacaacuuuagcuuagguguacuaggaauggcccuuuuucuagaggaaaugcuaagaacucgagucggcacaaaacaugcuauccuacucguggcuguaaguuucguaaccuugaucacagguaacaugucuuuuaaagaucuagggagggucguagucaugguaggggcuacaauggcugaugacauagggauggggguaacauauuuagcucuguuagcagcauucaagguuagaccuaccuuugcggcuggcuuguuauugagaaaacuaaccaguaaggaguuaaugaugacaaccaucggcauaguacuacuuucgcaaucaacaauuccggagacgguauuggaauugacagaugcccuugcacuaggaaugaugguacuaaaaaucgucagaaauauggaaaaauaucaacuugccguuacuauaauggcgauucuaugugucccuaaugcugucauucuucagaacgcguggaaggugucaugcacaauuuuagcaguaguuucagucaguccucuauuacuuacaaguagucaacaaaagacggauuggaucccccuggcacuaacaaucaagggcuuaaacccgacagcuauauuuuuaacaacacuaaguagaacaaacaaaaagagaucuuggccgcuaaacgaagcuauaauggcuguuggaaugguuucaauuuuagcaucaagccuauugaaaaaugauauaccuaugacagguccccuagucgcaggcggauuacuaaccguauguuauguguugacaggacgaucagcugaucuggaacucgagagagcuaccgacgugaaaugggaagaccaggcugagaucagugguaguucaccaauacugucuauuacgauaucagaagauggaaguaugucaauuaaaaaugaagaagaagaacaaacccugaccauuuugauaaggacagggcuauuaguuauaagcgggcuauucccaauuagcauccccauaacagcggcagcaugguaccuaugggaagucaagaaacaaagagccgguguauuaugggauguuccgucaccgcccccgaugggcaaagcagaacuugaagacggggcauauaggauaaaacaaaaaggaauacuuggauacucccaaauaggugcaggaguauacaaagaaggcacguuucacacaauguggcauguuacgaggggcgcagugcuaaugcauaaaggaaaacgaauugaaccgagcugggcggacguuaagaaagaucugauuucauacggcggagguuggaaacuugaaggagaauggaaagaaggagaagaggugcaaguccuagcuuuagaaccuggcaaaaacccuagagcuguacaaacaaagcccggucuuuucaaaaccaauacaggcacuauaggugcuguaucauuggacuucucgccaggcacgucaggcuccccuauaauagauaaaaagggcaaaguaguuggauuauaugguaacggcguaguaacaagaagcggagcauacguaucagcaauugcccaaacagaaaaaucgaucgaagacaacccugagauagaggaugauauauuucgaaagcggagauugacaauaauggauuugcauccuggggcgggaaaaacaaagcgauaucucccggccauaguccgagaagcgauaaaaagaggacuuagaacuuuaauucuugcuccgacccgcgugguagcagcggaaauggaagaggcgcuucgcggauuaccgauuagauaucaaacacccgcgauaagggccgagcacacaggucgugagaucguagaucuaaugugucaugcuacuuucacaaugaggcuacuuucgccaguacgaguaccgaacuacaaccuaauuaucauggacgaggcccauuuuacagacccugccucgauagcagcucgagguuauauaucaacacgcguugaaaugggcgaggcagcuggaauauuuaugacagcuacacccccuggcucucgugacccuuuuccccagaguaaugcaccaauaauugaugaggaaagggagaucccugaacguuccuggaacucaggccaugaaugggugacagauuucaaaggaaaaacugugugguuugugccgucgauaaaagcaggcaacgauaucgccgcuugucuaaggaaaaaugguaagaaagucauacaauuaaguagaaagacauucgacucagaauacguaaaaacaaggaccaacgacugggauuuugucgugacuacugacauuucugagaugggagcgaacuuuaaagcagaacgggucaucgacccuaggcguuguaugaaaccaguaauucuuacagacggugaagaaagggucauccuugcagguccuaugccaguuacgcauuccucggcugcacaaagaagaggaaggauagguagaaacccaaagaacgagaaugaccaauauaucuauaugggagagccuuuggaaaaugacgaagauugugcacauuggaaggaagcuaaaauguuauuagacaauauaaacacaccagaagggauaauacccuccauguucgagccugagcgugagaaaguagaugccauagacggagaauaucgcuuaagaggugaggcaaggaaaacguuuguagauuuaaugcguaggggugauuuaccaguauggcuagcauauaagguagcggcggaaggaaucaacuaugcugaucguagaugguguuucgauggcauuaaaaacaaccaaauauuggaagagaauguggaaguagagauauggacgaaagaaggggaaaggaagaaauuaaaaccaagauggcuagacgcuagaaucuacagcgauccacuugcauuaaaagaauuuaaagaauuugcggcaggcagaaaaucacucacauuaaaccugauaacagaaaugggaagauugccuacauuuaugacccagaaaacuagggacgcuuuagacaaccucgcaguucugcauacggcagaagcagggggccgugcuuauaaucaugcacuaagcgaacuaccggaaacauuagaaacacuuuuacuauuaacauuauuggcaacuguuacgggaggcauauuucuauuuuuaaugucuggacgggggauaggaaagaugacguuaggcaugugcuguauuauaacggcauccauacucuuaugguaugcacaaauccaaccacauuggauagcggcaucaaucauucuagaauuuuuccuaaucguuuuacuaauaccagaaccugaaaaacaaaggaccccgcaagauaaucaauuaacuuauguagugauagcaauauugacagugguagcugccacgauggccaaugaaaugggcuuucuugagaaaacuaagaaagauuugggccuaggaaguaucgcuacucaacaaccagaaucgaacauacuggacauagaucugcguccagcuuccgcuuggacccucuacgcgguugccacuaccuucguaaccccuaugcugcgacacucaauugaaaacucaucggucaaugucaguuuaacugcaaucgcaaaucaggcaacaguguuaaugggguuaggaaaaggauggccacugucgaaaauggauauaggaguaccacuucuagcgauaggaugcuacucccaagucaacccuauaacucuuacggcugcucuauuauuauuagucgcucauuaugccauaauaggaccggggcugcaggcaaaggcuacgcgagaagcacaaaagcgcgcagcagcaggaauuaugaaaaauccaacagucgauggaauuacgguaauugaucuagaucccauaccuuaugauccaaaauucgaaaaacaauugggacaaguuaugcuauuaauccucugugucacccaagucuuaaugaugagaacaacaugggcccuuugugaagcccucacacuggcuaccggaccaauaaguacccuuugggaaggaaauccgggacgauucuggaauacaacgauugcgguaucaauggcuaacauauucagaggaaguuaccuagcgggggcaggucuacuauuuucuaucaugaaaaauacaacaaauacccggcgcgguacagguaauauaggagaaacauugggugaaaaguggaaaagcagguuaaacgcacuggggaaaagugaauuucaaacuuauaagaaaucaggaauacaagaaguagauagaaccuuagcaaaggaaggcaucaagcggggugagacagaucaucaugccgugucucggggaagcgcaaaacuucgaugguuuguugaacguaauaugguaacucccgaagggaaaguaguugauuuaggaugugguagaggugguuggucuuacuauugcgggggccugaaaaauguucgagaggugaaagggcuaacuaaaggaggcccggggcaugaagaaccgauuccgaugucgacguauggauggaauuuagucagacuucagaguggaguagauguguuuuucauuccaccagaaaaaugugauacauugcuaugcgauauaggugaaucaucucccaauccaaccguggaggccggacgaacacugagagugcuaaaucuaguagaaaauuggcuaaauaauaauacucaguucugcaucaaaguauugaaucccuacaugccaucgguaauugagaaaauggaagcacuucaaagaaaguacgguggagcccucgucaggaauccuuuaucacgaaacucgacccaugaaauguauuggguaagcaacgccagcggaaauauuguauccucagucaauaugaucagcagaaugcuaauuaauagauuuacaaugagacacaagaaggcuacuuaugaaccggauguugaucugggcaguggaacacguaacaucggaaucgagucagaaauuccuaaccuagauauaauuggaaagagaaucgaaaagauuaaacaagaacaugagacaaguuggcauuaugaccaagaucauccauacaaaacgugggcauaucaugguagcuaugaaacuaaacagacaggaucggccucaagcaugguuaacggcguaguaagacuacuuacuaaaccaugggauguccuaccgacaguaacacaaauggcaaugacagacacgacacccuuuggucaacaaaggguauucaaggaaaagguagauacaagaacacaagaaccgaaagaaggaacgaagaaauuaaugaaaaucacagcagaguggcuguggaaagaacuagguaaaaagaaaacuccgcgcauguguacaagagaagaguucacacguaaagucagauccaaugcugcucuuggagcaauauuuacggaugaaaauaaguggaagucugcaagagaagcgguagaagacagucgauucugggaguuagucgauaaagagaggaauuugcauuuagaaggaaaaugcgaaacgugcgucuacaacaugaugggaaaacgagagaagaaacuuggagaauuuggaaaggccaagggaaguagagcaauaugguacauguggcuaggagcgagguuucuagaauuugaagcucuaggauuucucaacgaggaccauugguuuagucgugaaaauucuuuauccgggguagaaggcgaagggcuucauaaacuuggguacauuuuaagggaugucaguaagaaagaggguggagcaauguacgccgacgauacugcgggcugggacacacgaauaacuuuggaggaucucaaaaaugaagagaugguaacaaaccauauggaaggcgaacauaagaaacuggcagaagccauauucaaauuaacauaucaaaauaaaguuguucgaguacaaaggcccacccccaggggaacgguaauggacaucauaagcagaagagaccaacguggaucaggacaaguggguacauauggauugaauacguucacuaacauggaagcacagcuaauuagacaaauggaaggcgaagguguguuuaagaacauucaacaucuaaccguuacagaggaaguagcuguacagaauuggcucgccagaguaggaagggagcggcugagcagaauggcaauaaguggcgaugauuguguaguaaagccuuuagaugaccgauuugccaaugcacuaacugcccuaaaugauaugggcaagaucagaaaagauauccagcaaugggaaccuucuaagggauggaacgauuggacacagguaccguuuuguucucaccacuuccaugaacuaauaaugaaggaugguaggguucugguaguucccugcagaaaccaagacgaauuaauuggacgcgcuagaaucagucaaggagcaggcuggagucugcgagagacggcauguuuaggcaagaguuaugcucaaauguggaguuugauguacuuucaccgaagagaccuacguuuagcagcaaaugcgauuugcuccgcgguuccaagucacugggugccaacaucccguacgaccuggagcauacacgcuaaacaugaauggaugacuaccgaagacauguuaaccguauggaacagaguguggauuagggaaaauccauggauggaggauaaaacgcccgucgagaguugggaagaaauacccuaucuagguaagcgugaagaucaaugguguggaucacuuauaggguugaccucuagagcuacaugggccaaaaauauacaggccgcuauaaaucaaguacgaagucugauaggaaacgaagaguacaccgauuacaugccguccaugaaacguuuucgacgagaggaagaggaagccggaguacugugguaa

SEQ ID NO: 22715 - RNA, 9876 nt, Artificial Sequence
  derived and/or modified CDS sequence (opt6) from DENV-2__FJ461321__SS-prME
uccgcugguaugauaauaaugcuaauuccuacaguuauggcauuucaucugacgacuagaaauggggaaccucauaugauaguaggcauacaagagaaaggcaagagucugcuguuuaagacggaagauggaguaaauauguguacacucauggcaauggaucucggagaauuaugugaggauacaauaacauauaagugcccacuuuuaagacaaaaugaacccgaagauauagauuguuggugcaacucgacaucaacguggguuacguauggcacuugcacgacaacuggcgagcaccgcagggaaaaacgaucgguugcguuggucccacauguugggaugggauuagaaacaagaacggaaacuuggaugaguucugaaggagcauggaaacaugcacaaagaauugagacauggauccuaagacacccaggguucacaauaauggcagcgauucucgccuacacgauagguacuacacauuuccaaagagugcuaauauucauccuguuaacugcgguugccccaaguaugaccaugcgguguauaggcauuucuaauagagauuucgucgaaggaguaucaggugguucguggguagauauaguucuugaacauggaaguuguguuacaacaauggccaaaaacaaaccgaccuuagacuuugaguuaauuaaaacggaagcuaaacaaccugccacguuacguaaauacugcauagaagccaagcuuaccaauaccacaacagaaaguagguguccaacgcagggcgagcccucguuaaaagaggaacaagauaagcgauuugucuguaaacauaguaugguggaucgcggauggggcaauggcuguggauuguuugguaaagguggaauaguaacaugugccauguuuaccuguaaaaaaaauauggaagguaaaaucguacaaccggaaaauuuagaauacacgauuguagugacuccacauagcggggaagaacacagugucggcaacgauaccgggaaacacgguauggaaauaaaaguaacaccucaaaguucuauaacugaagcagaacucacuggcuauggcacaguuaccauggaauguucuccccgaacaggacuugacuuuaaugagaugguacuucuucaaauggaaaacaaggcaugguuaguacacaggcagugguuucuagaccuuccacuaccauggcuuccuggcgcagauaagcaagaaaguaauuggauacaaaaggagacauuaguaacuuucaagaauccucacgcgaaaaaacaagauguuguggugcuaggaucucaggaaggagccaugcacacggcacugaccggcgcuacagagauccaaaugucuucaggaaaucuauuauuuaccggccauuugaaauguagguuaaggauggacaaacugcaauuaaaagggaugaguuacagcauguguacuggaaaguuuaaaguaguuaaagaaauagcagaaacgcaacauggcaccauagucaucagaguacaauacgaaggagauggaagcccuuguaaaauaccauuugaaauuauggaccuagagaaacgauauguauuggguagacucauuacuguaaauccuauagucaccgagaaggacucaccgguuaacauagaggcggagccaccguucggggacaguuacauuauuauaggaguugaaccaggacaacucaaauuaaacugguuuaagaaaggauccaguauaggacaaauguucgagacgacaaugagaggcgcuaaaaggauggcaauacuuggcgauacugcaugggauuucggaaguuugggagggguauuuacuucaaucgguaaagccuugcaucaaguauucggagcaauauacggagcggcuuuuaguggaguaaguuggacaaugaaaauacugaucggugugauaaucacguggauaggaaugaacagccggaguaccucacuaaguguaagccucguacuaguugguauaguuacacuauaucugggagugaugguacaagcagauucggguuguguaguaaguuggaagaauaaagagcuuaagugcgggagcggaauuuuuauaacagauaauguacacacauggacggaacaguacaaguuccaaccagaaucaccgucaaaacucgcgucagcuauacaaaaggcgcaagaagaggguauauguggaauaagaagugucacucgccuagaaaaccugauguggaaacagauaaccccagaacuuaaccauauucucgcggaaaaugaggucaaacuuacgaucaugacuggagauauccgugguauuaugcaggcagguaagagaagucuucgaccacagccuacggaauuaaaauacucauggaagaccugggguaaagccaaaaugcucagcacagagucauacaaucaaacauuucuaauugacggaccugaaacagcugaauguccaaauacgaauagggcuuggaauucacuagaaguggaggacuauggauucggcguuuucacuacaaacauuuggcuuaaacuuaaagaaaagcaggaugcauuuugugauagcaagcuaaugagugcggcaauuaaggacaaccgugcaguacacgcagauauggguuauuggauagaaagcgcacucaacgacacuuggaaaauagaaaaagcaaguuuuauugaagucaagaauugucacuggccaaaaucgcauacauuguggagcaacggaguccuagagagugagaugauuauaccaaagaacuuggcuggucccgugucccaacauaacuaccggccagguuaccacacgcaaauugcgggaccuuggcauuuagggaaacuugagauggacuucgauuucugugacggaacuacuguaauugugacagaagauugugguaacagggguccgaguuuaagaacaacaacagcauccggaaagcuuauuacagaaugguguugcaggagcugcacuuugccuccccuaagguauagaggagaagauggaugcugguauggaauggagauccgacccuuaaaagaaaaggaagaaaauuuaguaaacaguuuggucacagcgggccacggccagguagauaauuuuaguuuaggaguauuagggauggcacucuuuuuagaagaaaugcuucgcacaagaguagggacaaagcaugcaaucuuauuaguagcuguaaguuucgucaccuuaauaacaggaaauauguccuuuaaagacuuagggcguguaguugucaugguaggagcuacuauggcggaugacaucgggaugggaguuacauauuuagcacuauuggcggcauucaaaguucgaccaacauuugcugcuggauuguuauuaaggaagcuuacguccaaagaauugaugaugaccacuauuggaauuguauuguuaagucaauccacuauuccugaaacaguccuagaacucacagaugcacucgcuuuaggcaugauggugcugaagauuguacguaacauggaaaaauaucaacuugcaguaaccauuauggcaauacuauguguuccuaacgcgguaauucuucaaaaugcguggaaaguuucauguacaauuuuagccguagugagugugucuccacugcuuuuaaccucgucacagcaaaaaaccgacuggauaccuuuggcacucacgauuaaagguuuaaauccaaccgcgauauuuuuaacgacucuaagccguacgaauaagaaaagaagcuggccgcuaaacgaagcgauuauggcaguuggaaugguauccauucuggcaagcucauuguuaaaaaacgauauaccaaugacgggaccuuuaguagcggggggucuuuugacuguauguuauguucuuacgggaagaagugcggacuuagaacuagaacgggcuacuaaugugaaaugggaggaccaggcagaaauaagugguucaaguccaauucucucgauaacuaucuccgaagauggcagcaugaguauaaaaaaugaggaagaagaacaaacacuaacaauauuaauuagaacagggcuauugguaauuuccggacuauucccuauaucaauacccaucacugcugcagcuugguaccuaugggaaguuaaaaaacagagagccgguguacuuugggauguaccaucucccccuccuaugggcaaagcagaacuggaggauggggcguauaggaucaaacaaaaagggauccuagguuacucccaaauuggggcggguguauacaaagaaggcaccuuucauacaauguggcacgugacacgaggagcgguacuuaugcauaaagggaaaagaauagagccuagcugggcagaugucaaaaaggaucucauaagcuacgguggggguuggaaacuagaaggcgaauggaaggaaggcgaagaagugcaaguauuagcccuagagccuggaaagaauccaagagcagugcaaacaaaaccugggcuauucaaaaccaauacagggacaauaggagcuguaucauuagacuuuucaccgggaaccucggggucgccaauuauagacaagaaggguaaaguggucggccucuaugguaauggcgucgucacacgaaguggagcauacguaucggcaauagcacaaaccgaaaaaucgaucgaagacaacccugaaauagaagaugauaucuuuagaaaacgacguuuaacgauaauggaucugcauccaggggcaggaaaaacuaaacgauaucuuccagcgauaguaagagaagccauuaaacgcggacuucguacacuaauacuggcucccacuagaguagucgcggcagaaauggaggaagcauuacgaggauuaccaauuagauaucaaacacccgcaaucagggcggaacauacaggacgagaaauugucgaucugaugugucacgcuacauuuacaaugcgccuucuaaguccuguuagaguuccuaauuauaauuugaucauuauggacgaagcccauuuuacggauccagcaucaauugcugcacgaggcuauauaucgacaagaguagagaugggugaagcagcagguauuuuuaugacugcaacuccgccaggaucacgagacccauuuccacaaaguaaugcaccgaucauugaugaagagcgggaaauaccugaacguagcuggaauagcggacacgaauggguuacagauuuuaaagggaaaacaguuugguucguaccuucaauuaaggccggaaaugacauugcagcuugccuacggaaaaauggaaaaaaagugauccaacuaucaagaaaaacuuucgauucggaguacguaaaaacgcgcacuaacgauugggacuuugugguuacuacggacauuucggaaaugggagcaaauuuuaaggccgaacgaguaauagauccuagacgcuguaugaaaccaguaauauuaacagauggugaagaaaggguaaucuuggcuggaccaaugcccguuacacauucauccgcagcacaaagaagaggaagaauagguagaaacccuaagaaugaaaacgaucaguacauauauaugggugaaccauuggaaagcgacgaggacugugcccacuggaaagaagccaaaaugcuccuagauaacauuaacacuccagaaggaaucauaccuucaauguucgaaccagaaagggagaagguagacgccauugauggugaguacagguuacguggagaagcuaggaagacuuuuguagaucuaaugagaagaggugauuuaccugucugguuagcuuauaaaguugcggcugaagguauaaauuaugcagauagaagauggugcuuugauggaauuaaaaauaaccaaauauuagaggaaaauguagaaguagaaaucuggacgaaagaaggugaacgaaaaaaauuaaaaccccgcuggcucgacgcuagaauauauucagacccacucgcacuuaaagaauucaaggaauuugcggcaggaagaaagagccuaacccuuaaccugauaacggaaaugggcaggcucccaacuuuuaugacucagaagacgcgggaugcccuggauaaucuagcagugcuucauacggcagaagcaggcggaagagcguacaaccacgcgcuaucagaacucccggaaacccuagaaacacuacuccuuuuaacucuacuugcgacggugaccggcggcauuuucuuguuucugaugagcggcaggggaauaggaaaaaugacccugggaauguguugcauuauuaccgcuucuauauuacuaugguaugcccagauacaaccucauuggaucgcagcuucaauuauacuggaguuuuucuuaauaguguuauuaauaccagagcccgagaagcagcguacgccacaggauaaucaacuaacguacgucguaauagcuauuuuaacaguaguagcggcuaccauggcaaacgaaauggguuucuuagaaaaaacaaaaaaggauuuaggauuggggagcauugcgacacagcaaccagaaaguaauauacuugauauugaccuaagacccgcaucggcguggacccuguacgcuguagcuacaaccuucguaacaccuauguuacgucauucaauagagaauuccaguguaaacguuagcuuaacagcaauugcaaaucaagccacagucuuaaugggacuugguaaaggcuggccuuuaaguaaaauggauauaggggugccgcuauuagcaauaggauguuacucacagguaaauccgauaacuuuaacggcggcauuacuacuacuagucgcgcauuacgccauaauuggucccggccuucaagcaaaagcgacucgggaggcccaaaaaagagcagcugccggaaucaugaaaaauccuaccguagauggaauaacugucauagaccuagauccaauuccuuaugauccuaaauuugaaaaacaauugggacaggugauguuauuaauucuuuguguuacccaggucuugaugaugcggacuacaugggccuugugugaagcgcuaacuuuagcaaccggaccgauaagcacauugugggaaggaaauccgggucgcuucuggaauacaacuauugcuguuagcauggcuaauauuuucagaggaucuuauuuagcuggagcaggcuuacuauucucgauaaugaagaauacaacaaauacuaggcgaggaacugguaacauaggagaaacguuaggagaaaaguggaagucucgacuuaaugcuuuggggaaaagugaauuucaaaucuauaaaaaaucaggaauucaagaaguggaucgaacauuagccaaagaagguauaaagagaggagaaaccgaccaucaugcaguuagcagaggaucagcgaaauuacguugguuuguagaaaggaacaugguuacacccgaggggaaaguaguagaucuuggaugcgguagaggggguuggaguuauuacuguggaggauuaaagaauguuagggaagugaagggauuaacaaaaggcgguccaggacaugaagagcccauacccaugucaacguacggcuggaaucucgugcgacugcaauccggcguagacguguucuuuauuccaccggaaaagugugauacccuguuaugugacauaggcgaaaguucucccaauccgacaguagaagcaggaagaacccuaagagugcuuaaucuaguggaaaacuggcuaaauaauaauacucaauuuuguauuaaaguuuuaaauccguauaugccaucuguaaucgagaaaauggaagccuuacagagaaaauauggaggagcccugguaagaaauccauugagcagaaauucuacucaugaaauguacuggguuucaaaugcuucgggaaauaucguaucaaguguaaauaugauaagucgcaugcucauaaaucgguucacuaugagacacaagaaagcaaccuaugagccggacguugauuugggcagcggaacuagaaacauaggaaucgaaagcgaaauaccuaaucuagauauaauagggaaaagaauugagaaaauaaaacaagaacacgaaacaucauggcauuaugaucaagaccacccauauaaaacgugggccuaucaugguagcuaugaaacaaaacaaaccggaagugcuucaaguaugguaaacgggguuguccgguuacuaacaaagccaugggauguucucccaacaguuacacaaauggcuaugacagauacaacaccauucggccagcaaagaguauucaaagaaaaaguagauacacgaacccaagaaccaaaagaagggacaaaaaaacuuaugaaaaucacagcagaaugguuauggaaagaacuagguaagaagaagacaccaagaaugugcacaagagaagaguuuacucggaaaguacgaucgaacgcagcucugggggcaaucuuuaccgacgaaaauaaauggaaaagcgcaagggaagcuguugaagauucacguuucugggagcuagucgauaaagaaagaaauuuacaccuagaaggcaaaugugagacguguguauauaacaugaugggaaaaagagagaaaaagcugggagaguuugggaaagcaaaaggcagccgcgccauuugguauauguggcuuggugcucguuuuuuagaauucgaagcacuaggauucuuaaacgaagaucacugguuuagccgggagaauagcuuauccggaguagagggagagggauugcacaaacuuggcuacaucuuacgagacguaaguaagaaagagggaggagcaauguacgcagacgacacagcgggcugggacacaagaauaacguuggaagaccucaaaaacgaagagaugguaacaaaccacauggaaggggagcacaagaaauuagcagaggcaauuuuuaaauuaacguaucaaaauaaaguuguaagaguucaaagaccgacaccucgaggaaccguuauggauauaauaucacguagagaccaacguggcucaggucaagucggaacauacggucuaaacaccuucaccaauauggaagcacaauuaauucgucaaauggaaggagaaggaguguucaagaauauacaacaccuuacuguaacugaagaaguugcaguacauaacugguuggccagaguagggagggaacgcuugucaagaauggccauuaguggcgaugauugcguaguaaaaccacuagacgauagguuugcaaaugcacugacagcuuuaaaugacaugggaaaaauacgcaaagacauccaacaaugggaaccauccaagggauggaacgacuggacacaaguaccauuuugcucacaccacuuccaugagcugauaaugaaagacggaaggauucucguaguuccuuguagaaaucaggaugaacuaauagggagagcccgaauaagucaaggagcaggcuggagccucagagaaacugcguguuuaggcaaaucauaugcacaaaugugguccuugauguacuuccacagaagagaucuaagacucgcagcaaaugcuauuuguucagcagugccuucacacuggguacccacaucaagaaccacauggucaauucacgcuaaacaugaauggaugacaacggaggauaugcugacgguauggaacaggguguggauccgagaaaacccauggauggaagauaaaacuccuguagagucgugggaagaaauuccuuaccucggcaaacgggaagaucaauggugcggaucuuuaauuggccugacgucaagggccacuugggcuaaaaauauacaagcagcuaucaaccaagugcgcagccuuaucgggaaugaagaauauaccgauuacaugccuaguaugaaaagauuccgacgcgaagaagaggaagcugggguucuaugguaa

SEQ ID NO: 22716 - RNA, 9876 nt, Artificial Sequence
  derived and/or modified CDS sequence (opt6) from DENV-2__FJ410228__SS-prME
agugcaggaaugauaauuaugcuuauacccacuguuauggcuuuucaucugaccacucguaauggagaaccacauaugauagucgggauucaagaaaaagggaaaucucuuuuguuuaaaacagaagaugggguaaauauguguacauuaauggcuauggacuuaggagaacucugugaagauacgauaacauauaaaugcccccugcuacgucaaaacgaaccugaagacauagauugcugguguaauaguacaucaacaugggugaccuauggaacgugcacaacaacuggggaacauagacgugaaaaacggucgguagcacuggugccccacgucgguauggguuuggaaacacgcacagaaaccuggaugucuagcgaaggagcuuggaaacacgcacaacgcauugaaacauggauucugcgacacccuggauucacaauuauggccgcaauucuggcguacacuauagguacgacgcauuuucagaggguacuaauauucauacuacuuacagcuguugcuccuucgaugacgaugcguugcauugggauaucuaauagggauuucguagaaggaguuagugguggaucuuggguagacauaguacuugaacacggaaguuguguaacaacuauggcgaaaaauaaaccaacucuggauuuugaauuaauaaaaaccgaagcuaaacaaccagcaacucucagaaaauauuguaucgaagcaaaauugacaaauacaacgacugaaagucgguguccuacacaaggugaaccgucauuaaaagaagaacaagacaaacgguuugucuguaaacauucaaugguggacagaggauggggaaacggguguggucucuucggaaaaggaggaaucguaacaugugcuauguucacuuguaagaaaaacauggaaggaaaaauaguucaaccugaaaauuuggaauacacgaucguagucacuccacacaguggagaagaacaugcuguagguaacgauacgggaaaacacggaauggaaaucaaagucacaccacaaucgucaauaacagaagccgaacuuacuggcuaugguacgguaacgauggaauguagcccaagaacuggauuggauuucaacgagaugguacuuuuacaaauggaaaacaaagccugguugguucauaggcaaugguuucuagaccucccauuaccuuggcuuccuggcgccgacaaacaagagucaaacuggauacaaaaagaaacucuuguuacguucaaaaauccccaugcuaagaaacaagauguuguaguguuaggcucacaagaaggugcaaugcacacagcccuaacgggagccacugagauacagaugagcucagguaauuuacuuuuuacuggccacuuaaaaugcagacuaagaauggacaaauuacaauuaaaaggaaugucuuauucgaugugcacagggaaauuuaaaguaguuaaagaaaucgcagaaacccaacacgggaccauuguaauuagaguacaauaugagggagauggcagcccauguaaaauaccguuugagaucauggaucuagagaaaagguauguccugggccgacucauuacaguaaauccuauagucacggaaaaagauucuccugucaauauugaagcagaaccacccuuuggagauucuuacaucauaauaggcguagaaccgggacaacucaaauugaacugguuuaagaaaggaucaucgauuggccaaauguucgaaacuacaaugaggggcgcaaaacguauggcgauacuaggagacacugcuugggauuuugguucauuaggaggaguauuuacgaguauugguaaagcacuucaccaagucuuuggcgcuauauacggagcagcguuuaguggggucuccuggaccaugaaaauuuuaauuggcgucaucauaacuuggauaggaaugaacucgagaucuacaagccucagugugaguuuaguacucgucgggauaguuacgcucuauuuggguguaaugguucaagcggacagugguuguguagucagcuggaaaaauaaagaguuaaaauguggaagcgggaucuuuauaacagacaaugugcauacauggaccgaacaauauaaauuucaaccugagucgccuucgaaauuagcaucagccauccaaaaagcccaagaggaaggaaucuguggcauuagaucagugacacgcuuagaaaaucucauguggaaacaaauuacgcccgaacuaaaucauauucuggccgaaaacgagguuaaacuaacaauaaugacaggggacauuagaggaauuaugcaggcagguaaacguagcuuaaggccacaaccgacagagcuaaaguacagcuggaaaacaugggguaaggcuaaaaugcugagcacagaaagcuauaaucaaacuuuccuaauugauggcccagaaacagcggaauguccaaauacuaauagagcauggaacucguuggaaguugaagauuauggauuugggguauucacuacaaauauuuggcugaaguuaaaagaaaaacaagacgcauucugugacucuaaacuaaugucagcggcaauuaaagauaaccgagcaguacaugcagauaugggcuauuggauagaaucagcauuaaacgauacuuggaaaauagagaaagcaucuuuuauugaagucaaaaacugucacuggccaaagucgcacacucuguggaguaacgggguacucgaaucugaaaugauaauacccaaaaauuuagccgguccuguaucacaacacaauuaccgaccgggauaccauacacaaauagcugggccauggcaucuuggaaaacuugaaauggacuuugacuucugugacgggacaacugucauaguaacagaggauuguggaaacagagggcccagucuacgcacaaccacagcaucaggaaaacuaauaacggaaugguguuguaggucaugcacacuuccgccauuaagauaucggggagaagauggauguugguaugguauggagauucguccauugaaagagaaagaagagaacuuaguaaauucccuaguuaccgccggucauggucaaguagauaacuuuagucuuggaguauuaggaauggcucuauuuuuggaggaaaugcuucggacucgaguaggcaccaaacacgcuauauuacuugucgcuguaucauuuguuacguuaauaacaggaaauaugucuuuuaaggaucuuggcagaguaguaguaaugguuggagccacgauggcugaugauauuggaaugggaguaacguacuuagcauuacuggcagcauucaaaguaagaccaacguucgcggcaggauuacugcugagaaaacucacaucaaaagaacuuaugaugacaacuauaggcauuguuuuguuaucacaaaguacaauacccgagacgguauuggaacucacagaugcucucgcacuuggaaugaugguacuaaaaauugugagaaauauggaaaaauaucaauuagcgguaacaauuauggccauucuuugugugccaaaugccguaauucuucaaaaugccuggaagguaagcuguaccauacucgcugucgucaguguaucaccauuacuacuuaccucuagucagcagaaaacagauuggaucccgcuggcgcugacgauaaagggacuuaauccaacagcaaucuuuuuaacaacucuaagcagaacuaauaaaaagcgaucauggccacuaaaugaggccauuauggccgucgggaugguaucuauacuugcuucaagccuucuuaaaaaugacaucccgaugacugggccauuaguggccggcggucuccuaacaguuuguuauguauuaacaggacgaucggccgauuuggaauuagaacgagcuacugauguuaaaugggaggaccaagcugaaaucucagguucaagucccauauuaucuaucacaauaucagaagacggguccaugucaaucaaaaacgaagaggaagaacaaacucucacaauucugauaagaacuggacuauuggugauauccggacuauuuccuauaucaauuccuauaaccgcagccgcaugguaccuuugggaaguuaaaaagcaacgagcaggcguguuaugggaugucccaaguccaccuccaaugggcaaagcagaguuagaagauggagcguaucgaauaaaacaaaagggcauacuaggcuauagucaaaucggagcgggcguauacaaagaggguacauuucauacuauguggcaugugacacgaggcgcuguccuuaugcauaagggaaaaagaauagagcccagcugggccgaugucaagaaagaccucauuucuuauggagguggauggaaauuagaaggcgaguggaaagaaggagaagaaguccaaguacuagcuuuagagccgggcaaaaauccacgagcaguacaaacaaaacccggacucuucaaaacaaauacagguacuauaggagcagugaguuuagacuucucaccgggaacaagcggcaguccaauaauugauaagaaaggaaaaguagugggguuguauggaaacggaguuguaacgagaucgggagcguacgucucagcuaucgcacaaaccgagaaaucuauugaagacaacccugaaauagaagaugauauauuccgcaaaagacgauugaccauuauggauuuacauccaggagcaggaaaaacgaaacgauauuugccggcuauaguucgugaagccauuaagagaggucuaaggacacugauauuagccccaacuagagucguagcagcugaaauggaagaagcauuaaggggauuaccuauaagauaccagacuccugcuauaagggccgaacacacaggcagagaaauuguagaucuaaugugccacgcgacauuuacaaugcgacugcuuucuccuguuagaguaccaaacuauaaucugauuauaauggaugaagcacauuuuacggacccagcgucaauagccgcucgugguuacauaucgacgcguguggaaaugggagaggccgcaggaauauucaugacagcaacaccaccaggcucccgggauccguuuccccaaucuaaugcaccgauaauagaugaagaaagggaaauaccagagcgguccuggaauaguggucacgaaugggugacagacuuuaacgggaagaccguaugguucguuccgaguauuaaggcagguaacgauauugcagcaugucucaggaagaacggcaagaaaguuauacaacuaucacggaaaacauuugauucagaauacgugaaaacaaggacaaaugauugggacuucguuguaacaacagauauaagugaaaugggugcaaauuucaaagcugaaagagucauagauccacgcagauguaugaaacccgugauucuaaccgacggcgaagaaagaguuauuuuagcuggcccaaugcccgugacacauucgucagccgcucaacggcgcggucggauuggacgaaauccaaagaacgagaaugaucaauacaucuauaugggagaaccuuuggaaaaugaugaagacugugcacauuggaaagaagcaaaaaugcuacuagauaacauaaauacaccggaaggcaucauaccuucuauguuugagccagaaagggaaaagguugaugcuauagauggagaauaucgacuaagaggugaagcucggaagacauuuguagaucucaugagacguggggauuuaccgguaugguuagccuauaaagucgcagcugaagggauuaauuaugcagauagaagauggugcuuugacggaaucaaaaacaaccaaauuuuagaagaaaauguagaaguagaaaucuggacgaaggaaggggaaagaaagaaauuaaaaccgagguggcuugacgcuaggaucuauucggaucccuuggcacuaaaagaguucaaagaguucgcugccgggagaaaaucccuuacauugaauuuaaucacagaaaugggaagauuaccaacuuuuaugacacagaaaacgagggaugcuuuagacaaccuugcgguccuccacaccgcagaagcaggaggcagggcauacaaccacgcccuuucagaauuaccugaaacguuggagaccuugcuacuucuuacucuucucgcgacaguuaccggagguaucuuuuuauuucuaaugucugguagaggaauagggaaaaugacacuuggaauguguuguauaaucacugcuagcauacuccuaugguaugcucaaauacagccucauuggauugccgcaucuauuaucuuagaguucuuuuugauuguucuauuaauaccagaaccugagaaacagcgaacuccacaagauaaucaguugacuuaugugguaaucgcaauucuaacgguaguggcugccacaauggcaaaugagauggguuucuuagaaaagacaaagaaagacuugggacuggguagcaucgcaacccaacaaccggaaucuaacauacuagacauagaucuaagaccggcaagcgccuggacauuguacgccguagcgaccacauucguaacgcccaugcuacgacauucuaucgaaaacucgucugugaauguuucacuaacagcaauagcuaaucaagcaacagucuugauggggcuaggaaaagguuggccuuuaucuaaaauggauauagguguuccauuguuagcuauuggcuguuauucucagguaaauccaauuacccuaacggcugcauuacugcuacugguugcccacuacgcuauaauaggcccaggcuuacaagcuaaagcuacucgugaagcccagaaacgagccgcggcaggaauaaugaagaauccuacaguugaugguauaacagucauugaucuagacccgaucccguaugacccgaaauuugaaaaacaacugggacaggugaugcuucuaauacuaugugugacgcaagucuugaugaugcggacuacuugggcauuaugcgaggcuuuaacguuagcuacuggaccuauaaguacuuuaugggaaggaaauccaggacgauuuuggaacaccacaauagcaguuagcauggcgaacauauuuagagguuccuaucuagcaggagcaggguuauuauuuaguauuaugaaaaacacuacaaauacacgucgcgggacuggaaacauaggagaaacucuaggggaaaaauggaaaucgcgacucaaugcauuagguaaguccgaguuccaaauauauaaaaagucggguauucaggaaguugaucgcacccuggcaaaagaagggaucaagagaggugagacugaccaccacgcuguaagccgugguagugcaaaauuaaggugguucguagagcgaaauaugguaacgccugaagguaaagugguagaucuuggcuguggacgaggaggauggucuuacuauugcggaggucuuaaaaacguuagagagguaaagggucuaacaaaaggugggccaggucaugaggaaccaauaccaaugagcaccuauggauggaaccuagugagacuccaaucaggaguagauguguuuuucauuccaccggaaaaaugugauaccuuauuaugcgacauaggggaaucaucuccgaacccuacaguagaggcaggcagaaccuuacguguuuugaaucuuguggaaaauuggcuaaauaacaauacucaauuuugcauuaaaguguuaaacccguacaugccuucaguuauagagaaaauggaagcacugcagagaaaauacggaggugccuuaguaaggaacccuuugagccguaauucgacccaugaaauguauugggugagcaacgcgagcgguaacaucguaaguucuguuaacaugauaucaaggaugcuuauaaauagguuuacuaugcgccacaagaaagccacuuacgaacccgacguggauuuaggaucuggaacgaggaauaucgggauugaaagugaaaucccuaaucuggacauaauagggaaaaggauugagaaaauuaaacaagaacaugaaacaucguggcauuacgaccaggaucauccauauaagacaugggccuaccauggaaguuacgaaacuaagcagacaggcagugcuaguucaauggucaacgggguuguaagauugcuaacgaagccaugggauguucucccaacaguaacacaaauggcuaugacagauaccaccccauuuggccaacaacguguauuuaaggaaaaaguagauacucgaacucaagaaccaaaagagggcacaaagaaguuaaugaaaaucacugcagaaugguuauggaaagaguuggggaagaagaaaacuccgaggauguguacacgagaggaauuuacuagaaaggucagaucgaacgcagcgcuuggagccauauucacagacgaaaacaaguggaaaagugcccgagaagcaguugaagauagccgguuuugggagcuuguagauaaggagagaaauuugcaucuggaaggaaaaugugagacuuguguuuauaauaugauggggaagcgcgagaagaaauuaggagaauuuggaaaagccaagggcagcagagcuaucugguacaugugguuaggugcgcgauucuuagaguucgaggcauuaggcuuucucaaugaggaucacugguuuucgagggaaaauagucuuaguggcguagagggagaaggccuucacaaacuugguuauauuuuacgugacgugaguaagaaagagggaggcgcuauguaugcugacgauaccgcaggaugggauacccgaauuacccuagaagaucuaaagaaugaggaaaugguuacgaaccacauggaaggagaacacaagaaauuagcagaagcuauauuuaaauuaacauaucaaaauaaaguagugagaguacaaagaccaacgccuagagggacugucauggacauaauuucacgacgagaccaaagaggaucuggccaggugggaacauacggacuaaauacauuuacuaauauggaagcucaacucauccggcaaauggaaggcgagggcguauucaaaaacauccaacacuuaaccgugacagaagaaguagcaguacacaacugguuagcccguguaggcagggaaagauuaaguagaauggcgaucucgggggaugauuguguugugaaaccacucgacgauagauuugcaaaugccuuaaccgccuuaaacgacaugggaaagauacgaaaggauauucaacaaugggagccaaguaagggguggaacgauuggacgcaagucccauuuuguucacaccauuuucacgaauuaauuaugaaggacggaaggauucuuguagugccauguagaaaucaagacgaacugauaggacgagcuaggauaagucaaggagcgggauggucacuucgugagacggcaugccuuggaaagucauaugcgcagauguggagccucauguacuuucaucgaagggacuuaagguuagcagcaaacgcgauaugcucagccguacccucacauuggguuccuaccagucgaacgacuuggagcauacaugcaaagcacgaauggaugacgacagaagauaugcugacuguguggaaccgagucuggauaagagaaaauccuuggauggaagauaaaaccccgguagaauccugggaagagauaccguacuuaggaaaaagagaagaccagugguguggaucacuaauaggccuaacgucucgcgcgacaugggcuaaaaacauacaggcggcuauaaaucaaguaagaagccucauagguaacgaagaauauacugacuauaugcccucgaugaaacguuuuagaagagaagaagaagaggcaggaguauuaugguaa

SEQ ID NO: 22717 - RNA, 9876 nt, Artificial Sequence
  derived and/or modified CDS sequence (opt6) from DENV-2__FJ410233__SS-prME
ucugcaggcaugauuauaauguuaauuccuaccgugauggcguuccacuuaacuacuagaaauggugaaccacauaugauaguaggaauacaagaaaaaggaaaauccuuauuguucaaaacugaagacggaguaaacauguguaccuugauggcaauggacuuaggugaauuaugugaagacacuauaacguacaaauguccacuuuuaaggcaaaaugaaccugaagacauagauuguuggugcaauucuacaaguacauggguuacuuauggaacguguaccaccacuggggaacauagacgugaaaaacgcucuguggcauuaguaccgcauguagguaugggccuagaaaccagaacugaaacauggaugaguucugaaggagcuuggaaacaugcucaacgaauagaaacuuggauucuuaggcauccaggauuuacaaucauggcggcgauucucgcauacacaaucggaacuacccacuuccaacgcguacucauauucauucuccuaacggcgguagcuccuucaaugacuaugaggugcaucggaauaaguaauagagacuuuguagaaggcguaagcggagguaguuggguggacaucguacuugaacaugguucuugcgucacuacuauggccaaaaacaaacccaccuuagauuuugaguuaauaaaaacggaagcgaaacaaccggcuacucuacgcaaauauuguauagaagcaaaacucacaaacacgacuacugaaaguagauguccaacgcaaggggaaccauccuuaaaagaggaacaagacaaacguuuuguauguaaacauuccaugguugacagaggauggggcaaugguuguggucucuuuggaaaaggagguauaguaacaugcgcuauguucacaugcaagaaaaauauggaggguaaaauagugcagccagaaaauuuggaauacacaaucguaguuacgccacauucaggcgaggagcaugcagucgggaacgauacuggaaaacauggacaagaaauuaaagucacaccacaaaguagcaucaccgaagcagaacuaaccggguaugguacagugaccauggagugcucaccaagaacaggauuagauuuuaacgaaaugguauugcugcaaauggaaaauaaagcauggcuuguacacagacaaugguuuuuagaccuaccacugccgugguuacccggagcagacaaacaagaaucaaauuggauacagaaagaaacacucguaacauuuaaaaauccucacgccaagaaacaggacguaguuguccugggaagccaagaaggggcaaugcauacugcacucacaggcgcaacugaaauccagaugaguagugguaaucuucuuuucacaggucaccuaaaaugccgacuucgaauggacaaacuccagcuaaaagguaugucuuauucaaugugcaccggaaaauucaaaguaguaaaagaaauugcagaaacacaacacggaacaauaguaauaaggguacaauaugaaggggaugguucgccguguaaaauucccuuugaaaucauggaccuagaaaaacgauauguucucggucguuugauuacaguuaauccaauuguaacagagaaagauagcccugucaauauagaggcagagcccccuuuuggagauucauauauaauuauaggaguagaaccaggccaauuaaaguuaaauugguuuaaaaagggcuccaguauaggacaaauguucgaaacgacuaugagaggggcuaagcgaauggcuauucugggggauacagcaugggauuuugggucuuuagguggcguauucacgagcauuggaaaagcucuacaccagguauuuggugcgauuuauggagcugcauucucgggcguaucauggacaaugaaaaucuuaauugggguuaucaucaccuggaucggaaugaauagcagaucaacuucacuuaguguaagccuaguacucguuggaauagugacauuauauuugggagucaugguacaagcagauucugguugcguagucucuuggaaaaauaaggagcuaaaaugugguagcgguauauucauuaccgauaacguccauacauggacagaacaauauaaauuccagccagaaagccccuccaaacuugcaagcgcuauacaaaaggcgcaagaagaagggauauguggcauaagaagcgucaccagauuagagaauuugauguggaagcaaauaaccccugaauuaaaucacauacuugcagagaacgaaguaaaacuaacuaucaugacaggggauauaaaggguauaaugcaggcggguaagaggucuuugcgaccacaaccaaccgaauuaaaguauucauggaagaccuggggaaaggcaaaaaugcuaucaaccgaaaguuauaaucaaacauuuuuaauagauggaccggaaacagcagaauguccuaauacgaaucgagcauggaacagccuagaagucgaagauuacggguuuggaguuuucacuacaaacauaugguuaaaguuaaaagagaaacaagaugcauuuugcgacaguaaacuaaugagugcggccauuaaagacaauagggcuguacaugcggacaugggauauuggauugagucggcacuuaaugauacauggaagaucgaaaaagcgucuuucauagaaguaaagaacugccacuggccuaagucgcacacucuuuggagcaauggaguacucgaaucggaaaugauuauuccaaagaaucucgcagggccaguuagccaacacaauuaccgcccaggcuaucauacgcaaaucgcagguccguggcaucucgguaaauuagaaauggacuuuaauuuuugugauggaacaacaguaauugucacugaagauuguggaaaucgaggaccaucauugcguacaacuacagcgucuggaaaauuaauuacugaauggugcuguagauccugcacacuaccaccccugagauauagaggggaagacgguuguugguauggaauggaaauaagaccucugaaagaaaaagaagagaacuuaguaaacucgcuugucacagcaggucauggacaaguggacaacuucucauuagguguacucgggauggcacuauuucuagaagaaauguuaagaacaagaguggguaccaaacaugcaauucuauugguagcaguaaguuucguaacauuaaucacaggaaacaugaguuuuaaagaucuaggucgagucguaguuaugguaggggcuacgaugaccgaugauauaggaauggguguaacguaccuagcauuacuagcagccuucaaaguccgacccacguuugcagcuggauuacuucugagaaagcucacaucaaaagaacuaaugaugacuaccauuggaauaguucuacucagccaguccacuauucccgaaacuguguuagagcuaacggacgcuuuggccuuagguaugauggucuugaaaauaguacgaaauauggaaaaauaucaauuagcagucacuauuauggcuauucuguguguaccuaaugcggucauucuccaaaaugcauggaaaguauccuguacaauucuagcagugguuucagugagcccguuacuauuaacaucaagucaacaaaagacagacuggauaccacuugcucuaaccauaaaagggcuuaauccuacggcgaucuuucuaacaacgcucucacgcacuaauaagaaaagguccuggccccuaaacgaagcgauaauggcuguaggaaugguuaguauacucgccaguuccuuacucaaaaacgauauaccaaugaccgguccgcuugucgcaggaggauuauuaacaguaugcuacguccugacaggucguucagcugacuuagaacuugaaagagcaacugaugucaagugggaagaucaagcugaaauaucggguaguaguccaauauugucgauuacuauaagcgaagauggaagcaugaguaucaagaacgaagaagaggaacaaacucugaccauuuuaauccgaacuggccuucuuguuauaucugguuuauucccuaucuccauuccgauuacugccgccgcaugguauuuaugggaaguuaagaaacaaagggcggguguuuuaugggauguuccuucuccgccgccuauggggaaggccgaacucgaagacggagcuuaccguauuaaacaaaaaggcaucuugggauacucacagauuggcgcggguguguauaaggaagguacauuucauacaauguggcauguaacuagaggcgcggugcuaaugcacaaaggaaaaagaaucgaaccuucuugggcagauguuaagaaagaucuaauauccuauggugguggauggaaguuagaaggugaguggaaagaaggagaagaaguacaaguccuagcuuuggaaccagggaagaacccacgugccgugcaaacaaaacccggccuauuuaaaacgaacacagggacaauaggcgcgguuagccucgacuuuuccccgggaaccucaggaagcccaauaaucgauaagaaagguaaaguuguaggacuauauggcaacggagugguuacaagaucuggggcguauguaucagcaaucgcacagacagagaaaaguauugaagacaauccggaaauugaagacgauauauuccgaaaaaggagauugaccauaauggacuuacacccuggcgcaggaaaaacgaaacgcuaucugcccgccaucguccgagaggccauaaaacgaggccuacgcacgcuaaucuuagcaccaacgagaguaguggcagcugaaauggaagaggcauuacgagggcucccaaucagauaucaaacgccagcgauaagagcggaacauaccgggagagagauugucgauuuaaugugucaugccacguuuacaaugcgauuauuaaguccuguaagagugccuaauuacaaccuuauaaucauggacgaagcgcauuucaccgauccagcuaguauagcugcgcgcggauacaucucuacucguguagaaaugggagaagccgccggaauauuuaugacugcuacaccaccagguucuagagacccuuucccucaaucuaaugcgcccaucauagacgaggaacgagaaauaccugaacggaguuggaacucaggucacgaauggguaaccgacuuuaaagguaaaacagugugguuuguucccuccauuaaagcuggaaaugauauagcugcuugccuacguaagaaugguaaaaagguaauucaauuaagucgaaagaccuuugacagugaauacguuaaaacccgaaccaacgacugggauuucguaguuacuacagacaucagcgaaaugggagcaaacuuuaaagcggaacgcguaauagauccaagacgcuguaugaagccaguaauuuuaacggacggggaggaacgaguuauauuagcugguccgaugccuguaacacauaguagugcggcacaaagaagggggagaauuggacguaaucccaaaaacgagaacgaccaauauaucuauaugggugaacccuuagaaaacgaugaagacugcgcucacuggaaggaagcuaaaaugcugcuggacaacauaaacaccccagaagguauuauccccucaauguucgaacccgaacgggaaaaaguagaugcuaucgacggagaguaucgacuacguggagaagcuagaaaaacauuuguugacuuaaugagacguggcgauuuaccgguaugguuagcauauaaaguugcagcggaaggaauaaauuaugcugaccgaagaugguguuucgacggcaucaaaaacaaccaaauucuagaggaaaacauggagguagaaauauggacaaaagaaggagaacguaagaaguugaaaccuagauggcuagacgcuagaauuuauucagacccauuagcacuaaaagaguucaaagaauuugcagcugggagaaagagcuuaacucucaaucugauaacagagauggggcgacuaccaaccuucaugacacaaaagacuagggacgcuuuagauaaccucgcaguguugcauacagccgaagcaggggguagagcauacaaccacgcuuuaucagaacuuccugaaacauuagaaacuuuauuauugcuaacauuacuagcuacagugacagggggaauuuuucuauucuuaaugagcgggcgugguauuggaaagaugacacuaggcaugugcugcauuauaacugcguccauacugcuaugguaugcacagauacaaccacacuggauagcagcgaguauuauauuagaauuuuuccuuauuguccuauuaauaccugaaccugagaagcaaagaacaccacaggauaaucaguuaacuuacguaguaauugcgauacucaccguggucgcagccacuauggcgaaugaaaugggcuuuuuagagaaaacuaaaaaggaucuaggcuuagggagcauugcuacaagacagccagagaguaacauuuuggacauagauuuacggcccgccuccgcauggacauuauaugccguggcuacaacguucguuaccccaaugcuacggcauagcauagaaaacuccucagugaacgucucguuaacagccaucgcuaaucaagcaacaguuuuaaugggauuaggcaaaggguggccucucagcaaaauggacaucggaguuccacuucuugcaauuggaugcuacucgcaaguaaacccaauuacucucaccgcugcguuauuguuguuagucgcacauuaugcgauaauagggccugguuuacaagcuaaagcuacgagagaagcucagaaacgggcugcggcugguauaaugaaaaaccccaccguagacggaauaacuguaauagauuuagauccuauaccauacgacccaaaauuugagaaacaacuaggacaaguaaugcuauuaguacucugcguaacacaagugcuaaugaugcgaacuacgugggcacucugcgaggcgcuuacacuagcuacuggaccuauaaguacuuuaugggaagggaauccuggacgauuuuggaacaccaccauagcuguaucaauggcuaauauuuuuagggguucguaucuagcuggagcuggacuuuuguucaguauuaugaagaauaccaccaauacgagaagaggcacagguaauaugggagagacacuaggggagaaauggaaguccagacuaaaugcucuagggaagucagaauuucaaaucuacaaaaagucuggaauccaagaaguggauagaaccuuggcaaaggaaggaauaaaacgaggggaaaccgaccaucacgcggucucucgcggaagugccaaauuacgaugguuuguugaaaggaacaugguaacucccgaagggaaaguaguggaccuuggcuguggucgaggaggaugguccuacuacugcggaggccucaaaaacguucgcgaggucaaaggauuaaccaaaggagggcccggacaugaagaaccgaucccaaugaguacauauggauggaacuuaguacgccuacagaguggaguagauguauuuuucauuccgccagaaaaaugcgauacccuauugugcgauauaggagagagcaguccuaauccuacaguggaagccgggagaacacuuagggugcuaaaccuuguagaaaauugguuaaauaauaacacacaauuuuguauaaaaguauuaaauccauacaugccgucgguuauugagaaaauggaagcauugcaaagaaaauauggaggagcuuuaguacgaaauccacucucaagaaacucuacacacgaaauguauuggguaucaaaugcgagugguaacauagugaguagcgucaauaugaucucaagaaugcugauaaaucguuucacgaugaggcacaagaaagcuacauacgagccugacguagauuugggcucgggaacuagaaacauaggcaucgagagugagauacccaauuuagauauaauuggaaagcgaauugagaaaauuaaacaagaacaugagacaucauggcauuacgaucaagaucauccguauaaaacuugggccuaccacgguuccuacgaaacuaagcaaacagggucugcauccucaauggucaauggcguaguaagauuguuaacuaaaccaugggauguccuuccuacgguuacccaaauggcaaugacagacaccacacccuuuggacagcaaagaguguuuaaagaaaagguugauaccagaacccaggaaccgaaagaggggacgaaaaagcuaaugaagaucacagcugaaugguuauggaaagaacuagguaaaaagaaaacacccagaauguguacacgagaagaauuuaccagaaagguaagguccaaugccgcacugggagccauauucacagacgaaaacaaguggaaauccgcacgagaagccguugaggacagucgauucugggaacuggucgacaaagaacgaaauuugcauuuagaaggaaaaugcgagacaugcguuuauaauaugauggguaaaagagagaagaaacuuggagaauuuggaaaggcuaaaggaucgagagcaauuugguauaugugguuaggagcuagauuucuugaguucgaagcauuagguuucuugaacgaagaucacugguuuagucgcgagaacagucucaguggggucgaaggagaggggcuacauaaacuggguuacauauuaagagauguuaguaagaaagaaggcggugccauguaugcugaugacacagccggaugggacacaagaauaacccuagaggaccuaaagaacgaagaaauggugacuaaccacauggaaggcgaacauaaaaaguuagcugaagcaaucuucaaauuaacauaucagaauaaaguaguacguguccaaaggccgacuccgagaggaacaguuauggauaucauaucacgacgagaucagagggggucuggacagguuggaacuuacggauugaauacauuuacgaacauggaggcccaacuaaucagacaaauggagggugaaggcgucuuuaaaaacauacaacaucucacugucacggaggaagucgcagucaaaaauuggcucgcaaggguggggcgagaacgucuuagcaggauggcaaucaguggggacgauugcguugucaaacccuuagaugacagguuugcuaaugcuuuaacggcuuugaacgacaugggaaagauuagaaaagacauacaacaaugggaaccgucgaaaggauggaacgacuggacgcaaguacccuuuugcagucaccauuuucacgaauuaaucaugaaagauggaagggugcuuguuguccccugcagaaaucaagaugaguuaaucggacgagcuagaauaucacaaggagcgggauggagucuacgugagaccgcaugucuagggaaauccuaugcacagauguggucacuaauguauuuucaucguagggaucuuagacuugcagcuaaugcuaucuguagugcgguaccuagucauugggugccuacaucaaggacaaccuggaguauucaugcaaaacaugaauggaugacuacagaagacauguugacaguuuggaauagaguuuggauacgcgaaaauccguggauggaggacaagacaccaguagagucuugggaagagauacccuaucuaggaaaacgagaagaucaguggugcggcucauuaauuggauuaacaagucgcgcgacuugggccaaaaauauacaagcggccauaaaucaaguccguucauugauuggaaaugaagaauacacugauuauaugccaucuaugaaaagauuccgucgggaagaagaagaagcaggaguuuugugguaa

SEQ ID NO: 22718 - RNA, 9876 nt, Artificial Sequence
  derived and/or modified CDS sequence (opt6) from DENV-2__FJ410237__SS-prME
ucagcuggaaugauuauuaugcuaauuccaacgguuauggccuuccaucuaacuacuaggaacggugaaccacauaugauaguggggauucaagaaaaagggaaaagccuuuuauuuaaaacugaagacgguguaaauaugugcacacuuauggccauggacuuaggagaacuaugugaagauacaauaacguauaaaugcccacuacuuaggcagaaugaaccagaagacauagauuguugguguaacucaacaagcacauggguaacguauggaaccuguacaacaacuggagaacacagaagggaaaaacguucaguggcuuuagugccucauguaggaaugggucuugaaaccagaacggaaacuuggaugucaagugaaggggcuuggaaacacgcccagcggauagaaacuuggauccuacgacauccaggcuuuacgauaauggcugcaauccuugccuauaccauagguacgacucacuuccagagaguguuaaucuuuauucucuuaacggccguagcaccuucuaugacuaugagauguaucggaauuaguaaccgagacuucgucgaaggugucagcggagggucauggguugacauaguacuugaacauggaagcuguguuacaacuauggcgaaaaauaaaccuacacuagauuuugaacuaauaaaaacagaagccaaacaaccggcaaccuuaagaaaauauuguauagaagccaaauugacaaauacuacgacagaaucaagguguccaacccaaggagaaccuucguuaaaagaagaacaagacaaaagauuuguuugcaaacauagcauggucgacagaggauggggaaauggaugcggguuauuuggaaaaggaggaauuguaacuugugcaauguucacguguaagaaaaauauggaaggcaaaauaguacagccggaaaacuuagaauacacaauaguggucaccccacacaguggagaagaacaugcagucggaaaugauacaggaaaacauggacaagaaauaaaagugacaccgcaaucaaguaucaccgaagcagaauugacaggauauggaacagugaccauggaaugcuccccaaggacggggcuagacuucaaugaaaugguccuauuacaaauggagaauaaagcaugguuagugcacaggcagugguucuuagaccuuccucugccguggcugccuggagcagacaaacaagaaagcaacuggauacaaaaagaaaccuuaguaacuuucaaaaauccacacgccaagaaacaagaugucgucguccucgggucacaagaaggagcuaugcauacagcucuaacaggugcuaccgagauccagaugaguagcggaaauuuacucuuuaccggucaucucaaaugcagauuaaggauggauaaacuccaauuaaaagguaugucauacaguauguguacagguaaauuuaaagugguaaaagaaaucgccgagacacagcauggaacgaucguaauaaggguucaauaugaaggugauggcagcccauguaaaauuccauuugaaauaauggaucuagaaaaacguuaugucuuaggcagauugauaacugucaaccccauaguuacggaaaaagacucaccgguaaauauugaagcugagccacccuuuggcgauucuuauauaauuaucggcguagagccgggacaacuaaaauugaauugguuuaagaaagguucuucgauuggucagauguucgaaacuacgaugagaggugcaaaacguauggccauacucggagauacagcgugggacuuugggucacucggaggaguauuuacaagcauuggcaaagcgcugcaucaaguuuuuggcgcaaucuauggugcagcguuuucaggaguuucauggacaaugaaaauacuaaucgguguaaucauaacuuggaucggcaugaacucacgauccacaucuuuaagcguaucgcuaguucugguaggaauaguuacacuguaccuaggagugaugguucaagcggauucugggugcgucguuucauggaaaaacaaagagcuaaagugugggucuggcaucuuuauaaccgauaauguacauaccuggaccgagcaguauaaguuucaaccagagucucccagcaaguuggcgucagccauacaaaaggcucaggaggaaggaauuugcggcauaagaucuguaacacgacucgagaaucucauguggaaacaaaucacaccggaacuaaaccacaucuuggcagaaaacgaggucaaguuaacuauuaugacgggagauauuaaagguauaaugcaagcggggaaacgcucucugcgaccucaaccaacagagcucaaauauucguggaaaacuugggguaaagcaaaaaugcucucuacagaguccuauaaucagacauuucuuaucgaugggccggagaccgcagagugcccuaauacuaacagggcauggaacuccuuagagguggaagauuauggcuuugggguauuuacuaccaacauuugguuaaaacugaaagagaaacaagaugcauucugugauucaaagcugaugagugcagcgauaaaggauaacagagcuguacacgccgauaugggcuauuggauugaaucugcgcucaacgauacuuggaaaauagaaaaagcgagcuucauagaagugaaaaauugccauuggccaaagagucacacucucuggaguaauggaguccuagaaucggaaaugauaauacccaaaaaucuggcaggaccaguaagucaacacaauuaucguccgggguaccacacacagauugcgggacccuggcacuuaggaaaacucgaaauggacuuugauuuuugugacgguacaacagugauuguaacagaagauuguggaaaucgaggaccaagccuucgaacgacaacugccagugguaaauuaauaacagaaugguguugucgaaguugcacacuuccaccucuacguuauagaggcgaagaugguugcugguacggaauggaaauccggccauuaaaggagaaagaagaaaaccugguaaacagucucguaacagcaggucacggacaaguugacaauuuuucauuaggggucuuagggauggcucuguuuuuagaagaaaugcuuagaacuagaguaggaacaaagcacgcgauuuuacuuguugcgguuucauucguuacgcuaauuacagguaauaugagcuuuaaagaccuaggaagagugguaguuaugguuggugcaacuaugacagaugauauagggaugggcgugaccuauuuggcacuucucgcggcauuuaaaguccgacccacauuugcggcgggcuuauuguuaagaaaacuuacaucaaaagaguuaaugaugaccacuauagggauuguucuacucagucaaagcacgauuccugaaacgguuuuagaguuaaccgaugcgcuagcacucgguaugaugguauuaaaaaucguaagaaauauggaaaaauaucaacuagcaguaacaauaauggcuauauuauguguaccuaaugcaguaauuuuacaaaaugccuggaagguaaguuguacgauauuagcuguaguaaguguaaguccauuauuauuaacaaguucgcaacagaaaacagauuggauaccauuggccuuaacuauaaaaggucucaacccaacagcaauuuuccuuacuacgcuuagcagaacaaauaagaaaagaucauggccauuaaaugaagcaauaauggcaguuggaaugguuaguauucuugcgagcagcuugcucaaaaacgauauaccuaugacugguccucucguugcugguggccuguugacagugugcuaugugcuaacuggccgaucagcagauuuagaacuagaaagggcaacagauguuaaaugggaagaucaggccgaaaucucagggagcucuccaauauugaguauaaccauaucugaagacggcucuaugucaaucaaaaaugaagaagaagaacaaacauuaacaauacugauaagaacaggguuauuaguaauaucugggcuauuuccaauuucuauaccaaucacugcagcugcgugguaccuaugggagguuaagaaacaaagagcugguguucucugggauguuccaucuccaccacccauggguaaggcugaacuagaagacggugcguauagaauuaagcaaaaggggauucuggguuauagucagauaggagcaggaguguacaaagaaggaacauuucauacaauguggcaugugacgcgcggagcuguccuaaugcacaaggggaagcgaauagagccgucuugggcggacguuaagaaagacuugaucucguacgguggaggcuggaaauuggaaggcgaauggaaagagggcgaggaggugcagguauuagcguuggaacccgguaaaaaccccagagcaguccagacgaaaccaggccuauuuaaaacaaauacggggacuauuggugcaguaaguuuagauuuuucuccuggcacuucaggaagcccuauaauagauaagaaaggcaaaguuguaggcuuguacggaaauggcguaguaaccaggucuggugccuauguaucagccauagcacaaacagaaaaaucuauagaggauaauccugaaaucgaagacgacauauuccggaaaagacguuuaacaauaauggacuuacacccaggggcagguaaaacuaaaagauaucugccagcaauuguaagggaggcaauaaaaagaggacuacgcacacuaauucuagcacccacucguguggucgcugcugaaauggaagaagcucuacgaggacugcccauacgcuaccagacacccgcaauuagggcagagcauacaggcagggaaauaguggaccuuaugugucaugccacuuuuacaaugaggcuacuuucacccguucgaguaccaaauuacaacuugauuauuauggaugaggcacacuuuacugacccugcuucaauugccgcuagagguuacauauccacgcgaguugaaaugggugaggcggcaggaauauuuaugacagcaacuccuccuggcucacgggauccauuuccccaaagcaaugcucccauuauagacgaagaaagagagaucccagagagaaguuggaacuccgggcacgaaugggucacagauuuuaagggcaaaacgguuugguucguaccaucuaucaaagcggguaaugauaucgcagccugcuugcgaaagaacggcaagaaagugauacaacuaucuagaaaaacuuuugacagugaauaugucaaaacaaggacaaaugacugggacuucguaguaacaacagacaucagugaaaugggagcuaacuuuaaggcagagcguguaauagauccgcgucgcugcaugaaacccguaauucuaacggauggugaagaacgcguaauacuagcggguccuaugccugugacgcacucaucggcugcacagagaagaggaaggauagguagaaaucccaagaaugaaaaugaucaauauauuuacaugggggagccguuggagaacgaugaagauugugcucauuggaaggaggcuaaaauguugcuagacaauauaaacacgccggaaggcauaauaccuagcauguuugaaccagaaagagaaaaaguagacgcaauagauggagaguauagauugagaggcgaagcucgaaaaacguuuguugacuuaaugagaaggggugauuugccaguaugguuagccuacaaaguugccgcagagggcauaaauuaugcagauaggaggugguguuucgacggaauuaaaaacaaccagauacuagaagagaauguugaaguugaaauauggacaaaagaaggugaaaggaaaaaguuaaaaccgaggugguuagaugcgcguaucuauagugacccacuugcccuaaaggaauuuaaagaguucgcagccggucgaaaaucacuaacucucaaccuaauaacagaaauggguagacuaccgacauucaugacacagaaaaccagagaugcucuggauaaccuugcaguacuucacacagcagaagccggaggccgagcauacaaucaugcacucagcgaauugcccgaaacacuggaaacguuacuacuguuaacucuucuugcuacagucaccggagggauauuuuuauuucugaugucugguagagggauaggaaaaaugacguuaggaauguguugcauaauaaccgcuaguauauuauugugguaugcccaaauucaaccacauuggauagcagcuucgauaauacucgaguuuuucuuaauaguuuuacucauaccggaaccggaaaaacaaagaacaccccaagauaaccaacuuacguauguggugauugcaauucucaccguuguggccgcaacuauggcaaaugaaaugggauuuuuagagaaaacgaagaaagaccuagguuuagguuccaucgcuacacagcaaccagaaucgaacauacucgauauagauuugagaccugcuagugcauggacacucuaugcagucgcaacuacuuucguaacuccgauguuacgacacagcauugaaaauucaagcguaaacgugucguuaacagcuauugcgaaucaagccacgguuuuaauggggcuagggaaaggauggccacuuaguaagauggacauaggcguuccacuauuagcuauaggcugcuauucccaagugaacccgauuacucuuacagcagcccuucuguuguuaguugcgcacuaugccauaaucggaccggggcugcaagcaaaagccacaagagaagcucagaaaagagccgcagcagguaucaugaaaaauccaacaguggauggaauaacuguaauugacuuggauccaauaccguaugaucccaaguuugaaaaacaauuaggucaagucaugcuuuuaaucuuaugugugacgcaaguauuaaugaugagaacaacaugggcuuugugcgaagcauuaacguuagcgacagguccaaucucgacucugugggaggggaauccuggacgauuuuggaacacuacaauugcggucaguauggccaauaucuuucgcggaucuuauuuagccggagccggauuauuauuuagcauaaugaaaaauaccacuaauacacgaagagggacaggaaacaugggggagacauugggcgaaaaauggaaaucgcguuugaaugcacuuggaaaaagugaauuucaaauauauaagaaaucgggaauccaggagguagacaggacccuugcaaaagaagggauuaagagaggugagacugaucaccacgcaguaagcaggggaucagcaaagcuaagaugguucgucgaaagaaacauggucacuccggaagguaaaguaguugacuuggggugugggagaggaggauggucauacuauuguggcgggcuuaaaaauguaagggaaguaaaaggccuaacaaaaggcgguccaggccaugaggaaccaauuccuauguccacauacgguuggaaucuaguuaggcuacaaucagguguagauguauuuuucauuccgcccgagaaaugugacacguugcugugugauauaggggaaaguuccccaaacccuacaguggaagcugguagaacgcuaaggguacuaaaucuagucgaaaauuggcucaacaauaauacgcaguucuguauaaagguauuaaacccauauaugccuucgguaauagagaaaauggaagcgcuucaaaggaaauaugguggcgccuuagugcgaaauccacuaucaagaaauucaacccacgagauguacuggguaagcaacgcuucgggaaauauaguaaguucaguuaauaugauaaguaggaugcuaauaaacagauucaccaugcggcauaagaaagccacguacgaaccugauguagacuuagguucagguacacggaauaucgguauugaaucggaaauaccgaaucuagauaucauagggaaaagaauugagaaaauaaagcaagagcaugaaacaaguuggcauuaugaucaagaccauccauauaaaacuugggcauaccaugguaguuacgaaaccaaacaaaccgggucggcgucaucuaugguaaaugggguggucagacuuuuaacuaagcccugggauguauuaccaacuguaacacaaauggcuaugacagauaccacaccguuuggucaacagagggucuuuaaagaaaaaguagauaccagaacccaggagccuaaagagggaacaaagaaguugaugaagauaacggcagagugguuguggaaagaacuagggaagaagaaaacuccacggauguguacucgcgaagaguuuacgcguaaaguacggaguaaugccgcccuuggugcaaucuucacugaugaaaauaaauggaaaagcgccagggaggcgguagaagacucuagguucugggaguugguagauaaagaaaggaaucugcaccuggaagggaaaugugaaacaugcguauauaacaugaugggcaaaagagagaagaaacuuggugaauuuggaaaagcuaaaggaagccgagcuaucugguacauguggcuaggagcucgguuuuuggaguucgaggcuuuaggguuccuuaacgaagaucauugguuuaguagggagaacucacuuucagggguagaaggugaaggauugcauaaacuuggauauauucuaagagauguuaguaaaaaggagggaggagcuauguaugcggacgauaccgcgggaugggacacgcggauaacuuuagaggaccuuaaaaaugaagaaauggugacuaaucacauggaaggagaacauaagaagcuagcagaggccaucuuuaaacugacauaucaaaauaaaguggucagaguacaaagaccuacgccaagaggcacagugauggacauaauaucccgcagagaucagcggggcucuggacaaguggguaccuauggauuaaauacauucacaaauauggaagcccaauuaauaaggcagauggaaggagaaggagucuuuaaaaacauucagcauuuaacuguuacagaagaagucgccgucaaaaacugguuagcccgaguaggaagagaaaggcucucaagaauggcaauaagcggcgaugauugcguugucaaaccacuugacgauagauucgcuaaugcucuuacugcuuuaaaugacaugggaaagauacgaaaggacauacaacaaugggaaccauccaaaggauggauugauuggacgcaagugccuuuuugcagucaucacuuccacgaacucauuaugaaagacgggaggguauuaguaguucccugccgaaaucaagaugaauuaauuggucgggcaagaauaucgcaaggagccgguuggucuuugagagagacggcgugucuaggaaagaguuaugcacagauguggucauuaauguacuuucauaggagagauuuacgguuagcagcgaaugccaucugcucugccguacccucgcacuggguaccaacaagcagaacgaccuggucaauacacgccaaacaugaauggaugacaacagaagacauguuaacuguuuggaauaggguuuggaucagggaaaauccuuggauggaggacaagacaccaguagaaucgugggaagaaauaccauaucuugguaaacgggaggaccaauggugugggucucucauuggucuaacgucacgagccacgugggccaagaauauucaagcugcaauuaaccaggugagaucguugauagggaaugaagaauacgcggauuauaugcccagcaugaagagguucaggagagaagaagaggaagcaggaguuuuaugguga

SEQ ID NO: 22719 - RNA, 9876 nt, Artificial Sequence
  derived and/or modified CDS sequence (opt6) from DENV-2__FJ410241__SS-prME
agugcugggaugaucauaaugcuuauuccaacuguaauggcuuuucacuuaacuaccaggaauggggaaccacacaugauagugggcauccaggaaaaaggcaaaucguuauuguuuaaaaccgaagacgggguaaacaugugcacgcuaauggcaauggauuuaggagaacuaugcgaagacacuaucaccuacaaauguccucuauugagacaaaaugaacccgaagacaucgauuguugguguaacucaacguccacguggguaacauauggaaccugcacgaccacuggagaacacaggagagagaaaaggaguguggcacugguaccccacguagggaugggguuggaaacacguacagaaaccuggaugucgagugaaggcgcauggaaacaugcgcaaagaauagaaacauggauauuaagacauccaggauuuacuauuauggcggcaauacuagcauauacuauugggacgacacauuuucaacggguucuaauauuuauacuauuaaccgcggucgcaccuagcaugaccaugaggugcaucgguauaucaaaccgagacuuugucgaaggcguaucugguggaucaugggucgacauaguccuugagcauggaucguguguaacuacaauggcuaaaaauaaaccuacacuggauuuugagcuaauaaaaacugaagcuaaacagccugcaacacuacguaaauauugcauagaggcuaaauuaacgaacacuacaacugaauccagaugcccaacucaaggagagccuagcuuaaaagaagaacaagacaaaagauuugucugcaaacacucgaugguagaucgugggugggguaaugguuguggauuauuuggaaaaggagggaucguaacuugugcaauguuuacgugcaagaaaaauauggaagguaaaauaguucaaccagaaaauuuggaauacacuaucgucguaacuccacauucaggcgaagaacacgcagucggcaaugacaccgggaaacacggucaagaaauuaaagucaccccacaaaguucuaucaccgaagcugagcuaacgggauacgguacagucacaauggaauguaguccuagaacgggacuagauuuuaacgagauggugcugcuacaaauggagaauaaagcguggcucguacaccgucaaugguuucucgauuuaccauuaccaugguuaccaggggcagacaaacaagaaaguaauuggauacaaaaagaaacauugguaacauuuaaaaacccacaugccaagaaacaagacguaguaguacuuggaucacaggaaggugcaaugcauacugcgcugacaggagcaacagagauucaaaugagcucugggaaucugcucuuuaccggacauuuaaaaugucgucuucguauggauaaacuacagcuaaaaggcaugucguacagcaugugcacagguaaauucaaagugguaaaagagauagcagaaacacaacacggcacaauaguuaucagaguacaguaugagggagaugggucaccuugcaaaauuccauucgaaauuauggauuuagagaaaagauauguauugggaagacuuaucacagucaauccuaucguaacagagaaagauucacccgugaauauagaggcagaaccacccuuuggggacaguuacauaauaaucggaguagaaccuggucaacuaaaauugaacugguuuaaaaaggggucaucuauaggacaaauguucgagacuacuaugagaggcgccaaacgaauggcuauacucggagauacagcaugggacuucggaaguuuaggaggggucuucacaaguaucggaaaagcgcuacaccaaguguucggggcgauuuacggggcagcuuucucggguguaucuuggaccaugaagauucugaucgggguaauaauaaccuggaucggaaugaacucacgcucgacaagucuaucagucagccucguuuuaguaggaauagugacauuauacuuaggagugaugguucaagcggauucuggaugcguaguuucauggaaaaacaaagagcuaaaaugcggaucuggcauauucaucacggacaacguucacacauggaccgaacaauauaaauuucagccagaaaguccaaguaaacuugccucugcgauacaaaaagcgcaggaggaaggaauuugugguauacgaucaguaacuaggcuagaaaauuugauguggaagcaaauaacaccggaacuuaaccacauucucgcagaaaaugaagugaaauuaacgauuaugaccggagacauuaagggcauuaugcaggcgggcaaaagaagccugagaccacaaccuacggaauuaaaauacaguuggaagacaugggggaaggccaaaaugcuuaguacggaaaguuauaaucagacuuuucucauagacggaccugaaacagcagaauguccaaauacuaauagagcauggaacagucuugagguggaagauuauggauucgggguauuuacgacaaacauauggcuaaaacucaaagaaaaacaagacgccuuuugugacucuaaacuaaugucugcagccauaaaagacaaccgagcuguccacgccgacauggguuauuggauagaaucagcauugaaugacacauggaaaauagaaaaagcaucauucauugaggugaaaaauugucacuggcccaaaagucauacguuaugguccaacggagugcuagaaagugaaaugauaauucccaaaaaccuagcuggcccugugucucagcacaacuaccggccuggcuaccacacucaaauugcaggaccauggcauuuaggaaagcuagaaauggacuuugauuucugcgaugggacaaccguaauaguuacagaagacugcggaaauagaggaccuucuuuacgaaccacaacagcgucuggaaaauuaauuacggaauggugcugucgcucauguacgcuaccgccauuaagguaucgaggugaagauggcugcugguacggaauggagauacgaccucucaaagagaaagaagagaaucucguaaacucuuugguaaccgcuggacaugggcaaguagacaacuucucguuagguguauuagguauggcgcuguuccuagaggaaaugcuaaaaacacgggucggcacaaaacaugcgauauuauugguugcaguuuccuucguuacacucaucacagggaacaugaguuucaaagaccuaggaagagucguaguuaugguuggagcaacuauggcugaugauauaggcaugggaguaacauauuuagcccuacuagcugcuuuuaaaguaagaccaacguuugccgcaggauuauuauugagaaaguugacaaguaaagagcucaugaugacaacaauaggaaucgugcuacuaucacaaaguaccaucccagaaacaguucuagagcugacagacgcauuggcacuugguaugaugguguuacgaaucguccguaauauggaaaaauaccaauuggcaguaacaaucauggcuauauuaugcguaccuaacgcuguaauauuacaaaacgcguggaaaguaaguuguacuauauuagccguaguaagcguaagccccuugcugcucacaagcucucaacagaaaacugauuggauuccauuagcacuuacaauaaagggcuuaaacccuaccgccauauuucuaacuacauuaucucguacgaacaagaaacgaucguggccgcuuaaugaagcuauaauggcaguaggaauggucaguauccuagcuaguucucuauuaaagaaugauaucccuaugacgggaccacucguagcuggaggauuacugacaguuugcuaugugcuuacuggcagaagugccgaucuggagcucgaacgagcgacagauguuaagugggaagaucaagcggaaaucaguggaucaaguccuauacuaucaauaacuauuucagaggaugggucaaugaguaucaaaaaugaagaagaagaacaaacuuuaaccauucuuauuagaacaggacuuuugguaauuaguggccuauucccaauaucaauaccaauaacagcagcagcuugguaucugugggagguuaagaaacaacgagcaggcguguuaugggauguaccgucuccaccaccgaugggcaaggcagaacuagaagacggagcauauagaaucaaacaaaagggcauucuagguuauagccaaauuggugccgguguauauaaagagggcacauuccauacaauguggcauguaaccagaggggccguuuuaaugcauaaagguaaacgaaucgaaccgagcugggcagacgucaagaaagauuugauuaguuaugggggagguuggaaacuagaaggcgaauggaaggaaggugaggaaguucaaguauuagcuuuagaaccaggcaaaaaucccagagccguucaaacuaaaccuggauuguucaagacgaauacuggcacaauaggcgccgucagucuugacuucuccccagguacaaguggcucgccuauaauagauaaaaagggaaaagucguagguuuguacgggaauggugucguuacuagaucuggcgccuauguaagcgccauagcacaaaccgagaagaguaucgaagauaauccggaaauugaagaugauauauuuagaaagagacgccugacaauaauggauuuacacccaggugccgggaaaacaaaaagguaucucccggcuaucguaagagaagccauaaaaagagguuugaggacacuuauucuagcgccaaccagaguaguugcagccgagauggaagaagcucuacgaggacuaccaauccgauaccaaacgcccgcuauucgcgcggaacauacaggucgugaaauuguugaucugaugugccaugccacauucacuaugagacuacuaaguccugugagaguaccuaacuauaaccucauuaucauggaugaagcucacuuuacagaucccgcgucuauugcugcacgaggcuacauuucaacaagaguugaaaugggagaagcggcugggauuuuuaugaccgcaacaccgcccggaaguagggauccuuucccucaaucaaacgccccaauaauagacgaagaacgggagauaccagaaagaucauggaacucuggacaugaguggguaacagauuucaagggaaaaacuguuugguucguccccaguauuaaggcggggaaugacauugcugcauguuuacguaaaaacggaaagaaaguuauacaauuaucaagaaaaacguuugauagugaauauguuaagacgagaacaaaugauugggauuucguuguaacuacggacauuucggagaugggggcaaauuuuaaagcugaacguguaauugacccccgaagauguaugaagccuguaauauuaacagacggugaggagaggguuaucuuagcagguccaaugccggucacacauaguagugccgcacaacgaagaggucgaauaggucguaacccgaaaaacgagaacgaucaguauauuuacaugggugaaccacuugaaaacgaugaggauugugcccauuggaaagaagcaaaaauguuauuagacaacauuaacacaccggaagguaucauacccaguauguuugaacccgaaagggaaaaaguggaugccauugacggagaguaucgccucagaggagaggcaagaaagacauucguugauuuaaugcgacgaggagaucugcccguuugguuggccuauaaaguugcagcugaaggaauuaacuaugcagaccgaaggugguguuucgaugguauuaaaaauaaccaaauuuuggaggaaaauguugagguggagauauggacaaaagagggagagagaaagaaauuaaagccaagauggcuagacgccaggauauauagugacccucuugcccugaaagaguuuaaagaguuugcagcuggaaggaaaucauugacacugaacuuaaucacugaaaugggccgccuccccacauuuaugacacaaaagacgagggaugcucuagauaauuuagcugucuuacauacagcagaagcaggaggaagggcauauaaucaugcgcuaucagaguugccugaaacuuuagaaacacugcuacuccuaacauuauuagcaaccgucacuggagggauauuuuuguucuuaaugagugggcgagggauugguaaaaugacauuaggaauguguuguauaauaaccgcuucuauacuguuaugguaugcacaaauucaaccccauuggauugcagcuucuauaaucuuggaguuuuuccucauaguucucuuaauuccugaaccugagaaacaaagaacgccccaagauaaccaacuaaccuauguggugauugcaauauugaccgugguggccgcaacaauggcaaaugaaaugggauucuuggagaaaacgaagaaagaccuaggauuaggauccauagccacgcaacaauuagaaagcaacauauuagacauagauuugcguccugccagcgcauggacauuauaugcugucgcuacuacuuuuguaacaccuauguuaagacauaguauagaaaacucuagcguaaacguaagucugacagcuauagccaaucaagcaacaguccuaauggggcucggaaaaggguggccucugaguaagauggacauuggcguaccguuacuugcaauagguugcuauagccagguaaauccuaucacacuuacggcagcuuuacugcuucuuguggcacacuaugccauuauugguccuggucuucaagcgaaagcaaccagagaagcacaaaagagggcagcagcaggcaucaugaagaauccgacgguagaugguauaacuguaaucgaucucgacccgauuccuuaugauccgaaauuugaaaaacaguuagggcagguuauguuacuaauccuaugcguaacacaggugcuuaugaugaggacuaccugggcucugugugaagcgcugacuuuggcuacgggaccgauuucaacuuuaugggaaggcaacccuggaagauuuuggaauaccacaauagcagugagcauggcaaauaucuucaggggaaguuaucuugcaggggcaggucuguuauuuucaaucaugaaaaauacaacuaauacgagaagaggaacgggcaauaugggagaaacccuuggagaaaaguggaaaagucgucugaaugcucuaggcaagagugaauuucaaauuuacaagaaaucagguauucaagaaguagacagaacacuugcgaaggaagguauuaaacggggugagacagaucaucacgcugucucuaggggaucugcuaaacuacgcugguuugucgaaagaaacauggugacgccagaaggaaaaguuguagaucuaggcugcggaagaggaggguggagcuauuacuguggaggacuuaagaauguaagggaagugaaagggcugacaaaaggagggccaggucaugaagaaccuauaccgaugucaacauauggauggaauuuaguaaggcuacagaguggaguggauguuuucuuuaucccgccggaaaaaugugacacucuucuuugcgacauuggagaguccagcccuaacccaacaguggaagcugggagaacccuacgaguguugaaccuaguugaaaauuggcuaaauaauaauacccaauuuugcauaaaagucuuaaauccauacaugccaagcguaauagagaaaauggaggcuuuacaaagaaaauauggcggugcgcuagucagaaacccucuaucaagaaauucgacgcacgaaauguacuggguaucaaaugcaucugguaauaucgucucaagugugaauaugauaagccguaugcuuauaaacagguuuacgaugagacauaagaaagcuaccuaugagccagacguugaccuagggucaggaacgcguaauauagguauagaaagugagauaccgaaucuagauauaauagggaaaagaaucgagaaaaucaaacaggaacaugagacaucuuggcacuacgaucaagaccauccuuacaaaacaugggcguaucaugguucuuaugaaacuaagcaaacgggaucugcgaguucuauggucaaugggguuguacgacuacuuaccaaacccugggauguacuccccacagucacucaaauggcgaugacagauacuacuccguuuggacagcaacgugucuucaaagagaaaguagauacccgaacacaggaacccaaagaaggcacgaagaaauuaaugaaaaucacugccgaauggcuauggaaggaguuagggaagaagaaaacuccuagaauguguacgagagaagaauuuacuaggaaaguaagaaguaacgcugcuuuaggcgcuauauucacggacgagaauaaguggaaaagcgcccgugaagcagucgaagauagcagguuuugggaauuaguugauaaagaaagaaaucuacaccuugaagggaaaugcgaaaccugcguauacaauaugaugggcaaacgugagaagaaauuaggagaguucgggaaagcuaaaggcuccagagcaauuugguacaugugguuaggagccagauuuuuagaauuugaggcacuaggcuuucuuaaugaggaucacugguuuuccagagaaaauucauuauccggaguagagggagagggauugcauaaacuaggauauauucugcgcgacguaagcaagaaagaggguggcgcaauguacgcggaugauacggcuggaugggacacccgcauaacucuugaagaucucaaaaaugaggaaauggugacuaaccauauggaaggugagcacaaaaagcuggcggaagcuaucuuuaaacuuaccuaccaaaauaaaguaguacggguacaaaggcccacgccccgaggcacaguaauggacauaauuucaagaagagaucaacgaggcuccggccaaguuggaacuuauggauuaaauaccuuuacaaauauggaagcucagcuaauucgacagauggagggagaaggaguauuuaagaauauccaacacuugacaguaacagaagaaguagcuguucaaaacugguuagcgcgcguugggcgcgaaaggcuaucuagaauggcuauaucaggugacgauugcguugucaaaccccuggaugaucgauuugcgaacgcacuaacggcauugaaugauaugggaaaaauuagaaaagauauacagcaaugggaacccucaaaaggguggaaugauuggacccagguacccuuuuguucgcaucauuuccacgaacucauuaugaaagacgguagaguccuaguaguuccaugccgaaaccaggacgaauuaauaggccgugcaagaauaucacaaggugccggaugguccuuacgagagacagcuugcuuaggaaaaaguuaugcacaaauguggucucuaauguauuuccauagacgagaccuaagacuggcagcaaaugcgauauguuccgcagugccaagucacugggugcccacaucgcgaaccacauggagcauacaugcuaaacaugaauggaugacuacggaggauauguuaacggucuggaaucgcguuuggauaagagaaaaucccuggauggaagauaaaacaccaguugaaucuugggaagaaauuccguauuuaggcaagcgggaggaccaauggugcgguucauuaauagggcucacgucaagagccaccugggcaaagaauauccaggcugcuaucaaucaagucagaucguuaaucggaaaugaagaauacacagauuacaugccauccaugaaaagauuuaggcgagaagaagaggaagccggggugcuaugguag

SEQ ID NO: 22720 - RNA, 9876 nt, Artificial Sequence
  derived and/or modified CDS sequence (opt6) from DENV-2__FJ410259__SS-prME
ucagcagguaugaucauuaugcuaauacccacaguaauggcguuucaucuaaccacuaggaacggagaaccacacaugauuguaggcauucaagagaaaggaaaaaguuuacuauucaaaacugaagacggaguuaauaugugcacacuuauggcuauggaucuuggagaacuuugugaagauacuaucacuuauaaauguccuuuauuaagacaaaaugaaccagaagauauugacugcugguguaauucaacaucgaccuggguaacguacggaacaugcaccacuacaggugaacaccgacgugaaaaacgaagcguugcauuaguaccgcacguaggcaugggccuggaaacaagaacagaaacauggaugucgagugaaggugcauggaaacaugcucaaagaauagaaaccuggauacugcgacauccagguuucacaauaauggcagcaauacuggcauauacaaucggaacaacacacuuucaaagaguguuaauuuuuauauuguugacggcaguugcuccuaguaugacaaugcgaugcauugguaucucaaacagagauuuugucgaagggguuucaggcggcucuuggguagauauuguacuggaacauggaucauguguaacgacuauggccaaaaacaaaccgacuuuagauuucgaacugaucaaaacagaagccaaacaaccggcuacuuugcgaaaauauugcauugaagcgaaauuaacaaauacaacuacagaaucccgaugcccuacacaaggagaaccgagccucaaagaagaacaagauaaaagguuuguauguaaacacucuaugguagaucgugguuggggaaacggaugcgggcucuuugguaaagggggaauaguaacaugcgcgauguuuacaugcaagaaaaauauggaaggcaaaauugugcaacccgagaauuuagaguacacaauaguaguuacuccccauuccggugaagaacaugcugugggcaaugauacagguaaacacgggauggaaaucaaaguaacaccgcaaucauccacuacagaagcagagcuaacuggguaugguacuguaaccauggaaugcucuccgcgaacggggcuagauuuuaaugaaaugguacuccuacagauggagaauaaagcguggcuaguacaucgacagugguuuuuagauuuaccacuucccuggcuaccuggcgcugauaaacaggagaguaacuggauacaaaaagaaacuuuagugacauucaaaaacccacaugccaagaaacaagauguuguaguauuggguucacaagagggggcaaugcauaccgcuuuaacuggcgcaacagaaauacagaugagcucuggaaaucuauuauuuacagggcacuuaaaaugucgacuacgaauggacaaacuucaauuaaaaggaaugaguuacaguauguguacgggaaaauuuaaaguugugaaagagauagccgagacacaacaugggaccaucguaauaaggguccaguacgaaggugacgguagccccuguaaaauaccauuugaaauuauggaucuugagaaaagguauguauuagggcgauugauuacagugaacccuauugucaccgaaaaagacagccccguaaauauugaggcagaaccaccauuuggggacucauauauaauaauuggaguugaaccaggacaacuaaaacuaaauugguucaagaaagggaguucaaucggccaaauguucgagaccaccaugcgaggagcaaaaaggauggcuauucucggagauacggcaugggauuuuggcucauuaggcggcguuuuuacaucaauaggaaaagcauuacaccaaguauuuggagcuauauacggcgcggccuucagugggguuucauggacgaugaaaauacuaauaggagugaucauuacauggauuggaaugaacagccgguccacaucuuuauccguaucuuuaguacugguugguauaguaacacuauauuuaggagugaugguccaagcagacuccggaugcguggucaguuggaaaaacaaagaauuaaaaugugguaguggcauauuuauaacagauaacguccauacuuggacugaacaguauaaauuucaaccugagaguccuaguaaauuagcuagugccauccaaaaagcacaagaggaggguauuuguggaauuaggagcgugacuagguuggaaaacuuaauguggaaacaaaucacucccgaguuaaaccauauacucgcagaaaaugagguaaaacuuacaauaaugaccggggauauccgcgggauuaugcaggcagggaaaagaagucugaggccucaaccaaccgaauugaaauauagcuggaaaacuuggggaaaagcgaaaaugcucaguacugagagcuauaaccaaacauuuuugauugaugggccugaaacugcggaguguccuaacacuaaucgugcauggaacucauuagagguagaagacuauggauuugggguguuuaccacuaauauaugguuaaaauuaaaagaaaaacaagaugcguucugcgauaguaaauugaugagcgcagcuauuaaagauaacagagcuguucacgcagacaugggauacuggauagaaagcgccuuaaaugauacauggaaaauugaaaaagcaucauuuaucgaagucaaaaauugccauuggccuaaaagucauacauuguggucaaaugguguuuuagaaucagagaugaucauaccaaagaaccuugccggcccaguuucgcaacauaacuaucggccagguuaucauacgcaaauugcaggucccuggcauuuggguaaacucgaaauggauuucgauuuuugcgacggaacuacgguaauaguuacagaagacugcggcaauagagggccaucacucagaacaacuacugcaucgggaaagcuaauaacagaguggugcugcagaucauguacuuugcccccgcugagauaucgaggugaagauggcugcugguaugggauggaaauuagaccacuuaaggaaaaagaagaaaaucuaguuaacucauuagucacagcuggccauggacaaguagauaauuuuucuuugggcgucuuaggaauggcacuauuccuagaggaaaugcugagaacacgcguuggcacaaaacaugcuaucuuacuggcagcaguaucuuucguuacauuaauaacagguaacaugucuuuuaaagaccuaggcagaguaguaguuaugguaggcgcaaccauggcagaugacaucgggauggggguuacauaucuugcucuguuagcggcuuuuaaaguucguccaacguucgcggcgggacuuuuauuaaggaaauuaacaucgaaggaauuaaugaugacgacuauagguaucguauuauugucgcagagcacuaucccagaaacgguucuugagcuuacagaugcguuagcguuaggaaugauggucuuaaagauaguacgcaacauggagaaguaucaacucgcgguuacaauuauggcuauauuaugcguaccgaaugcaguuauccugcaaaaugcguggaaagugucauguacaauauuggcaguaguaucagucagcccacuacuccuaaccucaucacagcagaaaacugauuggaucccauuggcgcuuacaauuaaaggacuuaaucccacggcuauauucuuaacgacgcuaucucggacgaacaagaaacgauccuggccguuaaaugaagcaauuauggcagucggaaugguaucgauccucgcaucaucuuuacuuaaaaacgauauccccaugacugggccuuuaguggcugggggucuuuugacgguauguuauguacuaacugggagaagcgcagauuuagaacuggaaagggcaacagauguaaaaugggaggaccaggcagaaaucucgggaaguaguccuauccucaguauaacgauuagugaagauggaagcaugucuaucaaaaaugaagaagaagaacaaacgcuaacgauucuaauccgaacgggccuauuaguaauaaguggacuguucccaauaaguauuccaauaaccgccgccgcaugguaucuaugggaggucaagaaacagcgagcaggggugcucugggauguuccaucuccaccaccaaugggaaaggcugaguuagaagauggugccuauagaaucaaacagaaaggaauuuugggcuauucacagauaggugcgggaguuuacaaggagggaacauuucacacuauguggcacguuacuagaggggcggucuuaaugcauaaaggcaaacgaaucgaaccaucaugggcugacguuaagaaagauuugauaagcuacggaggcgguuggaaauuagaaggagaauggaaggaaggagaggagguccaagugcuagcacucgagccaggaaagaauccucgggcaguucaaacgaaaccgggacuauuuaagaccaauacugguaccauaggcgcugugagucuagacuucaguccugguacuucaggaagcccaauaauagacaagaaagggaagguugucggccucuauggaaauggaguugugacaagaaguggggccuacgucagcgcaauugcacagacugaaaagucaauagaggacaauccugaaauagaggaugauauauuccgaaaacguagguuaacaauuauggaccuacauccaggagcagguaaaacaaaacgguaccuaccugcuauuguccgugaagcaaucaagcgaggccuuagaacuuuaaucuuagcuccaaccagggucguugcggccgaaauggaagaagcauugcgaggacuaccgauuagauaucaaacgccugcaauaagggcagaacauaccgggagagaaauuguagaucuuaugugccacgcaacauucacaaugagauuguuaucccccguucgaguaccuaauuacaaucuaauuaucauggacgaagcucauuuuacugauccagcaaguauugcagcacggggguauaucagcacucguguagaaaugggggaagccgcgggaauauuuaugacugcaacuccacccggaagcagggacccuuuuccacaaucuaaugcacccauaauagacgaggagagggaaauccccgagcgaucuuggaacucagggcaugaauggguuacugauuuuaaaggaaaaacaguaugguuuguaccuucaaucaaagcaggcaaugauaucgcggcuugccugagaaagaauggcaagaaagucauccagcuaaguagaaaaacauucgauagcgaauacguaaaaacaaggacaaacgauugggauuucguuguuacaacggauauaagcgaaaugggggcaaauuuuaaagcggagagaguuaucgacccacgacggugcaugaaaccgguaauacuaacugacggugaggagagaguuauucuagcggggccaaugccggucacacauuccucagcugcacaacguaggggccguauagguagaaacccuaaaaaugaaaacgaucaauauauuuacaugggagagccauuagaaaaugacgaggacugugcucacuggaaagaagcuaagauguuacuagacaauauaaacacuccagagggaauaauaccgagcauguuugaaccagagcgugaaaagguagaugcaaucgacggagaauaccgguugagaggagaagcucgcaaaacauuuguagaucuuaugcgcagaggggauuugccagugugguuagcauauaaaguggcagcugaaggcauaaauuaugccgaucggaggugguguuuugauggaauuaaaaacaaucagauauuagaagaaaauguagagguugaaauuuggacaaaagaaggagaacgcaagaagcugaaacccagguggcuagacgcaagaauauauagugacccauuggcacuuaaggaauuuaaagaguuugcagcaggaagaaaaagucuuaccuuaaacuuaauuacugagauggguaggcuucccacguucaugacacagaaaacuagagaugcccuagauaaucuagccguuuuacacaccgcugaagcuggcggacgcgccuacaaccaugcguuaagcgaacuuccugaaacgcucgaaacauuacuccuacucacacuacuugcuacuguaaccggaggaauauuuuuauuucucaugucuggccgaggaauuggaaaaaugacguugggaaugugcugcaucaucacagcgaguaucuuacuaugguaugcucaaauucaaccacauuggauugcugcaaguauaauccuagaguucuuuuuaauagugcuucuuaucccagaacccgaaaaacaacgaacaccucaagacaaccaacuaacguaugugguuauugcaauauugaccguaguagcugcaacgauggcgaaugaaaugggguuucuggagaaaaccaagaaagaucuaggucucgguuccauagcaacgcagcagccagaaaguaauaucuuagauauugauuuaagaccggcuucugcauggaccuuauaugcuguugcaacuaccuuugucaccccuauguuaagacauucuauugaaaauaguucugucaacguaucacuaacagcuauagcaaaccaagcaacaguuuugauggggcuugggaagggauggccacuaucuaaaauggauauuggaguaccgcuucuggcaauaggcugcuacucucaaguuaaucccauuacucugaccgcagcauuguuacucuuaguagcacacuaugcuauuauagggcccgguuuacaagcaaaagcgacucgagaagcacagaagagagcugccgcaggaauaaugaaaaaucccacgguagauggaauuacaguuauagaucucgauccgauaccauaugacccuaaguuugaaaagcaacuagggcaagucauguuacuuaucuuaugcguuacacagguauuaaugaugagaacuaccugggcucuuugugaagcguuaacguuggcaacagguccgaucucgacucuaugggaagggaauccuggaagauucuggaacacuacgauugcagugucaauggcuaauauauuccgggggucauauuuagcgggugcaggauuacuauuuucuauuaugaagaauacaacuaacacgagaagaggaacuggcaauauuggagaaacccuaggagagaaauggaaauccagauuaaaugcauuaggcaaguccgaguuucagauauauaagaaaaguggcauucaggaaguugauagaacuuuagcuaaagaagguauuaaaagaggggagaccgaccaucacgcaguaucaagaggaucggcgaaauugagaugguuugucgaacguaauaugguaacaccggaaggcaaagugguagaucugggaugcggacgaggaggauggucauacuauuguggugggcuaaagaacguuagggaagugaaggggcuaacgaaaggaggaccuggacacgaagaacccaucccaaugaguacauacgguuggaauuuaguccgguuacaaaguggugucgacguuuucuuuauuccacccgaaaaaugugauacauuacugugugauauaggagaguccucacccaauccaacgguggaggcaggucgcacucuccgugucuuaaauuuaguagagaauuggcuaaauaacaacacucaauucuguauaaaagugcuuaauccuuacaugcccuccguaauagagaaaauggaggcacuucaaagaaaguauggaggagcucuuguaagaaaucccuuaagcagaaacagcacacacgagauguauuggguaucgaaugccaguggaaauauuguaagcucaguuaauaugauaucacguauguuaauuaaucgauuuacaaugagacauaagaaagcuaccuacgagccagauguugaucuggggucuggaacuagaaacauaggaauagaaagcgaaauacccaacuuagacaucauugguaaacggauugaaaagaucaaacaagaacacgaaacuuccuggcacuaugaucaagaucacccauauaagacaugggcuuaccacggaucauaugaaacaaaacagacagguagcgcaucuucaauggugaaugggguagugcgacuauugacgaaaccgugggacguauugccgacagucacucaaauggcuaugacagauacuacaccauuuggacagcagcgcguauuuaaagagaaaguagauacaagaacccaggagcccaaggaggggacaaagaaauuaaugaaaaucacagcugaaugguuauggaaagaauuggguaaaaagaaaacuccccgaaugugcacgcgugaggaauuuacuaggaagguacgaucaaacgcagcacucggggcuauauucacagaugaaaacaaguggaaaagcgcccgugaagccguagaagacaguagguucugggaauuaguggauaaggaaagaaacuuacaucuugaagggaaaugugaaacuuguguguacaauaugaugggcaaaagggagaagaaacuaggagaguucggcaaggcaaaagguaguagagccaucugguacaugugguugggagcaagguuccuggaauuugaagccuugggguuuuugaaugaagaucacugguucaguagagaaaacucauugucaggaguagagggagaaggcuuacauaaacuaggauacauauugagagauguuucgaagaaagaaggaggggcaauguacgcugaugauacggcuggaugggauacuagaaucacgcuagaagaucuaaagaaugaagaaaugguuacaaaccacauggaaggcgaacauaagaaacuagcagaagcgauauucaaauuaaccuaccagaauaagguaguuagagugcagcguccaacacccagaggaaccgugauggauauaauaucgcguagagaucaaagaggaucggggcaaguugguacauauggucuaaacacauuuaccaauauggaggcacaacuaauccgacaaauggagggagaagguguauuuaaaaauauacaacaucuaaccgugacagaggagguagccguccacaauuggcuagcuagaguaggacgggaacgacuaucgaggauggcaaucuccggagaugauugugugguaaagccccuggacgaucgguuugcuaacgcucuuacugcccugaacgauauggguaaaauacguaaagauauacaacagugggagcccucaaagggcuggaacgauuggacacaaguuccguuuugcucacaccauuuucaugagcuaauaaugaaagauggucguauucuuguugucccgugucgcaaccaagaugaauuaauaggaagggcaagaaucucccaaggugcaggauggaguuuaagagaaacugcaugcuuagguaaaucuuaugcccagauguggucacuaauguacuuccacagaagagauuuaagguuagcagcuaacgcuauauguuccgcaguaccaagucacuggguaccaacgagcagaacaacgugguccauacaugccaaacaugaauggaugacuaccgaagauaugcuaaccguguggaauagaguguggauacgggagaaccccuggauggaagauaaaacccccguugaaucaugggaggaaauaccuuauuuaggaaaaagagaagaucaauggugcgggucacucaucggccuaaccucuagggccacaugggccaagaauauacaagcagcaauuaaccaaguacgaucguuaaucggaaacgaagaguauacagauuacaugcccagcaugaagcgauuuagaagagaagaagaagaggcugguguauuaugguga

SEQ ID NO: 22721 - RNA, 9876 nt, Artificial Sequence
  derived and/or modified CDS sequence (opt6) from DENV-2__FJ547067__SS-prME
uccgcggguaugauaauaauguuaauaccaacugugauggcauuccaccuuacuacgcgaaauggagaaccacauaugauaguuggaauacaagaaaaaggaaaaucacuacuauuuaaaacagaagacggcgugaacauguguacauugauggcuauggaucuaggcgaacuaugcgaagauacuauuacauacaaaugcccauuguuacggcaaaacgaaccugaagauauagauugcuggugcaauagcacaucgacguggguuacauauggaacauguacaacaacaggcgaacacagacgagaaaaacguucaguagcucuaguaccgcauguagguaugggauuagaaacaaggacugaaacuuggauguccucagaaggagcauggaaacacgcacagagaauugaaacauggauccuuagacauccaggcuucacaauaauggcagcaauuuuagcguauacaauuggaaccacacacuuccagaggguauugauauuuauauuacuuacggccguagcaccuagcaugacaaugagauguauaggaauaucaaacagagauuucguugaggggguaucaggagguucauggguugauaucguccuugaacaugggucaugugugacaacgauggcuaaaaauaaacccacauuagauuuugagcuaaucaaaacugaggccaaacaaccugcaacacucagaaaauacuguauagaggcaaaacuaaccaauacgacaacagaaagucgauguccuacgcaaggagaaccuucuuugaaagaagaacaagacaaaagauuuguuuguaaacauucaauggucgaucguggguggggaaacggaugcggccuauucggaaaaggaggcauaguaacgugugcuauguucacaugcaagaaaaauauggaagguaaaauagugcagcccgaaaaucucgaguauacuauaguagucacaccgcacagcggugaagaacaugcaguggguaaugacacaggcaaacacgggcaggagauaaaagugacgccccaaucaucuaucacagaggcagaacuaaccggguaugguaccguuacgauggaauguucucccaggacaggacuagacuuuaaugaaaugguuuuacuacaaauggagaauaaggcuuggcuaguucauagacagugguuucuagaccucccacugccuuggcuaccuggggcagauaaacaagaaucaaauuggauccaaaaagagaccuuaguaacguucaaaaauccgcaugcgaagaagcaagacgugguagugcuaggcucgcaagaaggagcuaugcacacugcauuaacuggagcgaccgaaauccaaaugaguagcggaaaucuacuauucacuggacacuuaaaauguaggcuuagaauggauaaauuacaguugaaaggaaugucauauaguauguguacaggaaaauucaagguugucaaggagauagcugaaacucaacauggcacgauagugauaaggguacaauaugagggcgauggaaguccuuguaaaauaccauuugaaauaauggaucuagaaaagagguauguauuaggacgauuaauaacggugaacccuauuguuacagaaaaggauucaccuguaaacauugaggcagaaccuccauuuggggacaguuacauaauuauuggagucgaacccggacaacuuaaauuaaauugguuuaagaaagguucgucuauuggucaaauguucgaaacuacaaugcgaggggcaaaaaggauggcaauuuugggggauaccgcuugggacuucgguucauuagguggaguauucaccaguauaggaaaagcguuacaucagguauucggagcaauauauggugcagcguuuucaggaguuaguuggacaaugaaaauauuaauuggaguaauuauaacauggauaggaaugaacagcaggagcaccagcuugucgguaucauuagucuuaguaggaauaguuacacuuuaccucggggugaugguacaagcggacucugguugcgucgucagcuggaaaaacaaggaacuaaagugcggaucagguauauuuauaaccgacaauguacauacauggacagaacaauauaaguuccagcccgaaucaccaucaaaauuggcaagugcaauacaaaaggcucaggaagaaggcauauguggaauaagguccgugacacgauuggaaaauuugauguggaaacagauuaccccagaauugaaucauauacuugcagaaaacgaaguaaaacugacaaucaugacaggugacaucaagggaaucaugcaagcugguaagaggaguuugcguccacaaccaaccgaacuaaaauacaguuggaagacauggggaaaggcaaaaaugcucucuacugaaagcuacaaccaaaccuucuuaauagacgggccggaaacugcggagugcccgaacacuaauagagcauggaacucacuugagguagaagacuacggauuugguguauucacgacgaacauauggcuaaaguugaaagagaaacaagacgcauucugugauagcaagcucaugagugccgcuauuaaggauaaucgugcaguucaugcagauauggguuauuggauugaaagugcuuugaaugauacuuggaaaaucgaaaaagcaucuuuuauagaagucaaaaauugucauuggcccaaaucgcacacguuguggaguaacggcguauuagaaucagagaugauaauuccuaagaauuuggcggggccaguaagccaacacaacuaucguccggguuaucauacucagauagcaggaccauggcaucuaggcaaacuugagauggauuucgacuucugugauggaacuacugugauuguaacugaggacugcgggaauaggggcccaucacucagaacaacaacugcaucaggaaaacuuaucacagaaugguguuguagaucaugcacucuaccaccacuaagguaucggggugaagacggguguugguacggaauggaaaucagaccgcuaaaagaaaaagaggaaaaucugguaaauagucuagucacugccggucauggccaagucgauaacuuuucccuaggaguacuuggaauggcuuuauuccuugaggaaauguuaagaacacgaguugggacuaaacacgcuauacuauuaguugccauuagcuucguaacacuaauaaccggcaauaugucuuuuaaagaucuaggaagaguuguugugaugguaggcgcgaccauggcagaugacauuggcauggggguaacauaccucgcgcuccuagcugcuuuuaagguaagaccaacguucgcugcagggcuuuuacuuagaaaacuuacaucuaaagaacuaaugaugaccacaauagguaucguucugcuaagccagucaacaauuccagaaacaguccuugaauuaacugaugcguuagcgcucggaaugauggugcugaaaauuguucguaacauggaaaaauaucaguuggcaguaacaaucauggcaauccuaugugucccuaacgcuguaauccuccagaaugcauggaagguaagcugcacaauucuagcugcuguaucggucaguccacuacuucugacgucaagucagcagaaaacggacuggauaccacuagcuuuaacgauaaaaggucugaauccaacagcaauauuucugacuacucuauccaggacaaacaagaaaagaucauggccgcucaaugaagcaaucauggcagucgguauggucagcauauuagcaucaagucugcuuaaaaacgacauacccaugacgggaccacugguggcugguggucuucuaacuguaugcuacguccugacagguagaagugcugacuuagaguuagaaagagcaaccgacguaaagugggaggaacaagcugaaauuucuggauccagcccaauauugucaauaacaauaucggaagaugguaguauguccaucaaaaaugaggaagaagaacagacauuaaccauauuaauaagaacaggacuauuagugaucucuggccuguuucccauaucgaucccuaucacugcagcugcgugguaucuaugggaagucaagaaacaacgagcaggcguguuaugggauguuccgaguccuccaccaauggggaaagccgaauuagaggacggugcauauagaauuaaacaaaaagguauacuaggauacucucaaauaggcgcugguguauacaaagaagggacguuccacaccauguggcauguaacgcgaggggcaguauuaaugcauaaaggaaaacggauugagccaucaugggcagacguaaagaaagacuuaauuucguacggugggggcuggaaauuggaaggcgaauggaaagaaggggaggaagugcaaguacuugcauuagagcccggcaaaaauccacgggccguucaaacgaaaccaggacuauuuaagacaaauacagggacaauaggagcagucucauuagauuuuucaccaggaacauccggauccccuauaauugacaagaaagggaaagucguaggucuuuacggcaacggggugguuacgagauccggugcauacguaucugcaaucgcucaaacagagaaaucaauugaagauaaccccgaaauugaagaugacauauucagaaagaggagacugacuauaauggaccuacauccgggugccgguaaaaccaaaagauaccugccggcgauuguacgagaagcaauaaaaagaggacucagaacgcucauccuagcaccuacacgagucguagcagcggagauggaagaagcauuaaggggacuacccauaagauaucaaacucccgcgauaagagcugagcauacuggaagggaaauagucgauuuaaugugucacgcaacguuuaccaugagauuacuaagcccugucagggucccuaauuauaauuuaauaauaauggacgaagcucacuucacagaucccgcaaguauugcggcuaggggauauaucucaacgagaguggagaugggagaagccgcaggaauauuuaugacagccacuccuccagguaguagagauccauuuccucaaucaaacgcaccaauuaucgacgaagaaagagaaauaccugagagaucguggaacuccggacaugaauggguuaccgauuuuaaagguaaaacagugugguuuguacccaguauuaaagcagggaaugacauagcagccugucuuaggaaaaauggcaagaaaguaauacaauuaucaaggaaaacguuugauucugaguacguuaagacaaggaccaaugauugggauuuuguuguaacuacugauauaagcgagaugggagcaaauuucaaggcagagaggguaauagauccgagaagauguaugaaaccagugauacucacugauggggaagagagaguaauuuuagcaggcccuaugccugugacacauaguucagcagcacaacgccguggacguauugguaggaaucccaaaaaugaaaaugaccaguacauuuauaugggagaaccguuggaaaaugaugaagacugcgcgcacuggaaggaagcaaagaugcuuuuagauaacauaaauacuccagaaggaauaauaccaucaauguucgaaccggaacgggagaaaguagacgcaauagacggagaauauagguugaggggugaagccagaaagacuuuugucgaucucaugaggcggggagaucuuccgguaugguuagcguauaagguugcugccgaagggauaaauuaugccgacaggaggugguguuuugaugggaucaaaaacaaucagauauuagaagaaaaugucgaaguagagauauggacuaaggagggugagcgaaagaaauuaaaaccacgcuggcuugaugcucgaaucuauagugacccucuugcuuuaaaagaauuuaaagaguuugcugcaggacgcaaauccuuaacguuaaauuugauaacugaaauggggcgccuaccaacauuuaugacacagaaaacaagggacgcacuagacaauuuagcuguauuacauacggcugaggcggguggacgagcuuacaaucacgcacuaucugagcuaccagaaacucuugaaacucuacuacuuuuaacauuacucgcuacggugaccggaggaaucuucuuguuuuuaaugagcgguagagguauugguaaaaugacucuagguaugugcugcauuauaacagcuucaauacuccugugguaugcacagauccaaccacauuggauagcagccucgauuauauuagaauuuuuccuaauagucuugcuaauucccgaaccagaaaaacaaaggacuccgcaagacaaccaauugaccuauguaguaauagcuauucuaacugugguagcggcuacaauggcaaacgaaaugggauuuuuagaaaagaccaaaaaggauuuaggucuuggcagcaucgcuacccagcaaccagagucaaauauacuggacauugauuugcgaccagcuagcgcauggacacucuacgccguagcaacgacuuuuguaacccccaugcuaagacacucgauagaaaacaguucaguuaaugucagucuuacugcuaucgcuaaucaagcaaccguauuaaugggacuagguaaaggcuggccguuguccaaaauggauauagguguuccauuacuagcaauuggauguuauagccaagugaaucccaucacauuaacugcggcacuacucuugcuugucgcacauuaugccauuauugguccaggacuucaagcuaaagcuaccagggaagcgcaaaagagagcagcagcuggaauuaugaagaauccgacaguagauggaauaacuguaauugacuuagauccaaucccuuacgauccuaaauuugaaaaacagcucggucaaguaauguuauuaauccuaugcguuacacaaguauuaaugaugaggacuacaugggccuuaugcgaagccuuaacguuggccacuggcccaauaaguacacuaugggaggggaauccagggagauuuuggaacacaacuaucgcagucuccauggcgaacauauuccguggcaguuauuuagccggugccggccuucuauucucaaucaugaaaaacacaaccaauacaagaagggggacagguaauaugggagaaacguugggggagaaauggaaaaguagacugaaugcguuaggaaaaucagaauuucaaguguacaagaaaagcggcauucaggaaguugaccgcacauuggcgaaggagggaauuaagagaggugaaacugaucaccaugcugugucuagaggcucugcuaaauuaaggugguuuguggaacgaaacaugguaacaccggaagguaaggugguugacuuggguugcgggagaggggguuggagcuacuauugcggaggccuaaagaauguucgagaggucaagggucugacuaaaggggguccaggacaugaagaaccaauaccuaugucuacguaugguuggaaccuaguuagacuccaaucaggaguagauguuuucuucauaccgccugaaaaaugugacacccuauuaugugauauaggcgaaucaucaccuaauccaacuguggaagccggaagaacacuaaggguacuuaaccuuguugaaaacugguuaaauaacaacacacaauucuguauaaaaguucuaaacccauauaugccuucgguaauagagaaaauggaggcacuacagcgaaaauacgguggagccuuagugcgaaauccucuaucaagaaauucaacacacgaaauguauuggguaucaaacgcgagcggaaacauugucucgaguguaaauaugauaagucgaauguuaauaaauagguuuacaaugcggcauaagaaagccacauaugaaccugaugucgacuuaggcucgggaacgcgcaauauaggcaucgaaagugaaauaccaaaucuagacaucauaggcaagaggaucgagaaaauaaaacaggaacaugaaacuuccuggcauuacgaccaagaucauccuuacaagacgugggcguaccacgguucguacgagacaaaacaaacugggagcgcgucuuccauggucaauggcguugugcgccuacugacaaaaccaugggauguuuuaccgacaguaacucaaauggcgaugacggacacgacaccguucggccagcaaagaguguucaaagaaaaagucgacacacgcacacaagaacccaaggaagggacgaagaaauuaaugaaaaucacugcagaauggcuauggaaggaacuaggaaggaagaaaacaccaagaaugugcacacgagaagaauuuacccgaaaggugagaucaaacgcggcauuaggagcaauauucacagacgaaaauaaguggaaaagugcaagagaagcaguagaagauagucgguucugggaauuaguagauaaagaaagaaaccuucaucuagagggaaagugcgaaacuugugucuauaacaugaugggcaagagagagaagaaacugggagaguuuggaaaagcuaagggaagccgcgcuauaugguacaugugguuaggagcuagauuccucgaauuugaagcguuggguuucuuaaaugaagaccacugguuuucuagagaaaauucguuaucuggaguagagggugaaggcuuacauaaacucggguacauacuaagagauguaagcaagaaagagggcggggcuauguacgcugaugauacagcagguugggauaccaggaucacgcuagaagaccugaaaaaugaagaaaugguaacaaaccauauggaaggugaacauaagaagcuagcugaagcaaucuuuaaguuaacguaucagaacaaaguaguacggguccaaagaccuacaccacgugggaccguuauggauaucauaucaagaagagaccaaaggggcucgggucaaguaggaacuuacggacucaacacauuuacuaauauggaggcacaacugauacgucagauggaaggggaagguguuuuuaaaaguauacaacaccuuacggucaccgaagaagucgccgugcaaaauuggcucgcucguguuggacgagaacgcuugagcagaauggcaauuaguggagacgacugcgucguaaagccauuagaugaucguuuugcaaacgcacuaaccgcauuaaaugauaugggaaaaauaagaaaagacauacaacaaugggaacccucaaagggauggaaugacuggacucaggucccauuuugcucacaccacuuccaugaauuaauaaugaaagauggacgcguccuaguuguuccaugcaggaaucaagaugaauugauuggccgggcucgcauaagccagggcgcaggauggagcuuacgagaaacagcuugucuaggaaaaaguuacgcacagauguggucuuugauguacuuccauagaagagaccuaagacuugcagcaaacgcgauauguuccgcagugccuagucauuggguucccaccucaagaacaacuuggagcauucacgcaaagcacgaguggaugacgaccgaggacauguugacaguauggaaucgcguguggauuagagaaaauccguggauggaagauaaaacaccuguugaaucgugggaagaaauaccuuauuuaggaaaacgagaagaucaauggugugguagucuaauuggccuaaccagcagggcgacgugggccaaaaacauccaggcugcgauaaaccaaguaagaagucugaucggcaaugaagaauauacugauuauaugccuucuaugaaaagauuuagaagagaagaggaagaagcaggcguacuuugguaa

SEQ ID NO: 22722 - RNA, 9876 nt, Artificial Sequence
  derived and/or modified CDS sequence (opt6) from DENV-2__JN819418__SS-prME
acagcaggggucauuauaauguuaauaccaacagcaauggcauuucauuugacuacaagaaacggggaaccucauaugauugucggaaggcaagaaaaaggaaaaucguuacuauuuaaaacagaagauggggugaacaugugcacgcucauggcgauugaccuaggcgaauuaugugaagauacaaucacguacaaaugcccacuacugaggcaaaaugaaccugaggauauagauugcuggugcaacucuacgaguacaugggugacguaugggacguguacuacuacgggugaacacaggcgggaaaaacggagugucgcgcuaguuccacauguagggaugggacuagaaacgcgaacagaaacauggaugaguagugaaggugcuuggaaacacguccaaagaauugaaacuuggauauugcgccaccccgguuucacaaucauggcagcaauacucgcguauacgaucgggacaacucacuuucaacgugcguuaauauuuauccucuuaacagcagucgcuccuagcaugacuaugaggugcauuggaauaucaaauagagauuuuguagaaggaguaucuggaggcucauggguagauauugugcuugaacauggaucuugcguuaccacuauggccaaaaauaaaccuaccuuggauuucgaacuaauaaaaaccgaagcaaaacaacccgcaacacuccgaaaauacuguauagaagccaaauugacaaacacgacaaccgagagccgauguccaacacagggggaaccgagucucaaugaggagcaagauaaaagauuuguauguaaacauaguaugguugacaggggcuggggaaauggcuguggacucuuugggaaaggugguauugugacuugcgcgauguuuacauguaagaaaaauauggaaggaaaaguuguacugcccgaaaaucucgaguacacaauaguaauuacaccgcauagcggagaagaacacgcgguugggaaugauacgggaaaacaugguaaagaaauuaaaauuacuccacaaucuagcauuacagaagcagaacucacugguuaugguacagugacaauggaaugcuccccaaggacagguuuagacuuuaacgaaaugguacuuuuacaaauggaggauaaagcauggcuuguucauagacaaugguuuuuagaccuuccuuugcccuggcuacccggggcggauacacaggguagcaauuggauucaaaaggaaacacucguaacauuuaaaaauccacacgcaaagaaacaagauguaguugugcuagguucacaggagggggcuaugcauacagcccuaacaggagcaaccgaaauacaaauguccaguggcaauuugcuauuuaccggucaucuaaaauguagacuaagaauggauaaacuucagcugaaagggaugucauauucuaugugcacagggaaauuuaaaauuguaaaggagauagcagaaacucagcauggaacgauugugauacgggugcaauacgaaggggacggcucuccuuguaagauuccauuugaaauuauggaucucgagaaaagacauguacuagguaggcuuauaacaguaaacccaauaguuacagaaaaagauagccccguaaacaucgaagcggaaccgccuuuuggcgacucauauauuauuauugggguugagccgggucaacugaaacucaacugguuuaagaaaggaucuaguauaggacagauguucgagacgaccaugcgaggggccaagcgcauggcuauauugggugauacugcaugggauuucggaagucuaggagggguguuuacaagcauugggaaagcguugcaucagguauucggggcuauuuauggcgcggccuuuucagggguaucguggacaaugaaaaucuuaauuggugugaucauaacauggauagguaugaacucuagaucaacuucauuaagcguaucucuagugcuaguaggaguaguuacucucuaucucggggcaaugguacaagcagacucugguugugucguaaguuggaaaaauaaagaacuaaaauguggaagcggcaucuuuaucacagauaauguacauacuuggacugaacaauauaaauuccaaccggaaucuccgucuaaacuugcuagugcgauacagaaagcccaugaggaaggaauuugugguaucagaagugugacacgacuagaaaauuugauguggaagcaaauuacucccgaauugaaucauaucuuaucggagaacgagguaaagcuaacgauuaugacaggagauauuaagggaaucaugcaagcuggaaaacgcaguuuaagaccccaaccaacugagcucaaauacucuuggaaaacguggggaaaagcuaaaauguuaucaacagagucacauaaucaaacauuuuugauugacggaccagaaacagcagaaugucccaacacaaaccgagcauggaacuccuuggagguagaagauuauggauucggggucuuuucaacgaauauuuggcuuaaacuaagggaaaaacaagauguauuuugugauaguaaacuuaugagcgcggcaaucaaagauaacagggcaguccaugcagauaugggcuacuggauugaaagugccuugaaugacacuuggaaaauggaaaaagcuaguuuuauagagguuaagucaugucauuggccaaaaucccauacacuauggaguaacggaguauuggaaagugaaaugauaauaccgaaaaacuucgcaggcccaguaucucagcacaauuauagaccgggguaccauacacaaacagcgggaccguggcaccuaggaaaauuggaaauggauuucgacuucugugaaggaacaaccgucguggugacggaggacuguggaaauagaggcccaagucuaagaacgacaacagcaagcgguaaacugauuacugagugguguugcaggucaugcacacuaccuccauuaagguauagaggggaagacggguguugguacggaauggaaauccgcccacugaaagagaaggaggaaaaccuuguaaauucucuagugacagcagggcacgggcaaauugauaauuucagucucggaguacucgguauggcucuguucuuggaggagauguuacgcacuaggguagggacgaagcacgcgauacuauuaguagccgugagcuucaugacguugauuaccgggaacauguccuuccgagaucuaggacguguaauggucauggugggugccacaaugaccgaugauaucgguaugggagucacguaucuagcacuucuagcugccuucaagguaagaccuacauuugcagcaggucuguuacuaaggaaacuuacgucgaaagaacucaugauggcaacgauuggcauagcucuuuuaucacaaaguaccauaccugaaacuauuuuggaauuaacagacgcauuggcguuagguaugaugguguuaaagaucguuagaaauauggaaaaauaucaacuagcugugacaauuauggcaauaucaugcguaccaaacgccguaauucuacaaaaugcauggaaaguaaguuguacaauauuagcagcugucuccguuuccccgcugcuacuaacaaguucacaacagaaggcagacuggauacccuuagcccucacaauaaagggauuaaacccaaccgccaucuuuuuaaccaccuuaagccgaaccagcaaaaagagaucauggccccuaaaugaagcuauaauggcagucggcaugguaaguauauuagcuucuaguuugcuuaaaaaugacauuccaaugacggggccucuaguagcugggggacuccugaccguauguuauguucucacugguagaagugcugaccuagaacuagaaagagcugcugacguuaagugggaggaucaggcagaaauaucugguucaagucccauccucuccauaacaauuagugaagacggaaguaugaguauuaaaaaugaagaggaagaacaaacacuaacuauauuaauuagaacuggauuauuaguaaucuccggauuauuccccgucucaauaccaauuacagccgcagcaugguauuuaugggaagugaaaaagcagagagcggggguucuuugggauguaccauccccaccaccagugggaaaagcggaacuagaagauggggcauauagaauaaaacaaagaggaauuuuaggauauagucaaauaggugcaggaguauauaaagaagggaccuuccauacaauguggcauguuacgcgaggugcaguacuaaugcaucguggaaaaagaaucgaaccaucaugggcagaugucaagaaagaccuaaucagcuauggaggaggauggaaauuagaaggggaguggaaagaaggugaagaaguccagguuuuagccuuagaaccgggcaaaaauccccgagcaguucagacaaagccggguuuauuuaaaacgaauacaggcacaauaggcgcaguuagccuugauuuuaguccuggcacaucuggaagcccuaucguagauaggaaaggaaagguuguuggauuauaugguaacgguguaguuacaagaagcggugcauauguuuccgcaauagcacaaacagaaaagaguauagaggacaacccagaaauugaggaugauauauucaggaagaaaagacuuaccaucauggacuuacaucccggugccggaaaaacuaaaagauaccuuccagcuauagucagagaagcuauuaaacgcggauuacggacucuaauucuugcaccuacuagaguaguagcagcggaaauggaagaagcauuacgaggucuuccaauacgauaccagacaccagcaauacgugcagaacauacgggccgggagauaguagaucucaugugucaugcgacuuucacaaugagguuguuaaguccaguucgagugccaaauuacaacuuaaucaucauggaugaggcccauuucacugauccggccagcauagcagcaagaggcuacauaucaacgcggguugagaugggugaggcagcuggaauuuuuaugacugcgacgccuccugguagcagggacccauucccgcaaucuaacgcaccgauuauggacgaagaaagggagauacccgagagaucguggaacucaggacaugaauggguuacagauuucaaaggcaaaacuguaugguuugugccaagcauaaaagcugggaaugacaucgcggcaugcuuaaggaaaaaugguaagaaagugauccaauuaagucggaaaacauucgauucagaauauguuaaaacuagagcaaaugacugggauuucgucgugacaaccgauauuucugagaugggggcuaauuuuaaagcagaaaggguaaucgauccuagaagauguaugaaaccaguaauauuaacagacggagaagaacgugucauauuggccggaccuaugccgguuacgcacagcucagcugcacagagaagggguaggauuggccggaaucccaaaaaugagaaugaucaguauaucuauaugggagaaccccuagagaaugaugaagacugcgcacauuggaaagaagccaagauguuacuagauaauauuaacacaccugaaggcauuauacccucaauguuugagccggaaagggagaagguugaugcgauagacggagaauaccgcuuaaggggagaagcucgaaaaacuuucguagaccuaaugagaaggggcgacuugccagugugguuagccuauagaguagccgcugaggguaucaauuacgcugacagacgauggugcuucgauggcauaaagaauaaucaaauacuagaagagaauguugaggucgaaauauggaccaaagaaggagaaaggaaaaagcucaaaccuaggugguuagaugcaaggauuuauagcgaccccuuggcuuuaaaggaguucaaagaauuugcugcuggaaggaaaaguuugacacucaauuugauaacugaaaugggucgcuuaccgacauucaugacacaaaaggcuagagaugcguuagauaacuuagcaguauuacacacagcagaggcuggugggcgagcguauaaucacgcuuuaucggaauuaccagaaacucuugagacguuacuacuccuaacacuuuuagcaacuguaacagggggcauauuucuauuuuuaaugucugguaaggggauagggaaaaugacgcuggguaugugcugcauaauaacggcaucgauacugcucugguaugcacaaauacaaccacauuggaucgcagcuucaauaauacuggaguucuuuuuaauuguacuuuuaauaccggaacccgaaaaacaacgaacaccgcaagauaaucaguuaacuuauguaguaauugcgauacuaacgguaguagcugcuaccauggcaaacgaaauggguuuccucgaaaagaccaagaaagaucuuggccugggaagcauuacgacgcaggaaagcgaaucuaauauuuuagacauagaucucagaccagcgucugccuggaccuuauaugcgguagcuaccacauucguuacuccuaugcuacgucauagcauagaaaacuccucagugaacguuucauugacugcaauugcuaaccaagcaaccguuuuaaugggauuaggaaaaggauggccauugucuaagauggacauuggggucccguuguuagcaauaggauguuauucacaagucaauccgauuacauuaacagcugcauuguuacuuuuaguugcgcauuaugcaauuauaggcccaggacuacaagcuaaagcaacuagagaagcucaaaagagagcagcagcggggauaaugaaaaauccuacgguugauggaauaaccguaauugauuuagacccaauacccuaugauccaaaauuugaaaaacaauuaggccaagugauguuguuaaucuuauguguuacgcaaguucuaaugaugagaacgacaugggcauugugugaggcacuaacauuagcaacuggaccgauuagcacccuaugggaaggaaacccagguagguuuuggaacacaacaaucgcgguaucaauggcaaacaucuuuagaggaucuuaccucgcuggagcaggacucuuauucucuaucaugaagaauacaacuaauacacgccggggaacugguaauauaggagaaacgcucggagaaaaguggaaaucacgacuaaaugccuuagggaaauccgaguuccaaaucuacaagaaaagcgggauccaagaaguagaccguacauuagcaaaagaaggcaucaaacgcggugagacggaucaccacgcuguaagucgugggucugcuaaauuacgaugguuuguggaacgaaacaugguuacuccugaggggaagguaguggaucuuggauguggccguggaggauggucauauuauugugguggacuaaagaauguaagggaaguaaaaggacuaacaaaggguggaccaggucacgaagaaccuauuccaaugagcacuuacggauggaauuuaguaagacuacaaucaggaguugauguauucuucacgccaccugaaaaaugcgacacucuacuaugugauauaggagaaucuucuccuaauccaacaaucgaagcuggaagaacuuugagaguucugaauuuaguggaaaauuggcugaacaauaacacacaguucuguaucaaaguguuaaacccguauaugccgaguguuauugagaaaauggagacuuuacagagaaaauauggaggugccuuaguucgaaauccacuaucgagaaauucuacacaugagauguauugggugagcaacgcaacagguaauauaguuucaucaguaaauaugauaagucggaugcuaauaaaucguuuuaccaugaaacacaagaaagcgacuuaugaaccagauguagaucuagguagcgggacucguaacauuggcauagaaagugagauuccaaaucuagacauuauugggaaaagaauugaaaagauaaaacaagaacacgagacaucuuggcacuacgaccaagaucauccuuacaaaacgugggcuuaucauggcucauacgaaacgaaacagacaggauccgcguccaguauggugaaugggguaguaagacuacuaacaaagcccugggauguaguaccuaugguaacucaaauggcaaugacugauacaacacccuuuggacaacaaagaguguuuaaggaaaaaguugauacaaggacccaggagccaaaagaagguaccaagaaauuaaugaaaauuacggcggaaugguuguggaaggagcuagggaagaagaaaacaccuagaauguguacucgggaggaauuuaccagaaaaguacgaucuaacgcagcacuaggggccauauucacagacgaaaacaaauggaaaucagcaagagaagccguggaagacgguagauuuugggaauuggucgaccgugaaagaaaccuacaucuagaagguaaaugugaaacuugcguauauaauaugauggguaaaagggagaagaaacuuggagaauuugggaaggcuaaagguagcagagcuaucugguacaugugguuaggggcuagauuuuuggaauuugaagcacucggcuuuuuaaaugaagaucauugguucucccgagaaaacucauugucuggaguagaaggggagggacuccacaaacucgguuauauccuuagagauguuucgaaaaaggagggaggagcaauguacgcagacgacacugcagggugggauaccagaauaacucuugaggaucugaaaaaugaggaaaugguaacuaaccauauggaaggagagcauaagaaacuggcagaggccauauuuaaauugacuuaucaaaacaagguuguuagaguacaaagaccaacaccuagagguaccguaauggacauaauuagccgaagggaucaaagaggauccggacagguugggacguauggauugaacaccuucacaaauauggaagcacaauuaauacggcaaauggaaggcgaaggaauuuucaaaaguauucaacacuuaacuguaacggaagaaauagcgguccaaaacuggcuagcuagagucggaagggaacgcuugucaagaauggcaauaaguggggaugacugugucgucaaaccccucgaugaucgcuucgcgucagcucuuacagcacugaaugacauggguaaagugaggaaggacauccaacagugggagccgaguagagguuggaacgauuggacucaagugccauucugcagccaccacuuucaugaauuaauaaugaaagacggaagaguauuggucgugccaugcaggaaucaagacgaguuaauuggccgcgcgagaaucagucagggggcuggauggucuuuaaaggagaccgcauguuuaggaaagucuuaugcccaaauguggacccuaauguacuuucaucgacgugaccuacgauuagcugcaaacgccauuuguucagcaguuccuucgcacuggguuccaacaucacguacgacuuggucaauucacgcaaaacaugaguggaugacuacugaggauaugcuagcaguguggaauagaguguggauccaggagaauccguggauggaagauaagacuccaguggaaagcugggaagaagugccuuauuuaggaaaacgugaagaucaaugguguggcucauuaauaggucuuacaucacgugcuacaugggcgaaaaacauacaaacugcaaucaaucaaguaagaucgcuuauagguaaugaagaauacacagauuauaugccuagcaugaaacgauuucgaagagaagaggaagaagcggggguguuaugguaa

SEQ ID NO: 22723 - RNA, 9876 nt, Artificial Sequence
  derived and/or modified CDS sequence (opt6) from DENV-2__EU482640__SS-prME
acggcuggaauaauaaucaugaugauaccaacaguuauggcauuucaccuuacaacacguaauggugaaccacauaugaucguaucacgacaagaaaaaggaaaaucacuguuauucaaaacggaaaacggaguaaauauguguacauugauggcuauggauuuaggagaauuaugugaagauacaauaacuuauaacugcccauuacuuagacagaaugaaccugaagauaucgauuguugguguaauagcacaaguacauggguaacauacggaacaugcacugcaacuggggaacaccggcgcgagaaaagaaguguggcguugguuccacaugucggaaugggucuugaaacgcgaacggaaacguggaugucgagugaaggagcauggaaacacgcacaaagaaucgaaaccugggucuuacgacacccaggauuuacaauaauggcugcaauuuuagcauauaccaucgguaccacauacuuucaaagaguauugaucuucauucuucuuacgacaguagcgccaucaaugacuaugcgauguauagguauaaguaaucgagacuucguugaagguguuagugggggcucuuggguggacauaguacuugaacauggaucauguguaacuacaauggccaaaaacaaaccgacuuuagacuucgaacuuauaaaaaccgaagcuaaacauccagcaacauugcgcaaauauuguaucgaagcaaaacuuacaaauacgaccacugccagucggugcccuacucagggagaacccucacuuaaugaagaacaagacaaacgauuuguuuguaaacacagcaugguugauagagguuggggaaacggauguggucucuuuggaaagggaggaauagucacaugcgcuauguucaccuguaagaaaaauauggaagguaagauuguccaaccagagaacuuggaauauacaauugucauuacaccacauagcggcgaagaaaaugcuguagguaacgauacaggcaagcacggcaaagaaauaaaagucacaccgcaaucaucuauuacugaagcugaauuaacagguuauggcacuguuacuauggaauguucaccccguacgggccuugauuuuaaugaaauggugcuuuugcaaauggaaaacaaggcaugguugguccauagacaaugguuuuuggaucuaccacuaccgugguuaccaggagcugauacucaggggucaaauuggauucagaaagaaacuuugguaaccuucaagaacccacaugccaaaaagcaagauguaguuguucuagggucccaagaaggcgcaaugcauacugcuuuaaccggagcuacagaaauucaaauguccucggggaaccuacuuuucaccggacauuuaaaaugucgccucagaauggauaaguuacaauuaaagggaauguccuacaguauguguacagguaaauuuaaagucguaaaagaaauagcggagacacaacacggaacgauagucauaagaguccaauacgagggugaugguucaccaugcaaaauaccuuuugaaaucauggaucuggagaagagacauguccugggcagauuaaucaccgucaacccgauugucaccgaaaaggauaguccgguuaacauagaagcugaaccuccauucggggauaguuauauaauuauaggagucgagccaggacaacuaaaguuaucaugguucaagaagggcucaagcaucggucaaauguuugagacaacaaugagaggcgcaaagcgaauggcuauacuaggcgacaccgcuugggauuuugggaguuuaggagggguuuucacgucgauaggaaaagcccuucaucaaguauucggagcaauuuauggcgcagcauuuagcggaguaucuuggaccaugaagauacuaauagggguggucauaacuuggauuggaaugaacucgcgaucaacaaguuuaucggucucauuaguccuaguaggcguaguaacacuauaucuaggaguaaugguacaggcugauaguggauguguaguaucuuggaagaacaaggaauuaaaaugcggcucgggaauuuucaucacagauaacguccacacauggaccgaacaguacaaauuucaaccagaaagcccaagcaagcuggccucagcuauucaaaaagcacaugaggaaggaaucugcggcauucguaguguaacuagacuugagaacuugauguggagacaaauaacuccagaacuaaaucauauuuuaucagaaaaugagguaaaauuaaccauaaugacuggugauauaaagggaauaaugcaagcuggcaagaggucucuacgaccucagcccacggaauuaaaguauuccuggaaggcuuggggcaaggcaaaaauguugucaacagaguuacacaaccacacauucuuaauagauggucccgaaacugcugaauguccaaauacuaauagagcauggaacucccuugaaguagaggauuaugguuucggcguguuuacaacuaauauuuggcugaaacuuaaagagagacaagacguauucugugauuccaaacuuaugucugcugcaauaaaagauucaagagcaguacaugccgacaugggauauuggauagaaagcgcauugaacgacacuuggaaaaucgaaaaagcgagcuuuauugagguaaagagcugucauuggcccaagagucacacuuuauggucaaacggaguuuuggaaucagaaaugauuauacccaaaaacuucgcggggccggucagccaacacaacuacaggccaggauaccauacacaaacggcgggcccguggcacuuaggcagauuagaaauggacuuugauuuuugcgagggaacaaccguuguuguuacggaagauugcggaaaucgaggaccgaguuuacgaacaacaacagccuccggcaaauuaauaacagaauggugcugccggucauguacuuugccgccacuccgauaucguggugaagauggauguugguacggaauggagauacguccacuaaaagaaaaagaagaaaacuuaguuaacucgcuugucacugccggucauggacaaauagauaauuuuagccucggaguucuaggcauggcgcuauuuuuggaggagauguuacgcacgagaauuggaacaaaacaugcaauacuguuaguagcaguuucauuuguaacguuaaucacgggaaacaugucuuuuagagauuuagggagaguaaugguaauggugggugccacuaugacugaugacaucggaaugggggugacauauuuggcucuccuagcagcauuuaaagugcgaccaacauuugccgccggacuucuguugagaaaauuaacaaguaaagaacuuaugaugacgacuauuggaaucguauuacuuagucaaucuacaguaccugaaacaauacuggaacuuacggacgcuuuggcucucggaaugaugguuuuaaagauaguccgcaacauggagaaauaucagcuagccgucacgaucauggcaauauuaugcguaccaaaugccgucauccuacagaaugcauggaaagucucuugcacaacuuuagcggucguaucagucucaccacuauuauuaacaucuagccgucaaaaggcggacuggauuccguuagcauugacuauaaaggguuugaaccccacagcuauauuccuaacaacacuuuccaggacgagcaagaaacgauccuggccccuaaaugaggcuauaauggcuguaggaaugguaaguauacuugcuagcucacugcuaaagaaugauauaccgaugacgggaccauuagucgcugguggucuacuaacuguauguuauguauuaacuggaagguccgcggaccuugaauuggaaagagcagcggauguuagaugggaagaacaagcagaaauaagugguucaucucccauccuaucaauaacaauuucagaggacggaagcaugagcaucaaaaaugaagaagaagaacaaacacuuacgauauuaauuaggacaggacuauuaguaaucaguggguuauuuccuguaucuauaccaauaacagcggcggcgugguauuuaugggaaguuaagaaacaaagggcggguguguuaugggacguaccuaguccuccaccggucggaaaagccgaacuagaagacggcgcguacaggauuaaacaaaaaggaauuuuaggauacagccaaauaggugcaggcguauauaaggaagguacauuccacaccauguggcauguaacacgaggugcgguucuuaugcacaagggaaaaaggauugagccuucaugggcagaugucaagaaagaccuaauuucauacgguggaggauggaaauuagaaggugaauggaaagaaggugaagaaguacaaguuuuggcauuagaaccaggcaaaaauccaagagcaguacaaacaaaaccagguuuauuuaaaacgaacaccgguacuauuggagcuguaucauuagauuucagccccggaaccucaggaucaccuauugucgacaagaaaggaaaaguagucggucucuauggcaacggcguuguuacuagaucuggaacauauguauccgcgauugcucagacagagaaaaguaucgaagacaauccagaaauagaagaugacauuuuuaggaagaaaagacuuacaauuauggauuuacauccaggcgcaggcaagacaaagagauauuugccugccauuguuagggaggcaauaaagcgaggauugcgaacauuaauuuuagcaccgacgcgaguaguagcagcagagauggaagaggcccucagagguuuaccgauaagauaucaaacccccgcuauuagagcagagcacacaggccgcgaaauaguggauuuaaugugucaugcuacauuuacuaugagacuacuuucaccuaucagagugccuaauuacaauuugauaauuauggacgaagcacauuuuacugacccagcaucaaucgcagcccggggauauauauccacgcgaguagaaaugggugaggcagcggguaucuucaugacagcgaccccgccuggaucuagagaccccuuuccacaaagcaaugcuccuaucauggaugaagaacgagagauuccugaaagaucauggaacuccggacacgaguggguaacggacuucaaaggaaaaacugugugguuugugccuucuauaaaagcggguaaugacaucgcggcaugucuuaggaaaaacggcaagaaaguaauucaauugagucgaaagacuuuugauucagaauauauaaaaacaagaacgaacgauugggauuucgucguaacaacagauaucucggagaugggggcaaauuuuaaagcugagcgagugauagauccccgaagauguaugaaacccguaauacuaacugacggcgaagaaaggguaauacuagcagguccuaugccuguaacccacucaucagcggcgcaacgccgaggaagagugggacguaaccccaaaaaugaaaaugaucaauacauauacaugggagaaccacuagagaaugaugaagauugcgcccacuggaaagaagccaagaugcugcucgacaauauaaauaccccagaaggcauuaucccgucuauguucgagccugagcgagaaaaaguugacgccauagacggugaauauagacuaagaggugaagcacguaaaacauuuguugaccuaaugagaagaggugaccuuccuguauggcuugcguaucgaguagcugcagaaggaauaaauuaugcggaccgaaggugguguuucgauggaguuaagaauaaccaaauucuagaagaaaaugucgaaguagaaauauggacaaaagaaggagaaaggaagaaacuuaaaccaagaugguuggaugcaagaaucuauucugacccauuggcccuaaaagaguucaaggaguuugcugcaggaaggaaaucauuaacacuaaauuuaaucacagagaugggaagacuaccgacauuuaugacacagaaagcacguaacgcauuagauaaccuagccguauugcauacagcugaagcuggcggcagagcuuacaaucacgccuuaucagaauuaccugaaacuuuagaaacacuacuguuguuaacccuuuuagcuacgguaacaggaggcauauuucuauuuuuaaugucugguaaagguaucggaaaaaugacgcuaggaaugugcugcauuauaacggcgucaauacuucugugguacgcucaaauccagccccacuggauagcagccucaauuauuuuagaguucuuccuaauaguguuauuaauuccugagccagaaaagcaacgaacgccacaagacaaucaauuaacauaugugguuauugcgaucuuaacuguuguagcagcuacuauggccaaugaaaugggauucuuagagaaaacuaaaaaggacuuuggacuuggaagcauuacgacucaacaaccagaaaguaacauauuagacauugacuuaaggccagcaucagcauggacucuauaugcuguagcaacgacauucauaacaccaaugcuacgacauagcauugaaaacucuagugucaacgugucgcucaccgccauagccaaccaagcaacuguguugaugggcuuaggaaaagguuggcccuugucuaaaauggacauuggcguaccucuuuuagcaauaggaugcuacucacaaguaaacccgauaacuuuaacggcagcauugcuacuauuaguggcccauuaugccauaauuggcccaggacugcaggccaaagcaacuagggaagcacagaaaagagcagcugcaggaauuaugaaaaauccaacuguagauggaauuacgguaauagacuuagauccuauuccauacgauccuaaauuugaaaagcaacucgggcaaguaaugcuauuaguucuuugcguaacacaaguucuaaugaugcguacaacuugggcacuaugugaagcguuaacgcuagcuacuggcccaauaucuacauuaugggaaggcaauccagguagauucuggaauaccacaauagccguuaguauggcaaacaucuuucguggaucuuauuuggcgggcgcuggccucuuauucucgauuaugaaaaacaccgcaaauacgcgaagaggaacuggcaauacaggagaaacguugggugaaaaguggaagaaucgcuuaaaugcacuggguaaaagcgaguuccaaaucuacaagaaaagugggauucaagaaguagacaggacacuugcgaaagaaggaauaaaacgaggugagacagaucaucacgccguaucgcgaggaucagcuaagcucaggugguucguagagcgaaaccucguaacacccgaagggaaaguaguugauuugggguguggucgcggaggauggucauacuauugcgggggacucaaaaauguuaaggaaguaaaggguuuaacaaagggaggaccagggcaugaagaaccaauuccaaugagcacauauggauggaauuuaguacgacuccaaagugguguugauguauuuuucaccccaccugaaaaaugugacacguugcugugcgauaucggagaaucaagccccaauccgacuguagaagcggguagaacauugcgaguguuaaauuuaguugaaaauugguuaaacaacaacacacaguucuguauaaaaguucuaaauccuuauaugccgagcguuaucgagaaaauggaagcgcuacaacgaaaguacggaggagcauuggugaggaacccauuaagcagaaacucuacacaugagauguacuggguguccaaugcuagcggcaauaucguaucgucagucaauaugauauccaggaugcuuauaaaucgcuucacgaugcgacauaagaaggcgacauaugaaccagacguagaucuagggagcggaaccaggaauauuggaaucgaaucugaaacuccuaacuuggacauaauagguaagagaauagaaaagauaaaacaagaacaugagacaucguggcauuaugaucaagaucauccuuauaaaaccugggcuuaccaugguucguacgaaaccaaacaaacagggucugcuucaucuaugguaaaugguguagugaggcuuuugacaaagcccugggacguaauuccaaugguuacacagauggcaaugacagacacgacaccguuuggacaacagagaguauucaaagaaaaaguugauacaaggacucaagaaccgaaagagggcacuaaaaagcuaaugaaaauuacagcagaauggcuauggaaagaguuggguaagaagaaaacaccaagaaugugcacuagagaagaauuuacuagaaaaguaagauccaaugcagcgcucggcgccaucuucaccgacgaaaacaaauggaaaucagcaagggaagcgguugaggacagcggauucugggaauugguugacaaagaacgaaaucuucaucucgaaggcaaaugugaaacguguguuuacaauaugaugggcaaacgcgagaagaaauugggugaguuuggaaaagcaaaagguucccgcgccauaugguauauguggcuaggcgcacguuucuuagaguucgaggcauugggguucuuaaaugaagaucacugguuuuccagagaaaacucauugucagguguagagggugaagguuugcacaaacugggauauauccuaagagaugucucuaagaaagaagggggcgcuauguacgcagacgauacugcuggaugggacacccguauaacauuagaagaccuuaaaaacgaagagauggucacgaaucacauggagggagaacacaagaaacuagcugaggcaaucuuuaaguuaaccuaucaaaacaaaguuguuaggguucaacgcccaacaccaagaggaacagucauggauaucauuucgcgaagagaucagagagggucugggcaagugguuacuuacgggcuaaauacuuucacuaauauggaggcgcaguuaauaaggcagauggagggugaaggugucuuuaaaagcauacaacaacuaacgguuaccgaagaaauugcagugaagaauugguuagcgagaguuggaagagaaagacucagcaggauggccauuucaggggacgauugugucguuaaaccacuggaugaucgcuuugcaagugcacucacggcgcuaaacgauauggguaagguucguaaagauauacagcaaugggaacccuccaggggauggaaugauuggacacaaguaccauuuuguagucaccauuuucacgaauuaauaaugaaagacgguagggugcugguaguaccaugccgaaaucaagaugaacuaauuggucgugcaaggaucagucagggggcuggcuggucaaugagagaaacagcaugcuuagguaaaaguuaugcgcaaauguggagcuuaauguacuuucauaggcgugauuugagacuugcugccaacgccauaugcucagcaguaccaagucacuggguucccacuucuaggacuacauggucgauccaugcaacccaugaguggaugacuaccgaagacaugcuaacgguauggaacaggguauggauacaggaaaacccuuggauggaagacaaaacaccuguugaaaguugggaggaaauaccguaccuagguaaaagagaagaucaauggugugggagccugaucggacuaacuucacgagcgacgugggccaaaaauauucaaacggcaauaaaucagguacgcaguuuaaucgguaacgaggaauacacagacuauaugccguccaugaagagauuccgacgugaagaagaggaagcaggaguucuuugguag

SEQ ID NO: 22724 - RNA, 9876 nt, Artificial Sequence
  derived and/or modified CDS sequence (opt6) from DENV-2__EU482641__SS-prME
ucugcaggaaugauaauuaugcugauuccgacaguaauggcauuccaccuaacaacgagaaauggagaaccacacaugauaguagggauucaagaaaaaggaaaaucauuacuguuuaaaacugaagauggagugaauauguguacauuaauggcaauggauuuaggagagcuaugcgaagacacaauaacuuacaaaugucccuuacuaagacaaaaugaaccugaagacauugacuguuggugcaauagcacaagcacgugggugacauauggcacaugcaccauaacgggagaacaucgacgagagaaaagaucuguugcacuggugccccacguuggaaugggacuggaaacaagaacggaaaccuggauguccucagaaggagcauggaaacaugcccaaagaauugaaaccuggauccugagacauccgggauuuacgaucauggccgcaaucuuagcauacacuaucgguaccacacauuuucagcgaguacuuauauucauacuauuaacugcuguagcaccaucaaugacaaugagauguauugggauaaguaaucgugauuuuguagaagggguaucaggaggaaguuggguagauauaguuuuagaacacggcucuuguguaacgaccauggccaaaaauaaaccgacauuagacuucgaacuuauaaaaaccgaagcaaaacagccggcaacccuacgaaaauauugcaucgaggcaaaauugacaaauacuacuacagagucgagauguccaacucaaggggagccaucauuaaaagaggaacaagauaaaagguucguaugcaaacauaguaugguugauagaggcugggguaacgguugugguuuguucggaaaaggcgggaucguaacaugcgcaauguucacguguaagaaaaauauggagggaaaaauuguacagccagaaaacuuagaauacacuauuguuguuacaccacauaguggugaggagcacgccgugggaaacgacacuggcaaacauggcauggagauaaaagugacaccucaaucaucaauaacagaagccgagcuuacuggauacggcacuguuaccauggaauguuccccacgcacuggucuugacuuuaacgaaaugguauuacuacaaauggaaaauaaagccuggcuaguacauagacaaugguuucuugaucugccacuaccauggcuuccuggagcagacaaacaagaguccaacuggauucaaaaagaaacacucguaacuuuuaaaaacccacaugcgaagaaacaagauguggugguucuggguagccaagagggugccaugcauacggcuuuaacaggagcaacugagauucaaaugucuagcggcaacuuacuguuuacaggacacuugaaaugucgucuacggauggauaaauuacaacuuaaaggaaugucuuauucuaugugcacaggcaaauucaaagucguaaaagaaauagcagaaacacaacauggcaccauugucauaagagugcaguaugaaggagaugggaguccguguaaaauacccuuugaaaucauggaucuugagaaaagauaugugcucggaagacugauaacuguaaaucccaucguaacugagaaagauucaccgguuaauauagaagcagagccaccuuuuggagauagcuacauaauuauagguguugaacccggacagcuaaaacucaauugguucaagaaaggaagcucgauaggccaaauguuugaaacaacaaugcggggagcaaaaagaauggcaauuuuaggagacacggcaugggacuucggcagcuugggagguguuuuuacaucaauaggcaaagcauugcaccaaguguuuggggcuauauacggagcagcuuucucagguguuucuuggacgaugaaaaucuuaaucggcguaauuaucacauggauaggcaugaacucaagaagcacgagccugucugugagcuuagucuuaguaggaaucgucacacuguaccuaggggucaugguccaagcugauagcggauguguaguuucuuggaaaaacaaagagcuuaaaugcggaucaggaaucuuuauaacagauaacguccacacauggacugaacaauauaaauuucaaccugaguccccgucgaaacuagcgucugcaauacaaaaagcgcaagaggaagguaucugcgguauuagaucggugacaaggcucgagaaccuaauguggaaacaaauuaccccugaacuuaaccauauauuggcggagaaugaaguaaaacuuacaaucaugacaggagacauucgaggcauaaugcaagcaggaaaacgaucgcuacggccucagccaacagagcuuaaguacaguuggaaaaccuggggcaaagccaaaauguugucgacagaaucauacaaucaaacauuuuuaaucgacggcccggaaacggccgaguguccaaauacaaacagggcauggaacucacuggaagucgaggacuacgguuuuggugucuucacuaccaauauauggcucaaauuaaaagagaaacaagacgcguucugcgauucgaaacuaaugagcgcugcaauuaaagacaauagagcgguacacgcugauaugggauauuggauagaaucagcacugaacgacacuuggaaaauagaaaaagccucauuuauagaggucaaaaauugucacuggccgaagagucauacauuauggaguaaugguguccuagaaagcgaaaugauuauaccaaagaauuuggcaggaccugucucacaacauaacuauagacccgguuaccauacgcaaauugcgggaccguggcaccuaggaaaauuagaaauggauuucgacuuuugcgauggcacaacaguaauaguaaccgaagauugcggaaacagaggacccaguuuaagaaccacaacugcaaguggcaaauuaaucacagaaugguguugccguucauguacccuacccccacugagauauagaggcgaggauggcugcugguaugguauggaaauuagaccgcucaaagagaaggaggaaaaccucguaaauucacugguaacggcaggacauggccaaguugauaauuucucguuagggguacuagguauggcucuauuuuuagaagaaauguugcgaacaagaguuggaacuaaacacgcaauauuauugguagcaguuucauuuguaacccuaauuaccggcaauaugaguuuuaaggaucuaggucgcgucgucgucaugguuggagcaaccauggcagaugauauugguauggguguaacauacuuagcauuauuggcggcauucaagguucgcccuaccuuugcggcagggcuucuucuaaggaagcuaacaucaaaagaacuaaugaugacgacuaucggaauaguucucuuaucacaaaguacuauucccgaaacuguacuagaauuaacagaugcacuugcacucggcaugaugguuuuaaagauaguucguaacauggagaaauaccaauuggcgguaacuaucauggcaauauuaugcguacccaaugcuguaaucuuacaaaacgcauggaaaguaaguuguacaauauuggccguaguaucuguaaguccacuacuguuaacuagcucucagcagaaaacagacuggaucccguuagcucuaacaauaaaaggguuaaauccaacugccaucuuccuuacaacccuaagucgaacgaacaaaaagaggucguggccauugaacgaggccauuauggccgucgguauggugucuauccuggcuucaucauuacucaaaaaugacauuccaaugaccggaccccuagucgcuggaggucuuuuaaccguguguuauguuuuaacuggaagguccgcggaccuagaguuggagagagcuacugauguuaagugggaggaccaagcugaaaucucggguucuucgcccauauuaucgauaacaaucagugaagacgggucaaugucaaucaaaaaugaagaagaagaacaaacacuuacaaucuugauccggaccggacuucuaguaauaucgggccuauuucccauuucaauaccuauuacagccgcagccugguaccucugggaaguuaagaaacagagggcuggaguuuuaugggauguaccaagcccaccaccaaugggaaaggcagaacuagaagacggugcauauagaauaaagcaaaaagggauccugggauacagucagauuggugccgggguauacaaagaagggaccuuucauacgauguggcaugugacaagaggggcaguauugaugcauaagggcaaaagaauagaacccucuugggcugaugucaagaaagacuugauaucguauggagggggauggaaacucgagggcgaguggaaagaaggugaagaaguccaggugcuggcacucgagccgggcaaaaauccaagagcaguacaaaccaaaccgggacuauuuaagacuaauaccggcaccauaggagcuguaucucuagacuuuucacccggaacauccggaucaccuauaaucgauaagaaagggaaaguagucggucuauaugguaaugggguaguaacucgcaguggcgcauacguuucggcgauagcccaaacagagaagucuaucgaagauaauccagaaauugaagacgauauauuuaggaagagacgguuaaccauaauggauuuacacccaggugcagguaagacuaaacgguaucuaccugcgauaguaagagaagcaauuaaaagaggacugcgaacacuaauacuagcacccacacgaguaguagcugcagaaauggaagaagcacuuagaggauuaccuauaagauaccaaaccccugcaaucagagccgaacacacggguagagaaauaguagaucuaaugugccacgcaaccuucacuaugcgccuccuaagcccaguaagagugccaaacuauaauuuaauuauuauggaugaagcccauuucacugauccagccaguauagccgcaagaggauauaucaguacucgcgucgagaugggugaagcagcugguauuuucaugacggcaacgccuccggggaguagggauccguucccacagaguaacgcuccuauuauagaugaagaaagagaaauuccagagcguucuuggaauagugggcacgaauggguaacugacuucaagggcaaaacaguuugguuugugccgucaauuaaagcggguaaugacauugccgcaugucugcgcaaaaauggcaagaaaguaauacaacuaucacggaaaacauuugauucugaauaugugaagacacgaaccaaugauugggauuucguggucaccaccgauauaucugagaugggagcgaauuuuaaagccgaaagagucauagauccaagacgaugcaugaaaccaguuauauuaacagauggggaagaacgaguaauauuggcaggcccuaugccgguaacacauucgagugcagcucaaagacguggaagaauugguagaaauccuaaaaaugaaaaugaccaguacaucuauaugggugagccgcuugaaaaugaugaagauugugcacauuggaaggaagccaagauguuauuggacaauaucaauacaccugaggguauuauaccaagcauguucgaaccugaaagggaaaagguugaugccauagauggugaguaccgcuugcgaggagaagccagaaaaaccuuugucgacuugaugagaagaggagaucuucccguaugguuagcuuacaagguggcugcagaaggaauaaauuaugcagacagaaggugguguuuugauggaauuaaaaauaaucaaauccuagaggaaaauguugaagucgagaucuggacuaaagaaggagaaaggaagaaacuuaaacccagaugguuagaugcucgaauauacucagauccguuagcacuaaaagaauuuaaagaguucgcagcgggcagaaaaucacuuacccuaaauuuaauaacagagauggggaggcuaccaacguucaugacacagaaaacucgggacgcacuagacaaucuagcuguuuuacauacagcagaagcagggggacgagccuacaaucaugccuugagugaacugccugaaacccucgagacacuuuuacuacuaacacucuuagcuacgguaacuggcggaauauuuuuguuccucauguccggacgugguauugggaaaaugacgcuagggauguguuguaucauuacugcauccauacucuugugguacgcacagauacaaccucauuggauagcagcguccauaauacuugaauuuuuccuuauuguguuauuaauaccagagccggaaaaacagcguaccccacaagacaaucaauugacauacguugugauagcaauuuuaacggucguggcugcaacgauggcaaaugagaugggauucuuagagaaaacaaagaaggacuuggguuuagggaguaucgccacccaacaacccgaguccaauauccuagauaucgacuuaaggccagcaagugcuuggacucuguaugcaguagcaacaacuuuuguuacgccuaugcuaagacauucuauagaaaauuccucugucaacguaucucucaccgcgauugcuaaucaagcaacaguuuuaaugggauuggguaaaggauggccacuaucuaagauggauauagggguaccccuucuugcuauuggauguuauagccagguaaaccccauaacgcucacggcugcucugcuguuauuaguggcucauuaugcaauuaucgguccgggacuacaggcaaaagcaacgagagaggcucagaagagggcugcagcgggcauaaugaaaaacccuacgguugacggaaucacagugauagaccuagacccaaucccauacgacccaaaauuugaaaaacaauuaggccaaguaauguuacucauacugugugucacccaaguguuaaugaugagaacuacuugggcccucugcgaagcacuaacgcuggcuacagguccuaucagcacuuuaugggaagguaacccgggacgguuuuggaauacuacgauagcugucagcauggcaaacauauuuaggggaucauaucucgcaggggcagguuuguuguucucaaucaugaagaacaccacaaauacacgaagaggcaccggaaauauuggugagaccuuaggagaaaaauggaaaagcaggcuuaaugccuuaggcaaaucugaauuucaaauauacaagaaaucagguauccaagagguagacaggacuuuagcaaaagagggaauaaaacgcggagaaaccgaccaucaugcggugagcagaggcagugccaaguuaagaugguucguagagcguaauaugguuaccccggaaggaaagguuguagacuugggcugcggccgggguggguggagcuauuacugcggaggccuaaagaaugugagagaaguuaaaggauuaacaaaaggaggaccuggccacgaggaacccaucccuaugucuacauacggauggaaucuuguacgccuacaauccgguguggauguguucuuuauaccuccugaaaaaugcgacaccuuauugugugacaucggagaauccaguccuaaucccacaguagaggcaggucggacccugaggguacugaaucuuguugaaaacuggcuuaauaacaacacccaauucuguauaaagguauugaacccauacaugccuagcgucauagagaaaauggaagcgcuacaacguaaauacggcggagcgcugguacggaauccacuaucacgcaauuccacucaugaaauguauuggguuaguaaugccucaggaaauauagucuccaguguaaauaugauuagucgaauguugauuaaucgcuuuacaaugaggcauaagaaagcaacauacgaaccagauguagaccucggaagcggaacgagaaacauugguauagagucagaaauuccgaauuuagauauaauugguaaacgaauagagaaaauaaaacaagaacaugaaacauccuggcauuacgaccaagaucacccuuacaaaacaugggcauaucacggcucguaugaaacaaagcaaacggggucggcaucaucaauggugaacggcguaguuagauuauuaacuaagccgugggacguauuacccacuguaacccagauggcaaugacagauacaacacccuuugggcagcaaaggguauuuaaagaaaaagucgauacgcgaacccaagaacccaaagaaggcacuaagaaacuaaugaaaauuaccgcggaaugguuauggaaagaauuaggcaagaagaaaacacccagaauguguacacgagaagaauuuaccagaaaagucagaucuaacgcugcauuaggagcaauuuucaccgacgaaaauaaauggaagagugcuagggaagcuguugaagauucaagguuuugggaacucguggauaaagaaagaaaccuucacuuagaagguaaaugcgagacgugcguguauaauaugauggggaagcgggaaaagaaauuaggagaguuugggaaagcuaaagggucccgggcuauuugguauaugugguugggcgcaagauucuuagaguucgaggcucucggauuuuugaaugaagaccauugguucagcagagaaaauagcuuaagcggagucgagggagagggucugcauaaacuagguuauauucuuagagauguuagcaagaaagaaggaggggcaauguaugcagaugacacugcagggugggacacaagaauaacauuagaagaucucaaaaaugaagaaauggucaccaaccauauggaaggagagcauaagaaacuggcugaagcuauauuuaaauugacguaucaaaacaaaguuguacguguacaacgaccgacuccccgaggaacuguuauggauauuauaucucgacgcgaucaaagaggcaguggccaaguuggcacauacggauuaaacaccuuuacaaacauggaagcgcagcugauuagacagauggaaggagaagggguauuuaagaauauucaacaccuaacagugacagaagaaguagcaguacacaacugguuggcacgaguuggucgugaacgucucucucggauggcuaucagcggggacgauugcgugguuaaaccacuagaugaccgcuuugcaaacgcuuugaccgcguuaaaugauaugggcaagaucaggaaggacauccaacaaugggaaccaucuaagggauggaacgauuggacgcaaguaccguuuugcucgcaccacuuucacgaguuaaucaugaaagauggcagaauuuuagucgucccaugccggaaucaggacgaauuaaucgggagagcucggauaagccaaggagcugguuggagccuuagggaaacagcuugucucggcaagucauacgcacaaauguggaguuugauguauuuucaccgaagagaucugagacuagcugcaaaugcaauuuguucagcgguaccaucacacugggugcccaccucacguacuacuuggucgauacaugccaaacaugaauggaugacuaccgaagauauguuaacgguguggaacagagucuggauccgggaaaauccuuggauggaagauaaaacaccuguagaaucaugggaagaaauacccuauuugggaaagagggaggaucaauggugugggucauugauuggauuaacaagcagggcuacaugggcgaaaaauauacaggccgccauaaaucaaguaagaaguuuaauagggaaugaagaauauacugauuauaugccaagcaugaagagguuucgaagagaagaagaggaggcugguguccuuugguag

SEQ ID NO: 22725 - RNA, 9876 nt, Artificial Sequence
  derived and/or modified CDS sequence (opt6) from DENV-2__EU482642__SS-prME
ucggcaggcaugauuauaaugcuuauuccgacaguaauggcauuucaccuaacaacaagaaauggugaaccacacaugauaguugguauacaagaaaaagggaaaucuuuacuauucaaaacugaagacggcguuaauaugugcacccuaauggcgauggauuugggcgaacuuugcgaagauacaauuaccuauaaaugcccguugcuacgacaaaaugaaccggaagacauagauuguugguguaauaguacgucaaccuggguuacauacgggacauguacuacaacuggugaacauaggagagagaaaagaagcguggccuuaguuccacacguaggcaugggucucgaaaccagaacagaaacguggaugucuucagaaggagcauggaaacacgcacaaagaauagaaacuuggauacuacgucacccaggcuucacaaucauggcagcaauauuagcguacacaauagguacaacgcacuuucaaagaguauuaauuuucauauuauuaacagcaguagcaccaucaaugacaaugagguguaucgguaucaguaaucgggauuuuguagaagggguaucaggagguucuugggucgauauugucuuagaacacggaaguuguguuacgaccauggccaaaaauaaaccuacacuugauuuugaacuaauaaaaacagaggcaaaacaaccugccaccuuaagaaaauauugcauugaagcaaaacuuaccaacacaaccacugaaagccgcuguccaacccaaggagaacccagccuuaaagaggaacaagauaaaagauucguauguaaacauuccaugguagaucgcggauggggaaauggcugcggguuauucggcaaagguggcauaguaacuugugcaauguucacaugcaagaagaauauggaaggaaaaauuguccaaccagaaaaccuugaguacacaauaguaguaaccccucauucaggagaggaacaugcaguaggaaaugauacuggaaaacacggaaaagaaaucaaagucacaccacaauccagcauaacggaagcagaguuaacugguuauggaacaguaaccauggaguguagcccgagaacaggauuagacuuuaaugaaaugguauuacuacagauggagaacaaagccugguuaguacacagacagugguuccuggacuuaccucuacccuggcugccuggagcagacaaacaggagagcaauuggauccaaaaagaaacccuagugacauuuaaaaauccccacgcaaagaaacaggauguuguaguacuaggaagccaggaaggugcuaugcauacagcauugacaggugcaaccgaaauucaaaugaguucagguaaucuguuauucacuggacauuuaaaaugccgucuaagaauggauaaauuacaacugaaagguauguccuauucuaugugcacaggaaaauuuaaagucgugaaagaaauagccgagacucagcauggcacgauaguuauucgaguccaauacgaaggugauggaucgcccuguaaaauaccauuugaaauuauggauuuggaaaaacgauacguucucggaaggcuaauaacaguaaauccuauagugacagaaaaagacucgccaguaaauauugaagccgaaccgccguucggagacucuuacauuauuauaggaguagagccgggucaauuaaaauuaaauugguuuaagaaaggcaguaguauaggacaaauguucgaaacgacgaugcgaggcgccaaacggauggccauacuaggcgacacggcuugggauuucggaucguugggaggugucuuuacaucuauaggaaaagcauuacaucaaguauucggggcaauuuauggagcugcauucucagggguauccuggacuaugaagauucuaauaggaguaauaauuacguggauagggaugaacagcagauccacgagccuaucaguaucccuaguacucguugggauagucacacucuaccuuggagucaugguccaagcagauaguggauguguagugaguuggaaaaauaaggagcuaaaauguggaaguggcauauucauuacggacaauguucacacuuggaccgaacaauauaaauuucaaccagaguccccaucuaaauuagcauccgccauacaaaaggcacaggaggaagggaucugugggauucgaagcguuacaagauuggaaaaccugauguggaaacagauuacgccagaacuuaaucauauacuagcugaaaaugaaguuaaauuaacaauuaugacgggcgauauaaagggaaucaugcaggccggaaaaagaucacuacgaccacaaccgacagaguuaaaauacuccuggaaaacgugggggaaagccaaaauguuaucaacugaaagcuauaaucagacuuuucuuauagauggaccggaaacagcggaauguccaaauacaaacagagccuggaacuccuuagaaguggaagauuaugguuucggagucuuuacaacuaacauuuggcuaaaacugaaagaaaaacaggacgcauucugugacucgaaauuaaugucagcagcaaucaaagauaacagagccguucacgccgauauggguuacuggauagaaucggcgcuaaaugacacuuggaaaauugaaaaagccagcuucaucgaaguaaagaacugccacuggccaaagucccauacauuauggucuaacggcguccuagaaagcgagaugaucauuccuaagaauuuagcuggcccaguaagccaacauaauuauaggccugguuaccacacgcaaaucgcggguccauggcaucuagggaaacuggaaauggacuucgauuuuugugaugguacaaccguaauagugacggaagauugcgguaaccgagggccaucacuaagaaccacaaccgccucuggaaaacuaauuacggaauggugcugcagaucgugcaccuuaccaccucugcgcuaucgaggggaagauggauguugguacgguauggaaauccguccguuaaaagagaaagaagaaaaucuaguuaauuccuuagugacagcgggucacggacaaguagauaauuuuagucuggggguacuagguauggcguuauuuuuagaagaaaugcugagaacuagaguuggaacgaaacaugcaauacuuuuaguggcaguuucuuuugugacucuaauaacggguaauaugucuuucaaagaccuaggaagaguaguagucauggugggagccacaauggcagacgauauaggaaugggaguaacguaucuagcguuauuagcugcauucaagguacgaccaacguucgcagcagggcuauugcuuagaaaauuaacuucaaaagaauuaaugaugaccacaauagguauuguccugcuaucccaaucuacaauuccggaaacaguauucgaacuuacggacgcccucgcguuaggaaugaugguucuaaagauaguaaggaacauggaaaaauaucaacuugccguuaccauuauggcaauccuaugugugccgaaugcaguaauccugcaaaaugcauggaaaguuagcuguaccauucuggcgguugucucggugaguccacugcuacuaacuucaucucaacagaaaacugacuggauuccccuggcucugacaauuaagggucuaaauccaacagcaaucuuucuaacaacauugagcaggacaaacaagaaacgaucuuggccuuugaacgaagcaauaauggccgucggaaugguuucuauacuggcgucuucguuacuaaagaacgauauuccaaugacaggaccauuaguugcuggugggcuuuuaacuguguguuauguguuaacagggagaagugcagauuuggaauuggaacgugcaacugauguaaaaugggaagaucaagcagaaauaucgggaagcaguccgauccucagcauuacuauaucggaggacggaucuauguccauuaaaaaugaggaagaggaacaaacgcucaccauacugauacgaacaggucuauuaguuaucaguggauuauuuccaauuucuauaccaauaacagcagcagcgugguaccuaugggagguuaagaaacaacgagcaggcguuuuaugggaugucccaaguccgcccccaauggguaaagcugaacuugaagacggcgcuuauagaauaaaacagaaagggauacuugguuacagccagauuggagcuggcguuuacaaagaggguaccuuccacacgauguggcacgugacaagaggggcaguauuaaugcacaaaggcaaaagaauugagcccaguugggcugauguaaagaaagacuuaaucagcuacggagguggauggaaauuagagggagaguggaaagagggugaagaaguucaagucuuagcuuuagagccgggcaaaaauccucgagcgguucaaacuaaacccggauuguuuaaaacaaauacaggcacgauaggugcuguuucucuggacuuuucgccggggacauccgguaguccuauuaucgacaagaaaggaaaggucguaggacuguacggaaauggugugguuacccguaguggagcauacguuucugccauugcacaaacggaaaaaucaauagaagacaauccggagauagaggaugacauauucagaaaaagacgucuaaccauaauggaccugcauccaggagcugggaagacuaagcgguaccuaccugccauagugagagaagcaauaaagcgcggauuacgaaccuuaauacuagcaccaacaagaguaguggcugcugagauggaggaggcccuuagaggucuaccaauaagguaucagacuccugcaauaagggcugagcacacaggacgcgaaauaguagaucuaaugugucacgcgacauucacaaugcgacuauugucaccagugagaguuccaaauuauaaucuuauuauaauggaugaggcacauuuuacugacccagcaucgauugcagcaagaggguauaucucgacaagaguagaaaugggggaagcggcuggaauuuuuaugacagcaaccccgcccgggagcagggacccauuuccacagagcaaugcaccuauaauugaugaagaacgagagauaccugaaaggaguuggaauagcggccaugaauggguuaccgauuucaaaggaaaaacaguaugguuuguaccuaguauuaaagcuggaaacgauauugcagccugcuugaggaaaaauggcaagaaagucauucaguuaagccgcaagacauucgauucugaguacguaaaaacuagaacuaaugauugggauuucguggucacaacagauauaucagagaugggugcaaacuuuaaagcugaacgagucauagauccaaggagguguaugaaaccgguuauacuuacggacggugaagaacgaguaauacuugcuggaccgaugccuguaacacacucaucagcagcacagagacgagguaggauagggagaaaucccaaaaaugaaaacgaccaauacauauauaugggagaaccuuuagaaaaugaugaagauugugcccauuggaaggaagcuaaaauguuacuugauaauauuaauacaccagaggggauaauacccaguauguucgaacccgagcgcgaaaagguagacgccauagauggagaguaccguuuacggggagaagcaagaaaaaccuucguagacuugaugcgucgaggugaccuaccaguuuggcuugcauacaaaguugcagcugaaggcauaaacuacgcggauagacguuggugcuucgacgggaucaaaaauaaucagauacuagaagaaaauguagagguagaaauauggaccaaagagggcgaacguaaaaaguuaaaaccaagguggcuagacgcuagaauuuacucugaccccuuagccuuaaaagaguucaaagaauuugcagcuggaagaaaaucguuaacgcuuaaccuaauaacggaaaugggccgacuccccaccuuuaugacucagaaaacucgugaugcgcuugauaaccucgcaguccugcacacagcagaagcugggggcagagcauauaaucaugcacuaagcgaacuaccugagacuuuagaaacuuuauuauuacuaacacuuuuggcgacgguaacuggagggauauuuuuauuucuuaugucaggacguggaauagguaaaaugacucuaggaaugugcuguaucaucacagcuaguauccuauugugguacgcccaaauucaaccacacuggaucgcugccucaauaauucuagaguucuuccuaauaguccuauuaauuccagaaccagaaaaacagaggacuccgcaggauaaccaauuaacuuacgugguaaucgcuauauuaacaguagucgccgcuacuauggcgaaugaaaugggauuuuuagagaaaacuaagaaagaucuuggcuuagguucaauagcaacacaacaaccugagagcaauauacuggauauagauuuaagaccugcuagcgcuuggacgcucuaugcaguagcaacgacauuugucacuccgaugcuaaggcacaguauagaaaauucuaguguaaacguuucauuaaccgcgauagcgaaucaagcgacaguauuaauggguuuaggcaaaggauggccucuaucaaaaauggauauaggaguacccuuauuagcaauagguuguuauucccaagugaaucccaucacucuuaccgcggcacucuuacugcucguagcgcauuacgcuauaauaggaccagguuugcaagcuaaagccacaagagaagcgcagaagagagcagcagcaggcauuaugaaaaauccaacaguggacgguauaaccgucauugaucucgauccaauaccuuaugaucccaaguuugagaagcagcugggacaaguuauguuauugauuuuguguguaacccaaguacugaugaugcgaacuacaugggcauuaugcgaagcccuuacgcucgcaacaggaccuauuucuacccucugggaaggaaauccugggcgauuuuggaauacgacaaucgccgucagcauggcgaacaucuuuagggguaguuauuuagcaggcgccggccuacuuuucaguauuaugaaaaauacuacgaacaccagaagaggcacaggcaauaugggagaaacuuuaggagaaaaauggaaauccagacuaaaugccuuggguaaaucggaguuccaaauauauaagaaauccggcauucaagaagucgaucgaacccucgcgaaggaagguaucaaaagaggugaaacagaucaucacgcgguaucuagaggauccgcuaaacuuagaugguuuguggaacgaaacauggugaccccagaaggcaaagucguagaccuaggguguggaagagguggauggucuuauuacuguggagguuuaaagaauguaagagaaguaaagggccuaacaaaaggcgggccaggucacgaggaaccaauaccaauguccaccuauggcuggaaucugguaagacugcaaagcgguguggacguauuuuucauaccacccgaaaaaugcgauaccuuacuaugcgauauaggcgaaagcucuccuaauccaaccguugaagcuggcagaacacugagaguccucaauuuaguggaaaauugguuaaauaauaacacccaauuuuguauaaagguauuaaacccauauaugccaagcgugaucgaaaagauggaggcuuugcagcggaaauacggcggagcacuuguaaggaauccgcuauccagaaauucuacucaugagauguauuggguaaguaaugccucaggaaacauaguaucaucggucaauaugauaucccgcaugcuaauuaaucgguuuacaaugcgacacaagaaagcgacauaugaaccugacguagauuuaggaucagggacuagaaauauaggaaucgagagugagauaccuaaccuagacauaaucggaaaaagaaucgagaaaauaaaacaagaacacgaaacaaguuggcacuacgaucaagaccacccuuacaaaacuugggcauaucacgggagcuaugaaacuaaacaaacuggaucagcaucaucaauggugaaugggguaguaagguugcuuacaaagccuugggacguacuuccaaccguuacccaaauggcuaugacagacacgaccccauuuggacaacaaagaguuuuuaaagaaaaaguagauacccgaacacaagaaccgaaagaagguacuaagaaacuuaugaaaauuacagcagaaugguuguggaaagaauuagggaaaaagaaaacaccaagaauauguacaagagaagaauuuacucggaaaguacgauccaaugccgcucuaggagcaauuuucaccgaugaaaacaaauggaaaagcgcucgcgaagcaguugaagauucccgauuuugggagcuaguagauaaggagaggaauuuacacuuagaagggaaaugugaaacauguguuuauaacaugauggguaaaagagagaagaaauuaggggaguucgguaaggcaaagggaucaagagcaauuugguacaugugguuaggugccagguuccuagaguuugaagcccuaggguuuuuaaaugaggaucauugguuuucaagagagaauagcuuaaguggagucgaaggugaaggcuuacauaaauuaggguauauccuacgagauguauccaagaaagaaggaggggcaauguaugcggacgauacggcaggaugggauacgcgcaucacccuagaagaccucaaaaaugaagaaauggucacuaaccauauggaaggugagcauaagaaauuagcagaagcaauuuucaaauuaaccuaccaaaauaaggugguaagaguacaacgcccuacaccucgcggaaccgucauggauauuauaucuagaaaagaucaaagagguaguggucaaguagggacuuauggacugaauacauuuacuaauauggaggcucaguuaauacgccagauggaaggagagggagucuuuaagaauauacaacaucuaaccgugacggaagagguugcagugcagaauuggcuagcuagagugggcagagaaagacuaucuaggauggcaauaucaggugaugauuguguaguaaaaccucuugacgaccgauucgcaaaugcauuaacagcacuuaacgauauggguaaaauaaggaaggauauccagcaaugggaacccucaaaagguuggaacgacuggacacaaguccccuuuuguucccaccauuuucaugaacuuauuaugaaagacggaagaguucuaguuguaccaugucggaaucaagacgaauuaauaggcagagcgcggauuagucagggugccggguggucuuuaagagaaacagcuuguuuaggaaagucauacgcacagauguggucgcucauguauuuccauagacgagaucugagauuagcagccaacgcaauauguagcgcaguccccucccauuggguaccaacuagccgaacaaccuggucuauacacgccaaacaugaguggaugacgacugaagauauguuaacaguauggaacagaguauggauacaagagaacccguggauggaggacaaaaccccuguggaaaguugggaggaaauaccuuaccugggcaaacgagaggaccagugguguggcagucucauaggucuaaccucaagggcgaccugggccaaaaauauacaagccgcaaucaaccaaguaagaagucuuauagguaacgaggaauacacagacuauaugcccucgaugaaaagauuucgccgagaagaagaggaagcggguguucugugguaa

SEQ ID NO: 22726 - RNA, 9876 nt, Artificial Sequence
  derived and/or modified CDS sequence (opt6) from DENV-2__EU482643__SS-prME
ucagcugguaugauuauaaugcuaauuccaacugugauggcauuccaccuaacaaccagaaauggcgaaccacacaugauaguagggauacaagaaaaaggaaaaucacuacuauuuaaaacagaagacgggguaaacauguguacacuaauggcaauggaucuuggugaacuaugugaagacacaauuacauauaaaugcccacuccucagacaaaacgaaccugaagacauugauuguugguguaauuccacuucuacauggguuaccuacgggacauguacuaccacuggggaacaucgcagagaaaaacgcucuguggcuuuaguaccucauguuggaaugggauuagaaacacggacagaaacauggaugucuagugaaggagccuggaaacaugcucaacgcauagaaacuuggauauuacggcauccaggauucacgauuauggcugcaauauuagcguauacaauuggaacuacacauuuccaaagaguucuuauuuuuauccuacuaacagcaguagcacccucaaugacgaugcggugcauugguauaucaaauagagacuuuguagaaggaguaagcggagguucuuggguggauauagucuuagaacauggaagcugugucaccacuauggccaaaaauaaaccuacacuugacuuugaacuuauaaaaaccgaagcuaaacaaccugcaaccuuaaggaaauacuguauugaagcaaaauuaacaaacacaacgaccgaaucacgguguccaacgcaaggcgaaccauccuuaaaagaggagcaagauaaaagguuugucugcaaacauagcaugguugauagagguuggggaaauggaugugguuuauucgggaaaggagggauagucacaugcgcuauguuuaccuguaagaaaaacauggaagguaaaauuguucaacccgaaaaccuugaauauacaauaguuguaacaccucacagcggugaagaacacgcagugggaaaugauacgggaaaacauggaaaagaaauaaaaguaacaccccaaagcucaauuacagaagccgaacugaccggauacgguaccguuacgauggaaugcucaccgagaacuggucuagauuucaaugaaaugguauuauuacaaaugaaaaauaaggcuuggcuugugcauaggcaaugguuuuuggacuuaccacucccauggcuaccaggagcagauaaacaagagagcaacuggauccaaaaagaaacucucguaacguucaaaaauccccaugccaagaaacaagauguaguugugcuugguagucaagaaggagcaaugcauaccgccuuaacaggagcuaccgaaauacaaaugucuucgggaaaccucuuauuuacuggccaccuuaaauguagacugcguauggauaaauugcaacuaaaagguaugaguuauucgaugugcaccgggaaauuuaaagugguaaaagaaauagcugaaacucaacauggaacuauagucaucagaguacaauacgagggcgauggcaguccuuguaaaaucccguuugagauuauggaucuagagaaacguuauguacucggaagacuaauuaccguaaauccgauaguaacugaaaaagacucuccgguuaacauugaagcagagccucccuucggcgauagcuauauaauaauaggcguagaaccaggacaacuuaaacuuaacugguucaagaaagggaguaguaucggccaaauguucgagacaacuaugcguggcgcaaaacggauggcuauacuaggugauacugcaugggacuuugguagucuugggggaguguuuacgagcauuggaaaggcacugcaucaaguauucggagcaauauauggugcggcguuuucgggcgucucuuggaccaugaaaauauuaauuggagucaucaucacuuggauuggaaugaacaguagaaguacaucacuuuccguaucgcucguacuuguuggaauugucacuuuauaucuugguguaaugguacaggcagauucuggauguguaguaucauggaaaaauaaagaacuaaaaugugguucaggaauauucauaacagauaauguucacaccuggacugagcaguauaaguuccagccugaaucaccaaguaaguuggcgagcgccauccaaaaagcacaagaagagggaauuugcgggauccgaagugucacucggcucgaaaauuuaauguggaagcaaauaacaccagaauugaaccauaucuuggcugaaaaugaaguaaaacugaccauaaugacuggugauauaaaggguauaaugcaggcaggaaaaagaagucuaagaccgcaaccuacggaauuaaaauacaguuggaaaacaugggggaaagccaaaaugcuaucgaccgaaucguacaaucaaacauuucuuauugacggaccagaaacuacugaauguccuaacacaaacagagcguggaauagucuggaaguugaggacuacggauuuggagucuuuacaacaaauauuugguuaaaguuaaaggaaaaacaggaugcuuuuugugauucaaaauugaugucugcugcaauuaaagacaauagggcaguccacgcugauaugggcuacuggauagaaucugccuuaaacgauacauggaaaauagaaaaggcaucauuuaucgaagucaaaaauugccauuggccaaagagccauacccucuggucaaaugguguacuagaaagcgaaaugauaauacccaaaaaucuugcuggaccagucagucagcauaauuaccgcccgggguaccacacccaaaucgcgggacccuggcaccucgguaaauuagaaauggauuuugauuuuugcgacggaacaacaguuauuguaaccgaggacugcggcaacagggggccauccuuacgaacuaccacagcaaguggcaaauuaauaacagaaugguguugucguaguuguacccuaccgccauuacguuaucgaggugaagacggauguugguaugguauggaaauaagaccguugaaggaaaaagaagaaaauuuaguaaauucauugguaaccgcaggucauggccaaguugacaauuuuuccuuggggguuuuggggauggcauuguuucuggaagaaaugcugcguacuaggguugggacaaaacaugccauucuacuggugacaguuucuuuuguuacccuaauaaccgguaauauguccuucaaagauuuagggcguguuguggucauggucggagcgacuauggcagacgauauuggaaugggaguaacuuacuuagcacuacuagcugcguucaaggucagacccaccuuugcagcugguuugcucuuaagaaaacuaaccaguaaagagcucaugaugacaacuauaggaauaguacuucuaucacaaucaacaauaccugagacuguauuagaacuuaccgacgcccuggcucuaggaaugaugguacuuaaaaucgugagaaauauggaaaaauaucaacuugcaguaacuaucauggcaauacuauguguuccaaacgcaguuauucuacagaaugcauggaaaguaucaugcacuauucucgccgucguuucagugucaccauugcucuugacaucaucacagcagaaaacugacuggauaccguuagcacuuaccauaaagggcuuaaacccgacagcaaucuuuuuaaccacacugucccgaacuaauaagaaacguucauggccuuugaaugaagccauaauggcuguuggaauggucucgauauuagcuucuagccuucuuaagaacgauaucccuaugacuggaccucuagucgccggcggcuuacuaacgguuugcuauguacucacuggucgaagcgcagaccuagagcuugaaagagcaacugaugucaaaugggaagaucaagcagagauuuccggaucaucccccauacuuagcauaacuaucucagaagacggaagcaugaguaucaaaaaugaagaagaagaacaaacauuaacgaucuugauuagaacuggacuccuagugaucagcggucuguuuccaauaaguauuccgauuacagcagcagcuugguaucuuugggaagucaagaaacaaagagcuggaguuuugugggauguacccucgccaccaccgaugggcaaagcagaguuagaggauggugcuuaucguauaaagcagaagggcaucuugggcuacucacaaauaggagcuggcguguacaaagaaggaacauuucacacuauguggcacguuacgcgcggagcaguucuaaugcacaaagggaaaagaauagagccaaguugggcggauguuaagaaagaucuuaucaguuauggcggcgguuggaaacuugagggcgaauggaaagagggugaagaaguucaaguucuagcucuggaacccgggaagaauccuagagccguccagaccaagccgggucuguuuaagacaaacaccgguacgauuggagcggugucacuggacuuuagcccggggacgucuggaucaccaauaauugacaagaagggcaaaguuguugggcucuacggaaauggaguagugacaagaaguggagcauauguaagugcaauagcgcaaaccgaaaaaucuauagaggauaacccugaaaucgaagaugauaucuucaggaaaaggcguuugacaaucauggaucugcacccuggggcagggaaaacaaaacgcuauuuaccagcgauuguaagagaggccauaaaaaggggacuaagaacauugauauuagcgccaacacgugucguagcagcggaaauggaggaggcccuacgaggacuuccuaucagauaucaaacacccgcuauacgagcagaacacacaggucgcgaaauaguggaucuaaugugccaugcaacuuucacaaugaggcuguuaucaccagugagaguaccaaacuacaauuugauaauaauggacgaagcucauuucacagauccagcaagcauugccgcaagaggguauauauccaccagaguggaaaugggagaagcugccggaauuuuuaugacagcuacaccgccaggaagcagagauccuuucccucagaguaacgcaccgaucauagaugaggaaagagagauccccgagcgcaguuggaacucaggucacgagugggucacagauuuuaaaggcaaaacagugugguucguaccauccauaaaagcaggaaacgauauugcagcgugucuaagaaagaaugguaaaaagguaauacaguuaagcagaaagaccuuugauagcgaauauguaaaaaccagaaccaaugacugggauuuuguuguaacaacagacauauccgaaaugggcgccaauuucaaggcugaaagagucauugaucccagaagauguaugaaaccaguuauccuaacagacggagaagaaagagugauucuggcuggucccaugccuguaacucauagcagcgcagcacagcgcagaggccgaauagguaggaaccccaagaaugaaaacgaccaauauauauauaugggcgaaccauuagagaacgacgaagacugugcacacuggaaagaagcaaaaauguugcuggacaauauaaauacaccagaaggcaucauaccuaguauguuugagcccgaaagagaaaaagucgaugccauugauggagaauauagauuaaggggagaagcacguaaaaccuuuguugauuuaaugcgucgaggggaccuaccuguauggcuagccuauaaagucgcugcagagggaauaaacuacgcagauagacgaugguguuuugacggaaucaagaauaaccagauccuagaggaaaauguagagguugagaucuggacaaaggaaggcgagaggaagaaauuaaagcccagauggcuagaugcaagaauuuacucugacccacuugcccuaaaagaguucaaagaauuugcggcaggacgcaaaucacucacauuaaaucuaauaacggaaaugggacgacuaccaacguuuaugacgcagaaaaccagagacgcauuagauaaccuggcgguauuacauacggccgaagcagggggucgggcauauaaucacgcucugagugaacugccugaaacguuggaaacccuuuuacuacuaacucuacuagcaacugucacuggagguauuuuucuguucuuaaugaguggucgcggcauagguaaaaugaccuugggcauguguuguauuaucaccgccucuauauuauuaugguacgcucaaauucaaccacacuggauugcagcaaguauaauccuagaguucuuuuugauaguccuacuaauuccggaaccugaaaagcagcguacaccccaggauaaccaauuaacuuauguagugaucgccauucuaacaguuguagcagcaacgauggccaaugaaaugggauuucuagagaaaacgaaaaaggaucugggguuagggucaauagcuacacaacaaccagaauccaacauucuagauaucgaccuacguccagcuucggcuuggaccuuguaugcaguugcaacaacguucguaacgccgauguugagacauucgauagaaaauuccucagucaauguaagucuaacagcaauagcaaaccaggcgacaguucuaaugggauugggaaaaggguggccguugucgaaaauggauauaggggucccuuuauuggcaauaggguguuacucccaaguaaauccaaucacucuaacugccgcucuacuacuucuaguagcacacuaugcaauaaucgguccaggguuacaagcaaaggcaacaagagaagcgcagaaaagagcagcugcggguauaaugaaaaacccaacaguagauggaauuacuguuauagacuuagacccaauuccuuacgaccccaaauuugaaaaacaacugggacaggucaugcuucuuauacuuuguguaacacagguccucaugaugcgaacaacuugggcguuaugcgaggcuuugacauuggcgacgggcccaauuaguacuuugugggaggguaacccgggaagauuuuggaauacaacuauugcaguaaguauggcaaauauauuuagagguaguuaccuagcaggagccggacuccuauucaguauaaugaaaaauacuacaaauacgaggagaggaacugggaauauuggagaaacgcuuggagaaaaauggaaaagucguuuaaacgcauuagguaaauccgaauuucagauauauaagaaauccgggauucaagaaguagaccgaacucuagcaaaagaaggcauaaaacgcggagagacagaucaccaugcuguaaguaggggguccgccaaacuucguugguucguugagaggaauaugguaacuccggaaggaaaaguuguagaccuuggcugugggcgagguggcuggaguuacuacugugggggcuugaaaaauguuagggaaguuaaaggacuaacgaaaggagggccggggcaugaagaacccauaccuaugaguacauauggcuggaauuuaguuaggcuacagucuggaguagaugucuucuucauaccgccugagaaaugugacacauuacuaugugauaucggugaaucaucaccaaacccaaccguugaggccgguagaacuuuaaggguacuaaaucuaguggaaaacugguuaaauaauaauacucaauuuuguauaaaaguuuuaaaucccuacaugccuucagucauugaaaagauggaggcccuucaaagaaaauaugggggagcucuagugagaaacccacuuagcaggaacucaacacacgaaauguacuggguaaguaaugcaagcgguaauauaguaaguucuguaaacaugaucucaagaauguuaaucaauagauucacaaugcgccacaagaaggcaaccuaugaaccugauguugauuuaggcucaggaacccgcaauauuggcauagaaucggaaauaccuaauuuagauauaauagggaaaaggauugagaaaauuaaacaagaacaugagacaaguuggcacuaugaucaagaucauccuuauaaaacuugggccuaucaugguagcuacgaaacuaagcagacaggaucagcaucuucgauggugaaugggguagugagguugcuaacaaaaccuugggacgugcuuccaacaguaacgcaaauggcuaugacagacacuacuccguucggucaacagagaguauucaaagaaaaaguagauacacgaacccaagaaccaaaggagggaaccaagaaacuuaugaaaauaacugcagaauggcuuuggaaagaauuagguaaaaagaaaacaccgaggauguguacacgagaagaauuuacaagaaaaguuaggucaaaugcggcauuaggugcgaucuucacggaugaaaauaaauggaaaagcgcacgggaagcuguugaagacucacgauuuugggaauuaguagacaaagagcggaauuuacaccuggaaggcaagugugagaccugcguauacaacaugaugggcaaaagggaaaagaaacuaggcgaguucggaaaagccaaaggaagcagagcuauaugguauaugugguuaggcgcgagauuuuuagaauuugaagcgcuaggauuucucaacgaggaucauugguuuagcagggaaaacucauuauccgggguagagggugaaggauuacauaaguugggauacauauuacgagauguuucgaagaaagaaggcggugcaauguaugcagacgauaccgcaggaugggauaccagaauaacacuugaagaucucaaaaaugaagaaauggucaccaaccauauggaaggugaacacaagaaguuagcugaggccauauucaagcucaccuaucaaaacaaaguugugcgcgugcagcgaccaacuccuagaggaacgguuauggauauaauaucaagaagagaucaaaggggcuccggacaaguggguacauacgguuugaauacauuuacaaauauggaggcacaguuaauucgacagauggaaggagaagggguguuuaaaaauauucagcacuugaccguuaccgaagaaguagcaguccagaauuggcuagcaaggguuggacgagaaagauuaagcaggauggcaauaagcggugacgauuguguaguuaagccgcucgaugaucgguucgcgaacgccuugacagcucuaaaugauaugggaaaaauccgaaaagauauacaacagugggagcccagcaaaggauggaaugacuggacucaagugcccuuuugcucccaucacuuccaugagcucauaaugaaggauggucggguuuugguuguaccaugcagaaaucaagaugaauuaaucggacgcgcucggauuucgcagggggcgggguggagccuacgugaaacagcauguuuaggaaaaucguacgcccagauguggagccugauguauuuccaucgaagagaccugagacuagcagcgaacgcuauaugcucugcaguacccucucacugggucccaacuucaagaaccacauggagcauacacgcaaaacaugaauggaugacgacugaagacaugcucacgguuuggaauagggucuggauaagagacaauccauggauggaagauaaaacuccagucgaaaguugggaggagauuccauaucuagguaaaagggaggaucaauggugcgggucuuugaucgggcuaacaucgcgagcaacaugggccaagaacauacaagcugcaaucaaucagguaaggagcuuaaugggaaacgaagaauacacagauuauaugccaaguaugaagagguuucgaagagaagaggaagaagcaggcgugcuuugguaa

SEQ ID NO: 22727 - RNA, 9876 nt, Artificial Sequence
  derived and/or modified CDS sequence (opt6) from DENV-2__EU482644__SS-prME
ucagcggguaugauaauuauguuaauaccaacuguaauggcauuucauuuaacuacaaggaacggugaaccccacaugauaguagguauccaagaaaaaggaaaaucauuacucuucaaaaccgaagacggcgugaauauguguacuuugauggcuauggauuuaggcgaacuaugugaagauaccauuacguauaaauguccucuacuucgucaaaaugaaccugaagacaucgauuguugguguaauaguacuagcacauggguaacguaugguacuuguacgacuacaggcgaacaucgcagagagaaaagaucuguggcucucguaccgcacguagguaugggccuugaaacacgaacugaaacauggaugagcucugaaggagcuuggaaacaugcacaaagaauagaaaccuggauauuacggcauccgggguuuacuauuauggcagcuauacuagcauauacgauugguacaacccacuuccaaagggugcucauauuuauauuauuaacugcuguagcaccaucaaugacuaugcgauguauaggaauaucuaaccgagauuucgucgaaggcguaaguggcggcucuuggguagauauaguacuugaacacggcuccuguguuacuacgauggcuaaaaacaaacccacccuggacuucgaacuuauaaaaacagaagcuaaacaacccgcuacauugagaaaauauuguaucgaagcaaaacucacaaacaccacaacagaaucucgauguccuacacaaggugaaccaucauugaaggaagaacaagauaaaagauuuguauguaaacauucaaugguugauagagguugggguaacggaugcggacucuucgguaaaggagguauaguuacuugugccauguuuacauguaagaaaaauauggaaggcaagauagugcaaccagaaaaucuugaauauacuauaguagucacaccgcauagcggagaagaacaugcgguugguaacgacacagguaaacauggacaagaaauaaaaguuacuccacaaaguucaauaacggaagcagaacuuacuggauauggaacuguuaccauggaaugcagccccagaacugggcuagacuuuaaugaaaugguacucuuacaaauggagaauaaagcaugguuaguccauaggcagugguuccucgauuuaccgcuaccauggcuaccuggagcugacaaacaagaaucaaacuggauacaaaaagaaacccucguaacuuuuaaaaacccgcacgccaagaaacaggauguuguuguuuugggaucacaagaaggugcuaugcacacugccuuaacaggagcaaccgaaauacagaugaguucugggaaccuauuguucacaggccauuuaaaauguagguugcguauggacaaguugcagcugaaaggcaugucguauaguauguguacuggcaaguuuaaaguaguaaaagaaauagccgagacgcaacaugguacaauaguuaucagaguacaauacgaaggagauggauccccuugcaaaaucccguuugaaauuauggaucuggagaaaagguauguucuaggacgacugauaacaguuaauccuauuguuacggagaaagauagcccagucaauauugaagcugaaccuccauucggcgacagcuacauuauaauagguguagaaccaggucaacugaaauuaaauugguucaagaaagggucuaguauaggucagauguuugaaacaacaaugcgcggagcgaaaagaauggcuauccuuggagacacugccugggauuucggaucgcuuggaggaguuuucacaaguauaggaaaggcuuuacaccaaguauuuggggcaauauauggcgccgcuuuuucuggagugucuuggacaaugaaaauucuaauuggcguaauaauaacuuggauaggaaugaauagcaggucuacaagccuaucugucucuuuaguuuuaguuggaauaguaacauuauaucuaggcguaaugguccaggcugauucaggguguguaguaagcuggaagaacaaggaacugaaauguggaucgggcaucuuuauuacugauaacguucacacauggacggagcaauauaaauuucaaccugaaucaccaaguaaguuagccagugcaauccaaaaagcacaagaagagggaauauguggaauacguaguguuacacggcucgaaaauuuaauguggaaacaaauuacaccagagcuaaaucacauccuagcagaaaaugagguaaaauuaacuauaaugaccggugauauuaaagggauuaugcaagcuggaaagaggucgcugagaccucaaccuacagaauugaaauauucuuggaaaacauggggaaaggcaaagauguuaucaaccgagaguuacaaccaaacauucuuaaucgaugguccggaaacagcagagugcccuaauacaaaucgcgcauggaacucucuagagguagaagauuacggauucggaguuuuuacuacaaacauaugguugaaauuaaaagagaaacaggacgcguucugugacagcaaacuaaugucugccgcgauaaaggauaacagggcaguacaugccgacauggguuauuggauagaauccgcacucaacgauacuuggaaaauagagaaggcuucuuuuaucgaagugaaaaauugccacuggcccaaaagucacacgcuaugguccaacggagugcuagaaucugaaaugaucauacccaaaaaucuagcuggaccaguuucccaacauaauuaucguccggguuaucacacacaaauagcugggccauggcauuuagggaaacuugaaauggacuuugacuuuugcgauggaacaacugugaucguuacugaggacuguggaaauagagggcccagcuuaaggaccacaacagcgucaggcaaauuaauaacggaaugguguugcagaaguuguacuuuaccuccacuccguuacagaggagaagacggaugcugguacggaauggagauuaggcccuuaaaagaaaaagaagaaaauuuaguuaauagccuaguaacagcagggcauggucaaguugacaacuuuucccuuggagucuuggguauggcacuguuucuagaggaaauguugagaacacgaguagguaccaaacacgcaauucuauuaguugccguuucauuugucacauuaauuacuggcaacaugucauucaaagauuuagguaggguuguagugaugguuggcgcaacuauggcagacgauauaggaacaggggucacuuaccuagcuuugcucgcugcauucaagguuagaccaacuuucgcagcuggauuacuucugagaaaacuaaccucaaaagagcuaaugaugaccacgaucgguauuguccuguuaucgcaaaguacgauaccggaaacaguucuagaacucacggacgcccuggcucucgguaugaugguacuaaaaaucgucagaaauauggagaaguaucaguuggcaguaacgaucaugacuauacucugcgucccaaaugccgucauuuuacaaaaugcauggaaggugucgugcacaauacuagcuguaguaagcguuagcccacuuuuacuaaccucgucucagcagaaaacugauuggauaccacuugcucugacuaucaaaggccuaaaccccacagcaauauuuuugacaacgcucucgcgaaccaacaagaagaggagcuggccacuuaaugaagcuauaauggcaguuggaauggugucaauauuagcaagcucacuucuaaagaacgauauaccaaugacaggaccucugguggcuggaggauugcucacagucugcuauguauuaacggggcggucugcugaccuagagcuugagagagcaacggacguaaaaugggaagaccaagcagaaauuucgggaaguagucccauuuuaagcauuacgauaagugaagacggcucaaugagcaucaaaaacgaagaagaggaacaaacacuuaccauuuuaauacgaacuggucuucuagucauuucaggucuauucccuauaucgauaccgauaaccgcggcggccugguaucuuugggaagucaagaaacagcgugcgggaguacuuugggacguaccuucaccgccuccuauggguaaagcugagcuggaggacggcgcauauaggauaaaacagaaaggaauacucggcuauucccagauuggagcugguguuuauaaagaagguaccuuccauacgauguggcauguaacaagaggggcaguuuuaaugcauaaaggaaaacgaauagaaccuuccugggcagauguaaagaaagauuuaauaaguuauggagguggcuggaagcucgaaggagaguggaaagaaggagaggaagugcaaguucuugcauuagaacccgguaagaacccacgagcaguacaaaccaaaccuggacucuuuaagacaaauacagguacuauuggggcagugagucucgauuuuucaccaggaacauccgguagucccaucauagauaaaaagggaaaagucgucggucuauauggaaacgguguuguaacgcggagcggugcguacguaucagcaaucgcucaaacugagaagucgauagaggauaaccccgaaauagaagacgacaucuuccguaaaagaagauugacuauaauggaccugcauccaggugcagggaaaacaaaacgauauuuaccagcgauuguccgugaagcaaucaaacguggacuccgaacauuaauacuagcgccgacgcgaguaguagcagcggaaauggaagaagcacuucggggcuuaccgauucgguaucaaacccccgcuauuagagcugaacauacgggacgugagaucguagaccuuaugugucaugcaacauuuacuaugaggcuauuaucaccagugagggucccaaauuacaaucugaucaucauggaugaagcacacuucacagauccggcaucuaucgccgcgagaggauacauaagcacaagaguagaaaugggggaggccgcagguauauuuaugaccgcaacuccgccggguucacgagaucccuuuccgcaaaguaaugccccaauaauugacgaggagagagagauuccggagagauccuggaacucuggacaugaauggguaacggacuucaaaggaaagacugugugguuuguuccaucaaucaaagcggguaaugacauagccgcuugucugagaaagaauggcaagaaagugauacaauugucaagaaagaccuuugacagugaauauguuaagacacgaacaaaugacugggacuuuguaguaacaacugacauaagcgaaaugggagcaaauuuuaaggcugaacgcguuauagacccaaggagauguaugaaaccaguaauauuaacugauggcgaggagaggguaauauuggcggguccaaugcccguaacacacucaagcgccgcccaacguagagguagaauuggaagaaaucccaaaaacgaaaaugaucaguacaucuauaugggugaacccuuagaaaaugaugaggauugcgcgcacuggaaagaagcuaaaauguuacuagacaacauuaauacaccagaagggauuauuccaucaauguucgaaccugaacgagaaaaaguugacgcgauagauggugaauacagacuuaggggagaagcccguaaaaccuucguagaccuaaugagaagaggcgaccugccaguuuggcucgcuuauaaaguugccgcugaaggaaucaacuaugcagaccguaggugguguuucgacgggaucaaaaauaaucaaauacuagaagaaaacguugaaguugaaauauggacuaaagaaggggaacguaaaaagcugaagcccaggugguuagaugcaagaauauauagugauccgcucgcacugaaggaauuuaaggaauuugcugccgguaggaaaucuuuaacuuuaaaccucauaacagaaaugggcagacugcccacguucaugacucagaaaacuagagacgccuuagacaaccuagcuguacuucacacagcagaagccgguggucgagcauauaaccacgcguuaagcgaacuacccgaaacacuggaaacccuauuacuucuaacucuacuagcaacagugacaggcgguaucuuucuauuuuugaugucagguagagggaucgggaaaaugacuuuaggaaugugcugcauuauaaccgcuagcauauugcuuugguacgcucaaauacaaccucauuggaucgcagcaucuauaaucuuagaguucuuuuugauaguuuuauugauccccgaacccgaaaaacaaagaacaccgcaggacaaucaacucacauacguggucaucgccauacucacaguuguugcagccacuauggcaaacgaaaugggauuuuuagagaaaacuaagaaagaucucgggcugggaucuauagcaacucaacagccugaaagcaauauccucgauauagaucuuaggcccgcgagugcuuggaccuuauacgcuguugcaacuacuuucgugacaccuaugcuacgucacuccauagaaaauaguucagucaaugugaguuuaacggcaauagcuaaucaagcaacaguucuaauggguuugggaaaggguuggccguugagcaagauggauauuggaguuccguuacuagcaauagguuguuauagucaggucaacccaauaacccuaacugccgcccuccuauuacucguagcccauuaugcgauaaucggccccggacuacaagccaaagcaacuagggaagcccaaaagcgugcagcggcagguauuaugaaaaauccaacaguugaugguauuacagucauagaucuggacccuauaccauaugacccuaaauucgaaaaacaauuaggccaaguaauguuauugauacuaugugucacucagguuuuaaugaugcgaacaacaugggcgcuaugugaagcgcuuacgcuagcuacagggccgauuagcacacugugggaagguaacccuggacgcuuuuggaacacaacgauagcagucucuauggcuaauauauuuagaggaaguuacuuggccggggcagggcuacuauuuucaauuaugaaaaauacaacaaauacacgaagaggcacuggaaacaugggugaaacacuaggugaaaaauggaaaucucgcuuaaaugcacucggaaaaagugaguuucagauauauaagaaauccgguauacaagaaguagaucgcacacuagcaaaagaagggauaaaacggggugaaacggaccaucaugccgucuccaggggcucagcuaaauugagaugguucguugagcgaaacaugguaacaccugagggcaaaguaguugaucuggguuguggaagaggaggguggagcuauuauuguggcgguuugaaaaauguacgagaagucaaaggacuaacaaaagguggacccgggcaugaagaaccaauaccgaugagcaccuauggauggaaucuuguccguuuacaaagcggagucgaugucuucuuuaucccucccgaaaaaugcgauaccuuacuaugcgacauaggagaaaguucucccaacccuacuguagaagcuggccguacccuucguguguuaaaucuaguggaaaacugguuaaauaauaacacacaauucuguauaaaaguacuuaacccuuauaugccgucugugauagagaaaauggaagcguuacaacgaaaauauggaggagcccuugugagaaauccuuuaucaaggaacaguacacaugaaauguauuggguuucaaaugcuagugguaauauugucaguaguguaaauaugaucagcaggauguuaauuaaucgauucacgaugagacauaaaaaggccacguaugagccagauguugauuuggggucggggacacgaaauauaggcauugaaucagagauaccuaacuuagauauuauugggaaaaggauagagaaaauuaagcaggaacacgaaacaaguuggcauuaugaccaagaucauccuuauaaaacaugggcguaucauggauccuacgaaacuaaacaaaccggaagugccaguucuauggucaacgggguaguaagguuacucacaaaaccaugggacguguuaccaacugucacccaaauggccaugaccgacacaaccccguuuggccaacaaagaguuuuuaaagaaaaaguggauacgcgcacucaagaaccaaaggaaggaacuaagaaacuaaugaaaauaaccgccgaauggcucuggaaagaauuggguaaaaagaagaccccaagaaugugcacucgagaagaguucaccagaaaaguccggucuaaugcagcacuaggggcaauauuuacagaugaaaacaaauggaagucagcuagagaagcuguugaagauagccguuuuugggaauuaguagauaaagagagaaaucuccaucucgaagguaaaugcgaaacauguguauauaacaugauggguaaacgagagaagaaauugggugaguuuggaaaagcaaaaggcuccagagcgauaugguacauguggcuaggugcaagguuccuagaauuugaggcccuuggcuucuugaacgaagaucacugguuuucucgagaaaauucgcuuuccgguguagaaggagaagggcuucauaaacucggauauauucuuagagaugugaguaagaaagagggaggugcuauguaugcagacgauacagcgggaugggacaccagaaucacuuuggaagauuuaaagaacgaggaaauggucacuaaccauauggaaggggaacauaagaaacuagcugaggcgauauucaaacuuacuuaccaaaauaaaguaguuagaguucagcguccaacaccaaggggcacagugauggauauaaucucuagaagagaucagaggggcucugggcaagugggaacuuauggauuaaacaccuuuaccaauauggaggcacagcuaauccggcaaauggagggugagggagucuucaaaaauauacaacaccuuacaguuacugaggaaguggcaguacaaaacugguuagccagaguaggacgggaaagacuuucaagaauggcgauuucaggggacgauugugugguuaagccauuggaugacagauuugcgaaugcauuaacagcauugaacgacaugggaaaaauacguaaggacauccaacaaugggaaccaucaaaaggguggaaugauuggacacagguaccuuuuugcagucaccauuuccacgaacuaauaaugaaggacgguaggguucuuguaguaccaugccguaaucaagaugaauuaauuggccgugcaagaauaagucaaggugccggauggucacuccgagagacugcgugccugggaaaaucauaugcgcaaauguggucccuaauguauuuccaucgucgugaccuuagauuggcugcuaaugcaauaugcagcgccgugcccagccauuggguaccaacaagcagaacaaccugguccauacaugcaaaacaugaguggaugacaacggaagauaugcugacaguauggaauagagucuggauuagagaaaaucccuggauggaagauaagacgccaguagaaucuugggaagaaaucccuuacuuggguaaaagggaagaucagugguguggaucacugauaggguugacuucgagagcuacaugggcuaaaaauauccaagccgccauaaaccaaguaaggagccuaaucggcaacgaagaauacacagauuacaugccaucaaugaaaagauucagacgagaagaggaagaagcaggcguguuaugguaa

SEQ ID NO: 22728 - RNA, 9876 nt, Artificial Sequence
  derived and/or modified CDS sequence (opt6) from DENV-2__EU482645__SS-prME
agcgcgggaaugauuauaaugcucaucccuacgguaauggcguuucaccuaacgacucgaaauggggagccacacaugauaguuggaauacaggaaaaagguaaaucgcuccuauuuaaaacagaggaugggguuaauauguguacuuuaauggcaauggaccuaggagaauuaugugaagacacuauaaccuacaaauguccccuacuacggcaaaacgagccagaggauauagauugcugguguaacucuacaucgacaugggugacguaugguacaugcacaacgacuggcgaacaucggagagagaaaagaucuguugcuuuagugccacaugucgggaugggauuggagacgcgaaccgaaacauggaugaguuccgaaggagccuggaaacaugcgcaaagaaucgagacauggauucugagacacccaggauucaccaucauggccgcuauacuagcguauaccauugggacaacucacuuccagaagguacucauauucauauuauuaacugcaguggccccuaguaugaccaugagaugcaucgguauauccaaucgagacuucguagaaggcgugucaggaggaucguggguagauaucguacuggagcacggaucgugcguaacaacaauggcaaaaaauaaaccgacuuuagauuuugaguuaauuaaaacagaagcaaaacaaccggcgacguuacgaaaauacuguauagaagcuaaauuaacgaacacaaccacggaaucacggugcccuacgcaaggagagccuagcuugaaagaagaacaagauaagcgcuuuguuuguaaacacucaaugguugaccgaggaugggguaaugguugcggacuauucggcaagggaggcauuguaacaugcgcaauguucacguguaaaaaaaacauggagggaaagauugugcaaccugaaaaucucgaauacacuaucguuguuaccccccauucaggagaagaacaugcaguaggcaacgacacugguaaacaugggcaagaaauuaaaguaacuccccaaagcucaaucacagaggcagaacucacuggauauggcaccguaacaauggagugcagcccuagaacugggcuggacuuuaaugaaaugguauuauuacaaauggaaaauaaggcuuggcuugugcauagacagugguucuuagauuugccacugccauggcuacccggagcugauaagcaagagaguaacuggauucaaaaggaaacacucguaacauuuaaaaauccccaugcaaaaaagcaagaugucgucguccuaggcucacaggaaggagcgaugcauacagcauuaacgggggcuacugaaauacaaaugucguccggaaauuuacuauucacaggucaucuuaaaugcaggcugagaauggacaaacuucaacucaaaggaaugucuuauaguauguguacuggaaaauuuaagguaguaaaagaaaucgcagagacucaacauggcacaauuguaauacgcguccaauacgaaggggaugguaguccuuguaaaauccccuuugaaauaauggacuuagaaaaaagauaugugcuaggacgcuuaauuacaguuaacccaauuguaaccgagaaagacaguccagucaauauagaagcagaacccccauuuggagauaguuauauaauuauaggcguagagccaggacaauuaaaacuaaauugguuuaaaaaaggaagcaguauuggccaaauguucgaaacgacuaugaggggagcgaagagaauggcaauacucggugauacggcgugggauuuuggaagccuagguggcguauuuacaaguaucggaaaggcauuacaccaaguauuuggugcuauauauggugcagcauucaguggcguaucauggaccaugaaaauacuaaucggcgugauaauuacguggauagggaugaauucacgaaguacaucucugagcgucagccuaguacucguagggauuguuacccuguauuugggugugaugguccaggcagacagcgguugcguagugucguggaaaaauaaagaacucaaauguggauccgguaucuuuauuacagacaacgugcauacguggacagagcaauauaaguuccagccggagucuccuaguaaguuagcaagugcaauccaaaaagcccaggaagaagguauaugcgguauuagaaguguaacgagauuagaaaaucucauguggaagcaaauaacaccggaacugaaccauauccuagccgaaaaugaaguuaaauuaacgauaaugacaggcgacauaaaaggcauaaugcaagcagguaaaagaagucugcgaccacagccaacugaauuaaaauauucguggaaaacauggggaaaagcuaaaaugcuguccacagaguccuauaaccaaacuuuuuuaauagauggacccgaaacagcggaauguccaaacaccaauagagcauggaauagucucgaaguggaagauuauggauuuggagucuucacgacgaauauauggcugaagcuaaaggagaaacaagaugcuuuuugcgacaguaaacuuaugucugcagcuauaaaagacaauagagcgguccaugccgauaugggguauuggauagaaucugcauugaaugauacuuggaaaaucgaaaaagcaucauucaucgagguaaaaaauugccacuggcccaaaagccauacuuuauggucaaauggaguguuggaaagugaaaugaucaucccaaaaaaucuagcaggaccagucucacaacauaauuacaggccuggcuaccauacacagauugcagguccauggcaucuuggcaaauuagaaauggacuuugauuucugugaugguacuacugucauagucacggaggauugcggaaacagaggcccgaguuuacguacaacaacagcgucagggaaacugauuacagaaugguguuguagaucguguacauugccgccacuaagauaucguggcgaagaugguugcugguauggaauggaaauaagaccuuugaaggaaaaagaagaaaaucuggugaauagccuuguuacugccggacacggacagguugacaacuucucucuaggagugcuagggauggcucuauuuuuagaagaaaugcuaagaacaaggguggguacaaagcaugcaaucuuacugguagcaguuucguucguaacacuuauaaccgguaacaugucguuuaaagauuuaggccggguaguggugaugguaggugcgacaauggcugacgacaucggaaccggugucacguauuuagcacuacucgcugccuuuaaagugagaccaaccuucgcugcaggucuauugcuaagaaaacuaacuucaaaagaauuaaugaugacuaccauuggcaucguuuugcuaagccaaucaacaauaccugagacaguucuggaacuuacggacgcacuggcacuugggaugaugguccuaaagauagugaggaauauggaaaaauaucaacuagcgguaaccauaaugacuauucuauguguaccaaacgcuguaauauuacaaaaugcauggaaaguaucauguacaauacuagcuguagucagugugucuccuuuguuacuaacuaguagccagcaaaaaacagacuggauaccucuagcacuuacaauuaaaggccuuaauccaacagcuauauuucuaacaaccuuaucaagaaccaacaagaaacgaucauggccguuaaacgaagcaauaauggcgguagguaugguaucgaucuuagcaucaaguuuacuuaaaaaugauauaccgaugacaggaccgcuuguggcagguggacuuuugaccguguguuacgugcugacgggacgaagugccgaucucgaguuagaaagagcgaccgaugucaaaugggaagaucaggccgaaauuucagggucgaguccaauauuaagcauaaccauaagcgaagauggcucaaugagcauuaaaaacgaagaagaagagcaaacucuuacaauacugauucgaacaggacuacuaguaauaagcggcuuguucccaauaucaaucccaauuacggcagcugccugguacuuaugggaaguaaagaaacagcgcgcagggguuuugugggacguaccaucaccuccuccaaugggaaaagcugaauuagaagauggagcguauagaauaaaacaaaagggaauauuaggauacucgcaaauaggagccggagucuacaaagaggguacguuccauacuauguggcauguuacaaggggcgccguuuuaaugcauaaggguaaacgaauagaacccucaugggcugauguuaaaaaagaucuaauaucauauggcggagguuggaagcuggaaggggaauggaaagagggagaagaaguacaagugcuagcacuugaacccgggaaaaaucccagagcuguucaaacaaaaccaggauuguuuaaaacaaauacagguacuauaggagcuguuagcuuagauuucuccccuggaacuagcggaucaccaaucauagacaaaaagggaaaaguuguugguuuauauggaaauggggucguuacuagaucaggagcauacguaucugcgauagcucaaacagaaaaguccauagaagauaauccagaaaucgaggaugacauuuucaggaaaagaagguuaaccauaauggauuuacauccaggggcaggcaaaacgaaacgguaucuccccgccauagugcgugaggccauaaaaaggggacuaagaacucuuauuuuagcaccuacgaggguuguugcagcggagauggaggaagcccucagaggacuaccaauaagauaccaaacaccagccauaagagccgaacauaccggacgcgaaauaguugacuuaaugugucaugcaacauuuacaaugcggcuauuaagcccuguaaggguuccuaauuauaaccuuaucauaauggaugaggcacacuuuaccgauccagcaaguauugcugcuaggggauauaucucaacucggguagagaugggggaagcagcaggaauuuucaugaccgcgacuccuccagguucaagagauccauucccucaaagcaaugcccccauaauugaugaagaaagagagaucccugagagaucauggaacuccggucacgaguggguaacggacuucaaagggaaaacaguaugguucgugccuagcauaaaggcgggaaaugauauagcagcaugucuucgaaaaaaugguaaaaaaguaauacaauuaucacgaaagacguucgauucagaguacguuaaaacucgaacgaacgacugggauuucguaguaacaacugauauaagcgaaaugggagcaaauuuuaaagcugagcgaguuauagacccaagacgcuguaugaagccaguaauauuaacagauggagaagaaaggguaauuuuagcaggucccaugccgguaacgcauagcagcgcagcucaacgaagaggaaggauaggacgcaacccgaagaaugaaaaugaucaguauauauauaugggugaaccgcuggaaaacgacgaagauugugcacacuggaaagaggcgaaaaugcugcuagacaacauuaauacuccagaaggaauaauuccgagcauguuugagccugagagggagaaaguagaugcgaucgauggugaauaccgacuucgaggggaagcaagaaagacguuuguugauuugaugagacguggugaucuaccaguaugguuagcuuacaaaguagcagcagaggguauuaauuacgcugauaggcgaugguguuucgauggaauaaaaaauaaccaaauucuagaagagaauguugagguggaaaucuggacaaaagaaggcgaacggaagaagcucaaaccuagauggcucgacgcaagaauauauucagacccucuagcauuaaaggaguucaaagaauucgcugcggguagaaagagccuaacuuuaaauuuaauaacugaaauggggagguuaccaacguuuaugacgcagaaaacucgugacgcauuagauaaucuagcugucuuacacacugcugaagcagguggcagagcauauaaccacgcauugagugaauuaccagaaacacuggaaacucuguuacucuuaacguuauuggcaacugucacuggugguauuuuccuauuuuuaaugucaggaagaggcauugguaaaaugacuuuaggcaugugcuguaucauuacagcaucaauauuacucugguacgcucaaauccaaccacauuggaucgcugccaguauaauucucgaauuuuuuuuaauagugcuacuaauuccagaaccagaaaaacagaggacaccacaagauaaccaacuaacauaugucguaaucgccauucugacaguaguugcugcaacuauggcgaaugaaaugggauuuuuggagaaaacaaagaaagauuuaggucugggaucaauugccacccaacaaccggaauccaauauacuagacauugaccuaagaccggcaucugcuuggacguuguaugcaguugccacuacauucgucacccccaugcuacgacauagcaucgaaaacucaagugugaaugucucccuaacagcgauagccaaucaagcuacaguacucaugggacugggcaaagguuggcccuugaguaagauggauauagguguaccacuauuagcgauuggauguuacagccaaguuaacccaauuacacucacagcggcuuuguuauuauuagucgcgcauuacgcaauaauaggacccggauugcaagcaaaggcuacgcgggaggcacaaaaacgggcagcugcagguauaaugaagaacccaaccgucgacggaauaacugucauugacuuggacccuauuccguaugauccaaaauucgagaaacaacucggacagguuaugcuucuuauauuaugcguuacgcagguccuuaugaugcguacaacaugggcacugugugaagcauuaacucucgcuacagguccaauaagcacccuaugggaagguaauccgggcagauuuuggaauacaacuauugcgguaaguauggcaaauauuuuuagggguaguuaccucgcaggagcaggacugcuauucucuauuaugaaaaacacaacuaauacaagaagaggaacuggaaauaugggagagacuuuaggugaaaaauggaagagcagguuaaaugcuuuaggcaaaucagaauuucaaauuuacaagaagucagguauacaggaaguagauagaacacuagcgaaagagggcaucaagagaggugaaacagaccaucaugcaguuucuagggggucagcaaaauuaagaugguuuguugagcguaauaugguaacacccgaagggaaagugguagauuuggguugcggucgcgggggcuggucuuauuacugcggaggguuaaaaaauguacgagaagucaaagggcuaacaaaaggugggccagggcaugaggaaccaauaccaaugucgacguacggauggaaccuaguacgauugcagucaggagucgauguauucuuuauuccgccagaaaagugugacacuuuauuaugugacauuggagaaucuagcccuaauccuacgguagaagcggggcgaacguuacgcguacuaaaucuuguagaaaauuggcuaaacaauaacacacaauucuguauuaagguccucaauccauauaugccuuccguuauagaaaaaauggaagccuuacagagaaaauacggcggagcacugguccgaaacccuuugaguaggaauaguacucaugaaauguauuggguaagcaacgcuucgggaaacauaguuucuuccguaaauaugauaagcaggaugcucauuaacagauuuaccaugcgacauaagaaagccaccuaugaacccgaugucgaccuaggaucagguacaaggaacauaggaauugaaucugaaauuccaaacuuagauaucauagguaagaggauugaaaaaauuaaacaagaacaugaaacgagcuggcacuaugaucaagaccaucccuauaagaccugggcauaucauggcucuuaugagaccaaacaaacggguucagcuucgaguaugguaaauggagugguuaggcuacuaacaaaaccuugggacguauuaccuacaguuacucaaauggccaugacagauaccacaccuuuuggucaacaaagaguauucaaagaaaaaguagauacuagaacgcaagaaccuaaagaaggaaccaaaaaauugaugaaaauaacggcagagugguuauggaaagaguuaggaaagaaaaaaacuccucguaugugcacccgggaagaauuuacuaggaaaguucgaucuaacgcagcccuaggagcaauuuucacagaugaaaauaaauggaagagugcgagggaggcaguagaagauagcagauuuugggaguugguugauaaagaaaggaaucuacaccuagaggggaaaugugaaacaugcguauauaauaugaugggcaagagagaaaaaaaacuaggagaguucggaaaagcgaaaggaagucgggccaucugguacauguggcuaggagcaagguuuuuagaauuugaagccuugggcuuucugaacgaggaucacugguuuagccgcgagaacucauuaagcggagucgaaggggaaggucuacacaaguuagguuauauucugagagauguaucaaagaaagaggggggcgcuauguaugcggaugauacugcggguugggauacuagaauaacuuuagaagaucuaaaaaaugaagaaauggugacgaaccacauggagggagaacauaagaagcucgcugaggcaauuuuuaaauugacguaccagaacaaaguuguucgaguucagcgaccaacaccgcgcggaacugugauggacaucauaucucguagagaccagcgagggucaggacaaguugguacguacggacuaaauacguucacaaauauggaagcacaacuuaucagacaaauggaaggagaagggguauucaaaaacauccaacaccuuacagugacugaagaaguggcuguacagaauuggcuagcacgugugggaagagagagguuaaguagaauggcgauuucgggcgaugauuguguaguuaaacccuuggaugauagauucgcaaacgcauugacugcacuuaacgauaugggaaagauuagaaaagauauccagcaaugggaaccuucaaagggcuggaaugauuggacucaaguacccuuuugcucacaucauuuucaugaauuaauuaugaaagacgggcgaguacucguagugccauguagaaaccaagacgagcuuauagguagggcaagaauaagucaaggagcugguuggagcuuacgagagacagcuugucuggggaaaaguuaugcucagauguggucauuaauguauuuucaccgucgugaucucagacucgcugcaaaugcaaucugcucugcggugccaagucauugggucccgacauccagaacaacuuggucaauacaugcaaaacaugaguggaugacaacggaagauauguuaacuguuuggaaucgaguauggauuagggagaacccuuggauggaggacaagacaccaguagagaguugggaggagauacccuacuuagggaagagagaggaucaguggugcggguccuuaauaggcuugacgaguagagcaacaugggcaaaaaauauacaagcagcaauaaaccaaguccgaucucucauugggaacgaggaauacacggauuauaugccaaguaugaagagauuucgucgcgaggaagaggaggcagggguccuuugguaa

SEQ ID NO: 22729 - RNA, 9876 nt, Artificial Sequence
  derived and/or modified CDS sequence (opt6) from DENV-2__EU482646__SS-prME
ucugcaggcaugauaauuauguugauaccgacuguuauggcguuucauuuaacuacaagaaauggugaaccucauaugauaguuggaauccaagaaaaaggaaaaaguuuacuauuuaaaacagaagacggcguuaauaugugcacauugauggcaauggacuuaggagaacuaugugaagauacaauuacauauaaauguccccuacuuaggcagaaugaaccggaagacaucgacugcuggugcaacagcacaucuacuuggguaacguacggaacaugcacuacaaccggagagcaucgaagggagaaacgaagcguagcucuuguuccgcauguuggcaugggcuuagaaacaagaacagaaacuuggauguccucagaaggugcauggaaacaugcacaaagaauagaaacauggauacuccgacaccccggauuuacaauaauggcggcuauccuugccuacacuauuggaaccacacauuuccaacgagugcuaauauuuaucuuacugacagcuguggcaccguccaugacgaugcguugcauaggcaucucuaaccgugauuucguagaaggcguaucgggagguucauggguugacaucguauuagaacauggaagcuguguuaccacaauggcuaaaaacaaacccacuuuggacuucgaguuaaucaaaaccgaagcaaaacaaccagccacucuaagaaaauauuguauagaggcaaaacugaccaauacaacuacagaaaguagaugcccgacgcagggugaaccuuccuugaaagaagaacaagauaagcgauuuaucuguaaacauagcaugguggacagaggcugggggaaugguugcggauuauuuggcaagggagggauagucacaugcgcaauguuuacaugcaagaaaaauauggaaggaaaaauaguucaaccagaaaaucuugaguacacaauuguagugacaccucauagcggcgaagaacacgcgguuggcaaugauacagggaaacauggaaaagaaauaaaaguaacuccccaaucauccauaacagaagcagaacuaaccgguuauggaacggugacuauggaaugcagcccacgaacaggauuagauuucaacgaaaugguguuacuacaaauggaaaauaaagcauggcuaguccauaggcagugguuccuugaccuuccuuuaccuuggcuacccggcgcagacaaacaagaaucuaauuggauacagaaagaaacucuagucacguucaaaaauccacaugcuaagaagcaagacgucguaguauuagguucacaagaaggggcgaugcauacugcacuaacuggugcuaccgaaauacaaaugagcuccgguaacuuauuauucacgggccauuuaaaauguagacuuagaauggauaaacuucagcuaaaagggaugucauacucaauguguaccgggaaauucaaaguagucaaagaaauagcagaaacgcaacaugggacaauagucauaagggugcaauacgagggagacggguccccuugcaaaauaccuuucgagauuauggaucuugaaaaacgauacguacuaggccguuuaaucacaguaaacccuaucguuacugaaaaggauucaccugucaauaucgaagcagaaccaccauuuggagauucguauauaauaauaggaguugaaccgggacaauuaaaacuaaauugguuuaagaaaggaaguucaauuggucaaauguucgaaaccacuaugagaggugcaaaaagaauggcuauacuaggagauaccgcuugggauuucggaucauuaggugggguguuuacuucaauaggaaaagcccuccaucaaguauuuggagccauuuauggggcagcauuuagcggagugagcuggaccaugaaaauccuuaucggaguaauuauaacauggauaggcaugaacucacgcaguacuucacuauccgugucauuaguuuuaguagguauugucacuuuguaucuuggaguaauggugcaagcugauucuggauguguugucucauggaagaauaaagaacuuaaaugcgggucggguauauuuauaacagacaauguccacaccuggacggaacaguauaaauuucagccagaaucuccuagcaaauuagcuucagcuauacaaaaagcucaagaggagggaaucuguggcauaagaucugugacgcgccuagaaaauuuaauguggaaacaaauuacacccgaauugaaucacauccuggccgaaaacgaaguaaaauuaacaauuaugacaggggacauuaaagggauaaugcaagccgggaaacgaucacuacgcccacagccaaccgaauuaaaguacucauggaaaaccuggggcaaagcaaaaaugcuuagcacagaaagcuauaaucagacguuucuuauagacgggccugaaacagcugagugcccuaauaccaaucgagcauggaacucguuagagguugaggauuauggauuuggaguguuuacuacgaauauuugguuaaaauuaaaagaaaaacaggacgcuuuuugcgauaguaaacugaugagcgcugccauaaaagauaaucgagcaguacacgcggauauggguuauuggaucgaguccgcauuaaaugauacguggaaaauugaaaaagccuccuuuauagaggucaaaaacugccauuggcccaaaucccacacucuauggaguaacggaguucuagaaucugaaaugauaauucccaaaaaucucgccggaccaguaagccagcacaauuaccguccuggguaccacacucagauugcagguccauggcauuugggaaaguuagaaauggacuuugacuuuugcgaugguacaacggucauaguuaccgaagauugugguaaccgcggacccagucucagaacaaccacugcuucaggaaaauugauaacagaaugguguugccguucuuguacccucccaccuuuacgauaucgaggagaagacggguguugguaugguauggaaauucggccauuaaaagaaaaagaagaaaacuugguuaacucgcucgugacggcuggucauggucaaguugacaacuuuuccuuaggggucuuaggcauggcuuuguuucuagaagagaugcucagaacgagaguuggcacaaaacaugcgauauugcucguagccgucucuuucguuacacucauaaccggaaauaugaguuuuaaggaucuagguagaguagugguaauggucggagcaacaauggcagacgauauagggaugggugugacuuauuuagcacuucuggcagcguuuaaggucagaccaacguuugcagcaggucuucuauuacgaaaauuaaccucaaaagaacuaaugaugacuacaauaggaauaguacuuuuaucacaaagcacaauaccagagacugucuuggaauuaacugaugcuuuagcauuagguaugaugguuuuaaaaaucguacgcaacauggaaaaauaucagcuagccguaacuauuauggcaauuuuaugcguuccuaaugccguaauauuacaaaacgccuggaaagucagcugcacaauauuggccguaguauccguuuccccucuacucuugacgucgagccaacagaaaacugauuggauaccuuuggcacuaacgauuaaaggccucaauccaacggccauauuucuaacgacauugagucgcacaaauaagaaacggucuuggccacuuaacgaggcaaucauggcuguagggaugguaucuauccuugcaucaucccuccugaaaaaugauauuccgaugacagguccucuaguagccggugggcuauugacaguuuguuauguauuaaccggucgaagugcagauuuagaauuagagagggcuacugaugugaaaugggaagaccaagcagaaauaagcggcucguccccaauacuaucaauuacgauuucagaggaugguucgaugucuaucaaaaaugaagaggaggaacagacauuaacaauacuaaucagaacaggauuauuagugauauccggguuauuccccauaagcauuccaaucacagcugcggccugguaucuaugggaagucaagaaacaacgagccggcguauugugggacguaccgucgccgccuccaaugggaaaagcggaauuagaagacggcgcuuaucggauuaaacagaaggguauccuuggguacagucaaauaggggccgguguauacaaggaagguaccuuucacacuauguggcacgucacucgcggcgccgugcuuaugcacaaagguaaaaggauagagccaagcugggcugacgucaagaaagaucuaauaagcuacgguggcggguggaaguuggaaggagaauggaaagaaggugaggaaguucaaguccucgcauuagagcccgguaaaaauccaagggcugugcagacuaaaccaggauuguuuaaaaccaacacaggcaccauuggugcaguuucauuagacuucucuccaggaacaaguggaagucccauaauagacaagaaaggaaaaguaguaggcuuauauggaaauggagugguaacaagaucaggagcauauguaagcgccauugcgcagacugagaaaaguauugaagauaaccccgaaauagaagacgauauauuuagaaaaagaagguuaaccauuauggaucuucacccuggcgcugguaaaacaaagagauacuuaccagcaauuguacgagaagccauuaaacggggauugcguacucucaucuuagcaccaaccagggucguagcugcggaaauggaggaagcccuaagaggucugccgauucguuaucaaacuccagcaauccgugccgaacacacggguagagaaauaguagacuuaaugugucacgcaaccuucacaaugagacuuuuaaguccaguaagaguaccuaacuauaaccuaauuauaauggacgaagcucacuuuacggauccugccucaaucgcugcgcgaggguauauaucgacccgaguagaaaugggugaagccgcgggcaucuucaugacugcaaccccgcccggaaguagagaccccuucccgcaaucaaaugcccccauuaucgacgaggagagagaaauaccggaaagauccuggaacuccggucacgaguggguuacggacuuuaaagguaaaacugucugguuuguaccuaguauaaaagcgggcaaugauauagcagcgugccugcgcaagaacggaaagaaaguaauacaauuaagucgaaaaaccuucgacagugaguacgucaaaacuagaacaaacgauugggauuuugucguuacgacugauauaucggaaaugggcgcaaauuuuaaagcugaacguguuaucgaccccagaagauguaugaaaccuguaauacuaacggauggagaagaacgagucauacucgcaggcccaaugcccguuacucauucgucagcggcacaacgccgaggaaggaucggacgcaacccgaaaaaugagaaugaccaauacauuuacaugggugaacccuuagaaaacgacgaagacugugcucacuggaaagaggcuaaaaugcugcuugauaauauaaacacuccugaaggaauaauaccuucaauguuugagccugaaagagaaaaaguagacgcuauagacggcgaauaccgacugcgcggagaggcaagaaaaacauucguagacuugaugcgcaggggagauuuaccgguguggcuagccuacaaaguugccgcugagggaauaaauuaugccgauaggagguggugcuuugauggaauuaaaaauaaucaaauauuagaggaaaacguagaagucgagauauggaccaaagaaggagaaagaaagaaauugaaaccacgcuggcuugaugcaaggauauacucugauccgcuagcucuaaaagaguuuaaagaauuugcagcagguaggaaaucauuaacccuaaauuuaauaacagaaaugggacgacuaccgacuuucaugacccaaaagacgagagaugcauuggauaaccuggcgguauugcauacagcagaggcuggaggucgagcguauaaccacgcccuaagcgaauuaccugagacucuugagacccugcuucuauuaacccuacuagcuacaguaacagguggaauuuucuuguuucuuaugucgggcagagguauagguaagaugacguuaggaaugugcugcauaaccacggccucaauacuucucugguacgcucaaauccaaccucauuggauagcagcaaguauaauauuggaauuuuuccuaauaguuuuauugauaccagagccagagaaacaaaggacgccacaagauaaucaacuuacauauguaguaauagcaauacucaccgugguagcugcaacaauggcgaaugaaaugggauucuuagagaaaacuaaaaaggauuuagggcuuggaucuauagcaacccagcagcccgaaucgaacauacuugacaucgaccuuaggcccgcaagugcauggacacuauacgccguagcuacuacuuucgugacaccuauguuaagacauaguauagaaaauucuucaguuaacgucagucuuacagccaucgcaaaucaagcaacuguucuaaugggauuaggcaagggauggccccucuccaaaauggacaucgguguuccauuauuggcaauuggaugcuauucucagguuaauccuauaacgcucacagccgcccuauuguuacucguagcucauuaugcuauaaucggaccgggacuacaggccaaagcaacaagagaagcccaaaaacgagcagcagcaggaauaaugaaaaaccccacggucgaugguauaaccguuauagaucucgacccuauuccguacgacccgaaauuugaaaaacaauuaggucaaguuaugcuacuaauuuuguguguuacgcaaguauuaaugaugcguacgacgugggcuuuaugugaggcauuaacucucgcgacagguccuaucucaacguugugggaaggaaaucccggccguuucuggaauacuacaauugcaguaaguauggcuaacauauuuagagggaguuauuuagcaggcgcaggguuacuguucaguauaaugaaaaauacgacaaauaccaggcgaggaacaggaaauaugggagaaacacuuggugaaaaguggaaaucccgcuuaaaugcguuagggaaaagcgaauuucagauuuauaaaagaucaggaauacaagaaguagauagaacacuugccaaagagggaauuaaaagaggagagacggaccaucaugcaguauccagagguagugcuaaauuaaggugguuuguagaaagaaacaugguaacgccggaaggaaaaguuguagaucuagggugcggaagaggagguuggaguuacuauugcgguggacucaaaaauguucgagaaguaaaaggucuaacuaaaggaggaccaggacaugaagaaccaauuccuaugucuacguauggauggaaccuuguccguuuacaaucagggguagacgucuuuuucauuccaccagagaaaugugauaccuuauuaugugacaucggggagucaucuccuaauccgacaguagaggcuggcaggacucugagaguacuaaauuuaguagaaaacuggcuaaauaauaauacacaauucuguauaaaagugcuuaauccguauaugccuuccguuaucgagaaaauggaagcauuacagagaaaauaugguggagcccuggugagaaacccuuuaagcagaaauuccacucaugagauguacuggguaaguaacgcuagugggaauauaguuucaaguguaaacaugauuucgcgcaugcugauaaaccgauuuacgaugagacauaagaaagcuacauaugaacccgacguggaucucggguccggcacaagaaacaucggaaucgaaagugaaauuccaaacuuagacaucaucggcaaacgaaucgagaaaauuaaacaggaacaugaaacaucauggcacuaugaucaagaucauccauauaagacaugggcguaucauggcucguaugaaaccaaacaaaccgguucugcuucgucaaugguaaacgggguuguacgacugcugacaaaaccaugggacguauuacccacagucacucaaauggcaaugacagacacgacaccuuuuggucaacaaagaguuuuuaaagaaaaaguugacacacgaacgcaagaaccaaaagaagguacuaaaaagcuaaugaaaauuaccgcagaguggcuauggaaggagcuagggaagaagaaaacgccacguauguguacaagagaagaguuuacccgcaaaguaagaaguaaugcagcgcugggagcuauauuuacagacgaaaacaaauggaaauccgcucgcgaagcgguugaggauucuagauuuugggaauugguagauaaggaacguaaccuucacuuggaagguaagugcgaaacaugugucuauaacaugauggguaaaagagagaagaaauuaggagaauuugguaaagcgaaagggagccgagccauaugguacauguggcuaggagcacguuucuuggaauuugaggccuuagguuuccuuaaugaagaucauugguuuagcagagaaaauucauuaaguggaguggaaggugaaggauuacacaagcuagguuauauacuuagggauguaucaaagaaagaagggggagcaauguacgcugacgacacggccgguugggacacaagaauuacacuagaagacuuaaagaaugaggaaaugguaacgaaucauauggagggagagcauaagaaauuggccgaagcaauuuuuaaauuaacauaccaaaacaaagucguacgaguacagagaccgacaccgcgaggcacaguuauggacauaaucucaagacgugaccagagagggaguggucaaguaggaacguacggacucaauacuuuuacuaauauggaggcgcaacuaauacgccaaauggaaggcgagggaguguucaaaaauauacaacaccuuaccguaacggaagaagucgcuguacaaaauugguuagcccgaguggggcgagaacgacucagucgaauggccaucucuggagacgauugugucguaaaaccccuagacgacagauuugcaaaugcacuaaccgcauugaaugauauggguaaaauacgaaaagauauacagcagugggaacccagcaaggguuggaacgauuggacacaagugccuuucuguagccaucacuuccaugaauugauuaugaaagacggacgaguccugguaguaccaugcagaaaucaagaugagcuaauuggacgcgcccgcauuucacaaggcgcagguuggaguuugcgggagacagcaugucucgguaaaaguuacgcccagauguggagcuugauguacuuccaucggagagaucugagauuggcagcuaacgcuauuuguucugcagucccaucacauuggguaccuacaagucggacaacuuggucuauacacgcaaagcacgaauggaugacuacagaagacauguuaacaguauggaauagaguuuggaucagagaaaauccauggauggaggauaaaacaccgguugagucgugggaagaaauaccuuacuuggguaaaagagaagaucaauggugugggagucuuauaggauuaacaucaagagcaacaugggccaaaaauauacaagcggcuauuaaccaaguacguagucugaucgguaaugaagaauacacagauuauaugcccucuaugaaaagauuucguagagaagaggaggaagcgggaguguuaugguga

SEQ ID NO: 22730 - RNA, 9876 nt, Artificial Sequence
  derived and/or modified CDS sequence (opt6) from DENV-2__EU482647__SS-prME
ucugcggggaugauaauuaugcuuauuccaacgguuauggcauuucaucuaacaaccagaaauggugaaccgcacaugauuguuggcauucaagaaaaagguaaaagucuucuuuucaaaacugaagaugguguaaacaugugcacauuaauggccauggaucucggcgaauuaugcgaagauaccauuacuuauaaauguccuuugcuuagacaaaaugaaccugaagacauagacuguuggugcaacucaacgucaacauggguuacauaugguacaugcacaacaacuggagaacauagacgagagaaaagauccguagcucuuguaccacauguugguaugggccuggaaacaagaacagaaacauggaugucgagcgaaggugcauggaaacaugcccaacgcauugaaacauggauucuuagacacccuggauuuaccauuauggcagcaauacucgcuuacacaauagggacgacccauuuccaacguguacuuauauuuauauuacuaaccgcaguagccccaagcaugacaaugagauguauaggaaucagcaaccgcgacuuuguagaaggaguaaguggaggcucauggguagauaucgugcucgaacaugguuccuguguaacuacuauggcgaaaaacaaaccuacuuuagacuucgaacucauuaaaacggaagcgaaacaaccagccacgcucagaaaauacugcauugaagcuaaacucacaaacacaacaacugaauccagaugcccuacacaaggggagccgucguuaaaagaagaacaggauaaacgauuuguaugcaaacauucaaugguagaccgaggguggggaaauggauguggacuguucggcaaaggaggaaucguuacuugcgcuauguuuacuugcaagaaaaauauggaaggaaaaauaguacaaccagaaaaccuugaauauacaaucguaguaacgccucacucaggcgaagaacaugcagucggaaaugauacagggaaacauggaaaagagauuaaaguuacgccgcagucaagcauaacggaggcagaacuaacaggcuauggaacugucaccauggaauguagcccuaggacuggucucgauuucaaugaaaugguauugcuccaaaugaaaaauaaagcauggcuuguccacagacaaugguuucucgaucuuccccuaccaugguuacccggagcagauaaacaggagagcaauuggauucaaaaagagacucucgucacauuuaaaaauccucaugcuaagaaacaggauguuguaguacuaggaucacaagaaggagcgaugcauacggcauuaacaggggcaacagagauacagaugaguucuggcaaucuguuauuuacagggcaccuaaaaugcagacuccguauggauaaauuacaacucaaaggaaugucuuacucgauguguacagggaaauucaaagugguuaaagaaauagcggaaacgcagcauggaacuauagugaucaggguacaauacgaaggagauggaaguccauguaagauaccauucgagauaauggauuuagagaaaagauauguauuaggacggcuaauuacaguaaauccaauugucacugaaaaagauagucccgugaauaucgaagcugaaccaccauuuggugauucauauaucauaaucggggucgagccaggccaacuaaaauugaacugguuuaagaaaggcucaucaauaggucagauguuugaaacaacuaugagaggagccaaaagaauggccauacugggggauacagcaugggauuuuggaucacuugguggaguuuucacaaguaucggaaaagcgcuacaccaagucuucggugcuaucuacggagcagcauuuucgggcguguccuggacaaugaaaauuuuaauaggggugauaauuacuuggauuggaaugaacucacguaguacaagccuaucagugucucuaguauuagucgggauaguaacacuauaccucgggguaaugguucaggcugauagugguuguguagucucguggaaaaauaaggagcuaaaguguggaucugguaucuucauaacagacaauguucauacauggacagaacaauauaaguuucaacccgaaucacccucaaaauuagcaagcgcaauacaaaaagcucaagaagaggggauaugcggaauacguucgguaacuaggcuagaaaaccuaauguggaagcaaaucacaccugagcucaaucacauuuuggcagagaaugaaguuaaacugacaauuaugacaggcgacauaaaaggaauaaugcaggcaggaaaacgaagucucagaccucagccaacagaauuaaaauauucauggaaaacaugggguaaagcgaaaaugcuaucaaccgaaucauauaaccaaacuuuucuaauagauggucccgaaacggcggaguguccaaauacuaacagggcauggaacucacucgagguagaggacuacggauuugguguauuuacgacuaacauauggcuaaaacuaaaagaaaaacaagacgcguucugugauucuaaacuuaugucugccgccauaaaggacaaccgagcugugcaugccgacaugggguacuggaucgaaucagccuuaaacgauacauggaaaauagagaaggcgagcuuuaucgaggucaaaaauugccauuggccaaaaucucauacgcuuuggagcaacggaguucuagaaagcgaaaugaucauacccaaaaaucuagccggacccguaucacaacacaauuacagaccgggauaucacacacaaaucgcggguccuuggcauuugggaaaacuagaaauggauuucgacuuuugugauggaacuacaguuauaguaacagaagauugcgguaauagaggcccaucucuuagaacuaccacugccucugguaaacugauaacggaaugguguuguagauccuguacucucccgccauuacgcuauaggggugaagacggguguugguacgggauggaaauccguccacugaaagaaaaagaagaaaaucuaguuaauucauuaguuacggcuggacauggccaaguugacaauuuuucguugggaguacuuggaauggcccuauuuuuagaagaaaugcuaagaacuagaguggggacaaagcaugcaauacuguuagucgcagugaguuucgugacacuuauuacuggaaauaugucauuuaaagaccuuggaaggguuguuguaaugguaggggcuaccauggcagaugacaucggaaugggagucacauaucuagcauuauuagcagcauucaaagugaggccaacuuuugcagcaggacuccuguugaggaaauuaacaucuaaagaauuaaugaugaccacaaucggaauuguguuauuaagccaaaguacaauuccugaaacaguucuugaacuaaccgaugcccuagcuuuagguaugauggucuuaaaaaucguaagaaacauggagaaauaucagcuugccguaacgaucauggcaauuuugugcguuccuaacgcuguaauucuucaaaaugcauggaaaguaucauguacgauccuugcagucguaucaguaucuccauuacuauuaacaaguagucaacagaaaacugauuggauaccauuagcauuaaccauuaaaggcuuaaacccaacugcaauauucuuaacaacuuuaucgagaacuaauaagaaaagguccuggccacuuaacgaggcuauaauggccguaggaaugguaucuauauuagcauccucuuuauugaagaaugacauaccgaugacgggaccauuaguggcaggggguuugcugacgguuuguuauguccucacgggaaggagcgcggaucuagagcuugaacgcgcuaccgaugucaaaugggaagaucaagcagagaucucaggcuccaguccaauuuuaagcauuaccauaucugaagacgggucaaugagcaucaaaaaugaggaagaggaacaaacauuaacuauacugauacggacaggguuguuagucaucagcgguuuauuuccgauaucaaucccaauaaccgccgcggcuugguauuuaugggaggucaagaaacagcgugcaggcguucuuugggaugugccuaguccuccaccaaugggaaaagcugaauuagaggacggagcauaucguauuaagcaaaaaggcauauuaggauauagccagaucggagcugggguauacaaagaaggaaccuuccacacaauguggcacguaacgagaggcgcaguacuaaugcacaaaggcaaaagaauagaacccucaugggcugaugucaagaaagaucugauaagcuacggcgggggauggaaauuggaaggcgaauggaaagaaggugaagaaguacaaguguuagcacuagaaccugguaaaaauccaagggcuguacaaacaaaaccgggauuguucaaaaccaauacugguacgauuggagcaguuucauuggauuucucaccaggaacaucaggcaguccuauaauugauaaaaagggaaaaguugucggccuuuauggaaauggaguuguaacucggucaggagccuauguaucagcaauagcgcagacugaaaaaucgaucgaagauaacccagagauugaagacgacaucuucaggaaacgucgccuaacgauaauggauuuacacccuggggccgguaaaacuaaacguuaccuuccugcgauagugagggaagcgauaaaaagagguuugaggacacuaauacucgcuccaacgcgcgucguagcggcagaaauggaagaagcgcuaagaggcuuaccaauucguuaccagacgccagcaauucgggcggaacacaccggcagagaaauuguagaccuaaugugucaugcuaccuuuacaaugcgacuacuuucaccgguacguguccccaacuacaacuuaauaauuauggaugaagcacauuucacggauccagcaagcauugcagcgaggggguacauuaguacaagaguugagaugggagaagcugcggggauuuuuaugacugcuacuccaccuggaucacgagaucccuuuccacagucuaaugcaccaauuauagacgaagaacgcgaaauuccagaaagaagcuggaacuccggucacgaauggguaacggacuuuaagggcaaaaccguuugguuuguucccucaauaaaggcgggaaacgauauagcugcuugcuuacgcaaaaauggcaagaaaguaauacaguuaucacguaaaacuuucgauucugaguacguaaaaacacgaaccaacgacugggauuuuguaguuacaacagauauauccgagaugggugcuaauuuuaaggcugaaagaguuauagaccccagaagaugcaugaaaccaguaauauuaaccgacggagaagaaagaguuauauuggccggacccaugccaguaacacauaguucggcagcacaaagaaggggaagaauuggucguaaccccaaaaaugaaaaugaucaguauauuuacaugggugaacccuuagagaaugacgaagacugugcacacuggaaagaagcuaaaaugcucuuagacaauauuaauacuccggaagguaucauaccgaguauguuugaacccgaaagagaaaagguagaugcaaucgacggggaauacagacuccggggugaagcaagaaaaacauucguagauuuaaugcguagaggagauuuacccguauggcuagcuuacaagguugcugcagagggcauaaauuaugcagaccgucgcuggugcuuugauggcauuaagaacaaccaaauucucgaagaaaacguugaagucgaaaucuggacaaaagaaggagagaggaagaaacuuaagccuagauggcuugacgcuagaauuuacagugauccuuuagcguugaaagaguucaaagaauuugcagcgggccggaaaaguuuaacgcugaauuuaauaacagaaaugggacgacuacccacauuuaugacucaaaagacaagagaugcgcuugacaacuuagcaguguuacauacugccgaagccggcggacgcgcauauaaccacgcguuauccgaguugccagaaacgcuggaaacacuccuucuauuaacacuccucgcuacuguuacaggaggaauauucuuauucuugaugucuggaagaggaauaggcaaaaugacucucgguauguguuguauaauaacugcaaguauauugcucugguaugcacaaauucaaccacacuggaucgcagcuaguauaauccuggaguucuuuuugauugucuuauugauaccggagccagaaaaacaacguacaccgcaagacaaccaguuaacauauguaguuauagcaauucugacuguaguagcugccacuauggcgaaugaaaugggauuuuuagagaaaacgaagaaagaccucggacugggcagcaucgcaacucaacaacccgaaucaaauaucuuggacauagaccuacggcccgcuuccgccuggacacuuuaugcuguagcuaccaccuuuguuacucccaugcugcggcauucuauagagaacucuuccguaaacguaagucuuaccgcuauagcuaaucaagcuaccguacuaaugggucuaggcaaggguuggccucuaucgaaaauggacauaggagucccccuucuugcaauaggaugcuauagucaagucaaucccaucacacuaacugcugcacuauuauugcuaguugcacacuaugcaauuauaggaccgggacuacaagcaaaagcaacccgugaagcgcagaaacgggcggccgcagggauuaugaaaaauccuacaguggauggcauaacaguaaucgaccuggauccaauaccauacgauccgaaauuugagaaacaacugggccaaguaauguugcuuauucuaugcguuacucaaguacuaaugaugcguacuacgugggcacuaugugaagcgcuuacauuggccacaggcccaauaucaacuuuaugggaggggaacccugggagguuuuggaauacaacgaucgcggucagcauggcgaauauauucaggggaucuuaucuggccggugcugguuuacucuucucuauaaugaaaaauacgacaaauacgcggagagggacagguaacauaggugaaacguuaggcgagaaguggaagucucgucuaaaugcacucgguaagagcgaguuccagacuuauaagaaaagcgguauucaggaaguugaccgaacucucgcaaaagaggguauuaaaagaggugaaacggaccaucaugccguuagucgaggaucugcuaaacuaagaugguuuguugagcguaacaugguaacgccugaaggaaaaguuguugaucucggaugcgguagaggcgguugguccuacuauugugggggacuuaaaaacgugagagaaguuaaaggccuaacgaaaggugguccuggucacgaagaaccuauuccgaugaguacguaugguuggaauuuaguuagacuccagagcgguguagacguauucuucauaccgccggaaaaaugcgacacgcugcuaugcgauaucggugaaaguagucccaauccaacaguagaagccgguagaacacuaagaguucucaaccugguagaaaauugguugaauaauaacacacaguuuugcaucaagguucuuaacccauauaugcccucuguuauagagaaaauggaggcacuacagaggaaauauggaggcgccuuaguacgaaacccauugagccgaaacucaacccacgaaauguauuggguuagcaaugcaagugggaacauagugucauccguaaacaugaucuccagaauguuaauuaaccgauuuacuaugcgacacaagaaggcaacauacgaaccagauguugaucuaggaagcggaacgagaaauauaggcauugagucugaaauuccaaaucuggacauuauaggaaagcguauugagaaaaucaagcaagaacacgagacuuccuggcauuacgaccaggaccauccguauaagacaugggccuaucacggguccuacgaaaccaaacaaaccggaagugccaguagcauggucaauggugugguacgucuacuaacaaaaccaugggaugucuuaccaacagugacacaaauggcaaugacagauacaaccccauuuggacagcaaagagucuucaaagaaaagguugauacacgcacacaagagccuaaggaaggaacaaagaaacuaaugaaaaucacugccgaauggcucuggaaggagcuuggcaaaaagaagacaccgagaaugugcacuagggaagaguucacucgcaaaguaagaaguaaugccgcccuaggcgcgauauuuacagaugaaaacaaauggaagucagccagagaagccguagaagauaguagauuuugggaauuaguagauaaagaaagaaaucuacauuuagaaggaaagugugagacguguguauacaauaugauggguaaaagagagaagaaauuaggcgaauuuggaaaagccaaggggucuagagcaauuugguauaugugguuaggcgcgagguuuuuagaauuugaagccuuaggcuuucugaaugaagaucauugguuuucgcgagagaacucccugagcggagucgaaggugaaggacuccacaaauuagguuacauuuuacgagacgugagcaagaaagaaggaggcgcgauguaugccgacgacaccgcagguugggauacaagaaucacgcuggaagauuugaagaaugaggaaaugguaacuaaccacauggaaggggagcauaagaaacuugcagaagccauuuucaaauuaacauaccaaaauaaggugguacguguacaaagacccaccccucgaggcacgguaauggauaucaucagcaggcgagaucaaagaggaaguggacaaguuggaacauaugggcuaaacaccuucaccaauauggaagcgcaguuaauccgucagauggaaggagaagggguauuuaaaaauauccagcacuuaacggucaccgaggagguagcuguacagaacugguuggcucggguuggucgugagcggcucagccgcauggcgaucucaggagacgauuguguggucaaaccauuagaugacagauuugccaaugcacuaacagcucucaaugauaugggaaaaauuagaaaagauauccaacaaugggaaccgaguaagggauggaaugauuggacacaaguuccuuucuguucgcaucauuuucacgaacuaauuaugaaagauggucgaguauuaguaguaccgugcagaaaucaagaugaauuaaucggcagagcaagaauaagccaaggggcuggauggagucuucgcgaaacugcuugccuugguaaaucguaugcacaaauguggaguuuaauguauuuccauaggagagaccugagauuggccgcgaacgcuauauguucagcaguaccgucccauugggucccuacuagccgaacaaccuggagcauacaugcuaagcaugaauggaugacuaccgaagauauguuaaccguguggaauaggguauggauucgcgagaauccauggauggaagauaagacuccggucgaaucgugggaagaaauuccuuaccuaggaaaacgggaagaccaaugguguggcucuuuaaucggacucacaaguagagcaacaugggcgaaaaacauacaagcggccauuaaccagguacguaguuuaauagguaaugaagaauacacagauuauaugccaucaaugaaacgauuuagacgcgaagaggaagaagcgggaguccuuugguaa

SEQ ID NO: 22731 - RNA, 9876 nt, Artificial Sequence
  derived and/or modified CDS sequence (opt6) from DENV-2__EU482648__SS-prME
acggcuggaguaauaauaauguuaauucccaccgcgauggcguuccaucuaaccacucguaauggggaaccccauaugauaguaggaaggcaagaaaaagguaaaucauugcuauuuaaaacagaagacggaguuaauauguguacccuaauggcuauagauuuaggugaauuaugcgaagauacuauaaccuauaaaugcccacuauuacgccaaaacgaaccggaagacaucgacuguuggugcaauuccacaucaacauggguaacuuaugguacguguacuacuaccggagaacaucgacgcgagaaaagaaguguagcuuugguaccacauguagguaugggacuagaaacucgaacggaaacauggaugucaagugaaggggcguggaaacaugcacaacguauagaaacuuggaucuuaagacacccaggauucacaauuauggcagcaauccuagcuuauacaauaggaaccacucauuuccaaagagcacuaauauuuauacuacucacugcaguagccccuucaaugacaaugcgauguauagguauaucaaacagagacuuuguugaaggcgugucuggagggucguggguugauauuguucuggaacauggcucuugcguaacuacaauggcuaaaaauaaaccuacacuagacuuugaacuaauaaaaaccgaagcaaaacaaccagcaacauugagaaaauacuguauagaagcuaaacuaacuaauacaacuacagagagcagaugcccaacccagggugaaccuagccuuaaugaagaacaggauaaacgguuuguuuguaaacauucaaugguagaccgaggcuggggaaauggaugcggguuguuugggaaaggcgguaucguuacaugcgcgauguucacauguaagaaaaacauggaagguaaaauaguacagccggaaaauuuagaauauacgaucguuauaaccccucauuccggugaagaacacgcaguaggaaacgauaccggaaaacaugggaaagaaauuaaaaucacaccucaaaguucaauaacagaagcugaauuaacagguuacggaacgguaaccauggaauguucgccacgcacggggcuagacuucaaugagaugguuuuguugcaaauggaggauaaagcaugguuggugcaucgucaaugguuuuuagauuugccacuaccuuggcuuccaggugcagacacccaaggaucgaacuggauacaaaaagaaaccuuaguaacauuuaaaaacccgcaugccaagaaacaagauguagucguacuuggaucccaagaaggugcaaugcauacagcgcuuaccggggcuacagaaauacaaaugaguucgggcaauuuacuuuucacaggacacuuaaagugccgauuaagaauggacaaacugcaauugaaaggaaugucauauucaauguguacggguaaauuuaaaauugucaaggaaaucgcagagacccaacacgggacaauugucauaagaguucaguaugaaggcgacgguagucccuguaagauuccuuuugagauaauggaucucgagaaaagacauguacugggacgcuuaauaacagucaaccccauuguaacggaaaaagauaguccaguaaauaucgaggcagaaccaccguucggagacucauauauuauuaucggaguagaaccaggccagcuuaaauuaaauugguuuaaaaagggaucguccauuggccagauguucgaaaccaccaugcgaggagcgaagagaauggcgauuuuaggugacacagcuugggauuuuggcucccuugguggcguuuuuacaucaauaggcaaagcacuacaccaaguauuuggagcuauuuauggagcagcguuuuccggaguuagcuggacuaugaaaauacucauaggagccaucauuacauggauaggaaugaacuccagaucaacgucauuaagcgugagccuagugcuaguuggagucauuaccuuguaucuuggagcaaugguacaagcagacuccggcugcguaguuucauggaagaacaaagaguuaaaaugugguuccgggaucuuuauaacugauaauguacacacauggaccgaacaauacaaauuccaaccagagucuccgucuaagcuagcgagugcuauacaaaaagcgcaugaagaggguauaugugguauucgaucugucacacggcuagagaacuuaauguggaagcagauaacaccggaacuaaaucauaucuuaagcgaaaaugaaguaaaauuaacuauuaugacuggggauaucaaaggaauaaugcaagcagguaaaagaagucuucggccucaaccgacagagcucaaguauaguuggaaaaccugggguaaagcgaaaauguuaucaacggaaagucauaaucaaacuuuccugauagauggaccggaaaccgcugagugcccgaacaccaacagggcauggaauagccuggagguggaagauuacggauucgggguauuuacaacuaacauauggcuuaagcuccgugaaaagcaggauguauuuugugauucaaagcuaaugucagcagcuaucaaggacaaucgagcuguucaugcagauaugggauacuggauagagucugcuuugaacgauacuuggaaaauggaaaaagcuagcuuuaucgagguaaaaucaugucacuggccuaaaagccauacucuauggucuaauggagugcuagaaagcgaaaugauaauuccuaaaaguuucgccgguccugugucacagcauaacuaucggccagguuacuauacacaaacagcuggaccauggcaccuaggaaaauuagaaauggauuucgacuucugugaagguacgacgguuguuguaaccgaagauugugguaauaggggaccaucauuaagaacuacaacugcaaguggcaaacuuauaacagaguggugcugccgaucgugcacauugccaccccuacgauacagaggggaggacgguuguugguacggcauggaaaucagaccacuuaaagaaaaagaagaaaauuuaguaaacagcuuaguuaccgcggggcacgggcagauagauaauuucagccugggaguccuagguauggcacucuuccuagaagaaauguugagaacacgagucgggaccaaacaugcgauuuuacugguugcagugaguuuuaugacacucauaacugggaauaugucauuccgagaccucggcaggguuaugguuaugguaggagcgacuaugacugaugauauugggaugggggugaccuaucuugcauuacuagcggccuucaaaguacguccuaccuuugcagcuggacuuuuauugcggaaauugacaucuaaagaacugaugauggcaacuaucgggaucgcauuauuaagccaauccacuaucccggaaaccauccuugaguugacugacgcauuagcucuggggaugaugguacugaaaauaguuagaaauauggagaaauaccaauuagcuguaacaauaauggcaauaucaugcguuccgaacgcugucauacuucaaaaugcauggaagguaaguugcacgauacucgcggccgucagcguaaguccauuguuauuaacaaguucgcaacaaaaagcagacuggauaccauuggcauugacuauaaaaggacuaaacccaacggcaaucuuucuaaccacacuauccaggacgucuaagaaaagauccuggccacuaaaugaagcaaucauggcaguaggaauggugucuauauuagcauccagucugcuuaaaaaugauauuccaaugaccggcccccuaguagcugguggauugcugacuguuuguuauguuuuaacagguagaagugcagaucuagaguuagaaagggcgaccgacguuaaaugggaggaucaagcugaaauuagcggaagcucaccaauuuuaaguaucacgauuucagaagaugguucuaugucuaucaaaaaugaagaagaagaacaaacccugaccauacugauuagaacaggucuauuaguaauaaguggauuguuuccaguaagcauuccaauuaccgcugcagcgugguauuuaugggaagucaagaaacaacgcgcaggaguucuaugggauguuccuucaccaccuccuguuggcaaagcagaauuagaagauggugcguaucguauuaagcagaaaggaauauuaggauauucucagauaggugcagggguauauaaagaagggacauuucauacgauguggcauguuacgcgaggagcggugcuaaugcaucguggaaaacguauugagccaagcugggcagaugucaagaaagaccugauaucauacggcggcgguuggaaacuagaaggagaauggaaggagggagaagaaguacaaguucuugcuuuagaaccgggcaaaaauccgagggcuguucagacaaagccaggguuauuuaaaacgaauacagguacgaucggugcagugagcuuggacuuuagcccuggaacaaguggcucaccuaucguggaucgaaaagggaaaguagucggcuuauacggcaauggagugguuacgcgcagcggagcuuaugugagcgcaauugcgcaaacagaaaaaucaaucgaagacaauccggaaauagaagaugauauauuucguaaaaagcgcuuaacuauaauggaucugcauccaggugcuggaaaaacuaaacgauaucuuccugcaauuguuagagaggcaauaaaacguggauuacgaacuuuaauacuggcuccaaccagagucguagcagcggaaauggaggaagcacuuagaggacugccaauaagauaucaaacucccgcuauuagagcagaacauacagggagagaaauaguagaccuaaugugucacgcaacauucacgaugagacuacucaguccaguuagaguaccgaauuauaaccuuauaauuauggaugaagcccauuucacagaucccgcaagcauugcggcgagaggauacaucucgacucguguugagaugggagaagcagcagguaucuucaugacagcuacaccacccggaucucgagauccuuuuccucaaucaaacgcuccaauaauugaugaagaaagagagauuccagaaaggucguggaacucaggacaugaauggguaaccgacuuuaaaggaaaaacugucugguucguaccgaguauaaaagcagguaacgauauugcagccugucucaggaagaaugguaagaaaguaauccaauuaucccguaaaacauucgacagugaauaugucaaaacccgaacaaaugauugggacuuugucguaacuacagacaucuccgaaaugggggcaaacuuuaaagcagaaagaguuauagauccuagacgaugcaugaaacccguaauucugacagacggagaggagagaguuauccuagccgggccgaugccuguuacacacaguucagcggcgcagagaagaggaaggaucggcagaaacccuaaaaaugaaaacgaccaauauauuuauaugggagaacccuuagagaaugacgaagauugcgcgcacuggaaagaagcaaaaaugcuauuagauaacauuaauacaccagaagggauaauaccgaguauguucgaaccagagcgagaaaaaguagacgcuauagacggcgaauacaggcucagaggagaagcacgcaaaacguuugucgaucuaaugcgaagaggagacuuaccgguauggcuagcguauagagucgccgcagaagggauuaacuaugcagaucgccguugguguuuugauggagucaaaaauaaucaaauacuagaggagaacguagaaguagaaaucuggacaaaagaaggagaaagaaagaaauuaaaaccccgauggcuagacgcuagaauauauagcgacccacuugcguuaaaagaguucaaagaguuugcugcugguagaaaaucauugacauuaaaccuuauaacggaaaugggaagguuaccuacauuuaugacgcaaaaagcuagggacgcacucgacaacuuagcuguccugcauacagcagaagccggugggcgggcauauaaccacgcucuaucugaacuucccgaaacacucgaaacucuucuccuauuaacauuguuagcaaccguuacaggagggauauucuuauucuuaaugucugguaagggaguggguaaaaugacguuagguaugugcugcaucauaacagcuucuauucuauuaugguaugcucaaauccaaccccauuggauagcggcaucuauaauacucgaguucuuccugauaguguugcuaauucccgagcccgaaaaacaaagaacuccucaagauaaucagcucacuuauguagugaucgcgauccugacagucguugcggcuacuauggcuaacgagaugggauuucuggaaaagacgaagaaagaucuaggauugggaaguauugcgacccaagaaccagaaagcaauauucuggauauagauuugaggcccgcaagugcauggacacuuuaugcaguagccacuacguucgugacaccaauguugcgccauaguauagaaaauuccucaguaaaugucagcuuaacagcuaucgcuaaccaggcaacgguuuuaaugggucuuggaaaagguuggccuuugucuaagauggauaucggcguuccauuauuggcaaucggcuguuauucccaagucaauccaauuacauugacagccgcauugcuacucuuaauugcucacuacgcaauuauugguccaggccuccaagcgaaggcaacccgcgaagcacaaaaacgugcugccgcuggaauaaugaaaaauccuacaguagaugguauaacaguaauagauuuagaucccauccccuaugauccaaaguuugaaaagcaauuaggccaggugauguuacuuaucuuaugcguaacgcaaguccuaaugaugagaacgacuugggcacucugcgaggcucuaacucuagcgacugggccaauaucgacacuuugggaagguaaccccgggagguuuuggaauaccacgauugcugucaguauggcaaauauauuucgaggaagcuacuuagcuggagcaggacuuuuauuuucaauaaugaaaaacacaacuaacacaaggagggguacaggcaacaucggagaaacauuaggagaaaaauggaaaagucgccuaaacgcguugggaaaauccgaauuucagauauauaagaaaaguggcauucaggaaguagaccgaacguuagcgaaagagggaauaaaaagaggcgagacagaccaccaugcgguaucuagaggaucagcuaaacuacgaugguuuguagaaagaaacauggucacaccugaagguaaagucgucgaccuuggcugcggaagaggaggguggucauauuauuguggaggauugaagaauguccgcgaagucaaaggacuaacaaaaggugggccaggacaugaggagccuauaccaaugucuacauauggguggaacuuggucagacuacaaucaggagucgaugucuucuuuacgccgccagaaaaaugcgacacccuccucugcgauauuggggagucgucaccaaauccaacaaucgaagcgggaaggacacuccggguauugucucugguagaaaacugguuaaacaaugauacgcaauucuguauuaaaguacuaaauccguacaugccuuccguuauagagaaaauggaaacgcuacagcgaaaauacggaggcgcuuuaguuagaaacccguuaucacgaaacagcacccacgaaauguacugggucucgaacgcuacgggaaauauaguaagcucgguuaacaugaucucucggaugcuaauuaaucgguuuaccaugaagcauaagaaagcaaccuaugaacccgauguggaccuugggagcggcacaaggaauauugguaucgaauccgaaauaccuaauuuagacauuaucgguaaaaggauugaaaagauuaaacaagaacaugaaacgaguuggcacuaugaccaagaucacccguauaaaaccugggcuuaccauggaaguuaugaaacuaaacaaacagggagugcauccuccauggucaauggaguaguucgcuuguuaaccaagccaugggauguuguacccaugguuacucaaauggcaaugacagacacuacaccuuucggacaacaaagaguauuuaaagaaaaaguagacacgagaacacaagagccaaaagaagguacgaagaaauuaaugaaaauaacagcagaaugguuguggaaagaacuaggcaagaagaaaacaccaagaauguguacgagagaagaguuuacaaggaaaguucgguccaacgcugcacuaggugcaauauucacagaugaaaacaaauggaaaucggcaagggaagcaguugaggacucaagauucugggaguuaguagauaaagaacgaaaccuccaucuugaaggaaaaugugaaacaugcguguauaauaugauggguaaaagagagaagaaauugggggaguucggaaaagcaaaagguucucgugcuauuugguacauguggcuaggugcucgauuucucgaguuugaagcccuaggauucuuaaacgaagaccauugguuuucucgggaaaacucguuaucaggaguugaaggugaaggucuucauaaacuuggguauauuuuaagagacguguccaaaaaggaaggcggugccauguaugccgacgauacagcaggcugggauacaaggauuacucuagaagaccucaaaaaugaagaaaugguuacgaaucacauggaaggugaacacaaacgacuagccgaagcuaucuuuaagcuaacauaccaaaauaaagucgugcguguucaaagaccaacucccagagguaccgucauggauauaauuucaaggcgcgaccagagaggcucaggacaaguagggaccuacggccuuaauacauucacuaauauggaggcgcagcuuauuagacagauggaaggagaaggaauauucaaaagcauacaacaucugacgguaacagaagaaauagccguacaaaacuggcucgcaaggguuggaagagaaagacuuucacgaauggcaauaucuggugacgauugcgucguuaagccacuagacgaccgauucgcuucggccuuaacggcacuaaaugauaugggcaaaguuagaaaggacauacagcagugggagccaagcaaaggcuggaaugacuggacccaagugccguuuuguucacaccauuuccaugaauuaauaaugaaagacggcagagucuuagucgucccaugccgaaaucaagaugagcugauaggaagggcacguauuucccagggggcagguuggagcuuaaaagaaacugcuugucucgguaagagcuacgcccaaauguggagucuaauguacuuucauaggagagacuuacgcuuagcggcaaacgccauauguagcgcaguaccaucucauugggucccaacaucuaggaccacauggucaauacacgccaaacacgaauggaugacaacagaagauauguuaacgguauggaaccggguguggauccaagaaaauccguggauggaagauaagacuccgguagaaaguugggaagaaguaccguauuuagggaaacgagaagaucaguggugcggcagccuaauuggacuuacaucaagagcgacaugggccaaaaauauacaaacugcgauuaaccaaguacgaucauuaaucgggaaugaagaauacacugauuauaugccgucaaugaaaagauuccgucgagaagaagaagaggcaggggugcuuugguag

SEQ ID NO: 22732 - RNA, 9876 nt, Artificial Sequence
  derived and/or modified CDS sequence (opt6) from DENV-2__EU482649__SS-prME
ucagcuggaaugauaauaaugcuaauuccgacuguuauggcauuucaucucacgaccagaaauggggaaccacacaugauuguagguauucaagaaaaaggaaaaagccuccuauucaaaacggaagauggagucaauaugugcacguugauggcuauggauuuaggagaauuaugcgaagauacaauuacauacaaauguccauugcuacgacaaaacgaaccagaagauauugauuguuggugcaauucaacuagcacauggguaacauauggaacuuguacaacaacaggagaacacagaagagagaaaagaaguguagcacugguaccacauguugggaugggucuugaaacaagaacagaaacguggaugagcucagaaggagcauggaaacaugcacagagaauagaaacguggauauuaagacaccccggguucacuauuauggcggcuauucuagcguacacgauagguacaacccacuuucagcgaguauuaauuuucauucuacuaacggcuauugcaccuaguaugacaaugagauguauaggaauaucaaacagggacuuuguagaaggcguuucagggggaagcuggguggauauaguguuggaacacggaucaugcguuacaacuauggcgaaaaacaaaccaacuuuagauuuugaauuaauaaaaacagaagcgaaacaaccggcaacucucaggaaauacuguauagaagcuaaacuuaccaauacgaccacugaauccagauguccaacacaaggagaaccaucguugaaagaagaacaagacaaacgauuuguauguaaacacucgaugguugaccgcgguuggggcaacgguugcggcuuauucggcaaaggaggcauugugacaugcgcaauguucacuugcaagaaaaauauggaaggcaaaauaguccagccggaaaaccucgaauauaccauaguaguaaccccgcauucaggagaagaacacgccgucggcaacgauacgggcaaacaugguaaagaaauaaaaguaacgccacaaaguucaauuacugaggcugaacucacuggauacgggacggucacuauggagugcucucccaggacaggauuagauuucaacgagaugguuuuacuacaaauggaaaauaaagcaugguugguucaucgccaaugguuccuagaucuaccgcuaccauggcuaccaggggcugacaagcaggaaaguaauuggauacaaaaagaaacuuuaguuacguuuaaaaacccccaugcgaagaaacaagauguuguagucuuagguucacaagaaggagcaaugcauacugcuuuaacuggugcgacagagauacagaugaguucugguaacuuguuauuuacgggacaucuaaaaugccgauugagaauggauaaacuucaacucaaaggaauguccuauucaaugugcacagggaaauucaaaguagugaaggagaucgcggaaacgcagcacgguacaauaguuauccgaguucaguaugaaggugauggaagcccauguaaaauacccuuugagauuauggaucuggagaaaagauacguacuaggacgacucauaacgguuaacccaauugucacggagaaagauaguccaguaaauauugaagccgaaccacccuuuggcgauagcuauaucauaauagguguagagccugggcaauuaaaacuuaauugguuuaagaaaggauccaguauaggccaaauguuugagacgacaaugagaggagcuaaaagaauggcuauucuaggagauaccgccugggacuuuggcagcuuagguggggucuuuacaucgauaggaaaagcguuacaccaaguauuuggagccauauauggcgccgcuuuuagugguguuagcuggacaaugaaaauucugauaggaguuauaauuacguggauuggcaugaacagucgauccacauccuugucuguaucuuuaguucucgugggaauaguaacacuauaucugggggugaugguacaagcagacucaggcuguguugugaguuggaaaaacaaagaguugaagugcggaagcggaauuuucaucacugauaaugugcauacauggacggaacaguauaaauuucaaccugaaagccccuccaaguuagcuagcgcuauacagaaagcacaagaagagggaauaugugguauuagaucaguaacacgauuggaaaaucuuauguggaaacagauaaccccagaauugaaccacauacuagcagaaaacgaagucaaguugacuaucaugacgggggauauuaaggguauaaugcaagcggguaaaagaaguuuaagaccucaaccaacagagcuuaaauauucguggaaaacguggggaaaggccaaaaugcuaucaacagaaucguacaaucagaccuuuuugauagacgguccagagacagcugaguguccuaacacgaauagggccuggaacucauuagaaguagaagacuaugguuucgguguauuuacuacaaauaucuggcuuaaauugaaagaaaaacaagaugcguuuugugauucaaaacucaugucagcugcaauaaaagauaauagagcaguacaugcugauaugggcuacuggaucgaaucagcauuaaaugauaccuggaagauagaaaaagcaaguuucauugaggucaaaaauugucacuggccaaagagucauacacuauggagcaacgguguccuagaaagugaaaugauuauuccgaagaauuuagccgguccgguuucacagcacaauuauagaccuggcuaccauacacaaauugcagguccuuggcaucuagguaaauuagaaauggacuuugauuuuugcgauggcacgacagucauuguuacggaagacuguggaaacagaggccccagcuuaagaacaacaacagccagugguaaauuaauaacggaauggugcuguagaucguguaccuuacccccguuaagauacagaggugaagauggguguugguaugguauggaaauaaggccucugaaagaaaaggaagagaauuugguuaauagucucgugacagccggacauggacagguugauaauuuuucgcuaggaguguuaggaauggcucucuucuuggaagagauguuaagaaccagaguagguacuaagcacgcaauacuauuaguugcuguuucauucguaacacugauaacagguaacaugaguuuuaaggaccuaggaaggguuguagugauggucggugcuacaauggcggacgauauugguaugggugugucauaucuagcgcucuuggccgccuucaaaguacgaccaacuuuugcugccgggcuauuauuaagaaaauugaccuccaaagaauugaugaugacaacuauaggcauaguauuauuaucucaaagcaccauaccagagaccguauuagaauuaacggacgcauuagcucuuggaaugaugguccugaagaucguucguaauauggaaaaauaccaauuggcuguaacaaucauggcaauacuaugugucccaaaugcaguugugcuucagaaugcauggaaaguaucgugcaccaucuuggccgucguaucuguaucaccuuugcuauugacaagcucacaacagaaaacggauuggauaccucuugcauuaaccauuaaaggucugaacccaacggcaauuuuccucacaacacuauccagaacaaacaagaaacguuccuggccucugaaugaagccaucauggcaguagguaugguaucaauuuuagcaucuaguuuacugaaaaacgauauaccgaugacagguccgcuagucgccggaggguuacucacgguaugcuauguauuaacgggucgaucggcagacuuagagcuggaaagagcuacugacguaaagugggaagaucaagcggaaauaucuggcagcucaccuauauuaucuauuacaauuucagaagacggcucaaugucaaucaaaaaugaagaagaagaacaaacacucacgaucuuaauacgcacaggauuguugguaauuaguggucuuuuccccaucucgauaccgauaacagccgcggcaugguauuuaugggagguuaagaaacagcgagcgggaguacuaugggaugucccaaguccaccacccaugggaaaagcugaauuagaagauggagcuuauagaauaaagcagaaagggauucuaggguacucucagaucggugcuggaguauacaaagaaggaacauuucacacaauguggcacguuacacggggagcaguccuaaugcauaaagggaaaaggaucgagccgaguugggccgacgucaagaaagaccuuaucuccuacggaggcggauggaaauuggagggagaguggaaagaaggagaagaaguacaaguccuagcauuagaaccgggcaaaaauccaagagcaguccaaaccaaaccaggacucuuuaaaaccaauaccggaacaaucggcgccguuucccuagacuucaguccaggaacaaguggcuccccuauuauagacaagaaagguaaaguugucggacucuaugguaauggaguuguuacgagauccggagcauacguaagcgccauagcccagacagaaaaaucaauugaagacaaucccgagaucgaagacgauaucuuccguaaaaggcgccuuacaauaauggacuuacacccuggcgcaggaaaaacaaaacgauaucuaccugcaaucguacgugaagcaaucaaaagaggccuccgaaccuuaauauuggcaccaacgagagucguagcugcagagauggaagaagcauuaaggggauuaccuauuagguaucaaacaccagccauaaaggcugagcauacgggaagagaaauuguggauuuaaugugucaugcaacauuuacaaugcgauuacuguccccgguuaggguaccgaacuacaaucugauaauaauggaugaggcccacuuuacugaucccgcaucuauagcagcuagagguuacauaaguacacgagucgagaugggggaagcagcugggauuuuuaugacggcuacaccaccuggaagcagagauccguuuccacagucgaaugcaccuauaauugaugaagaaagggaaaucccagaaagaucauggaacagcggucaugaaugggucacugauuucaaagguaagacagucugguuuguucccuccauaaaggcuggaaaugacauagcagcaugucuaagaaagaacggcaagaaaguuauacaauuaagucggaaaaccuucgauucagaauaugucaaaacucgcacuaaugacugggauuucgucguuaccacugacauaagugaaaugggugcaaauuuuaaagcagaaaggguaauagacccuagacguugcaugaagccuguaauacuuacggacggagaagaaagaguaaucuuggcaggacccaugccaguuacgcauaguuccgcugcucaacggagagguagaauaggccguaaucccaagaaugaaaaugaucaauacauauacaugggagaaccguuggaaaaugaugaggauugcgcacauuggaaagaagccaagauguuacuggauaacauuaacacaccggaagguauaauuccaucaauguucgaaccagaaagagaaaaagucgaugccauugauggugaauauagacuaagaggugaagcaagaaaaacuuucguggaccuaaugagacgaggagauuuaccuguuuggcuagcguauaaaguagcagcggaggguauaaauuacgccgaccgccguugguguuuugacggaaucaaaaacaaccagauacuggaggaaaacguggaaguugaaauauggacgaaagaaggggaacgcaagaagcuaaaaccacguugguuagaugcaaggauauauucagauccccucgcuuuaaaagaguuuaaagaguuugcggcagggcguaaaagucucacauuaaauuugauaacagagauggguagauuaccuaccuuuaugacccaaaagacaagggaugcuuuggauaaccuagcgguacuacacacugcggaggccgguggacgagcauacaaucacgcccuaucagaguuacccgaaacucuugagacucucuuacuacuuacccuccuggcaacgguuacaggaggaauauuuuuauuccuuauguccgguagagggauaggaaaaaugaccuuggggauguguuguauuauaacggcuaguauauuauugugguaugcccaaauucaaccccauuggauagcugcaucaaucauucuagaauuuuuccuaauaguucuacugaucccugaaccagaaaagcaaaggacuccccaagauaaucaauuaacauauguagucauagcaauauuaacaguaguagcggcgacgauggcgaacgaaaugggguuucuagagaaaaccaagaaagacuugggacuaggaucaauugcgacucaacaaccagaauccaacauacucgauaucgacuugagaccagcaucagcuuggacgcuauaugcuguagcgacuacauucguaacgccgaugcugagacauucaauagaaaauaguaguguuaauguaaguuugacggcaaucgcaaaccaagcuacugugcucaugggacuagguaaaggauggccuuuaucgaagauggauauaggugucccacuucuggcuauugguugcuacucacaagucaauccgauaacgcucaccgcugccuuacucuuguugguggcgcauuaugcaauuauaggcccaggauugcaggcaaaagcgacgcgugaagcucaaaagcgagcagcugcggguauaaugaaaaaccccacaguggauggcauaacaguaauagaccuagacccaauccccuaugauccuaaguuugagaagcaacuaggacaaguaaugcugcucauauuaugcgugacucaggucuuaaugaugcguacaaccugggcucucugcgaagccuugacguuggccacagggccaauaucaacccucugggaaggaaacccaggaagauuuuggaauacaacaauugccguuucaauggcgaacaucuucagagguagcuaucuugcaggggcggguuuguuguucucuauaaugaaaaacacaaccaacacuagacgggggacaggaaauauuggagaaacacuaggcgaaaaauggaaaagccgccuaaaugcauuagguaaaagcgaguuccaaauuuacaagaaaucaggcauacaagaaguagacagaacgcuagcaaaagagggaaucaaaagaggggaaacagaucaccacgcuguaaguagaggaucugccaaacucaggugguucguugagagaaacaugguaacaccugaaggaaaaguuguggaccuuggauguggaagagguggauggaguuauuauuguggaggacugaagaauguaagggagguuaaagggcuaacaaaagggggccccggacaugaagaaccgauuccaaugaguacauauggguggaaccuaguuagacuacaaucaggagucgauguauucuuuauuccaccagagaagugcgauacauuacugugcgauauuggugaaagcagccccaacccaacuguagaagcuggaaggacucuccgcguccuaaaucugguagaaaauuggcuuaacaauaauacgcaauucugcaucaaaguauuaaaccccuauaugccauccgucauugagaaaauggaagcucuccaaagaaaguauggcggcgccuuaguacguaacccucuaagucgaaauaguacccacgaaauguauuggguuucgaaugcaucaggaaacauaguuucgaguguuaacaugauaucccguauguugaucaauagauucacaaugagacacaagaaagcaacauaugagccggacguagaccucggcagugguacuagaaacauagggauagagagugaaaucccaaauuuagauauaaucggaaaaaggaucgaaaagauuaagcaagaacacgaaacaucuuggcauuaugaccaggaucacccguacaaaaccugggccuaccaugggucauacgaaacaaaacaaaccggaucugcaaguuccaugguuaauggaguuguacgccuuuugacaaaaccuugggacguucuuccgacuguaacacagauggcaaugacagauacaacaccauucgggcaacaacgaguauucaaggaaaaaguugacacccgaacccaagagccuaaagaagguacgaaaaaguuaaugaagauaacugccgaauggcuauggaaagaauugggaaagaagaaaacgccccgcauguguacaagggaggaguucacuagaaaaguacggaguaaugcagccuuaggcgcaaucuuuacagaugaaaauaaauggaaaagcgcgcgggaggcuguagaagacagccgauucugggaguuaguagauaaagaaagaaauuugcaucucgaggguaaaugcgaaacaugcguuuauaauaugauggggaaacgagagaagaaacuaggagaguucggcaaagcaaaaggauccagagcaauuugguauaugugguugggcgcaagauuucuugaguucgaggcauuaggauuucuuaacgaggaucauugguuuucuagggaaaauucuuuaagcggggucgagggggagggucuccacaaacuaggauauauacuucgggauguuucuaagaaagaaggaggugcaauguacgcagaugacacugcagguugggauacaagaauaacuuuagaagauuugaagaacgaggaaaugguuacgaaccacauggaaggcgagcauaagaaacuagcagaggcuauuuuuaaauuaaccuaccaaaauaaggucguaagaguacaacgaccuacaccaaggggaacggucauggauaucauaagccgaagggaccaaagagggucaggccaagucggaaccuacgguuuaaauacauuuacaaauauggaagcucaauuaauaagacagauggagggggaggggguguuuaagaacauacaaaacuuaacuguaaccgaagaggucgcaguucaaaauugguuggcucggguuggaagggaacgccugagcaggauggccauaaguggugaugauuguguggucaagccauuagaugaucgauucgcuaaugcucuaacggccuuaaaugacaugggaaaaauaagaaaagauauccaacaaugggaaccgagcaaaggauggaaugauuggacacaaguaccguuuugcagccaccauuuccaugaacuaauaaugaaagauggccggguguuaguaguaccaugucggaaccaagaugaacugauuggccgggcacggauaucccagggagcaggguggagucuccgugaaacagcuugucugggaaagucauacgcgcaaauguggagucucauguacuuucaccgcagagauuuaagauuagcagcaaacgcaaucugcucagcggucccaucucauuggguuccuacaucuagaacaacauggaguauacaugcuaagcaugaauggaugacgaccgaagauauguuaacagucuggaauagaguguggauacgcgaaaauccauggauggaagacaaaacucccgucgaaucuugggaggaaaucccuuacuuaggaaaaagagaggaucaaugguguggaagucuuauuggguugacuucuagagcaaccugggcaaagaacauucaggcagcaauuaaucaagugaggagcuuaauugggaaugaggaauauacagauuauaugcccagcaugaaacguuuuagaagggaagaagaagaagcugggguauuaugguaa

SEQ ID NO: 22733 - RNA, 9876 nt, Artificial Sequence
  derived and/or modified CDS sequence (opt6) from DENV-2__EU482650__SS-prME
agugcaggcaugaucauaaugcuuauucccacggugauggcauuucaucuuacuacucgaaauggagaaccccacaugauuguugggauucaagaaaaagguaaaagucuguuauuuaaaacugaagaugggguaaacauguguacguuaauggcuauggacuuaggugaacuaugugaagauacaauaacauacaaaugcccucuacuaagacaaaacgaacccgaagacauagauugcuggugcaacagcacuagcacauggguaacguacggcacaugcacaacaacgggagaacauagacgugagaaaagaaguguagcauuaguaccacacgugggaaugggacuagaaacacggacagaaacauggaugucaucugaaggggcguggaaacacgcacaacggauugaaacguggauacuaaggcauccagguuuuaccauuauggcugcuauacuugcauauaccaucggaaccacgcauuuucaaagaguacugauauuuauauuacuaacggcuguagcuccuucaaugacaaugaggugcauaggcaucagcaaucgcgauuuuguugaagggguuucgggagguagcuggguagacauaguuuuagagcauggaucaugcguaacgacgauggcgaaaaauaaacccacauuagauuuugaauuaauaaaaacagaagcgaaacaaccggcaacacugagaaaauauugcaucgaagcaaaauuaacgaauaccacaacagaaucacgauguccaacacaaggagagccaucauugaaagaagaacaagacaaaagauucgucuguaaacacuccaugguagaucgaggauggggaaacggaugugggcuuuucgggaaaggagggauuguuacaugugcuauguucacuuguaagaaaaacauggaaggaaaaauaguucaacccgaaaaccuugaauacaccauaguuguaacaccgcacucgggggaagaacacgcgguuggcaacgacaccgguaaacauggacaggaaauaaaaguaaccccacaaaguucgaucacugaagcagagcucacuggcuauggcacuguaacgauggaaugcuccccgcgaacaggucuagacuuuaacgaaaugguauuguuacagauggagaauaaagcaugguugguacacagacaaugguuucucgaccuucccuuacccuggcucccgggggcugauaaacaagaauccaacuggauccagaaagaaaccuuaguuacauucaaaaacccacaugccaagaaacaggacguagucguucucggaucucaggaaggagcuaugcacacugcguuaacaggcgcuacagagauacaaaugaguaguggaaaccuucuguuuacaggacauuuaaaaugucgcuuaagaauggauaaauuacagcugaaagguaugagcuauucuaugugcacaggaaaauuuaaaguuguaaaagagaucgccgaaacacaacaugguaccaucguaauccguguacaauaugaaggagacggcaguccuuguaaaauaccuuuugagaucauggaucuagagaaaagauauguacuaggacgucuaauaacuguaaacccaauaguuacagaaaaagauucuccugugaauaucgaagccgaaccaccguuuggagauaguuacaucauaauagguguagaaccaggccaauuaaaauuaaacugguuuaagaaaggcagcaguauaggucaaauguuugaaacuacuaugaggggugcaaaaaggauggcgauucuaggugauacagcaugggacuucggaucauugggcggagucuuuaccaguauagggaaagccuuacaucaaguauuuggggcaaucuauggcgcugcguucagcggugucaguuggacaaugaaaauucucauugguguuauaauuacauggauuggcaugaauaguagauccacgucacuuagcguuucgcuaguauuaguaggaaucguaacucuuuacuugggcguuauggugcaagcagacagcgguugcguugugaguuggaaaaacaaagaacuaaaaugugggucaggaauuuuuauaacugauaauguacacacguggacagagcaguauaaauuucaacccgaaucacccucaaaauuagcuucggccauacaaaaagcccaagaagaggguauauguggcauccgguccguaacacgauuagagaauuuaauguggaaacaaauaaccccagaguuaaaucauauucuugcagaaaaugaaguuaaauugacuaucaugacaggggacauuaaagguauaaugcaggcagggaaaagaucucuuaggccucaacccacggaauuaaaauauucauggaaaacuuggggaaaagcaaaaaugcuaucaacagaaucuuacaaucaaacauuccuaaucgauggccccgaaacagccgaauguccuaauacaaaccgugcguggaacucacuggaagucgaggauuacggauucgguguuuuuacaacaaacauaugguugaaauugaaggagaagcaagaugcauucugcgacaguaaacuaaugucggccgcaaucaaagacaacagagcgguucaugcagauaugggauauuggauagaaucagcucuaaaugauacuuggaagaucgagaaagcaucauuuauagaggugaaaaacugucacuggccaaagucacacacacuuuggucaaacggggugcucgaaagcgaaaugauaauucccaaaaauuuagcuggacccguuucacaacauaauuaucgacccggcuaccacacucagauugcagggccuuggcaccucggaaaauuagaaauggauuucgacuuuugugauggaacgaccguaauaguaacagaagacugcggaaauagggggccuucucuccguacgacuaccgcaucagggaaauuaauuacagaauggugcuguaggucuuguacgcuuccaccgcuacgcuaucgaggagaagauggauguugguauggaauggagauacggccuuugaaagaaaaagaagaaaaccuaguaaauuccuuggugacggcuggacacggacaaguugacaauuucucccuggguguauuagggauggcgcuauuucuggaagagauguuacguacuagagucggcacaaaacaugcaauauuauugguggccgucucauuuguaacccuaauaacggguaauaugagcuucaaagacuuggguagaguaguaguuauggugggugccacuauggcugacgauauagguaugggugugacuuauuuagcgcuguuagcagcauucaaggugcgaccaacauuugcagccggucuucuucuaaggaaacuuaccaguaaagagcuaaugaugacuacaauuggaauaguccuacuaagucagagcacaauaccggaaacaguccucgaacuaacggacgcauuagcguugggaaugaugguuuuaaagauagugaggaacauggagaaguaccagcuagcggucacuauuauggcuauauuguguguaccaaacgcuguaauauuacagaacgcuuggaaaguuaguuguacaauuuuagcuguaguuaguguuagcccacuacuacucacaaguucacagcagaaaacggacuggauaccacuugcuuuaacaauaaaaggguuaaauccaacugcgauauuccuaacaacauuauccagaacaaauaagaaacguagcuggccauuaaaugaagcuauuauggccguaggcauggucucaauauuagcaaguagucuucugaaaaacgacauuccaaugacagggcccuuaguggcaggcggucuguuaacgguaugcuauguuuuaaccgguaggagcgcagacuuagaguuagagcgagcaacugacguaaagugggaagaccaggcagaaauaagcggcucgucucccauuuuaaguauaacuauaucugaagacggaucaauguccaucaaaaacgaagaggaagaacagacucucaccauauuaaucagaacaggauugcuaguaauaaguggacuauucccuauaucaaucccuauaacugcggcggcuugguaccuuugggaagucaagaagcaaagagcaggcguucuaugggacguaccuagcccgccacccauggguaaggcugaacuugaagacggagcuuauagaauuaaacaaaaggguauacuaggcuacucacagaucggugccgguguauauaaagaagggacauuucauacaauguggcaugugaccagaggagcaguacucaugcacaaaggaaaaaggauagaacccaguugggcugacgucaagaaagaccucauaucauacggaggaggguggaaacuagaaggugaauggaaagagggagaggaagugcaaguacucgcucuggaaccgggcaaaaacccuagagccguccaaacuaagccaggauuauuuaaaacaaauacagggacaauuggugcgguuagcuuagacuucucacccgguaccaguggaaguccuauaauagauaagaaaggcaaaguaguagguuuauaugguaacggcgucguuacaagauccggugcuuacguaucugccaucgcccaaacggaaaaaucaaucgaagacaacccagagaucgaggacgacauuuuuaggaagcgaagacuaacaauuauggaucuacauccaggugcaggaaaaacaaaacgauacuuaccggcaauuguacgugaagcuauaaagcguggacuuagaacguuaauacuagcuccuacgcgggucgucgccgcugaaauggaagaagcauugagagguuugccaaucagauaccagacucccgcuauacgcgccgaacauacggguagagaaauaguagaucuaaugugucacgcaacuuuuacuaugcgauuauuaucgccuguuagagucccaaacuauaaucuaauuaucauggacgaagcccauuucacagaccccgcgucuaucgcagcaaggggauacaucaguacacguguugaaaugggcgaggcugcuggaauuuuuaugacggcuacacccccaggauccagagacccauuuccucagucgaaugccccaaucauugaugaggaacgagaaauacccgagcgaucuuggaauaguggccaugaauggguuacggacuucaagggaaaaacuguaugguucguuccuaguauuaaggcagguaacgacauagcagcaugucuuaggaaaaacgggaagaaagucauacaauuaagccgaaaaacauucgacucagaauauguaaagacaaggaccaaugauugggauuucgucguuaccacagacauaucagaaaugggcgcgaauuuuaaggcggaaagaguaauagacccacggcgcuguaugaaaccaguaaucuugaccgauggcgaagaaagagucauucuagccggaccaaugccugugacacauaguucugccgcacaacgaagggggcguauuggacgcaacccuaaaaacgaaaaugaucaauauaucuacaugggagagccacuagaaaaugaugaagauugugcacacuggaaggaagcaaaaaugcuccuagauaacauaaacacacccgaagggauuauaccauccauguuugaacccgagagagagaaagucgaugcgauugacggugaauacagauugaggggagaggcucggaagacauucgucgauuugaugcgaagaggagaucuuccaguuuggcuugcguacaagguagcugcagaaggaaucaauuacgcagaucggcgaugguguuucgacggaaucaaaaauaaccaaauccuugaagaaaacguggagguagagaucuggacgaaggaaggagaaaggaagaaacuuaaaccgaggugguuagaugcucgcaucuacucagauccauuggcauugaaagaauuuaaggaauuugcagcagguagaaaaucguuaacucuuaaucuuauaacagaaaugggacguuuaccuacauucaugacccagaaaacccgagaugcguuagauaaucuagccguccuccauacagccgaggcugguggacgagcauacaaucacgcucucucagaguuaccagaaacuuuagaaacucuccuacuauuaacauuauuggccacugugacaggggguauauuucucuucuuaaugucaggccgggggaucggaaaaaugacucuaggaauguguuguaucauaacagcaucuauucuacucugguaugcacaaauacaaccacauuggauagcugcaucuauaauacucgaauuuuuccugaucguauugcugauuccugaaccagaaaagcaaagaacaccucaagauaaucaguugacauacguaguaauagccauucucacagucgucgcagcaacuauggcaaaugaaaugggauuccuagaaaagacaaagaaagacuuaggucuagggaguauagcaacucaacagccggaaaguaauauccuugauauagaucucaggccggccucugcuuggacacuuuacgccgucgcgacaacauucgugacaccaauguuaagacacucuauagaaaauucauccguuaauguaucacucacagcuauugcaaaccaggcaacuguccuaaugggucuaggaaaaggguggccucuuucaaaaauggauaucggcguucccuuacuagccauaggauguuacagucaagucaauccaauaacacuaacagcggcacuucuauugcuuguagcacacuacgcuauaauuggacccggacuucaagcaaaagcaaccagagaagcacaaaaacgggccgcagccgggaucaugaaaaacccuacaguugacgggauaacagugauugaucuagauccgauuccauacgauccaaaauuugaaaaacaauuaggucaaguuauguugcuuaucuuauguguuacacaaguacuaaugaugagaacaacuugggcucucugugaggcuuuaacauuagcaacagguccgauaaguacacuuugggaaggaaauccaggcaaauuuuggaauacaacuauagcugucagcauggcaaacauauuccgcggcucuuaccuugcaggagcgggauuacuauuuucaauaaugaaaaacacuacaaauacucggcgugggacaggaaacaugggagaaacucuuggagaaaaauggaaaagccgucuaaacacacugggcaaaagcgaauuucaaauauacaagaaaagcgguauucaagaaguagaucguacguuagcgaaagagggaaucaaaaggggcgaaacugaccaucaugcugucucacgaggcagugcaaaacuccguugguucguagaaagaaauaugguaacaccagaaggaaaggugguggacuuagggugugggagaggcggauggagcuauuauuguggagguuuaaagaacgugcgugaagugaagggccuuacuaaaggaggcccaggucaugaagaaccaaucccgaugaguacuuacgguuggaaucuuguacguuuacaaucaggaguugauguuuucuucauuccacccgagaaaugugacacauuauuaugcgacauaggagaaucaucucccaauccaacuguagaagcgggucguaccuugagaguacuaaaccucguagaaaacugguugaauaauaauacccaauuuuguauaaagguacucaaucccuauaugcccucaguaaucgagaaaauggaagcguuacaaagaaaguaugguggcgccuuaguucgaaauccacucagcaggaacucaacucaugagauguacuggguuaguaaugcaucaggaaacauaguaucuucaguaaacaugauuucgaggaugcuuauuaaccgauucacaaugaggcauaagaaagcuacguacgagcccgauguggacuuagggucggguacaagaaauaucggaauagaaagcgaaauaccuaacuuagacaucaucgggaaaaggauagaaaagaucaaacaagaacacgaaacuucuuggcauuaugaccaagaccacccuuacaaaacaugggcguaucacggaucauacgagacaaaacaaacaggaagugcuuccaguauggugaacggcguagugaggcuucucacgaaaccgugggauguacuaccgacugugacacaaauggcaaugacagacacuacuccguucggacaacaaagagucuucaaagaaaaaguugauacaagaacgcaggaacccaaagaaggaacgaagaaauuaaugaaaauaacugcagaauggcucuggaaagaacuuggcaagaagaaaacaccccgaauguguacacgagaagaguucacacgaaaaguaagaucaaacgcagcuuuaggagcaauauuuacugaugaaaauaaauggaaaucagcucgagaagcuguggaagauaguagauucugggaguuaguagacaaggagcggaauuugcaccuagaaggaaaaugugaaacgugcguuuauaauaugaugggcaaaagagagaagaaauuaggcgaauuuggcaaagcaaaaggcagucgugccaucugguauauguggcuaggcgcaagauucuuagaauuugaagcacuagguuuccuaaaugaagaucacugguuuucgcgagagaacucacuaucagguguagaaggugaaggucuacauaaauugggauauauucuaagggauguaagcaagaaagaagggggagcaauguacgcugaugauacagcuggaugggacaccaggauuacauuggaagauuugaaaaacgaagagauggugacaaaucacauggagggagaacacaagaaacuugcagaagcaauuuuuaaacuuaccuaucaaaacaaagucguucgaguucaaagaccaacacccagaggcacugugauggacauaauaagucggagagaucaacgggggucgggacaaguuggcacuuacggauuaaacacauuuaccaauauggaagcacaauuaauaagacaaauggaaggagagggaguuuuuaagaauauacagcauuuaacaguaacugaagaagucgccguacaaaauugguuggcacgaguugggagggaaagauuaagcagaauggcaauaagcggagaugacuguguugugaaaccauuggacgauagguucgcuaaugcgcucacggcauuaaacgacaugggaaagauacgaaaagauauccaacagugggagccaucaaaagguuggaacgacuggacacaaguaccuuuuugcucacaccacuuccaugaacugauaaugaaagauggacgaguauuagugguuccaugcagaaaucaagaugaacucauaggacgugcaaggaucagucagggagcuggcuggucgcuaagagagacagcaugcuuagggaagucguacgcacaaaugugguccuugauguauuuccauaggagagacuugagauuagccgcaaaugcuauaugcuccgcgguaccuucucauuggguaccaacaucacggaccacuugguccauccaugcgaagcaugaauggaugacuaccgaggauaugcucacaguauggaauaggguuuggauacgcgaaaacccuuggauggaggauaaaacuccuguugagaguugggaagaaauaccauaucuagguaaaagagaagaccagugguguggcucucugauaggucuuacaagucgugccacuugggccaaaaauauccaagcugcaauuaaucaagugcggagcuuaaucgggaaugaagaauauacggacuacaugcccuccaugaagagauuucggcgcgaagaggaggaggcuggaguacuuugguaa

SEQ ID NO: 22734 - RNA, 9876 nt, Artificial Sequence
  derived and/or modified CDS sequence (opt6) from DENV-2__EU482651__SS-prME
ucggcagguaugauaauaaugcuaauaccuacugucauggcauuccaccuaacuacucgcaauggagaaccucauaugauagucggcauacaggaaaaaggaaaaagucuucuuuuuaaaacggaggaugguguaaauaugugcacacuaauggcgauggacuugggugaacuaugcgaagauacaauuaccuacaaauguccucuucuacgucaaaaugagcccgaagauauugauugcugguguaacucgacaaguacguggguaacauauggcacauguacaacaacaggagaacauagaagagaaaaacggagugucgcauuggugccccacguaggaaugggauuagaaacccguacagaaacguggaugaguucggaaggagcguggaaacaugcacaaagaaucgaaaccuggauauuaagacacccaggauuuaccauuauggcagcuaucuuagcuuacacgauaggaacaacacacuuucaacggguacuaauauuuaucuuauuaacugccguagccccaucaaugacuaugagauguauuggcauaucgaacagagauuuuguagaagggguaucgggcgggaguuggguagauauaguacuagagcauggaagcuguguaacgacuauggccaaaaauaaaccuacccuagacuucgaacuaauaaaaacggaggcaaaacaaccagccacacuacgaaaauauuguauagaagcgaaauuaacaaauacaacaacugaauccagaugcccgacccaaggugagcccagccuaaaagaagaacaagacaaaagauuugugugcaaacacaguaugguagaccgagggugggguaauggaugcgguuuauucggaaaaggugguaucguaacuugugccauguucaccuguaagaaaaauauggaaggaaaaauaguacaaccugaaaaccuagaguauacaauuguugucacuccucauagcggagaagaacacgcagugggcaaugauaccgguaaacauggaaaagagauaaaagugacaccacaaucaaguauuacagaggcagaacucacagguuacggcacaguaacgauggaauguucgccuagaacgggucuggauuuuaaugaaauggugcuguuacaaauggaaaauaaagcguggcuuguccacagacaaugguuucuagauuugccauuacccuggcugcccggagccgauaaacaggaaagcaacuggauccagaaagaaacauuaguaacauucaaaaacccacacgccaagaaacaagaugucguaguucuuggaagccaagaaggugcaaugcauacggcauuaacuggcgcuacagaaauccaaaugucgagcggaaaucugcuguuuacuggacauuugaaaugccgucuaagaauggauaaacuccaauuaaaaggaauguccuacucuauguguacaggcaaauuuaaaguagucaaagagauagccgaaacacagcauggaacgaucguuauucgcgugcaauaugaaggcgauggaagucccuguaaaauaccauucgagauaauggauuuagagaaaagauauguacuuggccgacuuauaaccguuaauccuauuguaacagaaaaagacuccccgguaaacauagaagccgaaccaccauuuggagacucuuauaucauuauagguguugagccgggucaauugaaacuaaauugguuuaagaaaggaucauccauugggcagauguuugaaacgacgaugagaggagcuaaacguauggcuauuuuaggagauacagcaugggacuuuggaucuuuaggugguguauucaccaguauagguaaggcuuugcaucaggucuucggagcaaucuauggugcggcauuuucuggugucuccuggacaaugaagauacuuauagggguuauuauaacauggauugguaugaacucucgaaguacaagucugucuguuagcuuaguauuggugggcauaguuacuuuauaucucggagucaugguacaagccgauaguggcugcguuguauccuggaagaauaaagagcugaagugcgggucuggaauauucauaacagacaauguccauacauggacugagcaauacaaauuccaaccggaaaguccuucaaaacuggcaagcgcaauccaaaaggcacaagaagaagguaucuguggaauaagaucaguuacucgucuggaaaauuuaauguggaaacaaauuacacccgaauugaaccacauacuugcugagaaugagguuaaacuuaccauuaugacaggagauauaaaaggaauaaugcaagcaggaaaacgguccuuaagaccacaaccgacugaauuaaaauauaguuggaaaacaugggguaaagcuaaaaugcuuaguacggaaagcuauaaucaaacuuuccucauugauggcccggaaacggcggaguguccaaauaccaacagagcguggaacagucuagaaguagaagacuauggguucggagucuuuacuacaaauaucugguuaagacucaaagaaaaacaagacgcauucugugacucaaaauuaaugucugcugccaucaaggauaauagggcggugcaugcggauaugggauacuggauagaaucugcacuaaaugacacguggaaaauagaaaaggcuucguuuauagaagucaaaaacugucauuggccuaaaagccauacguuauggaguaacggaguucuugaaucugaaaugauaauacccaaaaaucuggcuggcccagucucucaacauaacuaucgaccagguuaucauacucaaaucacuggaccguggcaucuugguaaacucgaaauggacuucgauuucugcgacggcaccaccguaauaguuacagaagauuguggcaaccggggaccuucacuaagaacuacgacagccagcgggaaguugauaacagaguggugcugcagaaguuguacucuuccaccgcuuagauaccgaggggaggacggcugcugguacggcauggaaauucgaccacuaaaggagaaagaagaaaaucuugucaacaguuuaguaacggcgggccacggccagguagacaauuuuucucuaggagucuuaggcauggcauuauuuuuagaggaaauguugcgaaccagaguuggcacuaagcaugccauacuauuaguaacgguaaguuuuguaacccuuaucacugggaacaugucauucaaagaucugggcagaguuguuguaaugguaggcgcgacaauggcugacgauauaggaaugggaguaacguauuuagcucugcuagcagcauuuaaaguacguccaacauucgcggcaggauugcuauuacgaaaacuuacuuccaaggaacuaaugaugacaacaauaggaauaguauuauuaucucagaguacgauaccggaaaccgucuuggaacuuacugacgcguuagcccuaggcaugaugguuuugaaaauagucagaaauauggaaaaauaucaacuggcuguaacaauuauggcaauccuuuguguuccuaaugccguaguauuacaaaacgccuggaaaguauccuguacaauauuggccguggucucaguaucgccucugcugcuaacaagcagucaacagaaaacagauuggauaccuuuagcucuuacgauaaaaggacugaauccgacagccauauucuuaacaacuuuaucgagaacaaauaagaaacguaguuggccauuaaaugaagcaauaauggcuguagggaugguuagcauauuagcuucuagccuucuuaaaaaugauauaccgaugacgggaccccuaguugcgggaggcuugcuaacaguauguuacgugcucacagguagaagcgcggaucuagagcuagaacgugcaaccgaugugaaaugggaagaccaagcugaaauaucagggucuuccccaauacugagcaucaccauaucagaggacgguaguaugucuaucaaaaacgaggaagaggaacagacuuugacaauccuuauacguacagguuuauuaguaauaagugguuuguucccaauaaguauaccaauaaccgcggcugcgugguaucuaugggaggucaagaaacagagagccggaguuuugugggauguaccaucgccuccucccaugggcaaagcugaauuggaagauggggcuuaccgcaucaaacaaaaaggaauccucggauauucacagauaggcgccgguguauauaaagaagguacauuucauacaauguggcacguaacucguggagcagugcuaaugcauaaaggaaaacgaauugaaccuuccugggcagaugugaagaaagaccuuaucucguauggaggagguuggaagcuagaaggugaauggaaagagggugaggagguacaaguauuagcauuagaaccuggcaaaaauccaagggcagugcaaaccaagccaggcuuauucaaaacaaacacuggaacaauuggggcugucuccuuagauuuuaguccaggaacaaguggaagucccauaauugacaagaaaggaaagguaguaggccuuuaugguaacggaguagucacuagaaguggcgcuuacguuagugccaucgcgcaaaccgagaagaguauugaagauaauccggagauagaggaugacauauuucguaaaaggagacuaacgaucauggaucuccaucccggagcaggaaagacaaaaagguaucuuccugcaaucguuagggaagccauaaaaagaggcuugagaacgcucauccuugcucccacccgagucguugcggcugagauggaggaagcacuucgagggcucccaaucagguaccaaacaccggcuauaaaagcugaacacacaggacgugagauagucgaucuaaugugccaugcaaccuucacaaugaggcuucugaguccugugagaguucccaacuauaaccuuaucauuauggaugaggcacacuuuacggauccugcaucuaucgcagcaagagguuauauuucaacucgaguugaaaugggcgaagcagcuggaauauucaugacugcaacuccgccaggaucuagagacccauucccccaaagcaaugccccaauuaucgaugaagaacgagaaauaccagagcgaaguuggaacucuggacacgaauggguaaccgauuucaaaggcaagaccguaugguucguaccaucaauaaaagccggaaacgauauagcugcaugucuaagaaagaacggcaagaaaguaauccaacugagccgcaaaacauuugacagugaauauguaaaaacgagaacuaaugauugggacuucguuguuacuacagauaucagcgaaaugggagcaaauuuuaaggcugagagagugaucgacccccgcagauguaugaaaccaguuauacugacggacggugaagaaagggugauacucgcgggaccuaugccgguaacacauaguucugcugcgcagaggagaggaagaauagggaggaauccgaaaaaugaaaaugaucaauauauuuauaugggugaaccauuagaaaacgaugaagauugcgcacauuggaaagaagcuaaaauguugcuagauaauauaaauacuccggaagggauaaucccaagcauguucgaaccugaaagagaaaagguggacgcaauagacggagaauaucguuugcgaggagaagcacgcaaaaccuucguagauuuaaugagacguggagauuuaccaguuuggcucgcguauaagguagcagcagaaggaauuaacuacgcagaccggagguggugcuuugacggaauuaaaaauaaccaaaucuuagaagaaaacgucgaaguugaaauuuggacaaaagaaggagagcgaaagaaacuuaaacccagauggcuagacgcacggauauauagcgauccccuugccuugaaggaguucaaggaauuugcagcagggagaaaaucucuaacacuaaaucuaauaacagagaugggacgacuucccacauuuaugacgcaaaagaccagggaugcacucgacaacuuagcaguauuacacacugcagaagccggaggccgugccuacaaucaugcauugucugagcuaccggaaacauuggaaacccuacuacuacuuacucucuuagcaacagugacaggaggaauuuuucuauuucucaugaguggccgaggaauaggcaaaaugacguuagguauguguuguauuauuacagcaagcauucugcuuugguaugcacagauacagccucacuggaucgccgccaguaucauccuagaguuuuuccuaaucguccuucugauacccgagccugaaaaacaaagaacgccacaagacaaucaauugacauauguugucauagcuauacuaaccguuguagcagcaacaauggcaaaugaaauggguuuccuagagaaaaccaagaaagaucuagggcuagggaguaucgcuacacaacaaccagagucgaauauuuuagauauugacuuaaggcccgcauccgcuuggaccuuauaugcugucgcaaccacguuuguuacucccauguuacgacacagcauugaaaacagcaguguuaacguaucauugacagcaauagcuaaccaagcuacugugcuaaugggguuggggaaggguuggccgcuuucaaaaauggacauugguguuccguuacuagcaauagguugcuauucacagguuaaccccaucaccuugacugcagcauugcucuuacugguggcucauuaugcuauuauaggcccaggacuccaagcuaaagcaacccgcgaagcccaaaagagagccgccgcaggaaucaugaaaaaccccacaguagacggaauaacaguuauagaccuagaucccauuccauaugauccgaaguuugaaaagcaacuuggacagguaauguuauuaauacucugcguaacacaagucuuaaugaugagaaccacgugggccuuaugcgaggcauugacccucgccacggguccgauaucuacgcuaugggaggguaacccaggaagguucuggaacacaacaauagccguauccauggcaaacauauuccgggguucauaucuagccggagcaggacuacuauucuccauaaugaaaaacaccacaaacacacggagagguacaggaaacauaggagaaacgcuaggagaaaaguggaaaucaagguuaaaugcgcuaggaaaaagcgaauuucagauauauaagaaaaguggcauacaagaagucgacaggaccuuggcaaaagaaggcauuaaaagaggagaaacagaucaucacgccguaucucgcggaucugcaaagcugagaugguuugucgaacgaaauaugguaacccccgaagguaagguaguagaucuuggauguggaagaggaggcuggaguuauuacuguggcggucucaaaaacgucagagaggugaaagggcucacgaaaggaggaccaggacaugaagaaccaauuccaaugucaacguauggcuggaaucuaguacgacuacagagcggaguggaugucuucuuuauuccaccggaaaagugcgacacacuguugugugauaucggagaaaguuccccuaauccuacuguagaggcaggcagaacguugagaguccugaaccuaguggagaauugguuaaauaauaacacacaauucugcauaaaggugcuuaaccccuauaugccguccgucauagaaaagauggaggcacuccaaagaaaguacgggggagcucucgucagaaacccguuaucaagaaauuccacccaugagauguauuggguaagcaaugcuaguggcaauauuguuaguagcguaaacaugauaucuaggaugcuaaucaauagauuuaccaugaggcacaagaaagcaacuuacgagccugacgucgaccucgggagugggacuaggaacaucggcauagagucggagauacccaaucuagauauuauugguaaacguauagaaaagauaaagcaggagcacgaaaccucguggcacuacgaccaagaucacccuuacaaaaccugggccuaccauggaucauaugaaacuaagcagacagggucagccaguucaaugguaaacggagucgugaggcuauugaccaaaccaugggauguacuaccuacaguuacucagauggcaaugacagacaccacaccauucggacaacaacguguuuuuaaggaaaagguagacacgagaacucaagagccgaaggaagggacuaagaaacuaaugaaaauuaccgcggaaugguuguggaaagaauuggggaaaaagaaaacaccgaggauguguacacgugaagaguucaccaggaaagugagaaguaaugccgcauuaggcgcaaucuuuacugaugaaaacaaauggaaaucugcuagagaagcugucgaagauaguagauuuugggaauuaguagauaaagaacguaaucuucacuuagaaggaaaaugcgaaacaugugucuauaauaugaugggaaaaagagaaaagaaacuuggagaauuuggaaaagccaaagguucucgagcuauaugguauaugugguuaggagcucgauuuuuggaauuugaggcuuuaggauuccuaaacgaagaccacugguuuucgagagaaaauagucuaucaggcguggaaggagaagguuuacauaaacuagguuacauccuacgagacgugagcaagaaagaagguggagcaauguaugcagaugauacagcugggugggauacgagaauaacauuggaagauuuaaagaaugaggagaugguuacaaaccacauggagggagaacauaagaaauuagcagaggcuauuuuuaaauuaacuuaucaaaauaagguuguucgaguacagagaccuacaccucgaggaacaguaauggauauaauaagccgacgugaccagagggggucgggacaaguggggaccuacggacuaaauacguucaccaauauggaagcucaacugauacgucagauggaaggugaagguguuuucaagaauauacaacauuuaacagugaccgaggaaguugcaguacagaacuggcuugcucgcguaggcagagaaagacugagucgcauggcaauuagcggggaugacugcguuguaaaaccucucgaugauagauucgcaaacgcccuaaccgcacuuaaugauaugggcaaaauaagaaaagacauacaacagugggagccuaguaagggcuggaaugacuggacacagguaccuuucuguagucaucauuuccacgaacuaauaaugaaagauggucguguauugguaguacccuguagaaaucaagacgaacuaauuggucgagcucgaauaagccaaggcgcgggauggagcuuacgagaaacagccugcuuagguaaaaguuaugcucagauguggagucuaauguauuuccacagacgagaucuccgacuagcugcaaaugcaauauguucggcaguaccaucacauuggguuccgacaagucgaacaacuuggucuauccacgcuaaacaugaauggaugacaacggaagauaugcuuaccguguggaacagaguauggauaagagaaaacccauggauggaggauaaaacacccguagaaagcugggaggaaauuccuuaccuuggcaaaagagaagaccagugguguggcucgcuaaucgguuuaacaucacgagcaaccugggccaagaauauucaagccgccaucaaccaagucagaucauuaauaggaaaugaagaauauacugacuacaugcccaguaugaaaagauuucggcgggaagaggaagaggcaggcgugcugugguga

SEQ ID NO: 22735 - RNA, 9876 nt, Artificial Sequence
  derived and/or modified CDS sequence (opt6) from DENV-2__EU482652__SS-prME
ucagcagggaugauaauaauguuaauacccaccgugauggcuuuucauuuaacaacucgaaacggugaaccucacaugauaguagguauccaagaaaaagguaaaucucuauuauuuaaaacggaagaugguguuaacaugugcacacuaauggcuauggacuuaggagaacuaugugaagauaccauuaccuauaaaugucccuuauugcgacaaaacgagccugaagauaucgacugcugguguaacagcacuuccacauggguaacuuaugguacguguacaacgacuggggaacaucggagagaaaaacgcucuguagccuuaguaccgcacgucgggaugggacucgaaacgagaacggaaacauggauguccuccgagggugcauggaaacaugcacaaagaauagaaacauggauccuacgacaccccggauuuacuaucauggcugcaauuuuagcguacacaauugguacaacacauuuccaacguguccuuauuuucaucuuacuuacagcuguggcaccauccaugaccaugagauguauaggaauaucuaacagggacuuuguagaggggguuaguggagguagcuggguggauauaguccucgaacacgggucguguguaacuacaauggccaaaaauaaaccuaccuuagacuuugaacuaauuaaaacugaagccaaacaaccagcaacucucaggaaauauuguauagaagcaaaacucacgaauaccacuacggaaaguagauguccaacacaaggagaaccgagccugaaagaagaacaagauaaacguuuugucuguaaacauagcaugguagauagaggcuggggaaauggaugcgguuuauucggaaaaggaggcauagucacaugcgcaauguuuacuuguaagaaaaauauggaaggcaaaauugugcaaccagagaauuuagaguacacaaucguagucaccccucauaguggcgaggaacaugcaguugguaacgacacagggaaacauggucaagagauaaaaguaacuccucaaucaucaaucacagaagccgaauuaacaggauacggcacaguuacaauggaaugcucaccgcguacaggauuggauuuuaacgaaaugguuuuauuacaaauggaaaauaaagcaugguugguucaucgacagugguuccuggacuuaccauugccaugguugccaggagcagauaaacaagaaagcaauuggauccaaaaagaaacccuaguaacguuuaaaaauccgcaugcuaagaaacaggaugugguaguacucggaagccaagaaggagcaaugcauacagcauugacuggggccaccgagauacaaaugucgucgggaaaucuauuauuuacuggucaccuaaaauguagauuaagaauggacaaauuacaacugaaagguaugucauacagccuaugcacaggaaaauuuaaaguagugaaagaaauagcugaaacacaacacgguacuauuguuauaagaguccaauaugagggugauggaagucccuguaagauaccuuuugaaauaauggaccuugagaaaagguauguuuuagggagauuaauuacaguaaaccccauuguuacagaaaaggacucgcccguaaauauagaagcggagccacccuucggagauuccuauauuauuauaggcguagaaccugggcaguugaaauuaaauugguuuaaaaaggguagcagcauagggcaaauguucgaaacuacuaugagaggagcaaaaagaauggcaauucucggagacacggcaugggauuuugguucucuaggcggaguuuucacguccauaggaaaggcucugcaccaagucuucggcgcuauauacggagcggcguucuccggaguaagcuggacaaugaaaaucuuaauaggaguaauaaucacguggauuggcaugaacucacguagcacgucauugaguguaucauuaguacugguaggcauagucacacuauauuuaggagucaugguucaggcugacucuggauguguuguuagcuggaaaaauaaggagcuaaaaugcggaucaggaauuuuuaucacagauaacguacacaccuggacagagcaauauaaauuucagccagaaaguccaucaaagcuagcgagcgcaauacaaaaagcucaagaggaaggaaucuguggaauaagaucaguuacacggcuugagaaucuaauguggaagcaaauuacgccugagcuaaaccacaucuuggcagaaaaugaagugaaacuuacaaucaugaccggggacauaaaaggaauuaugcaagcuggaaaacggagccuaagaccacaaccuacggaauugaaauauucauggaaaacaugggggaaagcuaagauguuauccacggaaagcuauaaucaaacuuucuuaauugacggucccgaaacugcagagugcccuaauacaaauagagcguggaauagcuuagaagucgaagauuauggauuuggaguguuuacaacuaauauuuggcuaaaacuaaaagagaaacaagacgcuuucugcgauucgaaguuaaugagugcugccauaaaagauaaccgcgcaguacaugcagacauggguuauuggauagaaucagcucuaaaugacaccuggaaaauugaaaaagcauccuuuaucgaagucaaaaauugucauuggccaaaaagucauacauuguggucuaauggaguauuagagagugaaaugauuauaccaaagaaccucgcgggaccaguuagucagcauaauuauagaccgggauaccacacacagauugcugguccuuggcaccuggggaaguuagaaauggacuucgacuuuugcgacgggacgacaguaaucgucaccgaagauuguggaaacagagguccaucauugcguaccacuacagcaagcgggaaauuaaucacggaaugguguugucgaaguuguacauugccaccacuucguuaccguggcgaggauggaugcugguauggaauggaaauaaggccauuaaaagagaaggaagaaaaccucguuaauagucugguuacugcugggcauggccaaguggauaauuuuucacuaggaguacugggaauggcucuguuuuuggaagaaauguugcgaacucgugugggaacuaaacaugcaauacuuuugguggcaguuuccuuugugaccuuaaucacgggaaauaugucuuucaaagaucuuggucggguggucgugauggucggggcgacuaugacugaugacauaggaaugggaguaacauaccuugcacuacuagcagcuuucaaagucagacccacuuucgcugccggguuacuccucagaaaacucacaucaaaagaacuuaugaugacaacaauuggcauuguacuucuaucccagagcgcaauaccugaaacaguguuagaacuuacggaugcccucgcacuuggaaugauggugcuuaaaaucguuaggaauauggaaaaguaucaauuagcugucaccauuauggcuauucugugcguccccaacgcaguaauacuucaaaacgcuuggaagguuagcuguacgauacuagcaguagucucuguuucuccucuucuguuaacaaguagucaacagaaaacugacuggauaccgcuagcguugacaauaaaagguuuaaauccaaccgcuaucuuuuugacaacauugucuaggacuaauaagaagcgaucguggccacuuaacgaggcaauaauggcgguaggaaugguaagcauauuagcaagcagcuuacuuaaaaaugacauaccaaugacgggaccccuagucgcaggcggacucuuaaccguauguuacgugcuaacaggccgaucagcagaucuggaauuagaaagggccaccgacgucaagugggaagaucaagcugagauaagcgguaguuccccuauucucucuauaacuauaucagaagaugguaguaugagcaucaaaaaugaagaggaagaacagacucuuacgauauugauucggacaggacuauuaguaauaucuggauuauuuccgauaucaauuccuauuacugccgcagcgugguacuugugggaagucaagaaacagagggccgguguuuugugggacgugccaagcccaccacccauggguaaagccgaauuagaagacggagcuuaucgcauaaagcaaaaaggcauccuagguuauagucaaauaggugcgggcguauauaaagaagguacguuccauacuauguggcacgucacaagaggugcaguccuaaugcauaagggaaagagaauugaaccuagcugggcugacgucaagaaagauuuaauuucauacggagguggauggaaacuugagggugaauggaaagaaggagaagaaguacaaguguuagcauuagaaccuggcaaaaauccaagagcaguucaaacuaaacccggcuuauuuaagacgaauacuggcacaauaggugccguaucauuagauuuuaguccuggaacgucgggauccccuauuauugauaagaaaggaaaaguuguaggauuauacggaaauggaguagucacaagaucuggagcauacguaucagcgauagcgcaaaccgaaaaaucgauagaagauaauccagaaauugaagaugauauuuucagaaagaggagacuaacaauuauggaucuucauccaggagcgggaaaaaccaaacguuaucuaccagcgauuguuagggaagcuauaaaaagaggcuuaaggacauuaauuuuggcuccaacccgcgugguugcggccgaaauggaggaggcauuaagaggacuaccgauuagguaccagacuccugcaauccgagcagagcacacaggaagggaaauaguagaccucaugugucacgcaaccuuuacuaugcgucugcuuaguccaguacguguaccaaauuauaauuuaauaauaauggaugaagcacauuuuacagauccagccaguauagcagcgcgaggcuauauuuccacucggguugagaugggagaagcugcaggaauauuuaugacagcuacgccuccugguucaagagauccuuuuccacaaucuaaugccccaaucauagaugaagaacgagaaauuccugaacguucguggaacucgggacaugaauggguaacagauuuuaaaggaaaaacaguaugguucguccccucuauaaaagccgguaacgauaucgccgcaugccugagaaagaauggcaagaaaguuauacaauuaagucggaaaacauuugacagugaauauguuaaaacccgaaccaaugauugggauuuugucguuacaaccgacauauccgagaugggugcaaacuucaaggcugaaagaguaauugacccgaggagauguaugaaaccagucauccuuacagacggcgaggaacgaguaauccuagcaggacccaugccaguaacgcacucaagugcagcacaacgacgaggaagaaucgggagaaacccaaagaaugaaaacgaccaauacauauauaugggugagccacuggaaaaugaugaagacugugcgcauuggaaagaggccaagauguuguuagauaauauaaauaccccagaagguauuauuccgaguauguucgagccugaaagagaaaagguugaugcaauugacggagaauaccgccuccggggugaagcaaggaagaccuuugucgacuuaaugagacgcggggaccugccagugugguuagcauauaaaguugcggcagaagggauaaauuacgcugauagaagaugguguuuugaugggaucaaaaauaaucaaauuuuagaggaaaacguggaaguagaaaucuggacaaaggaaggggagaggaagaaauuaaaacccagguggcuugacgcucggauauacagcgauccucucgcccuaaaagaguuuaaagaauuugcagcggggaggaaauccuugacauugaaccuuauaacugaaaugggaagacucccuacguucaugacacagaaaacacgagacgcccuagacaaucuugcuguacuucauacagcagaagcugguggaagggcauauaaucacgcuuuaucugaacucccagagacccuagaaacuuuguuacugcucacccuucuggcuacaguuacugggggaaucuuccuuuuccuaaugucaggcagggggauuggaaaaaugacccuggguaugugcugcauuauuacagcuagcacacuauuaugguaugcucagauacaaccccacuggauagcagcuucuauaauccuagaguucuuucuaauaguucugcucauacccgaaccugaaaaacaaaggacgccucaagauaaucaauugacuuacgugguaauagcaauuuuaacgguagucgcagcgaccauggcaaaugaaaugggguuuuuagagaaaaccaagaaagauuuaggacucgguucuauagccacccagcaaccagaaaguaauauucuugacauugaucuucgacccgcuagcgcauggacauuauaugccguggcaacuacuuuugugaccccuaugcuuaggcauucgauugaaaacaguagcguaaacgucucucuaacagcaauugcaaaccaagcaacaguacuaauggguuugggaaaaggcuggccuuuaucuaaaauggauaucgguguaccauugcucgcuauaggauguuauagucaagugaauccaaucacacucacugccgcuuuacuucuuuuaguagcacacuacgcuauuauuggccccggacuacaagcaaaagcaacucgggaagcgcaaaaacgugcggccgccgguaucaugaaaaacccaacuguagaugggauuaccgugauagauuuggauccaaucccuuaugacccaaaauucgaaaaacagcuaggccagguuaugcuguuaauuuuauguguaacccaaguacuaaugaugaggacaaccugggcacucugugaggcuuuaacauuggccacuggaccaauaagcacucuuugggaagggaauccuggaagauuuuggaauaccacaauugcuguaucgauggcaaauauauuucgaggaucuuaucuugcaggcgccggccuauuauucucuauaaugaagaacaccacuaauacaaggcgcgguaccggaaacaugggcgagacucugggcgagaaauggaaaagcagguuaaacgcacuuggaaaaagugaauuucagauauauaagaaaagugguauccaagaaguugauagaacuuuggcaaaagaagguauaaaaagaggagagacagaucaccacgcaguaaguagagguagugccaagcugcguugguuugucgaacgaaauauggucacaccagaaggaaaagugguugaucuagguuguggccgagguggcuggucauacuauuguggggguuugaaaaacgucagagaagugaaggggcugacaaaagguggcccaggucaugaagaaccgauaccaaugucaacauauggcuggaacuuaguccgguuacaaucuggggucgacguguucuuuaucccacccgaaaagugugauacuuuacuaugugauauaggagagucgucaccuaauccaacuguagaagcgggacgaacauuaaggguauuaaauuuaguugaaaauuggcuaaacaauaacacucaauuuuguaucaaagugcuuaauccuuauaugccgucuguuaucgagaaaauggaggcacuucagagaaaauauggaggggcccucguccggaauccauuaucuagaaauaguacccaugaaauguacuggguuucgaacgcuaguggaaacauaguaucaaguguaaauaugauaagccguauguuaauuaaucgguucacuaugcgccacaagaaagcgacguaugaaccagacguagaucuugggagugggacacgaaauaucggaauugaaagcgaaauuccuaaccucgacaucaucggcaagagaauugagaaaauuaaacaagaacaugaaacaaguuggcauuaugaucaggaccacccguauaaaaccugggcuuaucacgguaguuaugaaacgaaacaaaccggaagugcaucuucuauggugaauggagugguaagauuguugaccaagccaugggacguuuuaccaaccgugacgcaaauggcuaugacagacacaacaccauuuggccaacagaggguuuuuaaagaaaaagucgauacccggacacaagaaccuaaggaaggaacuaagaaauugaugaagauaacugcugaguggcuauggaaagaauuaggcaagaagaaaaccccaagaaugugcacgagagaagaguucacuaggaaaguucguucuaaugcugcucugggagcuauauuuacugacgaaaauaaauggaaaagugcgcgagaagcuguagaggauucucguuuuugggagcucguggacaaggaacgaaacuuacauuuggaggguaaaugugaaacuuguguauauaacaugaugggcaagagagagaagaaacucggagaauuuggaaaagccaaagguucgagagccauaugguauauguggcuaggcgcccguuuccuagaauuugaggccuuaggguuucuuaacgaggaccacugguuuaguagggaaaacucucuauccggaguggaaggggaagggcuacauaaacuaggauacauacuacgggacguaaguaagaaagaaggaggugcaauguaugccgaugacaccgcaggaugggacacaaggauuacacuggaagaucuaaagaaugaagaaaugguaaccaaccauauggaaggugaacauaagaaauuagccgaggccaucuucaaacuuacauaccaaaacaaaguggugagaguucaaagaccaacaccgagaggcaccguuauggauauaauaucgaggcgugaccagcgugguucgggacaaguuggcacauacggccuaaacacguuuacgaauauggaagcucaauugauucggcaaauggaaggugagggaguuuucaaaaauauccaacaucuuacuguaacugaagaaguagcugucaaaaacuggcuagcgcgagugggccgggaaagacuaucccgaauggcgauuagcggggacgauugcgucguaaaaccauuagacgaccgauuugcuaaugcacuuacagcacuaaaugauaugggcaaaauaagaaaagauauucaacagugggaaccaucaaaagguuggaacgacuggacucaagucccauuuugcagccaucauuuucacgagcuaauuaugaaagauggaagagugcucgucguacccugcaggaaccaagaugagcuaaucgggcgagcucguaucagucaaggugcaggcuggucucuacgagaaacggcaugucuugguaaaucauaugcacaaauguggucauuaauguauuuucauagacgcgaucuucgucuugcagcgaaugcgauaugcagcgcaguaccgagucauuggguaccaacaagcaggacaacauggagcauacaugcaaaacaugaauggaugacaacggaggauaugcuaacuguauggaauagaguauggauaagagaaaauccauggauggaagacaaaacgccaguugagaguugggaagaaauuccuuaccucggaaaaagagaagaccaauggugcggcucuuuaauuggauuaacaucucgcgcgaccugggccaaaaacauacaagcugcuauaaaccagguuagaucguuaauagggaaugaagaguaugccgauuauaugccaaguaugaagagauuucgcagggaagaagaggaggcaggaguuuuaugguaa

SEQ ID NO: 22736 - RNA, 9876 nt, Artificial Sequence
  derived and/or modified CDS sequence (opt6) from DENV-2__EU482653__SS-prME
ucagcagggaugauaauuauguuaauaccgacaguaauggcauuccauuuaacaacacgaaauggcgaaccucauaugauagugggaauccaagaaaaagguaaaucgcuacuauuuaaaacugaagacggaguaaauauguguacacugauggcuauggauuuaggggaacugugugaagacacaauaacguacaaauguccacuacuaagacaaaacgaaccagaagauauugauuguugguguaauucaacgucuacauggguaacauaugggacauguacgacaacgggagaacacagaagggaaaaacgaucuguggccuuaguaccacauguaggaaugggguuagaaacaagaaccgaaacuuggauguccuccgaaggggccuggaaacaugcgcaaaggauagaaacuuggauuuuaagacacccaggauuuacaauaauggcggcaauuuuagccuauaccaucggcacuacgcacuuucaaagaguucuuauauucauauuauugacagcaguggcacccuccaugaccaugcgcugcauaggaauaucuaaccgagacuuuguugaagguguaucagguggaagcuggguggauauaguguuagagcacgguuccugcgugacuacuauggcuaaaaauaaaccuacacuagauuucgaacugaucaaaacagaggccaaacaaccggcaacacuaagaaaauacugcauugaagcaaaacugacuaauacuaccacggaaucacgcugucccacccagggagaacccucauuaaaagaagaacaagauaaacguuucguguguaaacauucaaugguagacagggguugggguaaugguugcggucuguuuggaaaaggggguauuguaacaugcgcgauguucacuuguaagaaaaacauggaaggcaaaauaguacaaccagaaaaucuugaguauacaauaguuguuacuccccauucaggagaagaacaugcagucggaaacgauaccggaaaacacggaaaagaaauaaaaguaaccccucagucuaguaucacugaagcagaacucacaggguauggaacugucacaauggagugcucgccgagaacuggucuggacuuuaaugaaauggucuuacuccaaauggagaacaaagccuggcuuguacacagacaaugguuccuugacuugccauuaccuuggcugccgggugcugacaaacaggagaguaauuggauacaaaaagagacacuugucaccuucaaaaauccucacgcuaagaaacaagauguuguaguacucgguucucaagagggugcaaugcacaccgcauugacgggugcgaccgaaauucaaaugaguaguggcaaucuauuauuuacgggccaccucaaaugccgcuuacggauggauaaacuacaacuaaaaggcaugucauacaguaugugcacaggaaaauuuaaaguagugaaagaaaucgcagaaacccagcauggaacuauaguaauaagaguacaauaugaaggcgacggaaguccauguaaaauuccuuuugagauaauggaccuagagaaaagauauguucuaggucgauugauaacggucaauccuauagugacagaaaaagauaguccaguaaacauugaagcugaaccuccuuuuggagacaguuauauuauaauaggcguagaaccaggacaguuaaaauuaaacugguuuaagaaaggauccaguauuggccaaauguuugagacuacaaugcguggugcaaaaagaauggcaauacuaggggauacagccugggauuuugggucgcuaggugguguauucacauccauugguaaagccuugcaccaaguguucggagcuaucuacggagcggccuuuucagguguuucauggacaaugaaaauauugauaggagucaucauuacauggauaggaaugaauaguagaaguacaagucuaaguguaucauugguauuaguuggaauuguaacccuuuauuuaggagucaugguacaggcugauagugggugcgugguuucauggaaaaacaaagaacuaaaauguggcaguggaauauucgucacagacaacguacacaccuggacagagcaauauaaauuucaacccgaaagccccaguaaacucgcaucggcuauacaaaaagcgcaggaagagggcaucugcggaauaagaucuguuacaaggcuugagaaccugauguggaaacaaauuacaccagaacugaaccauauccucgcggaaaaugaggugaaacugacgauaaugacaggggacauaaaaggaauuaugcaagcagguaagcgcagccugcgaccucaacccacugaacugaaauauucauggaaaaccugggguaaagcuaaaaugcuuucuacugaaucgcacaaccaaacuuucuugauagacgguccagaaacugcggaauguccgaauacaaaccgagcuuggaacaguuuagaaguggaagacuauggauuugguguuuucaccaccaauauuugguugagacugaaggaaaagcaggaugccuucugugauucuaaauuaaugucagcugcaaucaaagacaauagagcgguucaugcagacaugggauacuggauugaaagugcucuuaacgauacuuggaagauagagaaggccaguuucauugaagucaaaaauugccauuggcccaaaagucacacucuguggagcaacgguguucuagaaagcgaaaugaucaucccuaagaaucucgcagguccuguaucacaacauaacuacagaccaggauaucacacacaaauagcagggccauggcauuugggaaaauuggagauggauuuugacuucugugacggaacaacaguaauaguaacagaagauugcgggaauagaggaccaagccuacgcacgacuacugcuuccgggaagcuaauuacugaauggugcugucggagcugcacacucccuccgcuacgauaucgaggagaggacgguuguugguauggcauggaaauucgaccccugaaagaaaaagaggaaaauuugguaaacucuuuaguaacagccggucaugggcaagucgauaacuucucguuaggaguauuaggaauggcacuguuuuuagaagagauguuacgaacgagaguaggaacuaagcaugccauacuacuuguggccguuaguuuuguuacguuaauaacagggaauaugaguuuuaaagaucuaggacggguagucguaaugguuggagcaacuauggcugacgauauaggaaugggcgucacauaucuugcccuauuagcugcguuuaaaguccgaccaacauuugccgcaggacuucuccuccggaaguugaccucgaaagaacuuaugaugacaaccauaggaaucguacugcuaucacaaucaacaauucccgaaaccguacuagaauuaacggacgcucucgccuuaggcaugaugguacucaaaauuguaagaaauauggaaaaauaucaacuagcuguaacaauaauggcaauauugugcgugccuaacgccguaaucuuacaaaaugcauggaagguuaguuguacaauauuagcuguuguuaguguuucaccacuccuacuuacgaguagucaacagaaaacggacuggauaccauuagcauuaacaauaaaaggccuuaauccaacagcgauauuuuuaacaacuuuaucaagaacgaacaagaaacgaucguggcccuuaaaugaggcaaucauggcggucggaaugguaucaauccuugcguccucacuacucaaaaaugacauacccaugacugguccucuaguagcagggggauuacugacgguuugcuaugugcuaacgggucgaagugcugacuuagagcuugaacgagccacagacguuaaaugggaagaucaagccgagauaaguggaucaucaccaauccuaucaauaaccauuucagaagauggaucaaugucuauuaaaaacgaagaagaggaacaaacccuuacuauacuaauaagaaccgguuuauuagucaucucuggucuuuucccuauaaguaucccaaucacugcagcugccugguauuugugggaagucaagaaacagagagcugguguucuaugggacguaccuuccccaccuccaauggguaaagcagaguuggaagacggugcuuauagaauuaaacagaaaggaauuuuuggauauucacaaauaggcgcuggagucuacaaagaaggaacauuucacacaauguggcacguaacaagaggcgcuguuuuaaugcauaaagggaaacgaaucgagccaucuugggcagacguuaagaaagaucuaauuucguauggagggggcuggaaauuagagggagaauggaaggaaggugaagagguucagguccuagcacucgagccagggaagaaucccagagccguacaaacaaaaccuggucucuucaaaacuaacacagguacuaucggagcuguaucacuagacuuuaguccuggaacgucuggaucgccaauaauagauaagaaaggaaaagucgugggacuauacggcaacggugucgucacacgaucaggugcauacguguccgcuauagcucaaaccgagaaaaguauagaggauaauccggaaauugaagacgacaucuuucgaaaacgccgacuuacuauaauggaucuccauccuggugcagguaaaacaaagcguuaucuuccagcgauuguccgagaggcaauaaaacgaggcuugcgaacacuuauucuagcgccaacacgugucguggcggcggagauggaagaagcauuaagagggcucccuauuagguaucagacaccagcaauucgugcugaacauacugguagagaaauugucgaccuaaugugucaugccacauuuacaaugagauuacuaaguccaguacgagugccgaauuauaaucuuauaaucauggaugaggcccauuucacagacccagcaucgauagcagccagagguuauauuaguacaaggguagaaaugggggaagcugccgguauauucaugacagcaacaccuccaggaucuagagauccauucccgcaaucuaacgcuccuauaauugaugaggagcgugagauuccagagcgauccuggaacucaggucacgagugggucacugauuuuaaagguaagacagucugguuuguuccuaguauaaaagcuggaaacgauauagcagcgugucuaaggaaaaaugggaagaaaguaauccaacuaagucgaaaaacauuugacuccgaguacguaaaaacaagaacaaaugauugggacuuugugguaacaacagauauaagugagaugggugcgaacuuuaaagccgaacgaguaauugauccucguagguguaugaaaccugucauacuaacugacggcgaagagagagucauucucgccggcccaaugccugucacacauucaucugccgcccagagacgaggccgcauagggaggaacccuaaaaacgaaaaugaccaguauauauauaugggggagcccuuagaaaaugaugaggacugcgcacauuggaaagaagcgaaaaugcugcuugacaacaucaauacaccggaggguauaauaccaagcauguuugagccagagagagaaaaaguagaugcaauugacggcgaauacagacuccguggcgaagcgagaaaaacuuuuguagaccuuaugcggagaggugacuuaccuguuuggcucgcuuacaaaguagcagcagagggaauaaauuacgcagauagaagguggugcuucgacgguauuaaaaauaaucaaauccuagaagagaacguagagguggaaauauggacuaaggaaggcgaacgcaagaaacucaaaccucgauggcuugaugcgaggauuuauagugacccgcuugcccugaaggaguucaaagaauuugcagcaggccgaaaaucuuugacacuaaauuuaaucacugaaauggggcgucuuccaacuuuuaugacacagaagacaagagacgcccuagacaauuuagcuguauuacauacagcagaagcaggcggucgagcuuauaaucaugcacuaagugaauuaccugaaacauuagaaacuuuauuacuuuuaacucuacucgcaacagugaccggaggcauauuccuauuccugaugaguggucgaggaaucggaaagaugacuuuaggaauguguuguauuauaaccgcaucaauucuccuaugguacgcacaaauacaaccgcauuggauagcagccaguaucauauuggaguucuuccucaucgugcuuuuaauaccggaaccagaaaaacaaagaacaccacaggacaaucaauugacuuaugucguuauagccauccucacugucguugcggcaacuauggcgaaugaaauggguuuucuggagaaaaccaagaaagaucucggacuaggguccaucgccacgcaacaaccagaaaguaacauauuagauaucgauuuacgucccgcuucugcauggacacuguacgcuguggccaccaccuucgucacgccaauguuaagacauucaauagaaaauagcaguguuaauguuuccuuaaccgcgaucgcaaaucaagcaacaguccuaaugggacucgggaaggguuggccacuuaguaagauggauaucggcgugccauuauuggccauaggcuguuauucucaaguaaacccuauaacacuuaccgccgcauuacuacuacucguugcacacuacgcgauaauagguccaggguuacaagccaaagcaacacgggaagcucagaaaagggcagcggcaggaauaaugaaaaacccaaccguggauggaaucacuguuauugauuuagauccaaucccguaugauccgaaauucgaaaaacaguuaggacaaguaaugcuauugauccuauguguaacccaaguccucaugaugcgaacaacaugggcguugugugaagcacuaacacuagcgacaggaccgauaucaacauuaugggaaggaaauccugguagauuuuggaauacaacuauugcagucaguauggcaaacaucuuccguggcaguuaucuugcaggcgcaggacuauuauuuucgaucaugaaaaauacaacgaaugcucggcguggcacagguaauaugggugagacuuuaggagaaaaguggaaaucacgcuugaaugcuuuggguaaauccgaauuucaaauauacaagaaaaguggaauacaggaaguagacagaacguuagcuaaagaaggaauaaaaaggggagaaacggaccaucacgcaguaucacgagguucugcaaaguuacgcugguuuguugagcgaaauaugguaacaccagaagggaaagucguagaccuagggugugguagggguggguggagcuauuauugcggaggacuaaagaauguuagagaaguuaaggguuuaaccaagggagguccaggacaugaagaacccaucccaaugaguacauauggauggaacuugguuagauuacaauccgggguugauguuuucuucauuccaccugaaaagugugauacacuguuaugugacauuggggaaucgaguccuaacccgacuguagaagcugguagaacacuacgagucuugaaucuaguagaaaauuggcuaaauaacaauacccaguuuugcauaaagguacuaaaccccuauaugcccuccguaauagagaaaauggaggcauuacaacgcaaauacggaggugcauuggugagaaauccccuaagccgcaauucuacgcacgaaauguacuggguaaguaaugcgucagguaauauaguuagcucugucaauaugauuucccguaugcugauaaacagauucacgaugcgacauaagaaagccacguacgagccagacgucgaucuagguucuggcaccagaaacauuggcauugaauccgaaauaccuaaccuagauauaaucggcaagcgcauugaaaagauuaaacaagaacaugaaacgucguggcauuaugaucaagaucauccguacaagacaugggcuuaccacgguaguuacgaaacgaaacaaacaggcucugcaucaucaaugguuaaugguguaguaagacuuuuaacgaagcccugggauguucuaccuaccguaacccaaauggcuaugaccgauaccacuccauuuggacagcaacgaguguucaaggagaagguagauacgcgaacucaagagccaaaggaaggaacgaagaaacuaaugaagauuacagcugaaugguuauggaaagaauuggggaagaagaaaacgccuagaauguguacacgagaagaguucaccagaaaagucagaucuaaugcagcauuaggcgcaauauucacugaugaaaauaaauggaaaucugcuagagaagcgguugaggacaguagguuuugggaacuuguugacaaggagagaaauuuacauuuagaaggcaaaugugaaacuuguguauauaauaugauggggaaaagagagaagaaauuaggugaguucgguaaagcaaaagguagccgagcaauuugguauaugugguugggggcuagauuuuuagaguucgaggcuuugggauuccuaaacgaggaccacugguucucuagagaaaauucguuguccggggucgaaggggaagggcuacauaaauugggguauaucuuaagagauguuucgaagaaagaggguggugcaauguaugccgacgauacugccggaugggacacaagaauaacauuggaagaccuuaaaaaugaagaaaugguuacaaaucacauggagggggaacauaagaaacuagcagaagcaauauuuaaauuaacguaccaaaauaaaguaguccgagugcaaagaccaacgccccgcggcacugucauggauauaaucucgagaagggaucaaagaggcucaggucaaguggggaccuauggccuuaacacuuucacuaauauggaagcucaauuaauaaggcagauggaaggcgaagguguauuuaagaauauucaacaucucacugugacagaagaaguagcgguucagaacuggcucgcccgagucggacgugaaagauugucaagaauggcuauuagcggagaugacugugugguuaaaccauuggaugauagguucgcgaacgcguuaacagcauuaaacgauaugggaaagauacgaaaggauauucaacaaugggaacccagcaagggauggaacgacuggacgcaaguaccauuuugcucccaucauuuccacgaacuuauaaugaaagaugggcgaguacucgugguuccauguaggaaucaagaugaacuaaucgguagggcaagaauaucacagggugcaggguggaguuuaagagaaacugcuugccucgguaagucauaugcccaaauguggucauuaauguacuuucaucguagagaccuacgcuuagcagcgaacgccauaugcucggcaguaccaagccauugggugccaacgaguagaacgacuuggagcauucacgcuaaacaugaauggaugacuacagaagauauguuaacaguauggaacagaguauggauuagggaaaauccauggauggaggacaaaacuccaguugagucaugggaggagauaccauauuuaggcaaaagagaagaccaauggugcgguagcuuaaucggccuuacaucaagagcuacaugggccaaaaauauucaggcggcaauaaaucagguccguucuuuaauaggaaaugaggaguauacagauuacaugcccucaaugaaaagauuuaggagagaagaagaggaagcaggcguauuaugguaa

SEQ ID NO: 22737 - RNA, 9876 nt, Artificial Sequence
  derived and/or modified CDS sequence (opt6) from DENV-2__EU482654__SS-prME
ucagccgguaugauaauaaugcuaauaccaacaguaauggcuuuucaccuuacaacaaggaauggagaaccacauaugauaguggguauucaagagaaaggaaaaucucuucuauuuaaaacugaagacggaguuaacaugugcacucuaauggcaauggacuugggugaacuaugcgaagacacuauuaccuauaaauguccguuguuacgacaaaacgaaccagaggauauagauuguugguguaauucaacaucuacaugggucaccuauggaacgugcacuacaacaggagagcauaggagagagaaaagaucaguagccuugguaccacacgugggcaugggauuggaaacaagaacugaaacuuggaugucuucugaaggagcuuggaaacaugcacaaagaauugagacguggaucuuaagacacccagguuuuacaauuauggcugcaauauuagcguauacaauaggcaccacccauuuucaaagaguauugauauucauucuacuuacagcggucgcaccaagcaugacgaugaggugcauuggaauaucgaacagggacuuuguggaagguguaucuggugggagcugggucgauauaguuuuagaacauggcucuugcguaacaacuauggcgaaaaacaaaccaacauuagauuucgaacuaauaaaaaccgaggcuaaacagccagcaaccuuacgaaaauauuguaucgaagcaaaacucacaaacacaacaacagagagucgcuguccgacacagggggagccgucucuuaaagaagaacaagauaaaagauuugucuguaaacacaguaugguggaccgggggugggguaacggauguggccuuuucggaaaaggcggaauuguuacaugugcgauguucacauguaagaaaaauauggaaggaaaaauaguacaaccugaaaaucucgaguauacaauuguuguaacaccacacucaggcgaagaacacgcgguggggaaugacacaggaaaacacggacaggagauaaaagugacaccacaaucaucgauuacagaagccgaauuaacaggauaugguacaguaacgauggaauguucacccagaacaggauuagacuuuaaugagaugguuuugcuucaaauggaaaacaaagcaugguuaguccaucgccaaugguuuuuggauuugccauuaccuuggcuacccggcgccgacaaacaggagucaaauuggauacaaaaagaaacauuagucacuuuuaaaaacccgcacgccaagaaacaagaugucguaguacuaggcucacaagaaggugcgaugcacacugcuuuaacgggggcaacugaaauacaaaugucaagcgguaaucuauuauuuaccggucaccugaaaugcagauugagaauggauaaacugcaacuuaaaggaaugucauauucaauguguacgggaaaauuuaagguagucaaagaaaucgcagaaacccaacacggcacuauagugauaagaguucaauacgaaggagacggcaguccaugcaaaauuccguuugaaauaauggacuuagagaagagauauguauuaggcagauugauuacggucaacccuaucguuaccgaaaaagauagucccguuaacauagaagcagaaccgccguuuggugauaguuauauaauuauugguguagaacccggucaauugaaacucaauugguucaagaaaggaagcucgaucggacaaauguucgaaacgacgaugaggggugcuaaaagaauggcgaucuuaggggauacagcgugggacuuuggauccuuggguggcguauuuacauccauaggcaaagcacuucaccaaguauuuggugcaauuuacggugccgcauucagcggcgugagcuggacgaugaaaauauuaauagguguaauaauaacauggauagguaugaauaguagauccacaagucucucaguaagccuaguuuugguaggcaucguaacauuguaccuaggcguuaugguacaagcugauucagggugcgucguuaguuggaaaaauaaagaacuuaaauguggaucugguauauucauuacugacaacguacauacauggacugaacaauacaaauuccaaccagaaaguccuucuaaauuagcuagugcuauacaaaaagcacaggaagaagggauuugcgggauuagaucuguuacacgacuagaaaaucuaauguggaaacaaauaacaccugaguuaaaucacauauuagcugagaaugaaguaaaaaugacaaucaugacgggggacaucaaaggaaucaugcaagcagguaagcgaagccuacguccacagccaacugagcucaaauacucauggaagacuuggggcaaagccaagaugcuaagcacugaaucuuauaaucagacauuccugauagauggaccugagacggcggaauguccaaacaccaaccgggcauggaacucacucgaaguugaggauuauggauuuggcgucuuuacuacgaauauuugguugaaacuaaaagagaaacaagacgcauucugugacaguaaacuaaugagugccgccauaaaagacaacagagcuguucaugcagauaugggauacuggauugaauccgcccucaaugacacauggaaaauagaaaaggcaaguuucauugaagucaaaaauugucauuggccaaagucccauacucuaugguccaauggcguauuagaaagcgaaaugauaauuccgaagaacuuggcagguccaguaagucaacauaacuauaggccuggauaucauacacaaauagcaggcccauggcacuuggggaaacuagagauggauuucgauuuuugugauggcaccacggucauugugacggaagauugcgguaauagggggccuaguuugagaaccacaacagcuuccggaaaauuaauaaccgagugguguuguagaaguuguacauuaccgccucuacgauaucgcggcgaagauggcugcugguacgggauggaaauccgaccucuuaaagaaaaagaagaaaaucuugugaacuccuuaguaacagcaggucauggacaaguagacaauuucucauuagggguccugggaauggccuuauuccucgaagaaaugcuaagaacacgcguaggcaccaaacaugcuauucuauuaguggcagugucuuucgugacccuaaucacuggaaacaugagcuuuaaggauuuaggccgaguaguaguuauggucggagcaacuauggcagacgauauaggaauggggguaacguacuuagcauuacuagcugcuuucaaggucagaccgacauuugcagcagguuugcuacugagaaaacugacuuccaaagaguugaugaugacaacaauuggaaucguacugcuuucucagucuaccauuccagagacaguacucgaacucacugaugcacuugcauuagguaugaugguguuaaaaauaguucgaaacauggaaaaguaccaacuagccgucacaauuauggccaucuugugugucccaaacgcaguaauacuacaaaaugcauggaaagucagcuguacuauauuagcagucguaucagucucgccucuacuacugacuucaagucagcagaaaacagacuggauaccucuagcuuuaacaauaaaagguuugaacccgacggcuauuuuucugacgacuuuguccagaacuaacaagaaaaggucuuggccacugaaugaagcgauaauggcaguagguaugguuagcauauuagcuagcucgcuacucaagaacgauauacccaugacaggcccccuaguagcaggaggccuacucacagucugcuauguucucaccggccgaucugcagaccuugaacuagaaagagcaacagacguuaaaugggaagaccaggcggagaucagugguucaucuccuauauuaagcauaaccauuagugaggaugguucgaugagcaucaaaaaugaagaggaagaacaaacucuaacaauuuuaauccggaccggccuucucguuauuaguggacuuuucccaauaaguauuccuauaacugccgcggcgugguacuuaugggaggucaagaaacagagagccgguguccuaugggacguaccgucgccucccccuauggggaaagccgaacuggaggauggugcauauagaaucaaacaaaaggggaucuuaggcuauagucaaauuggagcgggcgucuacaaagaaggaaccuuucauacaauguggcacgucacuagaggcgcuguauuaaugcauaaaggaaaaagaaucgaaccaaguugggcggacguaaagaaagaccucauaaguuacgggggcggguggaaauuagaaggugaguggaaagagggagaggaaguacaggucuuagcauuagaacccggcaaaaauccaagggcaguucaaacaaaacccggucuguuuaaaacuaauacuggaacgauaggagccguaucgcuggacuuuaguccaggcacgagcggaucuccaaucauugacaagaaaggaaagguaguuggucuguauggcaauggggugguaacccgcagcggggcauacguaucggcgauugcacagacagaaaagucaauagaggauaauccagaaauugaagaugacauauuccgcaaaaggcguuuaacuaucauggaccugcacccgggugcaggaaagacgaaaagauaccuaccggccauaguccgagaagcuauaaagcgaggauuaagaacgcuaauauuagcaccaacuagggucguagcugcugagauggaagaagcgcuacgaggcuuacccauacgauaccaaaccccugccauaagggcagaacacacugggagagaaauagucgauuugaugugccaugcaaccuucacgaugcgucuuuuaucaccugugagaguaccuaauuacaacuuaauaaucauggacgaagcgcacuuuacggacccagcaaguaucgcagcaagagguuacauaaguacgcgaguagaaaugggcgaggccgcaggaauuuucaugacagccacaccaccggggaguagagacccuuuuccacaaagcaacgcaccuauaaucgacgaagaacgcgaaauaccagagagaagcuggaacucuggucaugaauggguaaccgauuuuaagggcaaaacuguuugguuuguccccucuaucaaggccggaaacgacauugcggcgugucuccguaagaacggcaagaaagugauccaacuuucgagaaaaacauuugauucugaguauguuaaaacgagaacaaaugauugggacuuuguagucaccacugacauaagugaaaugggagccaauuucaaggcagaacgcguaauagacccacgacguugcaugaagccugugauucuaacagauggcgaggagcgggugauuuuagcaggaccgaugccaguaacgcacucaucagccgcacaaagaagagguaggauuggcagaaaucccaaaaacgagaaugaccaguauauauacaugggagaaccuuuggaaaaugaugaagacugugcgcacuggaaagaagcaaaaaugcuacuagauaauauuaauacgccugaagggauuauacccuccauguuugaaccggaacgagaaaaaguagaugcuaucgauggugaauauagauuacgaggugaagcacgaaaaacuuuuguagauuuaaugagaaggggagauuuaccaguaugguuggcuuauaagguagcugcugaggguauuaacuaugcggauagaagguggugcuuugauggcaucaaaaacaaucaaauacucgaagaaaauguugagguugaaauuuggacuaaagaaggggaaagaaagaaauuaaaaccucgcugguuagacgcucguauuuauagugauccgcuagcccugaaagaguucaaagaauuugccgcaggccguaaauccuuaacacuaaaccuuaucacagaaauggguagacucccaacguuuaugacacagaaaacaagggacgcucuggauaaccuugccguucuucauaccgccgaagccggaggccgugcauauaaucacgcauuaucugaauuaccggaaacgcuugaaacacucuuacuacuaacacuauuagcaaccguaacaggcgguauauucuuguuccuaaugucuggaaggggaauagguaaaaugacucuugguauguguuguaucauaacagcguccauacugcuaugguaugcacaaauacagccacauuggauagcagccucaauuauucuugaauuuuuccuuauaguauuacuuauaccagaaccagagaagcaacguacaccucaagauaaucaauugacuuauguaguaauugcaaucuuaacuguaguugcagcaacuauggcaaacgaaaugggguuccucgagaaaaccaagaaagaccuaggauuagggucgaucgcuacccaacaaccggaaucuaacauacuggauauagaucuuaggcccgcaucagcauggacauuauacgcaguggccacaaccuucguuacgcccauguugcgacauuccauagagaacagcucagugaaugucuccuuaacggcuauagccaaccaggcaaccguacuuaugggauuaggaaaaggguggccucuuucuaaaauggauauugggguaccacugcuagccauaggauguuacagccagguaaaccccauaaccuugacagcugcacuccuacuauuaguugcacacuaugccaucaucggcccaggccuucaagcgaaggcaacacgagaagcacagaaaagagccgcugcugguauuaugaaaaacccaacaguggauggaauaacaguuauagacuuagauccaaucccuuaugauccaaaauuugagaaacaauuagggcagguuauguuacugauacuauguguuacgcagguacuaaugaugcguaccacaugggcauugugugaagcgcuaacauuagcaacaggacccauaucuacuuuaugggaaggaaauccuggccgcuucuggaacacaacaauagcgguaaguauggcaaauauauuuagaggaucauaucucgcuggagcagggcuauuauucagcauaaugaaaaauacuacuaauacgcguagggguacaggaaacaugggggagacccugggagaaaaauggaaaucgagguuaaauacauuaggaaaaucugaguuucaaaucuauaagaaaucggguauccaggaaguugauagaacguuagcaaaggaaggaauaaagcgaggcgagacggaucaucacgcaguaucaaggggauccgcuaaauugaggugguuuguagaacguaacaugguuaccccugaaggaaagguaguugacuugggcugugguagaggaggguggaguuauuauugugggggucuuaaaaauguuagggagguaaaaggccuaacaaagggcgguccaggccacgaagaaccaauuccuaugucgacguauggcuggaaccuaguacgacuacaaucugguguagaugucuucuuuauaccuccagaaaaaugcgauacgcuauugugugacauaggggaaucaagcccaaacccgacaguugaagcaggacgaacacuacgaguauuaaaccuaguagaaaauugguuaaacaauaauacgcaauucugcauaaaaguuuugaacccuuacaugccuaguguaauugagaaaauggaagcacuacaacgaaaauaugggggagcacucguccguaauccauugaguagaaacucgacccacgagauguauuggguaaguaaugcaucugggaacauaguaucaagcgugaauaugauaagccguauguuaauaaaucgauuuaccaugcgacauaagaaagcuacauaugaaccagauguagaucuggggucggggacacguaacauagguaucgaaagcgagacgccaaacuuagacauaauuggcaaaaggauagaaaagauaaaacaggaacacgaaacuucauggcauuaugaccaggaucacccguacaagacgugggcauaucauggcaguuacgaaaccaaacaaacugguagcgcaucgucaauggugaauggaguuguacgucugcuuacuaaacccugggauguuuuaccaaccguaacucagauggccaugacagauacgacuccauuuggucagcaaagaguguuuaaagagaaaguugauacuaggacacaagaacccaaagaaggaaccaagaaacuaaugaaaauaacggccgaaugguuguggaaggaacucgggaagaagaaaacaccacggaugugcacaagggaagaauuuacaagaaaaguaagauccaaugccgcacugggggcaauauuuacagaugaaaacaaguggaaaucagcuagggaagcaguugaagauagcagauuuugggagcuaguagacaaagaaagaaauuuacaccuugaagggaaaugcgagacaugcgucuauaacaugaugggaaagagagagaagaaacuuggagaauuugguaaagcaaaagguucccgagcaauaugguacaugugguuaggagcaagguuccucgaauuugaagcccuggguuucuugaaugaggaucauugguuuucgcgggaaaauucguugaguggugucgaaggagagggauuacauaaacuaggauauauauuaagagacgucagcaagaaagaagggggagccauguaugcagaugauaccgcgggaugggauacuagaauaacguuagaagaccucaaaaacgaggaaaugguaacaaaucauauggaaggagagcacaagaaacuagcagaagcuauauuuaaguuaacauaucaaaacaaagugguuagaguacaaaggccaacaccucgcggaacaguaauggauauaaucucuagaagagaucaaagaggaagcggacaaguaggcacuuauggacucaauacuuucacuaacauggaagcucaacucauaagacaaauggaaggagaagggguauucaaaaauauucaacaucucacugugacugaggaagucgcaguucagaauuggcucgcgcgcguaggaagagagagauuauccaggauggcaauuagcggagaugauugcguuguuaaacccuuagacgacagauuugccaaugcacuaaccgcacucaacgauauggguaaaauccgaaaagacauacaacagugggaaccuuccaaaggcuggaaugacuggacacagguaccuuuuugcagucaccauuuucaugaacuaauuaugaaagauggucgaguucuuguggugccaugccggaaucaagaugaguugauaggcagagcuagaauaagccaaggagcaggauggagcuuaagagagacggccugccuuggcaagucuuacgcacaaauguggucacugauguauuuucauagaagagaccuacgucuugcagcaaacgcaauuuguagugccguaccuagccacugggugccuaccuccaggacaaccugguccauacaugcaaaacacgaauggaugacgaccgaagacaugcuaaccgucuggaaucgugucuggauaagagaaaacccuuggauggaagacaaaacuccaguggaaagcugggaagaaauacccuaucuuggcaagagggaagaucaaugguguggcagcuuaaucgggcuaaccagucgagccaccugggcuaaaaacauucaagcagcgauaaaccaaguaagauccuugauaggaaacgaagaauacaccgauuacaugccuucaaugaaaagauucagacgcgaagaggaagaagcugguguucugugguaa

SEQ ID NO: 22738 - RNA, 9876 nt, Artificial Sequence
  derived and/or modified CDS sequence (opt6) from DENV-2__EU482656__SS-prME
ucagcaggcaugauuauuauguuaauacccaccguaauggcauuccauuuaacaacuagaaauggagaaccacacaugauagugggcauucaagaaaaagguaaaagucuauuauucaaaacagaagauggagugaauauguguacauuaauggcaauggacuuaggagaauuaugcgaagauacaauaaccuauaaauguccccuauuacggcaaaacgaacccgaagauauagacuguuggugcaacuccacaaguacaugggucacauacggaaccuguacaacgacaggagaacaucguagagagaaaagaucgguugcgcuaguuccgcaugucggaaugggguuagaaacaaggacagaaacuuggaugucuagugaaggagcauggaaacaugcacaacgaauagaaacauggauacuaagacacccgggguucacgauuauggcagcaauacuugcuuacacuauugguacuacgcauuuccaaagaguguugauuuuuauuuuguugacagcaguagcaccauccaugaccaugagauguauagguauauccaaucgagauuuuguagaaggagucucaggcggcagcuggguagauauaguuuuagaacacggaagcuguguuacgacaauggcuaaaaacaaaccaacauuggacuuugaacuaauuaaaacagaagcgaaacaacccgccacauugcgaaaauauuguaucgaagcuaaauugacgaauaccaccacugaaucaagaugucccacacaaggcgaaccaucacuaaaagaagaacaagauaaaagguucgucuguaaacauucaaugguagaccgaggguggggcaacgggugcggacuauuugguaaaggggguaucgugacaugcgccauguuuaccugcaagaaaaacauggaaggcaaaauuguccaacccgaaaauuuagaauacacaauaguaguaaccccucauaguggagaagaacacgccguaggcaacgauacugguaaacacggcaaagaaauaaaaguuaccccucaaucuaguauaacugaagcagaacuaacaggauauggcacgguaacaauggaauguucaccaagaacugguuuagauuuuaacgaaaugguauuauuacaaauggaaaacaaagcaugguuaguucauagacaaugguuucuagauuuaccacuuccuuggcuucccggagcggacaaacaagagucaaacuggauacaaaaagaaacauuggugacauucaaaaauccacaugccaagaaacaagacgugguugugcuggguucccaagaaggagcaaugcauacggcgcuaacgggagccacagagauucaaaugaguagcggcaaucuuuuauucacuggucaccuaaagugucgauuacggauggauaaacuacaauugaagggaaugucauauucaaugugcacaggcaaauuuaaagucguaaaagaaauagcugaaacacaacauggaacuauaguaauaagaguccaauaugaaggggacggaagccccuguaaaauaccuuuugaaaucauggaccucgaaaaacgguaugugcucggaagacuaauaacaguaaauccuauuguaacagaaaaggauucucccguaaacaucgaagcagaaccuccguucggugacucauauauaauaauaggugucgaaccaggacaacuaaaacuuaauugguuuaagaaagguaguaguaucggacagauguuugaaacaacgaugagaggugccaagagaauggcuauacuaggggauacugcgugggauuuuggaaguuuaggggguguauuuacaucaauaggaaaagccuugcaucaagucuuuggagcaauauauggugccgcguucucaggaguuucuuggacgaugaaaauucuuauaggcguaauaauuacguggauugggaugaacucuaggucuacgucauuaucugugucccuagugcuugugggcauuguaacguuguaccuuggaguuauggugcaagcggauaguggaugugucguuucauggaaaaacaaagaacuuaaaugcgggagcgggauauucguaacugauaacguccacaccuggacagagcaauacaaauuccaaccugagagucccagcaaauuagcaagugcuauacaaaaggcccaggaagaagguauaugugggauucggucagucacgagguuggaaaaucuuauguggaagcaaauaacaccggaauuaaaucauauacucgcagaaaaugaaguuaaauuaacaauaaugaccggcgauaucaagggcauaaugcaagcagggaagaggucucuccguccucaaccgacagaguuaaaauacagcuggaaaaccugggggaaagcgaaaaugcuuagcacugaaagccacaaccaaaccuucuuaaucgauggacccgagacagcugaaugcccuaacacaaaccgagcauggaacucacuugaaguagaagauuacggauucggaguuuucacaacuaauauuuggcuuaaauuaaaagagaaacaagacgcuuucugcgauaguaaauuaauguccgcagccauaaaagacaaccgcgcggugcacgcugacaugggauauuggaucgagagugcucuaaaugauacauggaaaauugaaaaagccaguuuuauagagguuaaaaauugccauuggccuaagucccauacguuauggucaaacgguguacuugaaucagaaaugaucauuccuaagaaucuugccgggcccguaagccagcauaauuacagaccagguuaccacacacagauugcgggucccuggcaucuggguaaacucgaaauggauuucgauuuuugugacggaaccacugugauagugacugaggauugugguaaccgcggcccuucgcuaagaacaacuaccgcgagugguaaauugauuacagaaugguguugccgaucuugcacuuugccuccacuacgcuaccguggugaagaugguugcugguauggcauggagauacgcccucuaaaggagaaagaagagaaucuggugaauagcuuaguuacagcaggucaugggcagguagauaauuucucccuuggaguauuagggauggcacucuuucuagaagagauguugcgaacuagaguagguacgaaacacgcuauacuccuaguugcuguauccuuuguaaccuuaauaacuggaaauaugucauuuaaagaucuugguagggucgucguuaugguaggagcuaccauggcagaugauauaggaauggggguuacauaucuagcacuauuagccgcguuuaaagucaggccuacuuucgccgcugguuuacuucuucgaaaauuaacgucuaaagaauugaugaugacgaccauuggaauuguacugcuuagccagucuacuauaccagagaccguauuagaacuaacugaugcucuagcguugggaaugaugguucuaaaaaucguuagaaacauggaaaaauaccaacuagcaguuacaauaauggcuauccuauguguaccaaaugcggucauauuacaaaaugcuuggaagguaucaugcacaauauuagcuguagugagcguaucaccacuacuacugacaucaucucagcagaaaacagacuggauaccauuggcuuuaacgauaaagggcuuaaauccgaccgccaucuuucuuacaacacugucacggacaaacaaaaagagauccuggccgcugaacgaggcaauuauggcaguaggaaugguuucuauacucgcgaguucgcuuuuaaagaaugauauaccaaugacugggccucuuguggccggugggcuacucacaguauguuauguccuaacugggagaucagcagauuuagaauuagaacgggcaacagaugugaaaugggaagaucaagcugaaauaucuggguccagcccuauacuuagcauuaccauaucagaagaugggucgaugagcaucaaaaaugaagaagaagaacaaacucuaacaauuuugauacgaacagggcuacuuguuaucagugguuuauuucccauaaguaucccgauaacagcagcugcuugguauuuaugggagguaaagaaacagagagcaggaguucucugggacgucccgucaccucccccuauggguaaagcagaauuagaagauggagcuuauagaauaaaacagaaaggaauccucgguuauagucagauaggagcuggaguauacaaagagggcacauuccauacaauguggcauguaacgcgaggggccgugcuaaugcauaaaggcaaaagaauugaaccauccugggcagacguaaagaaagaucuaauaagcuauggaggggguuggaaacuagagggcgaauggaaagaaggugaagagguacaaguauuagcuuuggagccugggaaaaauccaagagccgugcaaaccaaaccuggauuauuuaaaacgaauacugguacaauaggagcuguaucacuggauuucucucccggcacaucuggaucaccuaucauagauaagaaaggaaaaguggugggauuauacggcaauggugucguaacucgaucaggugcuuauguaucagcaauagcacaaacagagaaaagcauugaggauaaucccgaaauagaagaugauauuuucagaaaacggagacucacgaucauggauuuacauccuggggcagguaaaaccaagcgauaccuaccugcaauaguaagggaggcgauaaagcgagguuuacgcacuuuaauauuagcuccuacgaggguuguagcagcggaaauggaagaggcacuaagaggacucccuauucgauaucagacaccagccauucgagcagaacauacaggucgagagauuguagaucuuaugugccacgcaacuuuuacaaugcguuuacuauccccaguaagagugccaaauuauaacuuaauaauaauggaugaagcacauuucacggauccagccucuauagcagcaaggggcuacauaaguacgagaguagaaaugggggaggcagcagggauauuuaugacugccacaccaccaggaucuagagauccauuuccucaaagcaacgccccuauuuuagacgaggaacgagaaauuccugagagaucuuggaacagcggucaugaauggguaacagacuuugaggguaaaacugugugguuugugccaucaauaaaagcuggaaaugauauagccgccugcuuacgcaagaauggcaagaaaguaauucaauugucucgcaaaacguuugauucagaauacguaaaaacuaggacaaaugauugggauuucguaguaacaacggauauaagugaaaugggugcaaacuuuaaggcggaacgcgugaucgauccacguagguguaugaagccaguaauuuuaacugauggggaagaacgaguuauauuagcagguccaaugccagucacucacagcucagccgcacagcgucgcggacgaauagguagaaaccccaaaaacgagaaugaccaauauauauauaugggugagccauuagaaaaugaugaagauugcgcucauuggaaagaagcaaaaaugcuauuagauaauaucaauacucccgaaggaauuauucccucaauguuugagccggaacgagaaaaaguugacgcaaucgauggugaguauagauugagaggugaagcaaggaaaacauuuguugaucuaaugcggcguggcgauuuacccguuuggcuugcguacaaaguggccgccgaaggcauuaauuacgcagauagacgauggugcuucgacgguaucaaaaacaaccaaauacuagaagaaaacguagaggucgaaauauggacaaaagaaggcgaacgaaagaaauuaaaaccgagauggcuagaugcaagaauauacucugauccacuggcacuuaaggaguucaaggaguucgcagcuggucggaaaucacuaacccuaaaccuaauaacagagaugggcagauugcccacauucaugacacagaaaaccagagacgcacuugauaacuuagcaguucuccauacagcagaagcggguggucgagccuauaaucacgcuuuaagugaauugccggaaaccuuagaaacguuacuacuauuaacauuauuggccaccguaacuggcgggaucuuccuauuccuaaugucaggaagagguaucggaaaaaugacguuaggcaugugcuguauuauuacugcaucuauacuuuuaugguacgcgcaaauacaaccacauuggauagccgcauccauaauauuagaauuuuuccuaauuguucuuuuaauuccugaaccagaaaaacaacgaacuccgcaagacaaucagcuuacauaugucguuauugcaauuuugacaguaguggccgcuacuauggccaaugaaaugggcuucuuggagaaaacgaagaaagacuugggccucgguucuguugcuacucagcaacccgagucaaauauccuggacauagaucuacguccugcauccgccuggacacuauaugcagucgccacuacuuuugugacuccaauguuaaggcacagcauugaaaacagcucaguuaaugucaguuuaacagcgauugcaaaucaagcgaccguacuaaugggacuaggaaaaggauggccuuuaucaaagauggauauuggaguccccuuauuggcuauagguugcuauagucagguaaacccaauuaccuuaacagcugcuuuguuauuauuaguugcacauuacgcgauaauugguccuggucuacaagcgaaggcgacucgagaagcgcagaaaagagcagcagccgggauuaugaaaaauccaacgguagacgguaucaccguaauugaucuagaccccauaccuuacgacccaaaauuugaaaaacaacucggucaaguaauguuguugauucugugcgugacucaagucuugaugaugcguacgacaugggcucuaugugaagcauuaacacuagcaacaggaccgauuagcacacuaugggaagguaauccgggaagguucuggaauacaacuaucgcuguaagcauggcaaauauauuucgaggaucguacuuggcuggggcagguuuauuguuuucaaucaugaaaaauacaaccaauacuagaagaggcacaggcaauaugggagaaacacuuggagaaaaauggaaaucuagauuaaacgcuuugggaaagucagaauuucaaauauauaagaaaucaggaauacaagaagucgaucgaaccuuagcaaaggaaggaaucaaaaggggagaaacagaccaccaugcuguuagccgcggaucugccaaauuacgcugguucguagagcguaacauggucacuccugaggguaaaguuguugaccuaggguguggucgagggggauggucuuacuacugcggagguuugaaaaauguacgcgaaguuaaaggauuaaccaaaggugggccaggccaugaggaaccgauaccuaugagcacuuacggauggaaccuagugagacuccaaucgggggucgaugucuucuucauacccccggaaaaaugugauacauuacuaugugauauuggcgaaucaucgccaaacccaacagucgaagcuggccguacacuccgaguauugaauuugguugagaauuggcuuaauaacaauacucaguuuuguauuaaaguacuaaaccccuauaugccuucuguuauagagaaaauggaagcacuucaacgcaaauaugguggagcccuagugcgcaauccacuaaguagaaacaguacucaugaaauguauuggguuucaaaugcgaguggaaacauaguuucgucaguuaacaugaucucucgaaugcuaaucaacagauucacaaugcgacacaaaaaggcaacauaugaacccgacguugaccuggggagcgguacacgaaacauaggaauagagagcgaaauacccaaucuugauauuauagguaaacgaauagagaaaauaaaacaagaacaugaaacuucguggcacuaugaccaagaucacccguacaaaacaugggcauaccacggaucuuaugaaacaaaacagacuggcuccgcuucauccaugguuaacgguguaguuagauuauuaacuaaaccuugggacguucucccuacaguuacccaaauggcgaugacagauacaacacccuucggacaacagagagucuuuaaagaaaaaguagacacucggacacaggaaccgaaggagggaacgaagaaacugaugaaaauuacagcugaaugguuauggaaagaacucgguaagaagaaaacaccucggauguguacuagagaagaguucacacgaaaaguacguucaaacgcagcccuaggugcgauuuuuacugacgaaaauaaauggaaaucugccagggaggccgucgaagacucgcguuuuugggagcuagucgauaaagagagaaauuuacaucucgagggaaaaugugagacaugcguauauaacaugaugggaaagagagagaagaaacucggggaguucggcaaagcaaaaggguccagagcaauaugguauauguggcucggagcuagauucuuagaauuugaggcacucgguuuucucaaugaggaccauugguuuaguagagaaaacagucuuucagggguggaaggagagggcuuacauaaacuuggguacauacuccgagacguuagcaagaaagagggcggugcuauguaugcagacgacaccgcagggugggauacaagaauaacucuggaagaucucaaaaaugaagaaaugguuacaaaucacauggagggggaacauaagaagcuagcagaggcaauauucaaauuaacguaccaaaauaagguuguuaggguacaaagaccuacaccacgaggaacgguuauggacauuaucaguaggcgagaccagcggggcucugggcaaguaggaacguacggucugaacacauucacgaauauggaagcgcaauuaauaagacaaauggaaggugaaggcguuuuuaagaacauacaacauuuaacagucacugaagaaguggcaguacaaaauugguuagcacguguaggcagggagcgacuaucacgaauggcgauaucgggagacgacugcguagugaaaccccuagacgaucgcuuugcaaaugcacucaccgcucugaaugacaugggcaagauaaggaaagacauacaacaaugggaaccguccaagggauggaaugacuggacacaaguuccauuuugcagucaucacuuccaugagcucaucaugaaagacggaaggguacucgugguaccauguagaaaccaagacgagcugauaggacgcgcaagaauuucucaaggagcgggcuggucauugcgagagacagcaugcuuaggaaaaucuuaugcacaaauguggucuuuaauguauuuccaccgucgcgaucucagacuagcagcaaacgcaauuugcuccgccguuccgucgcacugggugccgacuucaagaacaacauggagcauucaugccaaacacgaauggaugacaacagaagacauguuaacggucuggaacagaguauggauaagggaaaacccauggauggaagauaagaccccaguagagucgugggaagaaaucccauauuugggaaagcgggaagaucaauggugcgggagccugauuggacuuaccucccgcgcuacgugggcaaagaauauacaggccgcaauaaaucaaguaagguccuuaauaggaaaugaagaauacacggacuauaugccuucgaugaagagauuuagacgugaggaagaagaagcuggugugcuuugguaa

SEQ ID NO: 22739 - RNA, 9876 nt, Artificial Sequence
  derived and/or modified CDS sequence (opt6) from DENV-2__EU482657__SS-prME
ucggcaggaaugauaauuaugcuuauuccaacugugauggcguuucauuuaacgacucggaacggcgaaccacauaugauuguuggaauccaagaaaaagguaaaagucuauuauuuaaaacagaagaugguguaaacaugugcacgcucauggcgauggaucuuggagaacuuugugaagacaccaucacguauaaaugcccauuauuacgucaaaaugaaccagaagauauugauugcuggugcaauagcacaucaacauggguaacguacgggacuuguaccacgacaggagaacaucgaagagagaaaaggaguguagcucuagugccgcauguugguauggggcucgaaacacgaacagaaacuuggaugaguagcgaaggcgcguggaaacacgcucaaaggaucgaaacauggauaaugagacacccaggguuuacuauuauggcagcaauacuagcauacaccauaggaacaacccauuuccaacgaguuuuaauauuuauacuacugacagcugucgcgccaaguaugacgaugcgcuguauuggaaucaguaacagagauuucguggaagggguaagcggaggaucguggguagauauaguucucgaacacggcuccuguguaacgacuauggcuaaaaauaaaccuacacuugacuucgagcuaauuaaaacggaagcaaaacaaccggcuacuuuaagaaaauauugcauagaggcgaaacuaacaaauacaacaacagaaucacgaugucccacucagggugaacccucccuaaaagaagaacaagacaaaagauuuguuuguaaacauagcaugguggaccguggauggggaaaugggugcggacuguucgguaaaggaggaauuguuaccugugcuauguuuaccugcaagaaaaauauggaaggaaaaauaguucagccugaaaaccuugaguauacaauaguaguaacuccacauuccggagaggagcaugcaguagggaacgauacaggcaaacaugguaaagagaucaaagugacuccacagucuucaaucacugaagcagaguuaacuggcuaugggacgguaacaauggaauguucccccagaacuggcuuggauuucaacgaaaugguacuucuccaaauggaaaauaaagcauggcuuguacauagacaaugguucuuagacuuaccgcuaccaugguugccaggugcugacaaacaagaaucaaauuggauucaaaaagaaacacuugugacauuuaaaaacccgcaugccaagaaacaggauguaguuguucuaggaucacaagagggggcaaugcacacagccuuaacuggggcaacagaaauucagaugagcucagggaauuuacuuuuuaccggacauuuaaaauguagacuucgcauggauaaacuccaauuaaaaggaaugaguuauucuaugugcacugguaaauuuaaaguagucaaggaaauugcagaaacucaacaugggacuauaguuauacgaguacaauacgaaggcgacggaucaccuugcaagaucccauuugaaauaauggaucuagagaaaagauacguacuuggaagauuaauuaccguuaacccaauaguuacugaaaaggauucuccaguuaauauugaggcugaaccaccuuuuggugauaguuauaucauaauaggaguagagccaggacaacucaagcuaaacugguucaagaaagguaguagcauaggccagauguuugaaacuacaaugagaggugccaagaggauggcaauauugggagauacagccugggacuuugguagccugggcggaguauucacaagcaucggaaaagcacuccaucaaguguuuggugcaauauacggagcagccuucagcggaguaagcuggacuaugaaaauucuaauaggaguuauaauaacuuggauagguaugaacucacgaucuacuucucucagugugucuuugguccuggucggaauaguaacguuguaccuuggcguaaugguucaagcagacucugguuguguugucucauggaaaaacaaggaguuaaaaugcggaagcggaaucuuuauuacugacaauguccacacauggacagaacaauacaaguuucaaccagaaagucccucgaaauuagcuagugcaauccaaaaagcacaagaagaggguauaugugggauccgguccguaacaagacuugaaaauuugauguggaagcagaucacacccgaauugaaucauauacuagcagaaaaugaggucaaauuaaccaucaugacaggagauauuaggggaauuaugcaagcaggaaaaagaucacuaagaccacagccaacggagcuaaaauauagcuggaaaacuugggggaaagcgaaaaugcuaucaacagaaucuuauaaccaaacauuuuuaaucgacggcccugaaacggcugagugucccaauacaaaccgagcauggaauagucuugagguagaagauuacggguucgguguauuuacaacuaauauauggcuaaaauugaaagaaaaacaggaugcguuuugugacagcaaacuuaugagcgccgcaauaaaagauaacagagcuguacaugcagauauggguuacuggauggaauccgcccuaaacgacacuuggaagauagaaaaagcgaguuuuauugaagucaaaaauugucacuggccuaaaagucauacgcuauggagcaaugguguauuagaaagcgaaaugauuauaccuaagaaucuugcaggaccaguaucgcaacauaacuaucgcccaggauaccacacacaaauagcgggcccuuggcacuugggaaaauuagaaauggacuuugauuuuugugauggcacaacagugaucguaacagaggacugcggaaaccgaggaccuaguuugaggacgacaaccgccuccgggaagcuaauaacggaaugguguugucgaaguugcacacuuccgccccuaagauauagaggggaagauggaugcugguauggaauggaaauacgaccacuuaaagaaaaagaggagaauuuagucaacagucuaguuacagcaggacauggacaaguagacaauuuuucacuggguguauuagguauggcgcuauuucuugaggaaaugcuacguacucgaguaggcacaaaacacgcaauuuuauugguagcgguuucguuuguuacacuaaucacuggcaauaugaguuuuaaagacuugggcagaguagucgucaugguaggggcaaccauggcagacgacauaggcauggggguaacauaccucgcuuuguuagcagcauuuaaagugcgacccacauucgcagccggacuauuauuaaggaaauuaaccuccaaagagcucaugaugaccacuauugguauaguguuacuaucacaaaguacaauaccggaaacaguacuugaauugacagaugcgcucgcauuaggcaugaugguacuaaagauagugagaaacauggaaaaauaccaauuagcaguaacaauuauggcaauuuuaugcgugccaaaugcaguuauacuucaaaaugcuuggaaaguuucguguaccauacuggcaguggucagcguaaguccccuauuacucacaucgagucaacagaaaacugauuggauaccgcucgcguuaacuaucaaggguuugaauccgacagccauauuucugaccacacugagcagaacuaauaagaaaagaucuuggccccuaaaugaagccauaauggcgguaggcaugguaucgauacuggccucuucacuacuuaagaaugacauacccaugaccgggccuuuaguugcugguggacuauugaccguauguuauguguugacuggaagauccgcagaccuagaauuggaacgugcuacugacguuaagugggaagaccaagcagagauuagcgguucgagcccuauacuaucaauaaccauaucggaggauggaucaaugucuaucaaaaaugaagaagaagaacagacucuaaccauucucauacguacaggacuucuagugaucuccggucucuuccccauaagcauacccauuacagcggcggccugguauuuaugggaaguuaagaaacaaagagcaggcguauuaugggaugugccuaguccgcccccuaugggaaaagcagaauuggaagauggagcauaccguauaaagcaaaaagggauccuaggauauucacaaauuggagcaggcguuuacaaagaagguaccuuucacacgauguggcauguaacucgaggagcgguacuaaugcacaaaggaaagcgcauagaaccaagcugggcggaugucaagaaagauuuaauaucauacggaggaggauggaaauuagaaggcgaguggaaggagggagaggaaguacagguacuggcguuagagccgggcaaaaauccaagggcuguucaaacaaaaccaggauuauuuaagacgaacacaggaacaauaggugccgucucauuggacuuuucaccuggaacaaguggaaguccgaucauagacaagaaagggaaaguaguuggucuauacgguaacggaguaguaaccagaaguggagcauacguaagcgcaaucgcccaaacagaaaaaucaauugaggauaauccagaaauagaagaugacauuuucaggaaacgcaggcuuacaaucauggaucuacauccaggugccggcaagacuaaaagauacuugccagcgaucguucgggaggcaauaaaaagaggauuacguacauugaucuuagcacccacgaggguuguagcugccgaaauggaagaagcccuucguggucucccuauuagguaucaaaccccugcaauaagagcagaacauacaggucgggaaaucgucgauuuaaugugccacgcaacauucacgaugagacuucuaaguccaguucgcguaccgaauuacaauuugauaauaauggaugaagcucacuucacggauccugcuagcauagccgcacggggauacaucaguacaagagucgagaugggugaagcggcugggauauuuaugacggcaacuccuccuggaucacgagaccccuucccacaaucaaaugcgcccauuauagaugaggaacgcgaaauaccugaaagaucauggaacagcggacacgaaugggucacugauuucaagggaaaaacagugugguucgucccuagcauaaaggcagguaaugauauagccgcaugucuaagaaagaauggcaagaaaguaauacaacugaguagaaagacuuuugacucugaguauguaaagacuaggacaaacgacugggauuuuguaguaacaacggauauauccgaaaugggugcaaacuuuaaggcagagcgcgugauagauccacgacgcugcaugaaaccaguaauacugacugacggugaagaacggguuaucuuagcgggaccgaugccuguaacacacucaucagcugcucagcgaaggggaagaaucggacgcaacccaaagaaugagaaugaucaauacauauauaugggugagccgcuagaaaaugaugaagacugcgcacauuggaaagaagcaaaaaugcuauuggacaacaucaauacuccggagggaauaauaccaagcauguuugaaccagagcgugaaaaaguugacgcaauugauggagaauauagauuacgaggugaagcgcggaaaacauucguagaucucaugcgccguggagaccuaccgguuugguuagcauauaaggucgcagcagaaggcauaaacuaugcggaccgucgguggugcuucgaugguaucaaaaauaaucaaauccuagaagaaaauguugaaguagaaauuuggacuaaggaaggggagaggaagaaacuaaaaccaagauggcucgaugcgagaauuuacucagauccauuagcccuuaaggaguucaaagaauuugcagccggucgaaaaucguuaacacugaaucugauuacagaaaugggacggcucccaacauuuaugacacagaaaacuagagaugcccuagacaaucuggcaguauuacauacagcugaagcugguggacgagcauauaaucaugcucugucagaguuaccagagacauuagaaaccuuguuacugcuaaccuugcuagcuacgguuacgggcggcauuuuccuguuuuugaugagcggucgaggaauagguaagaugacucugggaauguguugcauuauuacugcuucaaccuuacuaugguacgcacaaauacaaccacacuggaucgccgcuuccauaauacuagaguucuuucuaauuguguuguuaauaccagaaccugaaaaacaaaggacgccccaggauaaccaacuuacuuauguagugauagcaauacuaacgguaguagcagcaacgauggcgaaugagaugggguuucuggagaaaacgaaaaaggauuuaggccuaggaucuauagcgacacagcaaccagaaucaaacauauuagauauagaucugaggccugcuagcgcauggacucuauacgcgguagcaaccacauuuguaaccccaauguuaagacauaguauagaaaauagcuccgugaacgugucauuaacagcuauugcaaaccaagcaacaguauugaugggacuaggcaaaggauggccguuaucuaagauggacaucgguguacccuuauuggcaauuggguguuacucucagguuaacccaauaacauugacugcagcguuacuguuacugguugcacauuacgcgauaaucgggccuggacuacaggccaaagcuaccagagaggcucaaaagagggcugcugcuggaaucaugaaaaauccgaccgucgacgguauuacuguaauagacuuggauccaaucccuuaugacccgaaguuugaaaagcaacuggggcaaguaaugcuauugauacuauguguaacgcaaguuuuaaugaugagaacaacaugggcacuaugugaggcacuaacucuugcaacagguccaauaucaacacuuugggagggaaacccagguagauuuuggaauacgacaauugcgguuucgauggcaaauauauuccgaggaagcuauuuggcgggggcaggauuacuauucucaauuaugaagaauacgaccaacacacggagaggaaccggaaauauaggagagacacuaggagaaaaauggaaaucacgucuuaaugcucuagguaaaagugaguuccagauuuacaagaaaucaggaauacaggaagucgauagaaccuuggcaaaagaaggaauaaaaagaggggaaacagaucaucaugcaguaaguagaggcucagcaaaacuucguugguucguggaacgaaacaugguuacaccugagggaaaagucguagaccuaggcuguggaagaggagguuggaguuacuacugcggugggcuuaaaaauguacgcgagguuaaagggcuaacuaaagggggucccggccacgaggaaccgauuccuaugucaacauaugguuggaaucuggucagauuacagucgggcgucgacguuuucuuuauaccacccgaaaaaugugauacgcucuugugugacauuggugaaucuucaccgaauccaacaguagaggcgggaaggacacucagaguucucaaucuaguagagaacugguugaacaacaauacacaguuuuguauaaaaguuuuaaacccuuauaugccgaguguuauagagaaaauggaagcacugcaaagaaaguacggaggagcacugguuagaaauccccugagucgaaauucuacacacgaaauguacuggguaucuaacgcaucuggaaauauaguaucaucuguaaacaugauuucuagaaugcuuaucaaccgguuuacaaugcgccacaagaaagcaacuuaugaaccagauguggaccuaggaucaggaacacggaacaucgguaucgaaucugaaauaccaaaucuugauauuauuggaaaacgcauagagaaaaucaaacaagagcaugaagcauccuggcauuacgaccaggaccauccuuauaaaacgugggcauaucauggaaguuacgaaaccaaacagaccggaagugccaguaguaugguuaacgguguaguucggcuuuuaacgaagccaugggacguacugccgacuguaacgcaaauggcuaugacggauacuacgccguuuggacaacaaagaguauucaaagaaaaagucgauacgagaacacaagagccaaaagaaggaaccaagaaguuaaugaagauaacugcagaauggcucuggaaagaacucggcaagaagaaaacucccaggaugugcacaagagaagaguucacucggaaagugcguaguaacgcggcguuaggcgcaauuuuuacagaugaaaauaaguggaaaucagcuagagaagcgguagaagauagccgauuuugggaacugguagauaaagaacgcaaccuucacuuggaagguaaaugugagacgugcguuuauaauaugauggguaaacgagagaagaaacuaggugaauuuggaaaagcaaaagggaguagagcuauaugguacauguggcuaggagcaagauuucuugaauuugaggcuuuagguuuucuaaaugaagaccacugguucucaagggaaaauucacuaaguggagucgaaggugaagguuuacauaaacuaggauauaucuuaagagaugucucuaaaaaggaagguggugcaauguacgcagacgacacagccggaugggauacccguaucacuuuagaagaucuaaagaacgaagagaugguaacgaaucacauggaaggggaacauaaaaaguuagcggaagcaaucuuuaaacuuacauaccaaaauaaaguaguacgaguacaaagaccuacaccacgaggaacuguaauggauaucauaucgaggagagaucagcgcggcucaggccaagugggaacuuauggauugaauacauucaccaauauggaagcgcaacuaauccgacaaauggaaggagaagguguauuuaagaacauucagcaccuuacaguaacugaggaaguagcggugcauaauugguuagcgagaguugggcgagaacgucuuaguaggauggccauuucaggagaugauuguguugugaagccccuggaugaucgauuugcgaacgcucugaccgcgcuaaacgauaugggaaagauacgaaaagacauccaacaaugggaaccaaguaaaggguggaaugacuggacucaaguuccauuuuguagucaucauuuccaugaauuaauuaugaaagauggccgagucuuaguaguuccgugccgaaaccaagaugaacugauugggagggcuaggauaagucaaggugccggaugguccuuaagagagacagcaugccuuggaaaaagcuaugcucagauguggucauugauguauuuucauaggcgggaccuccgcuuagcagcaaacgcgauaugcucggccguaccaucacacugggugccaacaagucgaacaacuuggucuauacaugcaaagcaugaauggaugacaacugaggacauguuaacugucuggaaccgugucuggauacgggaaaauccguggauggaagacaagacaccaguagaaucuugggaagaaauacccuacuuaggcaaaagagaagaucaauggugcggcuccuugauuggacucacgagucgugcgacaugggcgaagaacauccaggccgcgaucaaucaggucaggagcuuaauaggaaaugaagaauauacagacuacaugccauccaugaaaagauuccgacgagaagaagaagaagcagggguacuuugguaa

SEQ ID NO: 22740 - RNA, 9876 nt, Artificial Sequence
  derived and/or modified CDS sequence (opt6) from DENV-2__EU482658__SS-prME
ucugcggggaugauaaucauguugauuccuacggugauggcauuucauuugacaacucggaauggugaaccccauaugaucguuggaauacaggaaaaaggaaaaagccuucucuucaaaaccgaagacggaguuaauaugugcacgcuaauggccauggaucugggugaacucugugaagacacaauaacuuauaaauguccccuacuccggcaaaacgaaccagaagauauagacuguugguguaacucaacaagcacuuggguaacauauggaacuugcacaacgacaggggaacauaggcgagaaaaacgaaguguagcacuggugccacacguagguauggggcuagaaaccagaaccgaaaccuggaugaguucagaaggggcuuggaaacaugcacagagaauugaaacguggauccuuagacacccgggauucacaaucauggcagcaauucucgcauacacuauugggacaacacacuuccaacggguauugauauuuauucucuuaacagcagucgccccauccaugaccaugagaugcauaggaauuagcaauagagauuucgucgaaggggucucuggaggaaguuggguugauaucguccuagaacauggaucguguguaacgacgauggccaaaaauaaaccgacuuuagauuucgaauuaaucaaaaccgaagcaaaacagccagcaacucuaaggaaauauuguaucgaggccaaauugaccaauacaacgaccgagucgcgauguccaacacaaggcgaaccaagccuuaaagaagaacaagacaaacgguuuguguguaaacacucaaugguagacagaggaugggguaauggauguggguuauuuggcaaaggaggaauaguuacgugugcgauguuuacauguaagaaaaacauggaaggcaaaaucguucaaccagaaaauuuagaguauacaauuguuguaacaccacacucuggagaagaacacgcaguagguaaugauacaggcaaacauggaaaagagauaaaaguuacaccacaaucuuccauuacagaggcugaauuaacuggauacggcacuguuacaauggaauguucaccuagaacuggucuagauuucaaugaaaugguuuuacuacaaauggagaauaaagcauggcuuguucacagacagugguucuuagacuuaccuuugcccugguugccgggugcagauaaacaagagagcaacuggauucaaaaagagaccuuaguuacuuucaaaaacccucacgcgaagaaacaagacguaauaguauuagguucacaggaaggagcaaugcauacagcacucacaggugcaacugagauucaaaugaguucggggaaccuauuauucacuggucaucuaaaauguagacugaggauggauaaacuacaacugaaagguaugucauacagcaugugcacuggaaaauucaaaguaguuaaagaaauagcagaaacacaacauggaacaauugugauuaggguucaauaugaaggcgauggaucuccuugcaaaauuccguucgaaauuauggaucucgagaaacgguauguacuaggaagacugauuacaguuaauccaauuguaacagagaaagauucuccuguaaacauagaggcagaaccaccauuuggagacucauacauuaucaucggaguagaaccaggucaacuaaaauugaauugguuuaagaaagggagcagcaucgggcaaauguuugaaacaacaaugagaggggcaaaaaggauggcgauauugggggauacagcaugggauuuuggaucccuaggugguguguuuaccucuaucgggaaggcuuuacaucaaguauuuggagcaaucuauggggcugcauuuucaggaguaucuuggacaaugaaaauccucauaggagugauuauuacuuggauuggcaugaacucacgaucgacaucauuaucaguuagucuuguccuggucggcauuguaacgcucuaucugggaguaaugguacaagcugacucgggaugcguuguaaguuggaagaauaaggaacucaaguguggaagugguauauuuauaacugauaauguacacaccuggacugaacaauauaaauuucaaccugaaucaccaaguaaauuagcauccgccauacaaaaggcucaagaggaagggaucuguggcauucguaguguaacuagacuugaaaauuugauguggaaacaaauuaccccagaauugaaccauauccuagccgagaaugaggucaaauuaacaauaaugaccggagauauuaaagguaucaugcaagcagggaaacggagccuaagaccacagccuacagaacuaaaauauaguuggaaaacuugggguaaagccaaaaugcugaguaccgaaucauauaaucagacguucuugauugacggaccugaaaccacagaguguccaaauaccaaucgggcauggaacucccucgaaguugaagacuauggauuugggguguuuacuacaaacauauggcuaaaauuaaaggaaaaacaggaugcauucugcgauuccaaacuuaugagcgcagcuauaaaagauaacagggcaguacaugcagacauggguuauuggauagaguccgccuuaaaugauacauggaaaauugagaaagcaucguuuauugaagucaaaaacugucacuggccaaagagucacacucuuugguccaacggaguacuagaaagugagaugauaauacccaaaaaucuggcugguccggucagucaacauaauuacaggccaggauaccauacgcaaauagcagguccauggcaccucggaaaacuagagauggauuucgacuuuugcgauggaacuacagugauagucacggaagauuguggaaauaggggcccuagcuuacguacaacuacagcgucggggaaacuaauuacagaaugguguuguaggucguguacuuuaccaccccuaagauauagaggggaagaugguuguugguaugggauggaaauacgaccacucaaagaaaaagaggaaaaccuagucaauucuuugguuaccgcuggucauggucaaguagauaauuuuagccuaggaguucuaggaauggcuuuauuccuugaagaaauguugaggacuaggguuggcacgaaacacgccauauuacucgucacaguaaguuucguuacacucauaacaggaaacaugucauuuaaagaucuaggcagagugguaguaaugguaggugccacaauggcagaugauauugggaugggcgucaccuacuuagcauugcuagcugccuuuaaaguaaggccaacguucgcagccggauuguuauugagaaaguuaacuagcaaagaacuaaugaugacaacaauugggauuguucuuuuaucccaauccacaauuccagaaaccguucuagaacuuaccgacgcacucgcacucgggaugaugguccuuaaaauuguccgcaauauggaaaaguaccaauuagcuguuacaauuauggcuauucuaugcguaccaaacgcaguuauacuucaaaacgcuuggaaaguaucguguacgauacuagcaguagugagugugucgccacuauuauugacaagcucgcaacaaaagacagacuggauaccucuugcacucacgauuaaaggucuuaauccaaccgcaauuuuucuuacaacucucucaagaacgaauaagaaacgaucguggccgcuaaaugaagcuauuauggcagugggcaugguaaguaucuuagcaagcucguuacucaaaaacgauauuccaaugacaggaccauuaguugcuggggguuuacuaacuguuuguuacguuuugacgggcagaucugcugauuuagaacuagaacgcgcaacggaugugaaaugggaagaccaagccgaaauuagcggaagcucuccaauccugucaauaacgaucucggaggaugggagcaugucaauuaaaaaugaggaagaagaacaaacuuuaacuauauugauucgaacaggacuauuaguuauuucaggcuuguuucccauuucuaucccaauuaccgcagcugcgugguauuugugggaaguuaagaaacaacgugcugguguucucugggauguucccuccccacccccuauggggaaggcagaguuagaggacggagcauacaggauaaagcaaaaagguauacuuggguauagucaaauuggagcagggguauauaaggaagguaccuuccauacgauguggcauguuacgcguggggcuguauuaaugcauaaggggaaaagaauagagccuucuugggcagaugucaagaaagaucucauuucuuacggaggaggcuggaaacuagaaggugaauggaaggagggggaagaaguacaaguuuuggcgcuagaaccugggaaaaauccaagggcgguucagacuaaacccggucuuuuuaaaaccaacaccgguacgauuggggccguuaguuuggauuuuucuccaggcacgagugggucgccuauaauugauaagaaaggaaaggugguuggcuuguauggaaaugggguuguaacccggaguggagcauauguuucugcaauugcacagaccgagaagucgauagaagauaauccugaaauugaagacgauauuuucaggaaaagacgacuaaccauuauggaucuacauccaggcgcuggcaaaaccaaaagauaccucccagcuauagugcgagaggcaauuaaacgaggacuacggacacuaauauuagcuccaaccagaguaguugcggcggaaauggaggaagccuuaagaggcuuaccaauccgauaucaaacaccagcaaucagagcagagcauacuggccgagaaaucguggaucugaugugucaugccacguucacuaugagauuauuaucgccgguacgcgugccuaauuacaaucucauuauaauggaugaggcgcauuucacagacccggcgaguauagcagcaagaggauacauaucaaccagaguugaaaugggcgaagccgcugguauauucaugacagcaacuccaccaggaagucgagauccuuucccgcaaaguaaugcuccaaucauagaugaggaacgcgaaauacccgaacguucuuggaacucuggucaugaguggguaacugacuucaaaggaaaaacaguuugguuuguaccaucgaucaaagcaggcaaugacauagcagcauguuugcguaagaaugguaagaaaguuauacaauugucaaggaaaacauucgauagugaauacguaaagacaagaacaaaugauugggauuuuguuguuacaacagauauaucagaaaugggcgccaauuuuaaagcagaacgcguaauugauccgaggcguuguaugaagcccgugauauuaacagacggagaagaacgaguuauccucgcuggaccaaugcccguaacacauaguagcgccgcccaacgaagaggacguauagguaggaauccuaaaaaugaaaacgaccaguauauuuacaugggggagccucuagaaaaugaugaggauugcgcccauuggaaggaggccaaaauguugcuugauaacauaaauacaccagaaggaauuauuccaucuauguucgaacccgagcgggagaaaguugacgccauagauggggaguacagauuaaggggugaggcucgaaaaacguucgucgaucugaugcgccgaggcgacuuaccaguaugguuggcauacaaaguagcugcugagggcauaaacuaugcugacaggcgaugguguuuugacgguaucaaaaauaaucaaauacuggaggagaauguagaaguagagauuuggacaaaagaaggugaaaggaagaaauugaagccacguuggcucgaugcacgaauauauucggaucccuuagcccuaaaggaguucaaggaauuugcagccggaagaaaaagccuaacacucaauuuaauuacggagaugggacgacuaccaacauuuaugacucaaaagacacgugaugcacuagacaaucuugcaguauugcacacggcugaagcuggagguagagcauauaaucacgcccuuucagaauuaccagaaacccuugaaaccuuacuuuuauuaacguuacucgcaacaguaaccgguggcauauuucuauuucucaugucgggccggggcauuggaaaaaugacacuaggaauguguugcaucauaacggcaucaauucuauuaugguacgcacagauucagccacacuggauagcagcgucaauaauauuagaauuuuucuuaauuguguuauuaauaccggaaccagaaaaacaaagaacaccccaagauaaccaacuaacauauguaguaauagcgauacucacaguugucgcggcgaccauggcaaacgagauggguuucuuagaaaagaccaagaaagaucuuggacuuggaucuaucgcaacucagcaaccagaauccaauauucuugacauagacuuaaggccggcuucagcauggacucucuacgccguagcaacaacauuugugaccccuauguugagacauaguauugagaacucaaguguaaauguaucucuaacagcaaucgcaaaccaggcuacuguccuuaugggacuagguaagggguggccacugagcaaaauggauauuggagugccacugcuagccauuggaugcuauucucagguuaauccaauaacgcucacugcagcguuauuacucuuagucgcacauuacgcaauaauagguccaggccugcaagcgaaagcuacacgagaagcccagaaaagggcagccgcugggauaaugaaaaacccuacgguugacgguaucacuguuauugaucuagaccccauuccauaugacccuaaauucgaaaaacaauuagggcaagugauguuauugauccuuuguguaacucaaguucucaugaugaggacuacaugggcguuaugugaagcgcuaacacuugcgacgggcccaaucuccacauuaugggaaggaaacccgggaagguuuuggaauaccacuauagcuguaucuauggcaaacauauuucgaggaucauacuuggcaggcgcaggucuucucuucucaaucaugaaaaacaccacuaacacuagaagaggaaccggcaacauaggugagacucucggugaaaaauggaaaagucgauuaaaugcacuugguaaauccgaauuucaaauauauaagaaaaguggaauacaagaggucgacagaacuuuggcaaaagaagguauaaaacgaggugagacagaccaucaugcaguaucccgcggcagugccaaacuaaggugguucguagagcguaauauggugacacccgaagguaaaguugucgaccugggauguggucgagguggauggagcuacuauuguggagggcuaaagaauguucgagaaguaaaagguuuaacaaagggaggaccaggccacgaggagcccauaccgaugaguacguacggguggaaccucgucagacuacaguccggaguugauguauucuuuaucccuccagaaaaaugugacacauuguuaugcgauauaggcgaguccaguccuaaucccacaguagaagccgggcgaacguuacggguuuuaaauuuaguugaaaacuggcuuaauaacaauacgcaauuuugcauaaaaguuuuaaacccuuacaugccuucgguaauagagaaaauggaggcauuacaaagaaaauauggaggugcucuuguaaggaauccccuauccagaaauucaacacaugaaauguauuggguuagcaaugccaguggaaacauuguguccaguguaaauaugauaagcaggauguuaauuaauagauucacaaugagacauaaaaaggccaccuacgaaccugacguagaccuuggaucuggaacucgaaacauagguauugaaagcgaaauuccaaaucuagacauuauuggaaagagaauagagaaaauaaaacaagaacaugaaaccaguuggcauuaugaccaggaucauccauauaaaacuugggcuuaucacggcucuuaugaaacuaaacaaacgggcagugcuucaucgaugguaaacggggugguuagacuauuaacuaaaccuugggauguuuugccuacagucacacagauggcaaugacugauacaacaccuuuuggccaacagcgcguguucaaagagaaaguugauacgcgaacacaggaaccaaaagagggcacuaaaaaguuaaugaaaauaacagcggaaugguuauggaaagagcuaggcaagaagaaaacaccacgaauguguacacgugaagaguucacacgaaaaguuaggucaaacgccgcauuaggugcaauauuuaccgacgagaacaaauggaaaucugcaagagaagcaguugaagauucuagguucugggaguuagucgauaaggaacgcaaucuccaucuagaaggaaaaugugaaacaugcguauacaacaugauggguaaacgggaaaagaaacuaggugaauuugguaaagcaaaaggaucuagagccauuugguacauguggcucggagcacgcuuucuugaguucgaggcuuuaggauuuuuaaaugaagaccacugguuuagucgagaaaauucacugucugggguagaaggagaaggucuucacaaauuggguuauauuuugcgcgauguuucuaaaaaggaagggggagcaauguaugcugaugauacagccggaugggauacucgaauaacgcuggaagaucucaagaacgaagagaugguuacaaaccauauggaaggggaacauaagaaacuggcagaagcaauuuuuaaacugacauaccaaaauaaaguaguaagaguccagagaccaacuccacguggcaccgugauggauauaaucucgaggcgagaucagaggggaucuggccaaguaggaacguaugguuugaauacauuuacaaacauggaagcacaauuaauucgacaaauggaaggugagggaguauucaaaaauauucaacaccucacuguaacggaagaaguagcaguucaaaacuggcuugcaagaguagguagagaaagacuuucucgaauggcuauuagcggggacgauugcgucgugaaaccucuagaugauagguuugcgaaugcacugacggcacuaaaugacauggggaaaauccguaaagauauccaacaaugggaacccagcaaaggauggaaugauuggacucaaguaccauuuugcagucaccacuuucaugaguugauaaugaaagaugggagaguucuaguaguccccugcagaaaucaagaugagcuuauaggcagggcuagaauuucccaaggugcggguuggucccuucgagaaacagccugccucgguaagucauaugcucagaugugguccuuaauguauuuucacagacgcgaucuacgacuagcagccaacgcaaucugcucagcagucccaagucacuggguaccuacaagcagaacaacguggaguauacaugccaaacacgaauggaugacaacggaagacauguuaaccgucuggaaucgagucuggauucgagacaauccauggauggaggacaagacuccgguggagagcugggaagaaaucccauauuuaggcaaaagagaagaucaauggugcggaucacugauaggauugacuucacgugcaacuugggcuaagaauauucaagcugcuauuaaucaaguucguucacuuauugggaaugaagaguauaccgacuauaugccuucaaugaaaagauuucgacgagaagaagaggaagccgguguuuuaugguga

SEQ ID NO: 22741 - RNA, 9876 nt, Artificial Sequence
  derived and/or modified CDS sequence (opt6) from DENV-2__EU482659__SS-prME
ucagcagguaugauaauaaugcucaucccaacgguaauggcuuuucaucucacaacuagaaacggugaaccacacaugauuguugggauacaagaaaaagggaaaucgcuacuauuuaaaacugaagaugggguaaacaugugcacguuaauggcuauggaucuaggugaauugugugaagauacuauuacauauaaauguccacugcuaagacaaaacgaaccagaagauauagacuguuggugcaacaguacuucaacuuggguaacuuacggcacaugcacgacuacgggggagcauagaagagaaaaacguaguguagccuuggucccacauguaggaaugggauuggagacacgaacugaaacguggaugucaucagagggggcuuggaaacaugcucaacggauugaaacuuggauacugcgacacccaggauucacgauuauggcugcaauccuagccuacacaauaggaacaacacauuuucaacgcgugcuuauauuuauucuauuaacagccguugcaccaucaaugacaaugagaugcauagguauauccaaccgggacuuuguagaaggaguaagcggugguuccuggguagauauaguauuggagcauggcucuugcguuacaaccauggccaaaaauaaaccaacacucgauuucgaauugauaaaaacagaggcaaaacaaccagccaccuuacguaaauauuguaucgaagcuaaacugacaaauacaaccacggagagccgauguccuacccaaggagagccuucauuaaaagaggaacaggauaaacgcuucguuuguaaacacaguaugguugaccgggguuggggaaacggaugcggacucuucgguaaaggaggaauaguuacaugugcaauguucacuuguaagaaaaauauggaaggcaaaauuguacaacccgaaaauuuagaauacacaauugucgugacuccgcauaguggagaggagcaugcagucgggaaugauacagguaaacacgguaaggagauuaaagucaccccacaaaguuccauaaccgaggcggaacucacaggguaugggacuguaacgauggaguguucaccuagaacuggccuugauuuuaacgagaugguauuauuacagauggaaaacaaagcaugguuagugcaucgacaaugguuuuuggauuuaccccuuccgugguuaccuggagcugauaaacaggaaucaaauuggauucaaaaagaaacacuugugacauuuaaaaauccacacgccaagaaacaggacgugguagucuuaggcagccaggaaggugcuaugcacacagcacuuacgggggcgacagaaauucaaaugucaaguggaaauuugcuauucacaggacaccuaaaguguagauugcgaauggacaagcugcagcugaaagggaugaguuauaguaugugcaccgguaaauuuaaagucgucaaggaaauagcggaaacacaacacggcacuauugugauacgaguccaauaugaaggcgauggcucacccugcaaaauuccauucgagauuauggacuuggagaaaagguauguccucggcagacuuauaacuguaaaucccaucguaacagagaaagauucgcccgugaacauagaagcugagccuccuuucggagacucuuauauuauaaucggaguagagccuggacaacugaaacugaacugguuuaagaaagggaguagcauaggacaaauguucgagacaaccaugcggggagcuaaaagaauggcgauucuaggcgacacggcaugggacuuuggaucgcuuggcgggguauucaccucuauaggaaaggcacuacaccaaguuuucggagcuauauauggagcagcauuuaguggugugaguuggaccaugaagauacuuauuggaguaauuauaacauggauaggaaugaacucgaggucaacuucauuaagcguaucacuggucuuaguaggaauuguaacauuauacuuggguguaaugguucaagcugauaguggcuguguuguaaguuggaaaaauaaggaacuuaaauguggaaguggcauauuuauaacagacaauguccauacuuggacggagcaauacaaauuccaaccagagaguccaaguaaguuggcuucagcaauucagaaagcacaagaagaagguauaugugguauaagaagcgugacgcgacucgaaaaucuaauguggaaacaaauuacccccgaacuaaaccacauauuagcagaaaacgaaguaaaacuaacaauaaugaccggagacauaaaaggcauaaugcaagcggggaaacgguccuuaagaccacaacccacggagcuuaaauauucauggaaaacauggggcaaagcaaaaaugcugucgacggaaucauacaaucaaacauuccuuauagauggaccagaaacaaccgaauguccaaacacuaaccgugcuuggaacagcuuggaagucgaggacuauggauucggaguauucacaacuaacauaugguuaaagcugaaagaaaagcaggaugcuuucugugauaguaaacuaaugucagcagcaauuaaagauaacagggcugugcaugcggacaugggguauuggauagaaagugcccuaaacgacacauggaaaauagaaaaggcuucauucauugagguuaagaauugccauuggccuaagagucacacacuguggucgaaugguguacucgaaagcgagaugauaauuccgaaaaauuuagcggguccaguuagucaacauaacuaccgaccaggauaccauacacaaauagcgggaccuuggcaccuaggaaaacuugaaauggauuuugauuucugcgauggaaccacaguaauagucacagaagauugugguaacagggguccgucacuuaggacuacuacugcauccgggaaacucauaacagaauggugcugucgcaguuguaccuugcccccacuucgauauagaggcgaagauggguguugguacggcauggaaauucggccauuaaaagaaaaagaagaaaacuuagugaacagccuaguaaccgcaggccauggucaaguugauaauuucucgcuaggaguauuaggaauggcuuuguucuuagaagaaaugcucaggacucggguaggaacaaaacaugcuauccuacucgucgcagucucguucguuacgcucaucacaggaaauaugucuuuuaaggaucugggucgaguaguaguuauggugggggcaacaauggcugacgauaucggaaugggaguaaccuacuuagcguuacuagcagcauuuaaggugagacccacuuucgcugcgggccuauuacuacgaaaacucacuucaaaggagcugaugaugacaacuauaggaauuguacuccuaucccaguccacgauacccgaaacaguucuagaacugacugacgcauuggcgcuuggcaugaugguccuuaaaauagugagaaauauggaaaaauaucaacuagcaguaaccauaauggcaaucuuaugcgucccaaacgccguaauacuucaaaaugcauggaaagugucuuguacgauuuuagcgguugugaguguaucaccauuacuacuaacaucaagucagcagaaaacugauuggauuccuuuggcauugacaauaaaaggacuaaacccaacagcaauauuccuuacuacacuaucaagaacaaauaagaaaagaaguuggcccuuaaacgaagcuauaauggcuguugguaugguaucuauacuggcaucuucgcuauuaaagaaugacauaccaaugacuggcccgcugguagcgggaggcuuguuaacaguuuguuacgucuuaacagggagaagugcagauuuagaauuggaacgagcuacagacgugaaaugggaagaucaagccgaaauaucaggaucuuccccgauauuaaguaucacaauuucagaggacggcaguaugucuaucaaaaaugaagaagaagaacagacacucacaaucuuaauuagaacaggacuucuaguuauaucaggucuauuccccaucagcauaccgauaacagcggccgccugguauuuaugggaagucaagaaacaaagagcaggaguucuaugggacgugccaucgccacccccgauggguaaagcugaguuggaagacggugcuuaucgaaucaaacaaaaaggaauacuuggauauucgcaaauaggggcaggaguguauaaggaagggacuuuucacacaauguggcaugucacacguggagcgguguugaugcacaaaggcaagcguauagaacccagcugggccgacguaaagaaggaucuaauaucguaugguggaggguggaaauuagaaggagaauggaaggaaggcgaagaaguacaaguacuugcacucgaacccgggaaaaauccacgagcgguacaaaccaaaccaggauuauuuaaaacaaacacgggcaccauuggcgcagucucucuagacuucucacccggaacuucuggaucuccaaucauagacaagaaaggaaaagucguaggacuuuacggcaacgguguaguuacacgaaguggcgcuuacgugucagcgauugcucaaacagaaaaaucaaucgaagacaauccugagauagaagaugauaucuuucgcaaaagacgccuuaccauaauggacuugcaucccggagccggaaaaacaaaacgcuauuuaccagcuauaguacgcgaggcuauaaaaagaggauuaagaacacuuauuuuggccccaacacgaguaguggccgcagaaauggaggaggccuuaagaggccucccaauuagguaucagacacccgcgauacgggcugagcacacaggaagagaaaucguggacuuaaugugucaugcgacguuuacgaugagacucuuaagcccaguaagagucccuaauuacaaccucauuauaauggaugaggcacacuuuacggauccggcgucuauagcagcaagaggcuauaucagcacaagaguagaaaugggcgaagcugcuggaauauuuaugacagccacaccaccagggaguagagauccauuuccucaaucgaacgcaccuauaauugaugaagaaagagagauuccggaacgaucguggaacacuggucaugaaugggucacugauuuuaaagguaaaacagucugguuugucccgucgauaaaggccggcaaugauauugcugcaugcuuaaggaaaaauggaaagaaagucauacagcugaguaggaaaacuuuugacuccgaauacguaaaaacuaggacgaaugauugggacuucgucguuacaacagacauaagugagaugggagcuaacuucaaagccgaacgagucaucgauccgcgaagauguaugaaaccgguaauacugacagauggugaagaacguguaauuuuagccggaccgaugccaguuacucauaguagcgccgcacaacggagaggcaggauaggaagaaaccccaaaaacgagaacgaucaauacauuuacaugggagaaccccuagaaaacgaugaggauugugcucacuggaaggaagccaaaauguugcuagauaacauuaacacgccagaaggaauaauaccgagcauguucgaaccggaaagagaaaaaguugaugcaauagacggagaauaccgauuaaggggagaagcuagaaaaaccuuuguggaccucaugcgcagaggugauuugccuguauggcucgccuauaaaguggcagccgaagguauuaauuacgcugacagacggugguguuucgauggcauuaaaaauaaccaaauacuugaggagaacguagaaguagaaauauggacuaaggaaggcgaaagaaagaaguugaaaccgagauggcuugaugcacguauuuauucggacccauuagcacugaaagaauuuaaagaauuugccgcugguagaaaaucucuaacccuuaaucugauaacugaaaugggacgguuacccacuuucaugacgcaaaagacacgugaugcauuagacaacuuagcuguauugcacaccgcagaagcuggggguagggccuauaaccacgcgcuaucugaguuaccagaaacuuuagaaacacuacuucuucugacuuugcuggccacuguaacagguggaauauuucuuuuucucaugucugguagggggauagguaagaugacacuuggaauguguugcauaauaacugcaucaauauugcuaugguaugcccaaauucaaccacauuggauugccgcaucuauuauacucgaguucuuucuuauuguauugcucauaccagaaccagaaaaacaaagaacaccacaagauaaccaauuaacuuauguaguaauagccauccugacugucguagcugccacuauggcuaacgaaaugggguuuuuagagaaaacgaagaaagaucuaggucuaggguccauugccacacaacagccugagucuaauauauuagauauagauuuacgacccgcaucagcuuggacauuauaugcuguugcaaccaccuucguaacuccuaugcuacgccacuccaucgaaaacucuagcguuaauguaucacuaacagcaauugccaaucaggcuacuguauuaaugggcuuggggaaaggguggccccucucuaaaauggauauagggguaccauuauuagcaaucgguuguuacagccaaguaaauccuauaacucuaacggcagcacuauuauuauuaguagcgcauuaugccauaaucggaccuggccuacaagcaaaggcaacaagggaagcucaaaaacgggcagcugcagguauaaugaaaaacccaacaguagacgggauaacagucauagauuuggauccaauaccauacgauccaaaauucgagaagcaacucggucaaguuaugcuauugauccuauguguuacacaaguuuuaaugaugaggacgacaugggccuugugugaagcgcuaacuuuagcgacagggccaauaagcacacugugggaagguaauccaggaagauuuuggaacacaacgauagcgguaucaauggcaaacauuuucagaggcucauacuuagcgggagcuggauuauuauucucaauaaugaaaaauaccacaaacacgcgcagaggcacaggaaacauuggagaaacucucggugaaaaauggaaaucuagacugaacgcucucgggaaaucugaauuucagaucuacaagaaaagcggcauccaagagguagaccggacauuagccaaagagggaauaaagcgcggggaaacggaccaucaugcugucucccgaggaagugcaaaacuccggugguucguagaaaggaauauggucacaccugaaggaaaaguagucgacuugggcuguggacguggaggguggagcuauuacugcggcggcuuaaagaacguucgagaaguaaaaggcuugacuaaaggugguccaggacacgaggaaccgauuccaaugaguacuuauggauggaaccuuguccgacuccagucaggaguugacguauucuuuauuccaccagaaaaaugugacacacuacuaugugacaucggggagucauccccgaauccaacaguggaagcagggagaacccuaagagucuugaaucuaguugaaaacuggcuuaacaauaauacacaauucuguauuaaaguucugaauccguacaugcccaguguaauugagaaaauggaggcucuacagcguaaacaugggggagcucucguacgcaauccacuaucgcgcaacaguacacaugagauguauuggguaucaaacgcuucugguaacauaguaucgagcguaaauaugauaaguagaaugcucaucaacagauucacaaugcgacauaagaaagcaaccuaugaacccgacguagaucuagguucaggaacaaggaauauuggaauagagucagagaucccgaaucuagauauaauuggcaaaagaauagagaaaauaaaacaagagcaugaaacgaguuggcauuaugaucaagaucauccauacaaaacuugggcguaccauggcucguaugaaacgaaacaaacaggaucugcgucgucuaugguaaauggugugguaaggcugcuuacaaaaccaugggauguucuaccuacuguaacacagauggcaaugacagauaccacuccuuucggacaacagcgaguauuuaaagagaaaguugauacaagaacccaggagccaaaagaaggcaccaagaaacuuaugaaaauaaccgccgaaugguuauggaaagaacuggggaagaagaaaacaccucgaauguguacgagagaggaauuuacacgaaagguaagaaguaaugcagcauuaggggcaauuuucacugacgaaaacaaguggaaaagugcuagggaagcaguagaagauucaagauucugggaacuuguugauaaggaaagaaaccuucaucuggaagguaagugugaaaccugugucuauaauaugaugggaaaacgcgagaagaaacuaggcgaguuugggaaagcaaaaggauccagagcaauaugguauauguggcuaggcgcacgguuucuagaguuugaagcacuagguuuucuuaaugaggaucauugguuuagccgagaaaauuccuugucugggguugaaggagaaggucuacacaaauugggauacauacuacgagauguguccaagaaagaagguggcgcaauguaugccgacgacacagcuggaugggacacucggaucacgcuagaagauuuaaagaaugaggaaauggugaccaaccauauggaaggggagcacaagaaacucgcagaagcaauuuucaaauugacauaucaaaacaaaguagucagagugcaacguccaacaccucgagguacaguuauggauauuauaagcaggagagaccaaagagguaguggucaaguaggaaccuacggguugaauacuuucacaaauauggaagcucaacuuauaagacaaauggagggcgaaggaguauucaaaaauauccaacauuuaaccguaacugaagaaguagcaguacaaaacuggcuagcccgaguaggaagagaaagauugucacggauggcaauuagcggagacgauuguguagucaaaccucuggacgauagauuugcaaaugcauuaacugcucuaaacgauauggguaaaauucgaaaagacauacaacagugggagcccucuaaggguuggaacgacuggacccagguaccauuuuguucucaucacuuccaugaauugauaaugaaagacggaagaguacugguagucccauguaggaaccaagacgagcuuauugguagagcucgcaucagccaaggcgcaggguggucacuccgagaaacugcaugccuaggaaaauccuaugcgcaaauguggagucuaauguacuuccaccgcagagauuuacgucuugcggcuaaugcuauaugcagugccguaccaagucacuggguaccgacgagucguacuaccuggaguauacacgcaaaacacgaguggaugaccacagaagauauguuaacaguauggaauaggguuuggauaagagagaacccuuggauggaagacaaaacuccuguagaaagcugggaggaaauucccuacuuagggaagagggaagaucaauggugcggcucuuuaauaggacuuacaagucgcgcaacgugggcuaaaaacauccaagcagcaauuaaucaaguaagaagccuuaucggggacgaagaauauacggauuacaugccuuccaugaagagauuuagaagggaggaagaagaagcaggagugcucugguag

SEQ ID NO: 22742 - RNA, 9876 nt, Artificial Sequence
  derived and/or modified CDS sequence (opt6) from DENV-2__EU482661__SS-prME
ucagccggaaugauuauaauguuaauaccaacuguuauggcauuucaucuuaccacaaggaauggagaaccacauaugauaguaggaauacaggaaaaaggcaaaucacucuuauucaaaacagaagauggaguaaacauguguacauuaauggcuauggaccuuggcgaauuaugugaagauacaauaacauauaaauguccccuucuaagacagaaugaaccagaagauaucgacuguugguguaacucaaccuccaccuggguuacuuaugguacauguaccacuacaggggaacauaggagggagaaaagguccguggcguuaguuccucauguaggaaugggccucgaaacccggaccgaaacauggaugaguagcgaaggggcauggaaacaugcucaacgaauagaaacguggauauuaaggcacccaggauuuacgauuauggcagcaauacuugcauauacuauuggaacgacucauuuccaacgagucuugauauuuauuuuauuaacugccguagcgccgagcaugacaaugcgguguauaggaauaagcaauagggauuuugucgaagguguuucgggcgggagcuggguugacauaguucuugaacaugguucuugugucacaacuauggcuaaaaacaaaccuacucuugauuucgaacugaucaaaaccgaagcgaaacagccagcuacucugagaaaauacugcauugaagccaaauuaacgaacacuacaacagaaucaagguguccaacucaaggcgaacccagucuuaaagaagaacaggauaaaagauuuguauguaaacacuccaugguagaucgaggauggggaaauggcuguggauuauucgguaaagggggaauaguuacaugcgcaauguuuacauguaagaaaaauauggaaggaaaaauaguacaaccggaaaaccucgaauauaccauuguaguuacuccacauuccggcgaagaacacgcagucggaaaugacacuggcaaacacggcaaagaaauaaaagucacaccacaaucuagcauaacagaagccgaauugacaggauaugggaccguuacuauggaaugcucaccacgaacuggauuagauuucaaugaaaugguacuacuacaaauggaaaauaaagcauggcucguacauagacaaugguuccuagauuuaccauuaccuugguugccuggagcugacaaacaagaauccaauuggauucaaaaagaaacgcuaguuacauuuaaaaauccacacgcuaagaaacaagacguuguaguacuaggaucucaggaaggagcuaugcacacagcacuuacgggagcuacagaaauucagaugagcucggguaacuuauuauuuaccgggcauuuaaaaugucgacucagaauggauaaacugcaguuaaaaggaaugucauauagcaugugcacaggaaaauuuaagguuguuaaagaaauugcugaaacacagcauggaacaauaguuauacgaguacaauaugaaggugauggcucaccauguaagauuccuuuugaaauaauggauuuagaaaagagauaugucuuaggacgguuaauuacaguuaauccgauuguuaccgagaaagauaguccugugaauauagaagcggaaccgccauucggcgacucauauauuauuaucgguguggaaccaggucaauuaaaauugaauugguucaagaaagguagcaguauuggucaaauguucgaaacaacuaugcgaggagcaaagagaauggccauuuugggcgauacagcuugggauuucggcucucuuggaggaguuuuuacuucaauugguaaagccuuacaccaaguauuuggagcaauauauggagcugcguuuaguggggugagcuggacgaugaagauuuugaucggcgugauaauaacauggauagguaugaacucucgcucaacaaguuugaguguaagccuaguccuaguugggauaguaacguuauaccuaggggucaugguccaagccgacucgggguguguuguuaguuggaaaaacaaagagcugaaaugcggcucggggaucuucauaacagauaacguacauacauggacugagcaauauaaauuucaaccugaaaguccuucaaaacuugcaucagcaauacaaaaagcccaagaggaggggaucugcggaauaaggucagugacaaggcuagaaaaucucauguggaagcaaauaacuccagaacugaaucacaucuuggcugagaaugaaguuaaacuuacaaucaugaccggcgauauaaaggguauaaugcaagcaggaaaacgaucuuuacguccacaaccgacagaacugaaauacaguuggaaaacauggggcaaggccaaaauguuaucaaccgaaagcuacaaccaaacuuuucuaauagacgguccggaaacggcagaaugcccgaauacaaaucgcgcauggaacucacucgaaguugaagacuauggguuugguguauuuacuacuaacaucugguuaaaacuuaaagaaaaacaagaugcauuuugugauucaaaacuuaugagcgcagccauuaaagauaaucgagccguacaugcagauaugggauauuggauugaaucugcacuuaacgacacauggaaaauugaaaaagcaucauucauagagguuaaaaauugucauuggcccaaaucacacacuuuguggaguaauggaguucuugaaagcgaaaugaucauacccaaaaauuuagcuggcccuguuagucaacacaacuauagacccggguaccauacgcagaucgcagggcccuggcaucuuggaaagcuagagauggauuucgauuucugcgauggaacgaccguaauaguaacagaagacugcgguaauagaggaccuucccuucgaaccaccaccgcuagugguaaacucauaacggaauggugcuguaggagcuguacguugcccccauuacgguaucgcggcgaggaugggugcugguacgggauggaaaucagaccgcugaaggaaaaagaggaaaaucuaguaaauagucuaguaacggcuggacacggacagguagauaacuuuucacuuggaguuuuaggcauggccuuauuucuugaagaaaugcuuagaacgagagucggcacaaaacacgcaauucucuuaguagcagugucuuucgucacgcuaaucacugguaacaugucauuuaaggauuuaggacgcgucgugguaaugguaggcgcaacaauggcggacgacauagguaugggcgucacguaucuagcacuuuuagcugcuuuuaagguaagaccaacguuugcggcaggacugcuacugaggaaacuaacuucuaaagaauugaugaugacuacuauaggaaucgugcuucuuagucaaucaacaauaccugaaacgguauuggaacuaacugaugcuuuggcauuaggaaugaugguuuugaaaauuguucguaacauggaaaaauaccaacuagccguaaccauaauggcaauuuuauguguuccgaaugcagucauauuacaaaacgcauggaaaguaucguguacaauauuagcugugguauccgucagcccuuuacuauuaacgucaucucaacaaaagacggacuggaucccuuuagcauuaacaauaaaggggcuuaauccaacggcuauauuccuuacaacauuaaguaggacgaauaagaaacguagcuggccacuuaaugaagcuauuauggccguaggaaugguuagcaucuuagcgaguagucuucuaaagaacgauauuccuaugaccggcccacucguagccggaggucuauugacaguguguuaugucuuaacaggaagauccgcugacuuggaacuagaaagagcaacggacguuaaaugggaagaucaagcagaaauuuccggaagcagcccgauacucucuauuaccauaucugaagacggaucaaugucuauaaagaacgaagaagaagaacaaacauuaacuauacuaaucaggacuggacuacucguaaucucagggcuuuuuccuauuucuaucccuauuacagcagcagcuugguauuugugggaagugaagaaacaaagggcaggagucuuaugggacguucccagcccaccaccuaugggcaaggcugaauuagaagauggagccuaucguauaaagcaaaaaggaaucuugggauacagucaaauaggggcggguguauacaaagaggggacauuucauacaauguggcacgugaccagaggagcagucuuaaugcauaaaggaaagagaauagagccuuccugggcugacguaaagaaagaccuaauauccuauggagguggcuggaaguuagaaggagaguggaaagaaggagaggagguacaaguucuggcauuagaaccaggaaagaauccucgagcaguccaaacgaaaccggggcuguuuaagacuaauacuggcacaauuggagcaguaaguuuggauuuuucgccuggaacaucugggucaccaauaauugacaagaaagguaaagucguuggauuguauggaaauggcgucgucacacggucaggagcuuacguuagcgcgauagcacaaacggaaaaaucgauagaagauaaccccgaaaucgagggagauaucuuucgcaaaagaagacuuaccaucauggaccuccauccaggugccgggaaaacaaaaagauauuuaccugcuauaguuagggaggccaucaaaagggggcuuaggacacuuauccuugccccgacuagaguuguagcugcugagauggaagaagcguuaagaggccuuccgauucguuaucaaacuccugcaauuagagcagaacacacagggcgagaaauaguagaucucaugugucacgcaacuuuuacaaugagauuauuaucuccuguccgagugccaaacuacaaucucauuaucauggaugaggcccacuuuacugacccagcauccauagcugcaagaggauauauuucaacaagaguagagaugggagaggcggcagggauauucaugacggcaacuccaccuggaagccgcgaccccuuuccacaaucaaaugcaccaauuaucgacgaagaacgagaaauuccagaaagauccuggaauaguggucacgaauggguaacagacuucaaagguaaaacaguaugguuuguaccuaguauaaaggcagggaacgacauugcugcaugcuuaaggaaaaacgggaagaaagucauacaauuaagccgaaaaacauuugauucggaguacguaaagacacgaacaaaugauugggacuuuguaguaacaacagacauuucugaaaugggggcaaauuucaaagccgaacgcgugauagauccuagaagauguaugaaaccaguuauauuaacugauggagaagaaagggugauccuugcagguccgaugccuguuacgcacucgagugcagcacagagaagagguagaauagggcguaaucccaaaaaugaaaacgaucaguauauauauaugggagaaccauuagaaaaugaugaagauugugcacacuggaaggaagcaaaaaugcuguuagauaauauaaacacaccagagggaaucaucccgucaauguuugaaccggaaagagaaaaggucgacgcuaucgauggagaauacagacucagaggggaagcacggaaaacauucguagaucuaaugcggagaggggaccucccuguauggcuggcauacaaaguagccgcagaaggaaucaauuaugcugaucgaagaugguguuuugacggaaucaaaaauaaccaaauauuggaagaaaaugucgagguggagauuuggacaaaagaaggggaacgaaagaagcuaaaaccaaggugguuagaugccagaauauauucugauccgcuugcacugaaggaguuuaaagaguucgccgcaggacggaagucacuuacguuaaauuuaauaaccgaaaugggacguuuacccacauuuaugacacagaagacucgagacgcuuuagacaaccucgcaguacuucacacggcagaggcugguggcagagcguacaaucaugcgcuaucagaacuaccagaaaccuuagaaacccuucuacuccugacuuuacuagcaaccguaacagguggaauuuuccucuucuuaaugagcgguagaggaauagguaaaaugacucugggaauguguugcauaauaacagccaguauacuucuuugguaugcacaaauucaaccacauuggauagcugcauccaucauauuggaguucuuucugauaguacuauugauaccagaacccgaaaaacaaaggacuccucaagauaaucaauugacauauguaguaauagcgaucuugacgguuguagcggccacaauggcuaacgaaaugggguucuuagagaaaacuaagaaagaucuuggucuaggaaguauugcuacucaacagccagaaagcaacauauuagauauugaucuucggccagcauccgcuuggacuuuauaugccguagcgacaacauuuguuaccccaauguugcgucauuccauagaaaacaguucuguaaacguuucccucacugccauugcuaaucaggccacgguccuuaugggacugggaaagggcuggccguuaaguaaaauggacaucggaguaccacuuuuagccauagguugcuacucgcaaguaaaccccauuacccucacagccgcccuccuauuguuaguagcucauuaugccauaauuggaccagggcuccaagccaaggcaacuagagaagcgcagaaaagggccgcagcgggaauaaugaaaaaucccacuguagaugguauaaccgucaucgauuuggaccccauaccuuaugacccaaaauucgagaagcaacuuggacaaguuauguuacugauccuaugugugacccaaguauuaaugaugagaacaacuugggcccuuugugaggcccuuacguuagcuaccggcccgauaagcacucuuugggagggaaacccaggaagauucuggaauacgacaaucgcggucucgauggcuaauauauuucgaggaucguaucuagcgggugcagguuuauuauuuucaauaaugaagaauacaacaaauacacgccgcgguacagguaauaucggagaaacauugggagagaaauggaagucgcgucuuaacgcacucgguaaaagcgaguuccaaauuuauaagaaauccggcauucaagaaguggaccggacauuagcaaaagaaggaauaaaacguggggagacagaccaccacgccguaucacguggauccgcaaaacuaagaugguucguagaaagaaauaugguaacaccggaaggcaaaguagucgaucuagguuguggacgugguggcuggucauauuauugcggggguuuaaagaacguacgagaagucaaaggacugacaaaagggggacccggucaugaggaaccuauucccaugucgacauacgguuggaaccuuguaagacugcaaaguggcguagauguauucuuuauuccaccggaaaagugcgauacccuacuaugugacauaggggaaucuagcccaaauccaacuguagaagccgguagaacacucagaguucuaaaucugguggaaaauuggcuuaauaauaauacgcaauucuguauaaaaguuuuaaaucccuauaugccaagugugauugagaaaauggaggcccuccagagaaaauacggaggcgcucucgugagaaacccuuuaucacgaaauaguacucaugagauguacuggguaagcaaugccucugguaauauaguuaguaguguuaacaugauaucuagaaugcuuauaaauagauuuacaaugagacacaagaaagcuacauaugaaccagacguugaucucggauccggaacuagaaacauugggauugaaagcgaaauacccaauuuggacauaauugguaaacgcauagagaaaauaaagcaagaacacgaaacgucuuggcauuaugaucaagaucacccguacaaaacuugggcauaucauggcaguuaugagacaaaacaaacagguagcgcaaguaguauggugaauggagucgugagauuauuaacaaaaccgugggaugucuuaccgaccgucacacaaauggcaaugacugacacgacgccauuuggccagcaacgaguauucaaagagaaaguagauacgagaacucaggagcccaaagaagguacaaagaaauugaugaaaauaaccgcugaauggcuuuggaaagaauugggcaaaaagaaaaccccgagaauguguacaagagaagaguucacaagaaaaguccguucuaaugcugcgcuuggagcaaucuucacugacgaaaauaaauggaaauccgcucgcgaagcgguugaagauagcagauucugggaauuaguagauaaagaaagaaaccuacauuuggagggaaaaugcgagacguguguuuauaauaugaugggcaagcgagagaagaaacuaggggaguucgggaaagcaaaagggucacgagcuauaugguauauguggcuaggggcaagguuccuagaguucgaggcuuuaggauucuugaaugaagaucauugguucucuagagaaaauucacuaagcggggucgaaggugaaggauuacacaaauugggguacauauuacgugauguaucgaagaaagaaggcggcgcaauguaugcagaugauacagcgggaugggauacacggauuacccuugaagaucuaaagaacgaagaaaugguuacuaaccauauggaaggagaacauaagaaauuagcagaagccaucuucaaauuaacguaucaaaauaaaguuguaagagugcagaggccgacacccaggggaaccgugauggacaucauaucaagacgagaucaaagagggucaggacaaguaggaacauacggccuaaacacguuuacuaacauggaagcgcaauuaauacgacaaauggaaggagaaggcgucuucaaaaacauacaacaucugacagugacagaggaaguugcuguucaaaauuggcuagcgcgcguagguagagaaagacuaucgagaauggcaauaucaggcgacgacugcguaguaaagccuuuagaugauagauucgcaaacgcauugacagcucuuaaugauauggguaaaauuaggaaggauauccagcaaugggaaccaucaaagggcuggaaugacuggacucagguaccauuuugcucacaucacuuccaugaacuaauaaugaaagauggcagagugcuaguuguuccauguagaaaccaggaugaguuaauagggcgugcuagaauaucacaaggagcugguuggucacuacgagaaacagcuuguuugggaaagagcuaugcccaaauguggucgcuaauguauuuucaccggcgagacuuacguuuagccgcuaaugcuauauguucagcaguaccgagccacugggugccuacuucucguaccacuuggucaauacaugcuaaacacgaauggaugacuacggaagauaugcuaacgguguggaauaggguauggauccgagaaaauccguggauggaagacaaaacuccaguugaauccugggaagaaauucccuaccuagggaagcgagaagaccaaugguguggaagucuaauuggcuugacgucaagagcuacaugggccaaaaauauacaggccgcaauuaaccaaguacgaagucuaauaggaaaugaagaauauacagauuauaugccaucaaugaaacgcuuccgcagggaggaagaggaagcaggcguuuuaugguaa

SEQ ID NO: 22743 - RNA, 9876 nt, Artificial Sequence
  derived and/or modified CDS sequence (opt6) from DENV-2__EU482662__SS-prME
acugcagggguuauuauaaugcuuauacccacagcgauggcauuucaccuuacaacaaggaauggagaaccacacaugaucguaggaagacaagaaaaagggaaaucauuauuauucaaaacggaagacggaguaaauaugugcacauugauggcuaucgauuuaggugaauugugcgaagacacaauuaccuauaaaugcccauugcuccggcaaaacgaaccugaggacauugauuguugguguaauucgacuagcacgugggugaccuaugguacaugcacuacuacaggagaacauaggcgagagaaaaggaguguagcgcugguuccgcacgucggcauggguuuagaaacacgaacugagacauggaugaguucagagggagcauggaaacacgcgcaaagaauagagaccuggauauuaaggcauccuggauucacgauaauggcugcgauacuagcguacacaaucggaacuacacacuuucaaaaagcgcuaauauucauacuacuaacagcaguagcacccaguaugacuaugagauguauagguauaucaaaucgcgacuuugucgaaggagucucaggaggaucauggguugauaucguauuagaacacgggucaugcguaaccacuauggcgaaaaacaagccaacucuggauuucgaacuaauaaagaccgaagcuaagcaaccugcuaccuuaaggaaauauugcauagaagcaaaacucacaaauacgacaaccgaaucucgaugucccacccaaggggaaccgucuuuaaacgaagaacaagacaagcgguuuguuugcaaacacuccaugguagauagggggugggguaauggaugcggacucuucgggaaagggggaauugugacaugugcaauguuuaccugcaagaaaaacauggaaggaaaaaucguacaaccagaaaaccuagaauauacaaucguaaucacaccgcacucaggagaagaacaugcaguggguaacgauacggguaagcaugguaaagaaauaaaaauaacaccacaaucaaguauaacugaagccgaacuuacagguuauggaacuguaacuauggagugcucuccccgcacuggcuuagauuucaaugaaaugguauugcuucaaauggaagacaaggcauggcucgugcauaggcaaugguuucuugauuuaccacuaccauggcuuccaggagcugauacacaaggauccaacuggauucaaaaagaaacacuugucacauucaaaaauccgcacgcgaaaaagcaagaugucguagucuuaggcucucaagaaggcgcaaugcauacggcccuaacgggagcgacggaaauccaaaugucuucagggaacuuacuuuucaccggacaucuuaaaugcagauuaagaauggauaaauuacaguuaaagggaaugucuuauaguauguguacaggaaaauuuaagauuguaaaagaaauugcugagacacagcacggaacaaucguuauucgcguacaauacgagggagacgggagcccuugcaaaauuccauucgaaauuauggauuuggagaagagacaugucuuaggacgccuaauuacaguaaauccuaucguuacagaaaaggauucaccagucaauauagaagcagagcccccauucggcgauucauacauaauaauaggaguagaaccuggucaacugaaauugaacugguuuaagaaaggaagcucaauaggacaaauguucgaaacaacaaugagaggggcuaagcgcauggcgauccucggagauacagcuugggauuuuggaucauuaggugggguauucacgucaaucggcaaagcacuacaccagguauuuggagcaauauauggagccgcauuuucaggaguguccuggacgaugaaaauccucauaggagcaauuauuacauggauaggaaugaacaguaggaguacaucacuaaguguuagcuuagugcuaguagguguaauaacgcuuuaccugggagcuaugguacaagcagauaguggcuguguaguaaguuggaaaaacaaggaauuaaaaugcgggucagguauuuucauaaccgauaacguacacacuuggacugaacaauacaaauuccaaccagagucucccucuaaguuggccucggcuauucaaaaggcacaugaagaggguauaugcggcauacguucuguaacgcgauuggaaaauuugauguggaagcaaauaacaccagaacuaaaccauauucugucagagaaugaggugaaguuaacgaucaugacaggugauauaaagggcauaaugcaagcaggaaaaaggaguuuacgaccucaaccuacggaacuuaaauauagcuggaagaccugggguaaagcgaaaauguuauccacagaaagucacaaccagacauucuuaauugacgggcccgaaacagcugaaugcccaaauaccaacagggccuggaacucucuagaaguagaagauuauggguuugguguauuuacuacuaauaucugguugaaacuaagagagaagcaggacguauucugcgauucaaaauuaaugucugccgcuauaaaagacaaucgugcaguucaugcggauauggguuacuggauagaaagugcucugaaugacacauggaaaauggagaaagcuaguuuuauagaagugaagucaugccacuggccuaagucacauacuuuaugguccaauggugugcuggaaagugaaaugauaauaccaaaauccuuugccgggccugucagucaacauaacuaucgaccuggauauuacacacagacagcaggaccauggcaccuugguaaacuagaaauggauuuugauuuuugugaggggacaacgguaguuguaacagaagacugcggaaauagagggccuucuuugagaaccaccacugcgucggguaaacuuaucacggaaugguguugccgaaguugcacacuaccaccccuccgauauagaggggaagacggcuguugguauggaauggagauccguccucugaaagaaaaagaagaaaauuuggugaauagucugguaacagcaggucacggacaaauugauaauuucucacuagggguccuaggcauggcguuauuccuggaagagauguuaagaacgcguguaggcacuaaacaugccauuuuauuggucgcagugagcuuuaugacauugauuaccggcaauauguccuucagagaccucgggagaguaaugguaaugguaggagcaaccaugacugaugacauaggcauggggguaacauauuuagccuuguuggccgcauucaagguacguccgacauuugcagcuggacugcuacucagaaaacuuacauccaaagaauuaaugauggcaacaauugguauagcauuauuaucgcagagcacaauuccagaaacaauccuggagcuaacagacgcuuuagcguuagguaugaugguccuaaaaauaguaagaaauauggaaaaauaccagcuagcagucacuauuauggcuauaucuugcgugcccaacgcaguaauccuacaaaaugcauggaaggucagcuguacuauuuuagcugcagucagugucaguccacuacuuuuaacuucgucucaacagaaagcugauuggauaccgcuggcacuaacaauaaaaggcuuaaacccuacugccaucuuccuaacuacauugucucguacaucuaaaaagaggaguuggccuuuaaaugaggcuauaauggccguagggaugguaaguauacuggcgucaagccuguugaaaaaugacauaccuaugacaggaccucuaguagccggugggcuauugaccguauguuauguccuaacaggccguagugcagaccuugaacuugagcgagcaacggacguaaaaugggaagaucaagcagaaauaagcggaagcucaccgauauugucaauaacuauuucggaggaugguaguauguccaucaaaaaugaagaagaagaacaaacacugacaauauuaauacguacaggcuugcuggugauuagcggccuuuucccaguaagcauaccgaucacugcugccgccugguaucucugggaggucaagaaacaacgagcaggaguuuuaugggaugugccauccccgccaccgguaggaaaagcagaauuggaagauggggcuuauaggauaaaacagaagggcaucuuggguuauucgcaaauuggagcuggcgucuacaaagaaggaacauuucacacuauguggcauguaacucgaggggcgguguuaaugcauagaggcaaaagaaucgaaccuuccugggccgacguuaagaaagaccugauauccuauggaggcggauggaaacuagaaggagaauggaaagaaggagaagaagugcaaguccuggcgcuagaaccagguaagaauccacgugccguacaaacaaaaccaggucuguucaagacaaauacaggaaccauaggggccgugucacuggauuucaguccaggcaccaguggaagucccaucguggauaggaaagggaaaguuguaggauuauaugguaacggagucgucacacgcaguggugcauacgugagugcaaucgcgcagacggaaaaaucaauagaggacaacccagagauugaagacgauauuuuccguaagaaacgacugacaauuauggaucuucauccaggcgcagguaaaacaaaaagauaccuaccagcuauugugcgggaggcuauaaaaagagguuuacggacauuaauauuggcgccaacuaggguaguugcagcagaaauggaagaggcacuaagagguuuaccaauucgauaccaaacaccagcuauccgagcagaacauaccggaagagaaaucguugauuuaaugugccacgcuacguuuaccaugcgcuuguuaaguccaguacgaguuccaaauuacaaccuaauaauuauggaugaagcucacuucacggacccagcaagcaucgccgcucgaggcuauauaucuacccggguugaaaugggagaggcagcggguauauuuaugacagcuacaccaccggggagccgcgauccauucccucaauccaaugcuccgaucaucgacgaagaacgggaaauaccagaaagaagcuggaacucugggcaugaguggguaaccgacuuuaaagggaagacugucugguucguaccuucaauaaaagcggguaaugacauugcagcaugucuucgcaaaaaugguaaaaaggugauacaacuuagucgcaaaacauuugacagcgaguacguaaaaacaagaacgaacgauugggacuuuguaguuaccacugauauaagugaaaugggggcaaacuuuaaggcugagcgcguuauagacccaagacgcugcaugaaaccaguaauauuaacugauggagaagaacgaguaauauuagcagggccaaugccaguuacacauuccucagcagcucagagaagaggacgcaucggcagaaaucccaaaaaugagaacgaucaauacauauauaugggagaaccgcucgaaaacgacgaagauugcgcacacuggaaagaagccaagauguuacuagacaauauuaacacacccgaggguaucauaccgaguauguuugagccggagagggagaaaguugaugcaauagauggagaguacagacuaagaggugaagcccgaaaaacauucguugaucuuaugcggagaggagacuuaccaguuugguuagccuaucguguggcagcagaggguauaaacuaugccgacagaaggugguguuucgauggagugaaaaauaaucaaauauuagaagaaaauguugaagucgaaauuuggacaaaagaaggggaaagaaagaaauuaaagccaagguggcuugacgcuagaaucuacucagacccgcuugcauugaaagaauuuaaggaguucgcggcaggacgcaaaucuuuaacccugaacuuaaucacagagaugggaagacugccaacauucaugacgcaaaaagcgcgggaugccuuagacaaucuugcuguguugcacacagccgaggcugguggaagggcauauaaccacgcgcuaucugaauuaccugaaacacuggaaaccuuacuacuguuaacuuuacucgcgaccgucacaggugggauuuuucuauuucuaaugucugggaagggcguagguaagaugacccuuggaaugugcuguauuauaacagcgucuauuuuacuuugguacgcucagauccaaccacauuggauugcugccuccauaauucuagaauuuuucuuaauaguacuacucauaccagaaccagaaaaacaacgaaccccacaagauaaucagcuuacuuacguagucauagcuaucuugacugugguugccgcgaccauggcuaaugaaaugggguuuuuagagaagaccaagaaagaccucggucuaggaagcauagcaacccaagaacccgagagcaacauacuggauauagauuuaaggcccgcaagcgccuggacgcuauaugcgguggcaaccaccuucguaacaccaaugcuacgacauagcaucgaaaauuccagcguaaauguaagccuaaccgcgauugccaaccaggcaacgguacuaaugggauuagggaaggguuggcccuuaagcaaaauggauauuggaguaccucuacuggcaauaggauguuacucacaaguuaauccaauuacacucaccgcagcacuucuacuacuuaucgcacacuaugccauaauugguccagggcuacaagcuaaagcaacaagagaagcacaaaaacgggcagcagcaggaauuaugaaaaauccgacugucgauggaauaacgguaaucgaucuagaucccauaccauacgacccaaaauucgaaaagcaacucggucaaguaaugcucuuaauucucugcguaacgcagguucuuaugaugcguaccacaugggcuuugugugaggcuuuaacauuagcgacgggaccaaucucaacuuuaugggaagguaacccaggaagguuuuggaauacgacaauugcgguuuccauggcaaauauuuucagaggaaguuaucucgcuggugcgggucuucuguuuuccauaaugaaaaauacuacaaacacaagaagaggaacggguaacaucggggaaacacuaggugaaaaauggaaaucacgauugaacgcacuaggaaaaagcgaguuccaaauuuacaagaaaucaggaauacaagaaguggaucgcacgcuugcuaaagaaggaaucaaaagaggagaaaccgaucaccaugcuguuucacgagguucagcuaaacugagaugguuuguugagagaaauaugguaacgccagaagguaaggucguagaccucgguuguggucguggaggauggucuuauuacuguggcgggcuaaagaauguaagagaggucaaaggcuuaacuaagggaggaccaggacaugaggaaccaauuccuauguccacguacgguuggaaccucguaaggcuacaaaguggggucgacguauucuucaccccaccagaaaaaugcgauacuuuauugugcgacauaggagaaaguucuccaaacccuacgauagaagcggggagaacauuacggguauuauccuugguugaaaauuggcuuaauaaugauacucaguucuguauuaagguauuaaauccuuacaugccaagcguuauagagaagauggaaaccuuacagaggaaauacggcggugccuuaguuaggaaccccuugaguagaaauagcacacaugaaauguauugggucaguaaugcaaccggcaauauuguauccucaguuaauaugauaagucggauguuaauaaauagauuuacaaugaaacacaaaaaggccacauaugaaccagacguagaucuuggguccggaacaaggaacauaggaaucgaaucagaaauaccuaaucuugauauaauugguaagagaauagagaaaauaaagcaagaacaugaaacuagcuggcacuacgaucaagaucauccauacaaaacuugggcguaccacgguuccuaugagacaaagcagacaggaucagcaagcagcaugguaaacggaguagucagacuauugacaaaaccuugggacgugguaccaaugguuacccagauggccaugacagauacgacucccuuuggccaacaaaggguauucaaagagaagguggacacccguacacaagaaccuaaagaagggaccaagaaauugaugaaaaucacugccgaauggcuauggaaagaauuaggcaagaagaaaacccccagaauguguacgagagaagaauuuacaaggaaaguucguucaaacgccgcauugggagcaauauuuaccgaugaaaauaaauggaaaagugcgcgagaagcuguugaggacagucgauuuugggagcuaguggacaaggaaaggaaccuccaucuagaaggaaagugcgaaacguguguauacaauaugauggggaaaagggaaaagaaacuaggagaauuuggcaaagcgaaaggaucacgagcaauaugguacaugugguugggggcgagauucuuggaauuugaagcucuaggauuccuaaaugaagaucauugguuuagcagagaaaauagucucucgggagucgaaggagaaggacuacauaaauuaggauacauauuacgagaugugagcaagaaagaaggcggugcgauguacgccgaugauacugccggaugggauacuagaauaacauuggaagaccuaaagaaugaagaaauggugacaaaucauauggagggagaacacaaacgguuagcagaggccauauucaaacuuacuuaccagaauaaaguuguucgcguccaaagacccacaccuagaggaaccgucauggacauaauuagcagaagggaccagagagguaguggucaaguugguacauacgggcuuaauacauuuacaaacauggaagcacaauuaauacggcaaauggagggagaaggaauauucaaguccauacaacauuuaaccguaacugaagaaauugcgguacagaacuggcucgcgaggguuggaagagagagguugucccguauggcaauaaguggugaugauuguguugucaaaccauuagacgacagauuugccucggcacucacagcacuaaacgauaugggcaaaguaaggaaagauauacaacaaugggaacccucaaaaggcuggaaugauuggacacaaguuccauucuguagccaucauuuucaugaauugauaaugaaagaugguagagugcuagugguacccuguagaaaccaagaugaacuaauuggacgggcaagaauuucccaaggagccggcuggucacuaaaagaaacugcaugcuuagggaaaucuuacgcucagauguggagucuuauguauuuucaucggcgugaccucagacuggcagccaacgcgauaugcagugcugucccaagccacugggugccaacgucaagaaccaccuggucaauacaugcuaaacacgaauggaugacaacugaggauauguuaacgguguggaaucgaguuuggauucaagaaaauccguggauggaggauaaaacuccuguagaaaguugggaagaagucccguaucuagguaaacgcgaagaccaguggugugguaguuuaauaggccucacaaguagagcuacaugggccaaaaauauacaaacugcuauaaaucaaguaagaucacuuauaggaaaugaagaauacaccgauuauaugccaucuaugaaacgauuuaggagagaggaagaagaagccggaguauugugguaa

SEQ ID NO: 22744 - RNA, 9876 nt, Artificial Sequence
  derived and/or modified CDS sequence (opt6) from DENV-2__EU482663__SS-prME
ucugcagggaugauaauuauguugauuccuaccgucauggccuuccaucugacuacgcguaauggggaaccacacaugauagucggcauacaagaaaaaggaaaaagucuauuauuuaaaacggaggaugguguaaauauguguacuuugauggcgauggauuuaggagaguugugugaagauacgauaacguauaaauguccacuucuaaggcaaaaugaaccggaggauauagacuguugguguaauucaacaucaacgugggugacauaugguacuugcaccacaacuggcgaacacagaagggaaaaacgaucaguggcguuggucccacacguuggaaugggauuagaaacucguacagagacguggaugaguagugaaggcgccuggaaacaugcacaacgaauugaaaccuggauacugagacaucccggcuucacgaucauggcugccauacuggccuauacaauagggacuacgcauuuccaacggguccuaauuuuuaucuuauuaacagcaguggcuccaaguaugacaaugcguuguauagggauuaguaauagagacuuuguugagggugugucuggggggaguuggguagauauaguccucgagcauggcuccugcguuacaacaauggccaaaaauaagccaacacuugacuucgaacucauuaaaacggaggccaagcagccugccaccuuacgaaaauacugcauugaagcaaaacuaacgaauacaaccacggaaucuaggugcccgacccaaggcgagccaaguuugaaagaggagcaagauaaaagauuugucugcaagcauucuaugguagaucgugguuggggcaaugggugugguuuauuuggaaaaggagguauaguaacaugcgcaauguucacuugcaaaaaaaauauggaaggaaaaauuguucaaccugagaaucuagaguacacaauaguagucacuccgcauagcggugaggaacacgcagucggcaaugauacgggcaaacacggaaaagagauaaaaguaaccccgcaguccucaaucaccgaggcggaguuaacaggguauggaacaguuaccauggaaugcucgccucggaccggcuuagacuucaaugaaaugguucuuuuacagauggaaaauaaagccuggcuaguucaucgucaaugguucuuagaucugccuuuaccuuggcugccaggugcggauaagcaagaauccaauuggauucagaaagagacucugguaaccuuuaaaaacccacaugcuaagaaacaagauguagugguguuagggagucaagagggagcaaugcauacagcguugacaggagccaccgaaauccaaaugagcagugguaacuugcuguuuacugggcaccuaaaaugucgguugagaauggauaagcuacaauuaaagggcaugucauacucuauguguacgggaaaguucaaaguaguaaaagaaauagccgaaacucagcacggcacaaucguaauaagaguucaauaugaaggagaugggagcccuuguaaaauaccuuucgaaauaauggaccuagaaaaaagguacguauuggggagacuaauuacagucaacccaaucguuacagaaaaagauagucccguaaacauagaggcagaaccaccguuuggagauucauauauaauaauaggagucgaaccagggcaacugaaacugaauugguuuaaaaagggaucuaguaucggacaaauguucgaaaccacaaugaggggugcaaaaaggauggcuauauugggagauacagccugggacuuuggaaguuuaggugguguauuuacgaguauagguaaagcauugcaucaagucuuuggagcaaucuauggggcggcauuuucaggaguuucauggacaaugaagaucuuaauaggaguaauaauaacauggauagggaugaacagucggagcaccucacuuucgguuucacuaguauuagucggcauagucacauuauaccuuggaguuauggugcaagcugacucuggcuguguugugaguuggaaaaacaaagaauugaaaugcggaagugguauuuucauaacggacaacgugcauacauggacagaacaauauaaauuucaaccagagucuccgagcaaguuagcuucugcaauccaaaaagcacaagaggaaggaauaugugguauuagaagcguuacuaggcuagaaaacuuaauguggaaacaaauaacaccggaauuaaaucacauucuggccgaaaaugaggucaagcugacaauaaugacaggcgauauuaagggaauaaugcaagcaggaaagcgcucuuuacgaccacaaccaacggaauuaaaguauucguggaaaacuuggggaaaagccaaaauguuaucuacggaguccuauaaucagaccuuccuuauugacggccccgaaaccgcagaauguccaaauacaaaccgagcauggaacucccuugaggucgaagauuacggauuuggcguauucacuacaaacauuuggcucaaauuaaaagaaaagcaggacguauuuugcgacagcaaauuaaugucugcggcaauuaaagacaaucgcgcugugcaugcugauaugggauacuggauagaaagugccuuaaaugacacauggaaaaucgaaaaagcauccuuuauugaaguaaaaaauugucauuggccuaaaagucauacacucuggucaaacggcguucuugaaucagagaugauuauaccaaaaaaccuagcaggaccugugagucaacauaauuaccgaccaggauaucauacgcaaaucgcagggccuuggcaccuagguaaacuagaaauggauuuugacuuuugugauggaacgacuguaauaguaacagaagauugcggaaauagaggcccaagucuucgcacaacaacagcaucugguaagcuaaucaccgaauggugcugcagaagcugcacauuaccuccccuucguuaucgaggggaggacggaugcugguauggaauggaaaucagaccauugaaagaaaaagaagaaaaccuaguuaacagcuuaguuacagcgggacaugggcagguagacaacuucucuuuaggcguguugggcauggcucuauucuuagaggaaauguuaagaacaagaguaggaacaaaacaugcuauuuuacuugucgcaguaucuuucguaacauuaaucacagguaacaugaguuucaaagauuuaggccgaguagucgucaugguaggagccacuauggcugaugacaucggaaugggcguaaccuaccuagcauuauuggccgcuuuuaaagugaggccaacauucgcagcuggacuccuacugagaaaauuaacaaguaaagaacucaugaugacaacgauagguauuguucuuuuaagccaauccacaauccccgaaacagugcuagaguuaacagaugccuuggcacuaggaaugaugguuuugaaaauaguuagaaacauggaaaaauaucaacuagcagucaccauuauggccauuuuaugcgugccgaaugcugucauucuccaaaaugcauggaagguaucauguacaauauuagcaguaguaucaguaucgccacuauugcucacaagcucacaacagaagacagauuggauaccacuugcauugacaauuaaaggucucaaucccacagcaauuuuucucacuacauugagucgaacaaacaaaaaacgcucauggccucuaaacgaagcuauaauggcgguaggcaugguaucaauauuagccucaaguuuguuaaaaaacgacauuccgaugacugggcccuuaguugcagggggcuugcuaacuguuugcuaugucuugacgggaaggagcgcagaucuagaauuagaacgugcaacugacguaaaaugggaagaucaagccgaaaucucaggaucuucgccaauucuaucuauuacuaucucagaagaugguaguaugucaauuaaaaacgaagaagaagaacaaaccuugaccauacuaauucgaacuggacuucuuguaaucaguggauuauuuccgaucuccauccccauuacggcagcagcuugguaucuuugggaagugaagaagcaacgagcagguguguuaugggauguacccagucccccaccuaugggcaaggcagaacuggaagauggagcauauaggauuaaacagaaaggaauacuaggcuacagccaaauaggagcuggcguauacaaagaaggaacuuuccacacgauguggcauguuacaagaggugcaguacucaugcauaaaggcaaaagaauugaaccaucaugggccgacguaaagaaagauuuaaucucauauggugggggauggaaacuagaaggcgaguggaaagaaggagaggagguucagguacuagcuuuagaaccaggaaagaauccaagagcaguacagacaaaaccaggcuuauuuaaaacaaacacaggcacgauuggugcaguaaguuuagacuucagcccagggaccucgggcucuccgaucauugauaaaaaaggaaaaguugucggcuuguauggaaauggaguaguuacacgaucaggagcauacguaagcgcaaucgcccagaccgaaaagucaaucgaggauaacccugaaauugaggacgauauauuuaggaaacggcgguuaacaaucauggaucuacauccuggagcaggcaaaacaaaacgcuaucugcccgcuauuguuagagaggcuauuaagaggggacuccguacguuaauauuagcgcccaccagaguaguugcagccgaaauggaagaagcucuacgugggcucccaauuagguaucaaaccccggcaauuagggcggagcacaccggaagggagauuguggaccuuaugugccaugcaacauuuacaaugagauuauuaaguccaguccgcguuccuaacuacaauuugauaauuauggaugaagcccacuucacagaucccgcuucgauagcagcgcguggauacauaagcaccagaguugaaaugggcgaggccgcuggaauuuuuaugacugcgacaccgcccgggaguagagacccuuuuccacaaucaaacgcaccuaucauagaugaagagcgagaaauuccagaaaggucauggaacagcggucaugaauggguaacagauuuuaaggguaagacggugugguucgucccaucaauuaaggccgguaacgacauagcagcaugcuuaagaaaaaacgguaagaaagugauccaguuaagucgaaaaacauucgauagcgaguauguaaagacaaggaccaacgauugggauuucguaguaacaacggauauauccgaaaugggcgcaaacuucaaggcggaaagaguuauagauccucgaagauguaugaaaccaguaauacuaacugauggagaagaaagagugauccuagcugggccuaugccuguuacucauucuagugcugcucagcggaggggacgaauaggaaggaauccgaagaaugaaaaugaucaauauaucuauaugggagaaccauuggagaaugaugaagauugugcgcauuggaaagaagcaaaaauguuauuggacaauauaaacaccccagaaggaauuauaccaagcauguuugaaccggagcgugagaagguggaugcuauagauggagaauacagauuacgaggagaagcacguaagacauuuguagauuuaaugaggcguggugaucuaccuguauggcuggcauauaaagucgcagccgaagggauaaauuacgcugaucgucgaugguguuuugauggaauaaaaaauaaucaaauauuggaagaaaauguggaagucgaaauauggaccaaagaaggugagcgaaaaaaacuaaaaccaaggugguuagaugcaaggauauacagugacccauuagcgcuaaaggaguucaaagaguuugcagccggccgaaaaagccugacgcuuaauuuaauuacagaaauggguagguuaccaacauucaugacccaaaaaacgagagaugcauuagauaaucuggcaguauugcacacggcagaagcuggaggacgagcuuacaaucacgcacuuagcgaauuacccgaaacauuggagacucuacuacugcuaacacucuuggcgacgguaacaggaggaauauuccuauuucuaaugucuggacguggcauugguaaaaugacguuaggcauguguugcauaauuaccgcaaguauauuacuuugguaugcacaaauccaaccacauuggauagcagcuucgauuauauuggaguuuuuccuaaucguccugcuaauuccugaaccggaaaaacaaaggaccccacaagauaaucaguugacauaugucguaauagcaauucuaacagucguggcagcaacaauggcaaaugaaaugggguuucuagagaagacgaagaaggacuucggguuagguucaauugccacgcaacaacccgaaucuaauauucuagacauagaccuuagaccugcuagcgcuuggacuuuauacgcuguggcaacuacauuuguaacaccaaugcuucgucauaguauugagaauucaucgguaaauguaucacugacggccauagcgaaucaggccacaguauuaaugggucuaggaaaaggguggccucuaaguaaaauggacaucgggguaccgcugcuagcgauuggguguuauucacaagugaacccaauaacauugacagccgcauuauuacuacuuguagcacacuacgcuauuauugguccugggcugcaagcaaaagcuacucgcgaggcucagaaacgagcggccgcaggcauaaugaaaaacccaaccgucgacggcauuaccgugauagaucuugacccaauaccguacgaucccaaauuugagaaacaguuaggacaaguaaugcuauugauccuuuguguaacacagguauugaugaugaggacgacaugggcacuaugugaagcucuaacgcuggcaacagguccaaucaguacuuuaugggaaggaaauccgggaagguucuggaacaccacaauagcaguaucuauggcaaauauauuucgagguagcuaccuugcgggugcaggccuauuauuuucaaucaugaaaaacacuacaaauacucgacguggcacaggcaauauuggagaaacguuaggagaaaaguggaagagcaggcuaaaugcauuagguaaaagugaguuccagauauacaaaaaaucagguauacaggaaguggauagaaccuuagcaaaggagggcauaaagcgaggggagacggaccaccacgcugucucaagggggucagcaaaacucagaugguuuguggaacgcaauauggucacuccagagggaaagguaguagacuuaggaugugguagaggaggauggaguuauuauugcggcggauugagaaacguaagggaagucaaagggcugacaaaggguggcccaggacaugaagaaccaauuccaaugucaaccuauggauggaaccucguaaggcuucaaucaggagucgauguuuucuucauaccgccugagaaaugugacacccucuuaugcgacauaggagaaucaagcccaaaccccacuguagaggcaggacguacgcucagaguauuaaaucuaguggaaaacuggcucaacaauaauacccaauuuuguauaaaaguacuaaacccauauaugccuaguguuauagaaaaaauggaagccuugcaaagaaaauaugguggcgcacuaguccgaaaucccuuaucacgaaauucaacucacgaaauguauugggucucaaaugcuucaggaaauauugucagcagcguaaauaugauuucaagaaugcugauaaacagguucacaaugagacacaaaaaggcaaccuaugaaccugauguagaucuagggucagggacacgaaacauaggaauugaaucagaaaucccaaaucuggacauuaucgguaagcgaauugagaaaauaaaacaagagcaugaaacauccuggcacuaugaccaagaccauccauacaagacaugggcguaucacggcucauaugaaacgaaacaaacugguucagcaucaucuaugguuaacggaguaguaagacuucuaacuaagccaugggauguauuaccaaccguaacccaaauggccaugaccgacacuacuccauuuggacaacagagaguguucaaagaaaagguagauaccaggacacaagaaccgaaggaaggaacaaaaaagcugaugaaaauuacagcugaaugguuauggaaagaauuaggcaaaaaaaaaacaccaaggaugugcacucgugaagaauuuacuaggaagguuagaaguaaugcugcacucggagcuauauucacagacgaaaauaaauggaaaucugcaagggaagcaguagaagacagucgauuuugggaacuaguggauaaagaaaggaacuuacaucuugaaggaaaaugugagacgugcguauauaacaugaugggaaaacgugaaaaaaaauuaggagaauuuggaaaagccaaaggaucuagggcaauaugguauaugugguuaggagcgagauuccucgaauuugaagcccuuggauuccuuaaugaggaucacugguucucaagagaaaauagucuuuccggaguugaaggugagggacuucacaaacuuggauauauuuuaagagacguaucaaaaaaggaaggaggugcgauguacgcugaugacacggcagggugggauacuaggaucacacuggaggauuuaaaaaacgaagaaaugguaacgaaucacauggaaggagagcacaagaagcuagccgaagcgaucuuuaaauuaacauaucaaaauaaaguggugcgaguacagcguccgacuccccguggaaccguaauggauauaauaucacgacgagaccagcgcggaucuggucagguggggaccuauggacuaaacacuuucacaaacauggaagcucaauugaucagacaaauggaaggagaaggaguauucaaaaauauacagcaucugaccgucacugaagaaguggcuguacaaaacuggcuagcaagaguuggaagagaacggcuuaguagaauggccauaagcggugaugauugugucgugaaaccuuuagaugacagguucgcaaaugcacucaccgcacuaaaugauaugggaaaaauacgaaaggacauacagcaaugggaacccuccaaaggguggaacgacuggacacaaguuccauuuugcucacaucacuuucacgaauugauaaugaaagauggcagaguauuaguagugccuugccgaaaccaagaugagcugaucgggcgggcaaggauuucccaaggugcugguuggagcuuaagagaaacagcaugcuugggaaagucguacgcgcaaauguggagucuuauguauuuucaucgaagggacuugagauuagcagcaaaugcaauaugcucggcaguuccgucacacugggugccaacauccaggacaacauggucaauccaugcuaaacacgaauggaugaccacagaggauauguugacagucuggaaucgaguauggauuagagaaaaucccuggauggaagacaaaacuccaguugaaucuugggaagagauaccauaccuagguaaaagggaagaccaaugguguggcagccugauaggguugacauccagggcgacaugggcaaaaaauauacaagcagcaauuaaucagguacguaguuugaucggaaaugaagaauauauagauuauaugccaagcaugaagcguuuuagaagagaggaagaagaagccggaguccugugguaa

SEQ ID NO: 22745 - RNA, 9876 nt, Artificial Sequence
  derived and/or modified CDS sequence (opt6) from DENV-2__EU482664__SS-prME
acggcuggaguuauaauuauguuaauaccgacagcaauggcguuccaucuaacaacaagaaacggugaaccacauaugaucgucggucggcaagaaaaaggaaaaucgcugcuuuuuaaaacagaagaugguguaaauauguguacacuuauggcgauagacuuaggagagcuuugugaagacacgauaacuuauaaaugcccacuacuacgucaaaaugaaccggaggacauugauuguugguguaauucuacuuccacuuggguaacauauggaacuuguacaacgacaggagaacauagaagagaaaaacguucaguagcauuaguuccgcacguagggaugggacuagagacuagaacugaaacuuggaugucaagugaaggugcauggaaacacgcacagcgaauagaaacauggauacuacgacauccugguuucacuaucauggcagcaauacucgccuacacaaucggaacuacgcauuuccaacgagcacugauuuuuauccuacuaacagcuguggcaccuucgaugacaaugcgguguauaggcaucuccaaucgugacuuuguagaaggaguaucgggcgggucauggguagauauugugcuagagcacgguucauguguaacgacuauggccaaaaauaaaccaacuuuggauuuugaguuaaucaaaacggaagccaaacaaccugcaacguuacguaaauacuguauagaagcgaaacuaacaaacacaacaacagaaagucgcugcccgacgcaaggagagccgaguuuaaacgaggaacaagauaaacgguuugucuguaaacacucuaugguagaccgcggcugggguaauggaugcggacuauucgguaaaggagguaucguuacaugcgcaauguucacaugcaagaaaaauauggaggguaaaauuguucaaccagaaaaucuggaauauacuauaguuauuacgccacauaguggggaagaacaugcagucgguaacgauacuggaaaacacggaaaagagauuaaaauaacaccccaaucuucaauaacugaagcugaguuaacaggcuacggaaccguaacaauggaauguaguccacguacgggccuagauuucaaugaaaugguacuauugcaaauggaagacaaagccuggcucguccaccgucaaugguuuuuagaucuuccucugccuuggcuacccggagcugauacucaagguucaaacuggauucaaaaagaaaccuugguaacauuuaagaacccacaugccaagaaacaagauguugugguauuggguucgcaagaaggugcgaugcacaccgcauuaacgggagcuacugagauccaaaugucuuccggaaaucuacuuuuuacaggacaucuaaaauguagacuacggauggauaaacuacaacuuaaagguaugaguuauucaauguguacuggaaaauucaaaauagucaaagagauugcugaaacacagcacgguacaauuguaaucagaguucaauacgaaggagacgggucaccuuguaaaauuccauuugaaauaauggaucuagagaaacgucauguacucggcagacuaauaacagugaacccaauagucacagaaaaggauucaccgguuaauauagaagcagaaccgccguuuggggauuccuacaucauaauuggaguggaaccugggcaauuaaaguuaaauugguuuaagaaagggucaucaauaggacaaauguucgaaacgacuaugagaggggcaaaaagaauggcgauacuaggugacacagcgugggauuuuggcucccuaggaggaguauuuaccaguaucgggaaagccuuacaccaaguauuuggugcaauauacggugcggcauuuucagguguaagcuggaccaugaaaauccuaauuggagcaauaaucacuuggauugguaugaacucgagaucuacaaguuuaagugucucccucguccuagucggaguaaucacauuauaccugggagcuaugguacaggcugauucgggaugcguaguaagcuggaaaaauaaggaacuuaaaugugguucugguauauucaucacagacaacguccauacuuggacugagcaguacaaauuccaaccugagucucccagcaaacuagcaucagcgauccaaaaagcccacgaagagggaaucugcgggauacgaaguguaacacgccuugaaaauuuaauguggaagcaaauaacaccggaguugaaucacauacugagcgaaaaugaaguaaagcuaacuaucaugacaggagauauaaaaggaauaaugcaagcagguaaaaggucuuugagaccacaaccaacagaauuaaaauauucauggaaaacaugggggaaggccaaaaugcuaucuacugagagccacaaccagaccuuucucauugacgguccugaaacagcagaaugcccgaauacgaauagagcauggaauagucucgaaguggaagauuauggauucggcguuuuuacgaccaauauauggcuaaagcuacgagaaaaacaagacgucuuuugcgauucaaaacuaaugucugcagcgauaaaggauaaccgagccguucaugcagauaugggcuauuggauugaaucagcacuaaacgauacuuggaaaauggagaaggcuucauucauagaaguaaaaucaugccacuggcccaaaagccacacguuauggucaaauggaguguuagaaucagaaaugauaauaccaaaaaguuuugccggaccaguuagucagcacaauuacagaccaggcuacuauacacaaacagcaggaccuuggcaucugggaaaacuagagauggauuucgacuucugugagggaaccacuguuguuguuacugaagauugcggcaauagaggaccuagcuuaaggaccacgacagcuagcggcaaguugauaacagaaugguguuguaggucgugcacucuaccaccguuacguuaucgaggagaagaugguugcugguauggaauggagauacggccguuaaaggaaaaggaagagaacuuaguuaacucauuagucaccgcagggcauggacagauagauaacuucucucuuggggugcuaggcauggcuuuauuuuuagaagaaauguuaagaacuagagucggcaccaagcacgcaauucuccuuguggcuguaucauucguaacauuaauaacuggaaauaugucauucagagaucucgguagaguuauggucauggucggugccaccaugaccgaugacauaggcauggguguaacguaccuugcauuauuagcggcauuuaaaguccgaccuacauuugcagccgguuuguugcuacgaaaauuaacaaguaaagaacuaaugauggcuacaaucgguauagcauuauuaagccagagcaccauaccagaaacgauacuugaacucacugacgcguuagcccugggcaugaugguacuuaaaauuguaagaaacauggaaaaauaucagcuggcgguaacaauaauggcaaucucaugcguuccaaaugccguaauucugcagaaugcguggaaaguuaguuguacaauucuagccgcagucucugugucaccauuauuacuuaccaguagucaacaaaaagcugauuggauacccuuagcacuaacuauaaaggguuugaaucccacggccauuuuucuuacuacccucucacguacuagcaagaaacgguccuggccuuuaaacgaagcuauaauggcuguuggaauggucucaauacuggcaucuucacugcucaagaaugacaucccgaugacagguccauuaguagcgggaggguuauugacaguauguuauguucuaacugguaggucggccgacuuagaauuagaaagagccacugauguuaaaugggaagaucaagccgagauaagugguaguucaccuauuuuaucuauuacuauaagugaagacggcaguaugagcauaaagaacgaagaagaggagcagacacucacaauacuaaucagaacaggauugcucgucauaucagguuuauuuccuguuuccauuccaauuacagccgcugccugguauuuaugggaaguaaagaaacaaagagcaggcguccugugggacguucccucgccaccaccuguaggaaaagcugaacuagaagacggcgcauaccgaauaaaacagaaagggauauuaggauacucgcaaauaggagcaggaguauauaaggaaggaacuuuccacacuauguggcauguaacucgaggggcaguuuuaaugcauaggggcaaaagaaucgagccuucgugggcagauguaaagaaggaucuuauaucauacggcggcggcuggaaauuagagggggaauggaaggagggagaagaaguucaaguacuagccuuagagccaggcaaaaauccaagagcaguccaaacaaagccgggucuuuucaaaacgaacacaggaacgaucggagcuguuagcuuggauuucaguccaggcacuucaggcaguccaaucguugaucgcaaagggaagguugucggauuguaugguaauggcguaguaaccagaucaggugcuuauguaucagcgauugcacaaacugaaaaauccauagaagacaacccagagaucgaagacgauaucuuccguaagaagagauugacuauaauggaccuacauccaggcgcaggaaaaacgaagagauaucugcccgcgaucguucgagaagcaauaaaaagggguuuacgaaccuuaauauuagcaccaaccagagucguggcggcugaaauggaggaagcguuaagagguuuaccgauacgauaucaaaccccugcuauaagggcggaacacacaggaagggaaauuguagaucucaugugucaugcgaccuucacgaugaggcugcuaucuccagugcgggugccgaauuacaaucugauaauaauggacgaggcgcauuuuacagacccagcauccaucgcggcaagaggcuacauaucuacaagaguagaaaugggggaggcagcagggauuuuuaugacggccacuccgccuggcucaagggauccuuuuccgcaauccaacgcaccaaucauugacgaagaacgggaaauuccugagagaucuuggaauagcggacaugaauggguaacggauuucaaagguaaaaccguaugguuuguuccaucaaucaaggccggaaacgacauagcagcuugccucaggaaaaaugggaaaaaggucauccaacuaucacgaaaaaccuucgauagcgaauauguaaaaaccagaacaaaugauugggacuuuguugugaccacggauauaagugaaaugggcgcaaauuuuaaagccgaacgaguaauugacccgagacgauguaugaagccugugauacuaacagauggugaagaaagaguaaucuuggcuggaccaaugcccguuacucauaguucugcagcacagagaagagggaggauaggacguaauccgaaaaaugaaaaugaucaauauauuuacaugggagaaccgcuagaaaacgaugaagauugugcucacuggaaagaagcaaaaaugcuuuuagacaauauaaacacaccugaagggaucauuccuuccauguucgaaccagaaagggaaaaaguugacgcgauagacggcgaauaccguuugagaggcgaagcacgcaaaacauucguagaccuaaugaggagaggagauuugccuguuugguuagcuuacaggguagcggcugaaggaauuaacuaugcugauagacgaugguguuuugacggagucaaaaacaaucaaauauuggaagaaaacguggagguagaaaucuggacuaaagaaggcgaaaggaagaaacuaaagccuagaugguuagacgcaaggauauacagugacccacuagcucuaaaagaauuuaaggaauuugcggcuggcaggaaaucucucacauuaaacuugauuaccgaaaugggucguuugcccacauuuaugacucaaaaagcuagagacgcucuugacaaccuagcgguacuacacacagcagaagccggagggagagcuuauaaccacgcacucuccgaauuaccagagacauuagagacauuauuauuauuaacccuacuagcaacaguaaccggaggcauauucuuauuuuuaaugucgggaaaaggcguaggaaaaaugacguuagguauguguugcauuauaacagcuucaauccuacuuugguaugcacagauacagccgcacuggauagcagcuucuaucauauuagaguucuuuuuaauuguguuacuaaucccggaaccugaaaaacaacguacaccgcaggauaaccaacuaacauacguuguaauugcaauauuaacagucguagcagcgacuauggcgaacgagauggguuucuuagaaaagaccaagaaagaucuuggauuagguucaguggcaacccaggagccggaaucaaauauacuugacauugaucuaagaccagcaagugcauggacccucuaugccguugcuacgacguuuguaacaccuauguugcgacacuccauugaaaacagcagugucaaugucagcuuaacagcuauugccaaccaagccaccguacuuaugggcuuaggaaagggauggccucuaaguaaaauggacauaggaguuccucuauuagcaauaggauguuacagccagguaaacccuauaacauuaacugcggcauuacuccuuuuaauagcacauuaugcaauaauuggucccggauuacaagcaaaagcaacucgugaggcucagaaacgggcugcggcaggcauaaugaagaauccaacaguagauggaauuacaguaauagaccucgacccaauaccguaugacccaaaguucgagaagcaacuaggucaaguuaugcuacuaauacuuugcguuacccaaguguuaaugaugagaacuacuugggccuugugcgaagcacugacucuggcaaccggaccuauaucuacccuuugggaagguaaucccggucgcuucuggaacacuacuaucgcugugucuauggcaaauauuuuuaggggcuccuaccuggcuggugcuggacuacuauucucgauaaugaaaaacacaacaaauacacgacguggaacuggaaauaucggggaaacuuuaggugaaaaauggaaaucgagguugaacgcguuagguaaaagcgaauuucaaauauacaagaaaucagguauccaagaaguugauaggacacuagcaaaagaaggaaucaagagaggagaaaccgaucaucaugcagucaguagaggaagcgcgaaauugcgaugguuugucgaaaggaacaugguaacaccggaagggaaaguugucgacuuaggaugcggccgaggcgguugguccuauuauuguggcgggcugaaaaacguacgagaagugaagggucugacuaaaggagggccuggucacgaggagccaauuccuaugucaacauacggcuggaaccuggucagacuacagagcggcguggauguauucuuuaccccaccggaaaaaugcgacacauuauuaugugauauaggugaaucuaguccgaauccuacaauagaagcugggcgaacucuacgaguucuaucgcuugucgaaaauuggcuaaacaacgauacgcaauuuugcauaaaagugcuaaaucccuauaugccaucugugauugaaaagauggaaacccuucaacguaaauacggaggagcgcugguacgaaauccguugucaagaaauagcacucaugaaauguacuggguguccaacgcaacuggcaauauagugagcucaguuaacaugauuucccgaauguuaauaaauagauucacgaugaaacauaagaaggcaacguaugagccugauguagaucuuggcucggggacaaggaauauagguauagaaagugagauucccaaccuagacaucauaggcaagcguauugagaaaauaaagcaagaacacgagacauccuggcauuaugaccaagaucaucccuacaagacgugggcauaucaugguucuuacgaaacuaaacaaacaggaucugcuucaucgaugguaaacggcguagugagauuacuaacuaaaccuugggauguaguccccaugguaacacagauggccaugacagacacuacaccauuugggcaacagagaguauucaaggaaaagguagacacaagaacacaagagcccaaggaaggaaccaagaaauuaaugaaaauuacagccgaauggcucuggaaagaacuuggcaaaaagaagacgccuagaauguguacuagagaggaguucacgagaaaggugcgaagcaaugccgcacuaggagcaauuuuuacagacgaaaauaaauggaaaagugcaagggaagcuguagaagauucccgauucugggaacugguugacaaagaaaggaacuuacaucuggagggaaagugugaaacguguguauauaauaugauggguaagcgagaaaagaaacugggugaguucggaaaggcaaagggaucucgagcaauaugguauaugugguuaggagcuagauuuuuagaguuugaagcguugggauuuuuaaacgaagaccauugguuuagucgagaaaauucccuaaguggugucgagggagaaggacuacauaaacuugguuauauccugagagauguaucaaagaaagaaggaggugcuauguacgcggaugauacagcuggaugggacacuagaauaacacuggaagaucucaaaaacgaagagauggucaccaaccacauggaaggugaacauaaaagacuagccgaagcaauauuuaaacuuacuuaccaaaacaagguagugaggguccaacgcccaacaccacgaggcacuguuauggauauaauuucccgucgagaucaaagaggaucgggucaaguggguacuuauggacugaauacauuuaccaacauggaagcccagcuaauaaggcaaauggagggcgaagggauuuucaaaaguauacaacaccuaaccguaacggaggaaaucgcaguacaaaauuggcuagcaagaguugggcgagaacggcucagccguauggcuaucagcggggaugauugcgugguaaaaccgcuagacgaccgauucgcaagugccuuaacagcauugaacgauaugggaaaaguaaggaaagacauucagcaaugggaaccuaguaaaggauggaacgauuggacacaagucccguucugcagccaucauuuucacgaacuaauuaugaaggauggccggguucuaguaguacccugucgaaaccaagacgaguuaauaggacgagcgaggauaagccaaggcgcuggcugguccuuaaaagaaacggcaugcuuagguaaaucauaugcacaaauguggucccuuauguacuuucaucgaagagaccuccgauuagccgcuaaugcaauauguucagccgucccaagucauugggucccaacaucacggacaacaugguccauucacgcaaaacaugaguggaugaccaccgaagacaugcuuacuguauggaaucgaguauggauucaggagaacccuuggauggaggauaaaacaccaguagagucuugggaagaaguaccauaucucgguaaacgugaagaccaauggugcggaagccuaauuggacuaacaucacgagcgacuugggcuaagaacauacagacagcuauaaaccaaguucguucacuaauuggcaacgaagaauauacggauuauaugccaucaaugaaaagauuccguagggaagaagaggaagccggaguauuaugguag

SEQ ID NO: 22746 - RNA, 9876 nt, Artificial Sequence
  derived and/or modified CDS sequence (opt6) from DENV-2__EU482665__SS-prME
ucggcaggaaugauuaucaugcuuauuccaaccgugauggcauuccaucucacaacuaggaauggagaaccccacaugauaguugggauacaagaaaaaggaaaaucguuacuauuuaaaaccgaagauggaguuaauauguguacacuaauggcaauggauuugggagaacuuugugaagauacaauuacauauaaauguccacuccucagacagaaugaaccggaagauauugauuguuggugcaauaguacaucaaccuggguuacauauggaaccuguacgacaacaggugaacauagaagggagaaaagaaguguggcauugguaccgcauguuggaauggggcucgaaacacguaccgaaacauggaugucuucagaaggggcguggaaacaugcgcaaaggauagagacguggauucuuaggcacccugguuuuacgauaauggcugcuauacuggcguauacuauugguacuacacacuuucagcggguuuugauuuucauuuuguuaaccgcuguugcaccauccaugacuaugaggugcauuggaauuagcaacagagacuuuguagaaggagugaguggaggaaguuggguggauaucguuuuagaacauggaucauguguaacaacgauggcuaaaaacaaaccaacccuagacuucgaauuaauuaaaaccgaggcaaaacagccggcgacacuacggaaauacuguauagaagcaaaauuaacaaauacaacuaccgaaagucgcugcccuacucaaggugagccaucauugaaagaggaacaggauaaaagguuuguauguaaacacaguauggucgauaggggcuggggaaaugguuguggauuauuugguaaagggggaaucgugacaugugcuauguucacguguaagaagaauauggaaggaaaaaucguacaaccagaaaaccuugaauauacuauaguugugacaccacacucaggagaagaacacgcagucggcaacgauacaggaaagcauggaaaggaaauaaaggucacaccacagucaagcauaacugaagcagaacucacaggguauggaacaguuacaauggaaugcagcccucgaacaggauuagauuuuaacgaaaugguacuccugcaaauggaaaacaaggcuugguugguacauagacagugguuuuuagacuuaccucuuccuuggcuacccggagcagacaaacaggaaucaaacuggauccaaaaagaaacgcucgugacguuuaagaauccucaugccaagaaacaggaugucgugguguuagguagccaagaaggagcaaugcacacggcccuuacaggagcgacagaaauucaaaugucaagcggaaaucuucuauucacagggcaccuaaagugcagguugcguauggacaaacuccaauugaaaggaaugucauauagcauguguacagguaaauuuaagguuguaaaagaaaucgcagagacacaacauggcacaaucguaaucagaguacaauacgaaggggauggaagcccuuguaaaauacccuuugagaucauggauuuggaaaaacgauacguauuagggcgucuuauaacaguuaauccuaucguuaccgaaaaagacucaccgguaaacaucgaagccgaaccgccguucggagacagcuacaucauaauuggaguugaaccgggucaauugaaauuaaacugguuuaagaaaggaucuucgauuggccaaauguuugaaacgacaaugcgaggagcgaagcgaauggcaauauuaggcgacaccgcaugggauuucggaucacuuggaggaguuuuuacuucgaucggaaaagccuuacaucaaguauucggagcuaucuauggagcugcauuuagcggaguuagcuggacaaugaaaauacuaaucggaguaauuauaacauggauaggaaugaacucaaggagcacaaguuugucugugucguuaguguuaguaggaauaguuacauuauacuuagguguaaugguacaggcugauucagguugugucgugucauggaagaacaaagaauuaaaguguggcagugguauuuuuaucacagacaaugugcacacuuggacggaacaauauaaguuucagccggaaucuccuaguaaguuagcuucagccauucaaaaagcgcaagaagaggguauuugcgguauuagguccguaaccaggcuagaaaauuuaauguggaagcaaauuacuccagagcuaaaucacauucuugcugagaaugaaguaaaauuaaccauuaugacgggugacaucaaagguauuaugcaagccgguaaaaggagcuugagaccucaaccgaccgaauugaaauauaguuggaagacguggggcaaagcuaaaaugcucucgacagaaaguuacaaccaaacuuuucuaauagaugguccagaaacagcagaguguccuaacaccaaccgagcuuggaauagcuuagaaguagaagacuaugguuucggaguuuucacaacaaauauauggcugaaguugaaagaaaaacaagaugcauuuugcgauaguaaacucaugucagcagcuauuaaagauaaucgagccguucaugcugauaugggauacuggauugaaagugcuuugaaugauacauggaagauagaaaaagcuagcuucauagaaguuaagaauugucauuggccaaagucacacacucucuggucuaacggaguucuagaaucggagaugauaauaccgaaaaauuuggcaggaccaguuucacagcauaauuacagaccaggcuaucauacccagauugcgggcccauggcaccucggaaaacuugagauggauuuugacuucugugauggaacgacaguaauuguaacagaagauugugguaaucgaggaccuucuuugaggacuacaacggcuagugggaaacuuauuacagaguggugcugcagguccugcacuuuaccgccucuuagauaucgaggugaagacggaugcugguacggaauggaaauccgaccacuaaaggaaaaagaagaaaauuuaguaaauucuuuagucacagcagggcauggacaagucgacaacuuuucucuaggaguucuaggaauggcuuuguuuuuagaagaaauguuaagaacccgaguaggcacaaagcacgcgauacuacucguggcagucucguuuguaacuuuaauaacaggcaacaugagcuuuaaagaccugggaagagucguaguuauggugggggcaaccauggcggaugauauaggcaugggggucacguaccuagcucuauuggcagccuuuaaaguaaggccaacguuugcagcagggcuacuauuaagaaaauuaacaucaaaggaauuaaugaugacaacuauugguauaguucucuugucucaaaguacaauccccgaaacagugcuugaacucacugaugcucuagcauuaggaaugaugguacuaaaaauuguacguaacauggaaaaguaucaacuugcaguuacaauuauggcaaucuuaugugucccaaacgccgugauauugcaaaaugcguggaaagugucaugcacgauacuggcgguugucaguguaagcccguuauuacuuacuuccucacaacaaaagacggauuggauaccacuagcacuaacaaucaaaggcuugaacccaacagccaucuuuuuaacuacacuaucaaggacaaacaagaagcggucguggcccuuaaacgaggcaauaauggcagucgguauggucucaauuuuggcuuccagcuugcuaaagaacgauauccccaugacagggccacuuguagcuggagggcuuuuaaccguguguuauguauuaaccgggagaucagcagaccuugagcuagagcgagcaacagacguuaaaugggaagaccaagcugaaauaucugggucaagcccaauacuaagcauaacaauaucagaagauggaagcaugaguauaaagaaugaggaagaagaacaaacuuuaacaauauugauacgaacaggacuuuugguaauauccggacuuuucccuauuuccauaccuauaacagcugcagcaugguauuuaugggaagucaagaaacaaagagcaggaguucucugggaugucccgucgccaccucccaugggaaaagcagaauuagaagacggggcauauagaauaaaacaaaaagggauucuagguuauucucaaauaggagcgggagucuauaaagaagguacauuccauaccauguggcacgucacacguggugcuguacuuaugcacaaggguaaacgaaucgagccuucaugggcggauguuaagaaagaucuaauaucauauggagggggauggaaguuagaaggggaauggaaggagggugaagaaguacaaguacuggcauuagaaccaggcaaaaauccuagagcuguucaaacuaaaccaggucuuuuuaaaaccaauacaggaacuauaggagcuguaucauuagauuuuagccccggaacaaguggaucccccauaauagacaagaaagguaagguuguuggauuauaugggaacggaguagucacccgaucuggugcuuauguaucggcuauugcccaaacggagaaaaguauagaagacaauccagaaauugaggaugacauauuuaggaaacguagauugacaauaauggacuuacauccaggcgcggguaaaacuaaaagguauuuaccugcaauagugagagaagcuauaaaaagggggcuacggacucuaauacuugcaccuacccguguugucgcggcugaaauggaagaagcauugcgggguuugcccaucagguaucaaacaccagccauucgggcagagcacacggguagagaaauaguugauuuaaugugucaugcaaccuucacuaugagacuacuaagcccuguaagaguuccuaauuacaauuugaucauaauggacgaagcacacuuuacagauccagcuucaaucgcagcaagaggauacaucaguacuagaguugaaaugggugaagcugccggaauauuuaugacagcaaccccacccggcagcagggacccuuucccgcaaucgaaugccccaauuauagaugaagaacgugaaauaccugaacgaagcuggaauaguggccaugagugggugacggauuucaaaggcaagacaguuugguuugugcccucaauaaaagccgguaaugacaucgcggcuuguuuacguaagaauggcaagaaagucauucagcuaucccgaaaaacguucgacucggaauauguaaaaacacgaacuaacgauugggauuuugucguuacuacugacauaagugaaaugggagcuaauuuuaaagcagaaagaguuauagauccacggcgaugcaugaaaccaguaauucuaacagauggagaggaaagaguaauacuagcuggaccaaugccaguuacacacucgucagccgcacagagacguggacgaauaggcagaaaucccaagaacgaaaacgaccaauauauauacaugggagaaccguuagagaacgaugaagauugugcacacuggaaggaagcaaaaaugcuacucgacaacauuaacacaccagaaggaauaauuccaucuauguuugaaccagaaagggaaaaaguagacgcaaucgacggugaauaccgauuacgaggcgaagcaagaaagacauucguugacuuaaugcgucggggugaucuaccaguuuggcucgcauauaaaguggcagcagaggguaucaauuaugcagauagacguugguguuuugauggaauuaagaacaaccagauacuggaagagaacguagaaguggaaauauggacaaaagaaggagaacgaaagaaacugaaaccgagauggcuagaugcaagaauauacagcgauccgcuagcgcuaaaagaguucaaagaguuugcagcugguagaaaaucacuaacguuaaaccucauaacagagaugggaagacuaccaacuuucaugacacagaaaacuagagacgcacuagauaaccuagcaguuuugcauacagcggaagccggugguagagcuuauaaccacgcccuaucagagcuccccgaaacucuagagacuuuauuguuacucaccuugcuagcaacgguuacuggagggauauucuuauuuuuaaugagcggacguggaauaggaaagaugacucuuggaauguguuguauaauaacugccaguauacuucugugguacgcacaaauacaaccacacuggaucgcggcguccauaauacuugaguucuuucugauagucuugcuuauaccugaaccagaaaaacagcgcacaccgcaagacaaucaacuaaccuaugucguaauagccauuuugacagucguggcagcaacgauggccaacgaaaugggguucuuggaaaagacaaagaaagacuuuggccuaggcucaaucgcaacgcaacagccagaauccaauauuuuagacauugaucuucgaccagcgucugcauggacucuguacgcuguugcuacaacuuucgugacaccuaugcuaagacauucaauagaaaacuccaguguuaacguaagccugacugcaauagcuaaccaagccacaguauuaaugggacuugguaagggauggccauugucuaaaauggacauuggaguaccacugcuagcuauagguuguuauagucaaguuaacccuauaacauuaacagcggcacuucuucuucuaguggcacacuacgcaauaauuggaccaggauugcaagccaaagcgacacgagaagcucaaaagagagcagcagcaggcaucaugaaaaaucccacaguagauggcaucacuguaauugaccuugauccaauaccguaugacccaaaguuugagaaacaacuuggacaaguaaugcuuuuaauacugugcguaacacaaguauuaaugaugagaaccaccugggcauuaugugaggcuuuaacauuggcaacgggcccuauuucuacccuaugggaagguaauccaggcagauuuuggaacacgacaauugcgguuucgauggccaacauuuuccgggguucuuauuuggccggugccggccuucuauuuucuauaaugaagaauacgacaaacacuagacgaggaacaggcaacauuggugagacucuaggugagaaauggaaaagccgauuaaacgccuugggaaaaucagaauuucaaauuuauaagaaauccggaauacaagagguagaccggacacuagccaaagaggguauaaagagaggagaaacagaccaucacgcuguaucucguggcucagcgaaauugcggugguucguagaaagaaauauggugaccccugaaggaaaagugguagauuuagguuguggaagagguggauggucuuauuauugcggaggccuaaagaaugugagagaagugaagggauugacgaaaggaggacccggucacgaagaaccuaucccuaugucgacuuacggauggaaucuggugcgguuacaaagugggguagauguuuucuuuaucccuccugaaaaaugugauacacuucuuugugauauaggagaaagcucaccaaaucccacuguggaagcuggccguacauuaagaguccugaauuugguugaaaauuggcucaauaacaauacacaauuuuguauaaaaguauuaaauccauauaugccauccguaauagagaaaauggaagcccuacagcguaaauacggcggagcccuuguccgcaauccuuuaucccggaacucaacacacgaaauguauuggguuuccaacgcgucagguaauauaguuucaagcguaaacaugauaucaagaauguuaauaaaucgguucacuaugcggcauaagaaagcgacguaugagccagacguggaucuagguucaggcaccagaaacaucgggauugaguccgaaauuccaaaucuugacauuaucgguaaacguaucgagaaaauuaagcaagaacaugaaacaaguuggcacuaugaucaagaucauccauauaaaacaugggccuaccauggaagcuaugaaacaaagcaaacaggcucagcuucaucaauggucaacggcguuguaagguuacuuacuaaaccaugggauguacuaccuaccguuacgcagauggcaaugacugauacuacgccuuucggccaacaacgcgucuuuaaagagaaaguagauacucguacacaagaaccuaaagaaggcacuaagaaacuuaugaaaauuacugccgaauggcuuuggaaagaacuaggaaagaagaaaaccccaagaaugugcaccagggaagaauuuacacgaaaagugcgaaguaaugcagcuuugggcgccauauuuacggaugaaaacaaauggaaaucugcucgugaggcugucgaagacucaagauuuugggaacuugucgauaaagaaagaaaccuccaucucgaaggaaaaugcgaaacaugcgucuacaauaugaugggcaaaagagagaagaaacuuggcgaauuugguaaagccaaagguucacgagcuaucugguauauguggcuaggcgcuagauuucuggaguucgaagcacuaggauuccuaaaugaagaucacugguucucaagagaaaauucacuaagcggcguagagggugagggauuacacaaauuagguuauaucuugcgagauguuucuaagaaagaaggaggcgcaauguaugcagaugacaccgccgggugggacacccgcaucacauuagaagaucuuaaaaacgaagaaauggugacaaaucacauggaaggagagcacaagaaacuggcggaggccauuuucaaacuuacauaucaaaauaaaguggucaggguacagcgcccgacgcccagggguaccguuauggacauuauaagucgaagagaccaaaggggaucaggucaaguaggaacuuacggguuaaauacauucacaaacauggaagcacaacuuauucgccaaauggagggggaggguguauucaaaaauauacaacaucucaccguaacagaagaaguugccguccaaaauugguuagcccgagucggccgcgagcguuugucaagaauggcaauaucaggugaugacuguguaguuaaaccguuagacgaucguuuugcaaaugcauuaacagcucuaaaugauauggguaaaauacgaaaagauauacagcaaugggaaccaaguaaaggauggaaugauuggacucaggucccguuuuguucacaccauuuucacgaauuaauaaugaaagaugggagaguucuggucgugccuuguaggaaccaggacgaauuaauaggccgagcgaggauuagccaaggggcagguuggagucuaagagaaacugcuuguuuagguaaauccuacgcacaaauguggucgcuuauguacuuccaucgacgagaucugcgcuuagcagcuaacgcaauuugcuccgcaguccccagccauugggucccaacaagcagaacuacguggagcauacaugcaaaacacgaauggaugacuaccgaagauaugcugacugucuggaaccgaguuuggauaagagaaaauccauggauggaggauaaaacaccaguagaaucuugggaagagauuccauacuuaggaaaaagagaagaccaauggugcggcucacuaauaggucuuacuagccgagcuacuugggcgaaaaacauacaagcugccauaaaucagguccguagcuuaauagguaaugaggaauauacugauuauaugccaagcaugaaacguuuuagaagagaagaagaagaggcuggaguauuaugguaa

SEQ ID NO: 22747 - RNA, 9876 nt, Artificial Sequence
  derived and/or modified CDS sequence (opt6) from DENV-2__EU482666__SS-prME
acugcuggcguaauuauaauguugauaccuacugcaauggcuuuucaccuaacuacuaggaauggggaaccacauaugauaguugggagacaagaaaaagguaaaagucuauuauuuaaaacagaggacggagucaacaugugcacuuuaauggcuauagaucucggagaauuaugugaggauacaaucacuuauaaauguccacuuuuaaggcaaaaugaaccagaagauauagauuguugguguaacuccacuuccacauggguaacguauggaacgugcacaacgacaggugaacacaggagggagaaaaggucuguugccuuagugccacauguugguaugggacucgaaaccaggacugaaaccuggaugucgucugaaggcgcauggaaacacgcacaacggauagaaacauggauuuuacgucaccccggcuucaccauaauggcagcaauccuagcauauacaauagguacaacucauuuucaacgagcauuaauauucauacuccuuacggcaguagcucccucuaugaccaugcgauguaucggaauaucuaaucgugacuucguggagggaguaagcgggggaaguuggguagauauuguacuggaacaugggaguuguguaacuaccauggcgaaaaauaaaccaacacuugauuuugaauuaauaaaaacggaagcaaaacaaccugcaacguugagaaaauacugcauagaagcuaaauuaacuaauaccacgacagaaucuagauguccaacgcaaggggaaccaagucugaacgaagaacaagauaaacgauuuguauguaaacauucaaugguggacagaggaugggguaacgggugcggacuauuuggcaaaggcggaauaguaacuugcgcaauguucacauguaagaaaaauauggaagggaaaauuguacaaccagagaaccuagaauauacuaucgucauaacgccucauucaggcgaggaacaugcuguagguaacgauacuggaaaacauggcaaagaaaucaaaauaacuccucaaucgucaaucacagaagcugagcuaacaggcuacggaacuguaaccauggaaugcucgccacgcacaggccuagacuuuaacgaaaugguuuuacuucaaauggaagacaaagcaugguuaguacacagacaaugguuuuuggacuuaccccuaccuuggcuuccuggugcagauacccaaggaagcaacuggauacagaaagaaacccuuguaacuuuuaaaaacccacaugcaaagaagcaagacguuguagugcuagggagccaagaaggugcaaugcauaccgcucuuacaggagcaacggaaauacaaaugucaagcggaaauuuacuguucacaggucacuugaaaugucgguuaagaauggauaaacuccaacuuaaagggaugucauacucgauguguacagguaaauucaaaaucguaaaagaaaucgcggaaacacaacacgggacgauugucauaaggguacaguaugagggggacgggucccccuguaaaauaccauuugaaauaauggauuuggaaaaacgacauguguuagggagacuuauuacagucaacccaauaguaacugaaaaagacucaccgguaaauauagaagcagaaccucccuucggcgacagcuacaucauuauuggaguagaaccgggucaauuaaaacucaauugguuuaagaaggguagcaguauugggcagauguuugaaacaacuaugcguggagcuaagcgaauggcaauccuaggugauacagcaugggacuucggaagucuaggaggaguauucacaucuaucggcaaagcccuucaccaaguuuucggggcuauauacggagcggcauucucaggcguuagcuggaccaugaaaauacugauuggcgcgauuauaacuuggauagguaugaacucgcgguccacuucacuuagcgugaguuuaguauuaguugggguuauaacacuauaccugggcgcuaugguccaagccgauagcggaugugugguauccuggaaaaauaaagaauuaaaauguggaaguggaauuuucaucacagacaacguacacacauggacugaacaauauaaguuucaacccgaaucaccgaguaagcuagccucggcaauccaaaaagcacaugaagaagggauauguggaauccguuccguaacacgauuagagaauuuaauguggaaacaaauaacacccgaauugaaucacauccugagugaaaaugaagucaaacuaacaauaaugacaggcgauauuaaagggauaaugcaagcagguaaacgauccuugagaccacaaccaacagagcuuaaauacaguuggaaaaccuggggcaaagcaaaaaugcuaucaacagagucacauaaccagacauuuuuaauugaugggcccgaaacugcugagugcccaaauacaaauagagcuuggaacagccuggaaguggaggacuauggauuuggagucuucaccacgaauaucuggcuuaaacuccgggagaagcaagaugucuucugugacaguaaacuaaugagcgcagcuauaaaggauaauagagcuguacaugcggacaugggauacuggauugaaagcgcucugaacgauacauggaagauggaaaaagccucguuuaucgaagucaagucaugccauuggccuaaaucacauacuuuauggaguaacgguguucucgaaucagaaaugauaauaccaaagaguuucgcagguccgguaucacagcauaauuauaggccaggcuaccauacacaaacagcgggaccauggcaccuugguaaauuggagauggauuuugauuucugugaaggcaccacaguugugguuacagaagauugcggaaaccgaggacccagcuugaggacaacaacagcaucagguaaauuaaucaccgaaugguguugccggucaugcaccuuaccaccauuaagguauaggggcgaagaugguugcugguauggcauggaaauaagaccacuuaaggagaaagaagaaaaucuuguaaauucauuagucaccgccggacauggacagauugacaacuucucucucgguguccuugguauggcgcuauuucuagaagaaaugcuaagaacucggguaggaacaaaacaugcuauucuacuuguugcugucucauucaugacgcuaauaacuggaaacaugucauucagagacuuagguaggguaaugguaaugguaggagcaacgaugacagacgacaucggaaugggggucacuuaucucgcacuguuagcggcauuuaaaguuaggccuaccuuugcagcgggacuccuauuaagaaaauugacaucuaaggaguuaaugauggcaaccauagguauagcccuguuaagucagaguacuaucccagagacuauccuugagcucacugaugcucuugccuuaggcaugaugguuuuaaaaauaaugagaaauauggaaaaauaucaacucgcggucacaauaauggcgaucucguguguaccaaacgcagucauauuacaaaaugcauggaaagucaguuguacgauacuagccgcaguuuccguaucaccacuacuguuaacaaguucacaacaaaaagcagacuggauaccuuuagcgcuaacaauuaaaggccuaaacccaacggcaauuuucuuaaccacucuuucaaggacuucaaagaaaaggucauggcccuugaaugaagcgauuauggcaguaggaaugguuaguauacucgcgucaaguuugcucaaaaacgacaucccaaugacagggccucuaguugcuggaggauuacuaacaguauguuauguacuaacuggaagaagugcagauuuggaacuggaacgagcaacugacguaaaaugggaagaccaggcggagauuucgggcaguaguccaauacuuuccauaacaauuagugaagauggauccaugaguaucaaaaaugaagaagaggaacagacccuaacuauauugaucagaacgggauuacucgucauuucagguuuauuucccguaaguaucccgaucacagccgcagccugguacuuaugggaagucaagaaacaaagagcgggagugcuuugggauguaccaucuccaccacccgugggcaaagcggaguuggaagacggggcauaucguaucaagcaaaaagguauucuaggauauucacagauaggggccggugucuauaaagagggaaccuuucacacaauguggcacgucacuagaggggcugugcuaaugcaccgaggcaaacggauagagccguccugggccgacguaaagaaagaucuuauaucuuacggcggcggcuggaaauuggaaggggaauggaaagaaggugaggaaguccagguacuagcuuuagaaccagggaaaaaccccagggcgguacaaacaaaaccgggauuauuuaaaacaaauacagguacaaucggagcagugucauuagauuuuucgccggggacaagcgggagcccuauaguugacagaaaagguaaaguuguaggacuguauggaaauggaguggucacaaggagcggcgcuuaugucagcgccauugcgcagacugaaaaguccauugaggacaauccagaaauagaagacgacauuuucaggaagaaaaggcuuacaauuauggauuugcacccaggcgcugggaaaacuaaaagauaccucccugcuauaguacgugaagcaauuaaacggggacuacgaacguuaaucuuggcaccuacaagaguaguagcagcagaaauggaagaggccuugagaggacuucccauuagauaccaaacuccagcgauaagagcugaacacacaggccgagaaauuguagaucuuaugugucaugcaacauuuacaaugagacuccucucacccguuagggugccgaacuauaauuuaaucauaauggacgaagcucacuuuacggauccugcaaguauagcagcacgaggcuacauaucaacgagaguagaaaugggggaggccgccggaaucuuuaugacagcgacaccgcccgguagccgagacccguucccgcaaaguaacgccccgaucaucgaugaggaacgagaaaucccugaaagaaguuggaacaguggucaugaauggguaaccgauuuuaaaggaaaaacuguaugguuuguaccaucuauaaaagcugguaaugauauagcugcgugucuacggaagaacggaaagaaagugauucaauuaucacguaaaaccuucgacucugaguacguaaaaacacgaacaaacgacugggauuucgucgugaccacagauauaucagagaugggugcuaauuuuaaagcugagcgugucauagacccgagaagaugcaugaagccaguaauacuaaccgauggagaggaaagagucauauuagcaggaccuaugccuguuacccauucuucagcugcgcagaggcggggccgaauugggagaaauccaaagaaugaaaacgaucaguauauuuacaugggggagccauuggaaaacgaugaagauugugcucacuggaaagaagcgaaaauguugcuagauaauauuaacacaccagaaggcauuauccccuccauguuugagcccgaacgggagaaaguggaugcuaucgacggggaguaucgacuucgaggcgaagcaagaaaaacguucguagaucuuaugagacgcggcgauuuacccgugugguuagcauauagaguugcagcagaaggaauaaacuaugcagaucgacgcuggugcuucgauggagucaaaaacaaccagauucucgaagaaaaugucgaaguagagaucuggaccaaagaaggagaacggaagaagcucaagcccagauggcuugaugcacgcauauacucagaucccuuagcuuuaaaagaauuuaaggaguucgcagccggaagaaaaucccucacgcugaauuuaaucacagaaaugggucgauuaccaacguuuaugacacaaaaagcaagagaugcucuagacaauuuggcggucuuacacacugccgaggcuggagggcgugccuauaaucaugcuuuaagcgaauuacccgaaacgcuugaaacccuauuguuauuaacauuguuagccacaguuacaggcgguauuuuucuguuccugaugucuggaaaaggcguuggaaaaaugacucuuggcauguguugcaucauaacagcaucgauacuucuuugguacgcccaaauacaaccacauuggauagcugcaaguauaauacuagaguucuuuuuaaucguucuccugaucccggagccagaaaaacaacgcacuccacaagacaaucaguugacuuauguaguaauugcaauacuaacuguagucgccgccacuauggcaaacgaaauggguuuccuggagaaaacuaagaaagaucucggauuaggcuccauagccacacaagaaccagaaagcaauaucuuggauauagaucuuagaccugccucugcuuggacgcuauaugccgucgcuacaacauuuguuaccccuaugcuaaggcauucgauagaaaacucuucaguaaauguaucccuaacagccaucgcaaaccaagcaacaguacuaaugggccuaggaaagggauggccccuaucuaaaauggacauagggguaccucuucuagcuauaggauguuauucccaaguuaacccaauaacacuaacggccgcacuuuuacucuugaucgcacacuaugccauuauaggacccggacuucaggcaaaagcaacgcgagaggcacagaaaagggccgcagcgggaauaaugaaaaacccuacaguggauggcaucaccgucaucgauuuagauccgauuccauacgauccgaaguuugagaaacaacuuggacaagugaugcuuuuaauucuuuguguaacacaagugcuaaugaugagaaccacaugggcccuuugcgaagcacuaacgcuugcuacaggaccaauuucaacauugugggaaggcaacccagggagguucuggaauaccacuauagcggucucuauggcaaauauuuuucgaggaucuuacuuggccggugcgggcuuauuauuuaguaucaugaaaaacaccacgaauacacgaagggggacagguaacauaggagaaacacuaggagaaaaauggaaaaguagacuaaacgcauuagggaaaagugaguuccaaauauacaaaaagucagguauccaggagguggacagaacacuagccaaggaagggauaaaacgaggagagacagaccaucacgcagucucuagaggaucggcuaaauuaagaugguucguugaacgaaauauggugacucccgaagguaaaguuguggauuuagguuguggcagagggggcugguccuauuacuguggaggacucaaaaacguaagggaggugaaaggauuaacuaagggugguccaggucaugaagaaccaauuccaaugagcacauaugguuggaaucucguuagauugcagagcggaguagacgucuucuuuacaccaccagaaaaaugugacacucuacuaugcgauaucggugaaagcucuccuaauccaacaaucgaagcugggcggacucuucgaguacugucguuaguggaaaacuggcuaaauaaugacacacaauucugcauaaaaguacugaauccauacaugccuucugucauagagaaaauggagacacuccaacggaaauauggcggggcucuaguuagaaauccgcuaucaaggaauaguacacacgaaauguauuggguuucaaacgcuacugguaacauaguuucgucagugaauaugauaucuaggaugcuaauaaaccguuucacaaugaaacauaagaaagcaacauaugaaccggauguagaccuugggucagguacaagaaacauuggaauugaaucagagauaccgaacuuagacauuauuggaaaaagaauugagaaaauaaaacaagaacacgagacaucuuggcacuaugaccaggaucacccauauaaaacuugggccuaccaugggagcuaugaaaccaagcaaaccggaagugcauccucuaugguuaauggcgucguccguuuguugacgaagccuugggacgugguaccgauggucacccaaauggcuaugacagauacgacuccauuuggacaacagaggguguuuaaagaaaagguugacaccagaacacaagaaccuaaagaagguaccaagaaacuaaugaaaauaacagcugaauggcuauggaaagaauuaggcaagaagaaaacaccacguauguguacaagagaagaauuuacacgaaaaguuaggaguaaugcugcacucggugcaauauucaccgaugagaacaaguggaaaagugcaagagaagcagucgaagauucuagauuuugggaauuaguugacaaagaacggaaccugcauuuagaaggaaaaugugaaacuuguguauacaacaugauggguaaaagggagaagaaauuaggggaguuuggaaaagcuaagggaucacgagccauaugguauaugugguugggggcacgauuucuagaguuugaagcacuagguuuccuaaacgaagaucauugguuuucucgugaaaauuccuugucgggggucgaaggagaaggucuccacaaguuaggauauauucuccgcgauguuuccaagaaagaaggcggagcuauguacgcagaugacaccgcagguugggacacgagaauuacauuagaagauuugaaaaaugaagaaaugguaaccaaucacauggagggagagcacaaaagacuagcagaagcgauauucaaauuaacuuaccagaacaaagucguuagaguccaaagaccuacgccgcgagguacuguaauggauauaaucagccgaagagaucagagggggucaggacaaguuggcacuuaugguuuaaauacauuuaccaauauggaagcucaacuaauuaggcaaauggaaggggaaggcauauucaaaaguauacaacaucuaacaguaacggaagaaauagccguacaaaacugguuagcaaggguaggccgggaaagauuguccagaauggcaauaaguggcgaugauuguguaguuaaaccacuugacgaucgcuuugcuuccgcauuaacagcccucaacgacaugggaaaaguuagaaaagauauucaacagugggagccaagcaaaggcuggaaugacuggacgcaagugccauuuuguagucaccauuuccacgaacuaaucaugaaagaugguagaguucuaguaguaccaugucgaaaucaggaugagcuuaucggucgcgcuaggaucucccaaggagcgggauggagucucaaagaaacagcgugccuagguaaaagcuacgcacaaauguggagccuuauguauuuucaucggcgcgaucuaagguuagcugcgaaugccauuugcucggcgguuccuucacacuggguuccaacgucgagaacuacguggucuauccacgcaaaacaugaguggaugacaacugaagacaugcuaaccguuuggaauagagucuggauacaagaaaacccuuggauggaagauaaaacgccagucgaaucaugggaagaaguaccauacuuggguaaaagagaagaucaauggugugguucgcucauugguuuaacuucccgagcuacuugggccaaaaauauacaaacagcaauuaaucaaguuagaucauugauaggaaaugaggaauauacagacuacaugccaucuaugaaaagauuucgucgugaagaggaggaggcuggaguacuaugguag

SEQ ID NO: 22748 - RNA, 9876 nt, Artificial Sequence
  derived and/or modified CDS sequence (opt6) from DENV-2__EU482667__SS-prME
uccgcaggaaugauaaucaugcucauaccgacaguuauggcauuccauuuaaccacuaggaauggugaaccucacaugauaguuggaauccaagaaaaagguaaaagccugcuuuucaaaacagaagacgggguaaacauguguacuuuaauggcaauggaucucggagaacucugcgaagacacaauaaccuacaaaugucccuuacuacggcaaaacgaaccugaagacauagauuguuggugcaauagcacaaguaccugggugaccuacgguacuuguacgacaacaggagaacaucgucgugagaaaagguccgucgcauuggugccacacgucggaaugggacuagaaacgagaacugaaacguggaugagcucggagggagccuggaaacaugcgcaaagaauagaaaccuggauacuuagacacccuggauuuacgauaauggcggcgauccuagcauacacaauaggaacaacacauuuccaaagaguccugaucuuuauucuacuaacggcgguggcacccagcaugaccaugcguugcauugguaucucaaacagagacuuuguugagggcguaagugguggaaguuggguugauaucguacucgaacacggaucuugcguaaccacgauggcgaaaaauaaaccaacauuggauuucgaacugauaaaaacggaagcuaaacaaccggcaacucugcgaaaauacugcauagaagcuaaacucacaaauacuaccacggaaucaagauguccuacucaaggugaaccuucccuuaaagaggaacaagacaaaagauuuguaugcaaacacucgaugguagaucgaggguggggaaauggaugcggccuguucgguaaaggagggaucguuacaugugcuauguucacguguaagaaaaauauggaaggaaaaauaguucagcccgagaauuuagaauauacuauaguuguaacaccgcauucuggagaagaacacgcaguggggaacgauacgggaaaacacggcaaagaaauaaaaguaacaccacaaucgagcaucaccgaagcagaauugacuggauaugguaccguuacgauggaaugcuccccuagaacuggacuggauuucaaugaaaugguauuauuacaaauggaaaauaaagcgugguugguccaucgacagugguuucuagaucucccacuaccgugguugccuggagccgauaaacaagaauccaacuggauacagaaagaagcacuuguaacuuucaaaaauccucaugcuaagaaacaagacgucguaguacuagguagucaagaaggggcaaugcauacggcgcuuacaggagcaacagaaauucaaaugaguaguggcaauuuacuauucacaggucauuugaaauguagauugagaauggacaaacugcagcuuaaaggaaugucauauucaauguguacuggcaaauuuaaaguaguaaaagagaucgccgagacacaacaugggacuauugucaucaaaguucaauaugaaggggacgguaguccauguaagauucccuuugaaaucauggacuuagagaagagauacguauuaggacgacuaauaacuguaaauccuauaguaacagaaaaagacaguccugugaacaucgaagcagaaccaccuuucggugauuccuauauaauaauagguguugagcccggacaauuaaaacuaaauugguuuaagaaaggaagcucaauaggucagauguuugagacaacaaugaggggcgcaaaaagaauggcuauccuaggagauacugcaugggauuuugggucauuaggcggaguguuuacuucaauagguaaagcacuacaucaaguuuuuggagcaauauauggggcggcuuucaguggcguaagcuggacuaugaaaauuuugauuggagucauaauaacauggaucggcaugaacuccagaucgacaucucuaucuguaaguuuaguauuggugggaauugucacguuguauuuaggaguuauggugcaagcggauucuggaugcgugguuagcuggaaaaauaaggaacuaaaguguggaucuggcauauuuauaacugacaaugugcauaccuggacugaacaauacaaguuucaaccugagucaccaucgaaauuagcuucagcaauucaaaaggcacaggaggaagguauaugugggauccgcaguguuacccgccuagaaaaucugauguggaaacaaauuacaccggaacuuaaucauauauuagcugaaaacgaggucaaacuaacaaucaugacgggagauauuaaggguauuaugcaagcaggaaaacguuccuugcgcccucaaccaaccgaguuaaaguauucuuggaagacaugggggaaagccaagauguugagcacagaaaguuauaaucaaacguucuuaauagaugguccagaaacagccgaaugucccaauaccaacagagcauggaauagucuagaaguggaagacuacggguuuggagucuuuacgacaaacauuuggcucaaacuaaaagaaaaacaagauguauuuugugauucgaaauugaugucagcugcaauaaaagauaauagagcggugcacgcugauaugggauauuggaucgaauccgcucuaaaugacacauggaagauagaaaaagccucauuuauagaagugaaaaacugucauuggccgaaaucacauacccuuuggaguaaugggguccuugaaucagaaaugauuauucccaaaaaucucgcaggcccuguaucucagcacaauuauagaccgggcuaucauacacaaauagccggaccauggcaucucgguaaauuagaaauggauuuugacuucugcgaugggacuacuguaauagugaccgaggauuguggaaaucgagguccuagccuacgcacuacaacagcaucgggaaaauuaaucacagaaugguguugcaggaguugcacacuaccaccauuaagauauagaggggaagauggauguugguauggaauggaaauacgacccuugaaagaaaaggaagagaauuuagucaacaguuuaguaacagcagggcacggacaaguugauaacuuuucccucggcgugcuugguauggcacuauucuuagaagaaaugcuaaggacgcgaguaggaacaaaacaugcaauuuuguuaguggcaguuagcuuugucacguuaaucacgggaaauaugucuuuuaaagaccuuggucgcgugguaguuauggucggagcaaccauggcugaugauaucgggaugggcguaacauaucuagcauuacuagcagccuuuaaaguuaggccaacuuuugcagccggccuucucuugagaaaauugacaagcaaagaacuaaugaugacaacaauaggcaucguucuacuuagucaaucaacuauaccugaaacaguauuggaauuaacagacgcauuagcguugggcaugaugguguuaaaaaucguacgaaacauggaaaaauaucaacuugcggucacaauuauggcuauccucugcguaccaaacgcugucaucuuacaaaacgcauggaaaguuucuuguaccauacucgcggucgucagcguaagcccucuguuacuaaccaguucacaacaaaagaccgauuggaucccgcuugcccuaacaaucaaagggcucaauccgaccgcaauuuuucuuaccacucuaagcagaacaaauaagaaaagaucuuggccacuuaaugaagccauaauggcgguugguaugguuucuauauuagcaaguagucuccuuaaaaaugauauucccaugacagguccucuaguagcuggcggguuauuaacggucugcuauguuuugacaggcaggucagcagacuuggaauuagaaagggcuaccgaugugaaaugggaagaucaagccgaaauaucaggaucuucaccaauucucucaauaacaauaucagaagacggaucaaugucuaucaagaacgaagaggaagaacaaacacuaacgauacugaucagaacaggauuauugguaauaucuggccuguuuccaaucaguaucccaauaacggcggccgccugguauuuaugggaggugaagaagcaaagagccgggguccuaugggacguuccaucaccgccacccauggggaaagcagaacuggaagacggggcauaucgaauaaagcaaaaaggaauccuagguuauagucaaauuggagcuggaguguacaaagaaggcacauuccauacaauguggcaugugacaagaggggcaguucuaaugcacaaaggaaaaagaauagagccaucgugggcagacgucaagaaagaucucauaaguuacgggggagguuggaaacuugaaggagaauggaaggagggagaagaaguccaaguauuagcccuagaaccggggaagaauccaagagccguucaaacuaaaccuggauuguucaagacaaauacgggcacuauaggugcagucucauuagacuuuagcccaggaacgagugggagcccaaucauagacaagaaagguaaagucguuggacucuacggaaaugguguaguaaccagaaguggugcauaugucagcgcuaucgcucagacugaaaagaguauugaagauaacccagaaaucgaagaugauaucuuucggaagaggcgucugacuauaauggauuuacauccuggcgcugggaaaacuaaacgauaucucccggccauaguaagagaagccauuaaaagaggauugcgaacacuuauucuagcgccgacgcgagugguugcagccgaaauggaggaggcucuaagaggucuaccaauacgguaucagacgcccgcuauaagagcagaacacaccggaagagagauaguugaucuaaugugucaugccacguucaccaugagauuauugagccccguacgaguucccaauuauaaccugauuauaauggaugaagcacauuuuacagauccagcgaguauugcagcaagaggguacaucucuacgagaguggaaaugggugaggcagcaggcauauuuaugacugcgacucccccaggcucgagagaccccuucccacaaagcaacgcgccaauuaucgacgaggaacgagaaauuccggaacgcucauggaauagcggacacgaaugggucacugacuucaagggaaagaccguaugguucgugccaucuauaaaagcugguaacgauauagcagcauguuuaaggaaaaauggcaagaaaguaauacaguuaucgagaaaaaccuuugauucagaauauguaaaaacacgaaccaaugacugggauuucguagugacgacggacauuucagaaaugggggcaaauuucaaagcggagagggucauugacccuagaagaugcaugaagcccguuauuuuaacugauggagaagaacguguaauauuagcggguccaaugccgguaacucacaguucagcggcucaaagaagaggaagaaucggaagaaaucccaaaaaugagaacgaucaauauauauacaugggggaaccacuggaaaaugacgaagauugugcucauuggaaagaggcgaaaaugcuguuagauaacauuaauacgccugaaggcaucauaccauccauguucgagccagagagagaaaaaguagacgcaaucgacggugaauacaggcuacgcggagaagcuagaaaaaccuuuguggauuuaaugcggcgaggugaucuucccguauggcuggcuuacaagguagccgcagaagguauaaauuaugcagauagacgauggugcuucgacggcauaaagaacaaccaaauuuuagaagaaaauguggaaguugaaauuuggacuaaagaaggcgaaaggaaaaagcucaaaccacguuggcuggacgcacggaucuauucagacccuuuagcgcuaaaggaauuuaaagaauuugcagcaggaagaaagaguuuaacauuaaacuugauuacagaaauggguagauuaccaaccuuuaugacucagaaaacucgugaugcauuagauaauuuagcaguauugcauacagcugaagcagggggucgagcauacaaccacgcacuauccgaacuaccagaaacccuggaaacgcucuuacuauuaacguuauuagcuaccgugacuggaggaaucuuucuauuucuaaugaguggucgagguaucggaaagaugacacuuggcaugugcuguauaauaaccgcuuccauucuacuuugguaugcucaaauccagccacauuggauagccgccucgaucauauuagaguucuuccugauugucuuauuaauaccugaaccggaaaagcaacgaacaccccaagacaaucagcuaacauaugugguaauagcaauccugaccguaguggccgcgacuauggcgaacgaaaugggguuucuggagaaaacgaagaaagauuucggacucggcucuauugcaacacagcagcccgagaguaauauucuagacauugacuugcggccugcuagcgcauggacauuauaugcaguggcaaccaccuuuguuacaccaaugcuuagacacucaaucgagaacaguucaguuaacguguccuugacggcuauagcaaaccaggcuacuguacuaauggggcuaggaaaaggcuggccauugucaaagauggacauuggagucccgcugcuggccauuggguguuauagucaaguaaauccaauaacucucacugcagcauuacuguugcugguugcacauuaugcaauaauaggaccaggucuacaagccaaagcaacacgugaagcacaaaagcgagccgcagcagguauaaugaaaaacccuacaguggaugguaucaccgugauagauuuagacccuauuccauacgacccuaaauuugaaaagcaacuagggcaaguaauguuauugauacucuguguaacgcaaguccugaugaugaggacaacaugggcucuaugugaagcacucacccuagccacuggaccgauauccacccuaugggaagggaaucccggacgauuuuggaauaccacaaucgcuguuucaauggcaaacaucuuucguggcaguuaccuagccggugcagggcuacuauuuuccauuaugaaaaauacuaccaacacgagaagaggcacuggaaauaucggggaaacacuaggagaaaaauggaagucccguuuaaaugcgcuaggcaagagcgaguuucagauauauaagaaaagcggcauucaagaaguagaucgaacguuggcaaaggaaggaaucaagagaggggaaacugaucaucacgcugucucaagaggaucggcaaaauuacgaugguuuguagaaagaaacaugguuacuccagagggaaaaguaguagacuuaggaugugggagaggaggauggagcuauuacugcggcgguuuaaagaacguaagagaagucaaggggcuuacaaaagggggaccgggacaugaagaaccaaucccaaugaguacauauggcuggaacuuggucagacuacaauccggaguugauguauucuuuauaccacccgaaaaaugugauacucuucuaugcgauauaggagaaagcuccccaaauccgaccguugaagccggacggacauugcgaguuuuaaaucuaguugaaaauugguugaacaauaacacccaauuuuguauuaaagucuuaaacccauauaugccgucuguuauagagaaaauggaggcuuuacaacgcaaguacggcggcgccuuggugagaaacccccuuagcagaaauagcacccaugagauguacuggguaucaaaugcgaguggcaauauuguuucuucugucaauaugauaagcagaaugcucauaaaucgauucacaaugcgccauaaaaaggcaacauaugaaccugacgucgauuuaggaaguggaacucggaauauagggaucgaaucagaaauucccaaccuagauauuauagguaaaaggauugaaaagauaaaacaagaacaugaaacaucuuggcauuacgaucaggaucacccauauaaaacaugggcauaccaugguucauacgaaaccaagcaaacggguucggcaagcuccaugguaaauggaguaguccgccuauuaaccaaaccuugggauguucuaccaacgguaacgcagauggcaaugacugauacaacaccauuugggcaacaaagaguauuuaaagaaaaaguugauacuagaacacaagaacccaaagaggggacaaagaaauuaaugaaaaucaccgcugaauggcuauggaaagaacucggcaagaagaaaacuccaaggaugugcacgcgagaagaauuuaccagaaaaguaaggucaaaugcugcauuaggugccauuuucacugaugagaauaaguggaagucagcucgugaagccgucgaagauucccguuuuugggagcuuguggacaaagaaagaaacuugcaccuagagggcaaaugugaaacauguguuuacaauaugaugggaaagcgagagaagaaacuaggugaauuuggcaaggcaaaaggaagcagagccauaugguauauguggcugggagcaagauucuuagaguucgaagcacuaggauuucuaaaugaggaccauugguucucaagggagaacucguuaagcggcgucgagggagaaggacuccauaaacuuggauacauacuucgugacgugaguaagaaagaggguggggcaauguaugcagaugacacugcagggugggacacacgcauuacuuuagaggaucugaaaaaugaagaaauggugaccaaccacauggagggcgaacacaagaaacuagccgaagcaauuuuuaaguugacauaucagaauaaaguugugcguguacaaagaccaacuccaaggggcacagucauggacauaauaaguagacgugaucaacggggaaguggacaagucggaacauacggguugaacacuuuuacaaauauggaggcgcaacuaauacggcaaauggaaggagaaggcguuuuuaaaaauauccaacacuuaacaguaaccgaagaaguugcggugcagaauugguuagcucgggugggaagagagagacugucgagaauggcgauaucuggagaugacugcgucgucaaaccgcuugaugauagauucgcaaacgcucugacagcucuaaacgauaugggaaagauaagaaaggauauccaacagugggaaccaagcaaaggcuggaacgauuggacacagguacccuucugcucacaucauuuucacgaacuuauaaugaaagauggucguguuuuaguaguuccaugcagaaaccaagaugaauugauagggagggcacgcauuucacagggugccggcugguccuugagagagacugcaugccuaggcaaguccuaugcgcaaauguggagucuaauguauuuccauagacgagauuugagauuggccgcaaacgcaauaugcucggcagucccuucccauugggucccaacgagccguacgacauggaguauccacgcaaaacaugaauggaugacgacagaagacaugcucaccgucuggaaucggguauggauucgagagaaucccuggauggaagauaaaaccccaguagaaaguugggaagagauaccuuaccuaggaaagagagaagaucaguggugugguagccugauugggcuuacaaguagagcaacaugggcgaagaacauccaggcugcaauaaaccaaguuaggaguuuaaucggaaaugaggaguauaccgacuacaugccaagcaugaaacguuuccgaagagaagaagaggaagcaggaguucuaugguaa

SEQ ID NO: 22749 - RNA, 9876 nt, Artificial Sequence
  derived and/or modified CDS sequence (opt6) from DENV-2__EU482668__SS-prME
agugcaggaaugauuauaaugcucauucccaccguuauggcauuccacuuaaccacccgcaauggagaaccucauaugauuguuggaauacaagaaaaaggaaaaucacuuuuauuuaaaacggaagauggaguaaauaugugcacuuuaauggcuauggaccugggagaacuaugugaagacacuauaacauacaaaugcccacuacuuagacaaaaugaaccagaagauauugacuguugguguaacaguacgucuacaugggugacauacggaacguguacaaccacgggggaacauagacgagagaaaaggucgguagcccucguaccacauguagggaugggacucgaaacgcgcacagaaacauggaugaguucggaaggagcuuggaaacacgcccagagaauugaaaccuggauacuaagacauccaggguucacaauuauggcggcuaucuuagccuacacaauugguacaacacacuuucaacgaguuuuaauauuuauucugcuaaccgccgucgcuccgaguaugacaaugagaugcauuggaauaucuaauagagauuuuguugaaggaguauccgggggauccuggguggacauagucuuggaacacgguaguuguguaacgaccauggcuaaaaacaaacccaccuuggacuucgaauuaauaaaaacugaagcaaaacaaccggcaacacugagaaaauauuguaucgaagcuaaacuuacuaacacaacaacagaaagucguuguccaacccaaggcgaaccaucgcucaaagaagaacaagauaaaagguuugucuguaaacauucuaugguagauagggggugggggaacggauguggucuauucgggaaagguggcauaguuacaugcgccauguuuacauguaagaaaaacauggagggaaaaaucgugcagccagagaaccuagaauauaccauaguagugacuccucauaguggugaagaacaugcagugggcaaugauacagggaaacacggcauggaaauaaaagugacaccucaaucguccauaacagaagcugaauugacuggcuacggcacugugacuauggaaugcucaccuagaacaggacucgacuuuaacgaaauggugcugcuacaaauggagaauaaggcuugguuaguacaucgucaaugguuccucgaccuuccacuaccaugguugccgggagccgacaaacaagaaaguaauuggauacagaaagagacccuugugacuuucaaaaauccacaugccaagaaacaagacguaguaguacuagguagucaagaaggagcaaugcauacggcucuuaccggcgcaacagaaauacaaaugucaucaggaaauuuguuauuuaccggucauuuaaaaugcagacucagaauggauaaacuucaauuaaaagguaugaguuauucaauguguaccgguaaguucaaaguaguaaaggagauugcagaaacacagcacgggacuauaguaauucgcgugcaguaugagggagauggcagucccuguaaaaucccauucgaaaucauggauuuagagaaaagauauguucuuggucgauugauaacaguaaaccccaucguaacagaaaaagauucuccugugaauauagaagcugaaccaccguucggugauaguuacauuauuaucggcguugaacccggacaacuaaaacugaauugguucaaaaagggaucuucuaucgggcaaauguucgagacuacaaugagaggagccaaaagaauggcgauauugggagacacugccugggauuucgguucgcugggaggaguauucacgucaauugguaaggcauuacaccagguuuuuggugccaucuauggcgcagcuuuuuccggagucucauggacgaugaaaauauuaauaggagucauuaucacuuggaucggcaugaauaguagaaguaccucccuuagcguuagccuaguacuugugggaauuguuacauuauaucuggggguaaugguccaagcagauagcgguugcguugugucguggaaaaauaaagagcuaaaauguggaaguggaauuuuuauuacagauaauguacacaccuggacagaacaauacaaauuucaaccugaaucuccaaguaaacuggcaucagccauccaaaaggcucaggaagaggguauuugugguauucgaagcguaacaaggcuugaaaaucugauguggaagcaaauuacucccgaauuaaaccauauacuugcugaaaacgaaguaaaacugacgauaaugacaggagauauacgcgguauaaugcaagcaggaaaaagaucccuacgaccgcagccaacagaacucaaguacucauggaaaacaugggguaaagcgaagauguugucaacagaaagcuacaaccagacauuuuuaauugacggaccagagacagcggaaugcccuaauacgaaucgagcauggaacagcuuagaaguagaggacuauggauucgguguauucacuacaaauaucuggcuaaaauuaaaagaaaaacaagaugcauuuugugacucgaaacuaaugucugcugcaauuaaagauaacagagcugugcaugcugacaugggauacuggauagagucggcucuaaacgacacauggaagauagaaaaggccucauuuauagaagucaagaacugccacuggccaaaaucccacacacuauggucgaaugggguacuagagucugaaaugauuauuccaaagaacuuggcagguccaguaagccaacauaauuaucgaccuggauaucacacacaaauagcaggcccauggcaccucggcaaauuagaaauggacuuugauuuuugcgaugguaccacaguaauaguaacagaagacuguggcaacaggggaccaucauuacgaacaacaaccgcaagcggcaaacuaaucacagagugguguugucgauccugcacacuaccuccauugcguuauagaggagaagaugguuguugguauggaauggagaucaggccucuaaaagaaaaagaagagaauuuaguuaacagucugguaacagcagggcacggacagguagauaauuuuagccuagggguauuggggauggcauuguuucucgaggaaaugcuacgaacgaggguuggcacuaaacacgcuauacuguuagucgcaguaucguucgucacauuaauaacagguaacaugucauucaaagaucuagggagaguaguugugauggucggugcgacaauggcugacgauaucggcauggguguuacguaccuugcacuacuagcagcauuuaaaguccgaccuacuuuugcagcagggcuauuacuacgaaaacuaaccucuaaagaacuuaugaugacaacuaucgggauagucuuauuaagucaaucaacaaucccugagacagucuuggagcuaaccgaugcguuggcacuaggcaugaugguauuaaaaauuguaagaaauauggaaaaauaucaacuagcuguuacgaucauggccauccuguguguuccaaacgcuguaauauuacagaaugccuggaaagucucauguacgauccuugccguaguuagugucaguccauuacuucuaacuucgucucagcagaaaacggacuggauaccccuagcacuuaccauuaaaggauuaaauccaaccgcaauauuccucacaacacucaguaggacaaauaagaaacguaguuggccuuuaaaugaggcaauaauggcaguggguaugguaucaauccucgccucaucuuugcucaaaaacgacauaccaaugacgggcccauuaguagccggaggacugcucacuguauguuauguacuaacuggacgcagcgcagaucuagaacucgaaagagcgaccgacguuaaaugggaagaucaagcggaaaucaguggaagcucaccuauacuaucgauuacaauaucagaggauggaagcaugucaaucaaaaaugaagaagaagaacaaacauugacgauacuaauacgcacgggacuacucgucauaagcggguuguucccgauuucaauuccgaucaccgcagcugcuugguauuuaugggaaguaaagaaacagagagccgguguguuaugggacguacccucuccgccaccaaugggaaaagcugaguuagaggacggugcauaucguaucaagcaaaagggcauauuaggauauucccaaauuggcgccgguguauacaaagaagggacauuccauacuauguggcacguuacgcgcggggcaguauuaaugcauaaagguaaaaggauagaacccucaugggcagacgucaagaaagaccuaauuuccuaugggggaggauggaaauuagagggggaauggaaggagggggaagaaguacaaguauuggcauuagagccagggaaaaacccaagggcagugcagaccaaaccaggacuauuuaaaacuaauacagguacgaucggcgcuguaucuuuagacuuuaguccaggaacaagcgguucgccaauaauagacaagaaagguaagguggucgguuuguauggaaacggaguugucacgagaucgggcgccuacgugagugcaaucgcucaaacagaaaaguccauagaagacaacccggaaauugaagaugauauauuucguaagcgacgauugacuauaauggaccuucacccaggagccgguaaaacaaaaagguacuuaccagcaauaguccgggaggcaauaaaaagaggucuaaggaccuugauacuagcgccaacccggguugucgcagcagaaauggaagaggcauuacguggucuuccuauucgcuaccagacaccggcaaucagagcagaacacacuggaagggaaauaguagaucuuaugugucaugcaacguuuacaaugagacuauugagcccagugagaguaccaaauuauaaucucaucauuauggaugaggcacacuuuacggauccggcaucuauagcagcaagaggguauauaucaacccgaguugaaaugggcgaagcggccggaauauuuaugaccgcaacaccuccagguuccagggaccccuuuccucaaucgaacgcucccauaauagacgaggaaagagaaauacccgagaggucuuggaacucaggucaugaaugggugacagacuuuaaagguaaaacagugugguuuguacccucaauaaaagcggguaaugauauugcugcauguuuaaggaaaaacgggaagaaaguaauccaauuaucacguaaaaccuucgacagcgaauacguaaaaacacgaacaaaugacugggauuuuguuguuacuacugacauauccgaaaugggcgcgaauuuuaaagcagaaagagucauagauccaagaagguguaugaaaccaguaauacugacggacggcgaagaaagaguuauauuagccgguccaaugcccgucacucacagcagcgccgcgcaaaggcgaggaagaaucggaagaaauccuaaaaaugaaaaugaucaauacauuuauaugggggaaccacuggagaaugaugaagauugugcgcauuggaaagaggcgaagauguuauuagauaauauuaauacaccugaaggaauaauaccaagcauguuugagccagaaagagaaaaaguagaugcaauagacggugaauacagacuucgaggcgaggcacguaaaaccuuuguggaccuuaugcguaggggcgaccuuccuguauggcuagcauauaaaguugcugccgaaggcauaaacuaugcagaucgaaggugguguuuugacgggaucaaaaauaaucaaauauuggaagaaaacguugaaguugagaucuggaccaaagaaggugaaaggaagaaauuaaaaccacgcuggcuugacgccagaauauacagugauccuuuagcuuuaaaagaauuuaaggaauuugcugcuggaagaaaaucccucacauuaaauuugauaacugaaauggguagauugccaaccuucaugacacaaaagacaagagaugcuuuagacaaccucgcgguucuacacacagcugaggcgggcggacgagcguauaaucacgcgcucucagaauuaccugaaacucucgagacacuuuuauuacuaacucuuuuggcgacuguaaccggagggauauuuuuguuucucaugucagguagggggauuggaaaaaugaccuuagggauguguugcauaauuacugcuucuauauuauuaugguaugcgcaaauacagccccacuggauugcugcaucaauuauucuagaguucuuuuuaauuguccuccugauuccagaaccagagaagcaaagaacaccucaagauaaccaacuaacauacguagugaucgcaauucugacagucguagcugcgaccauggcuaaugaaaugggauuuuuggagaaaacgaagaaagaucugggauuagguucaauagcgacacagcaaccugaaaguaacauuuuagacauugauuuacguccugcuucggcguggacauuauaugccguugcaacuacauuugugacacccauguugagacauucaauagagaauagcucagugaacguuucuuuaacagcaauagccaaucaagcaacaguucucaugggacuagggaagggcuggccguuaagcaaaauggauaucgguguuccccucuuagcgauugguugcuauucacaaguaaauccuauaacacuuacagccgcguuguuacuccuaguggcucauuaugcgauaauaggcccagggcuacaagcaaaggcgacgagagaagcacaaaagcgagcugcagcagggauaaugaaaaauccaacugucgauggcauaacaguaauagaccucgauccuauaccauacgacccaaaauucgagaaacaacuugggcaagucauguugcuuauacucuguguaacucaaguguuaaugaugagaacaacuugggcacuaugugaagccuugacacuagcuacuggcccuauaucaacauuaugggaaggaaauccaggcagguucuggaacaccacaauagcaguuuccauggcaaauauauuucgggggaguuauuuagcgggggcuggacuacucuuuucgauaaugaaaaacacgacgaauacuagacgugggacaggaaacauuggugaaacuuuaggagagaaauggaagaguagguugaacgcacuaggcaaaucggaauuucaaauauauaagaaaaguggaauacaagagguugacagaacucucgcaaaagaaggaaucaaaagaggcgagacugaucaucaugcaguaucaagaggaucugcgaaacuacguugguuuguggaaaggaauauggugacacccgaaggcaaaguaguugaucucggaugugguagaggaggguggaguuacuauuguggcggucuuaaaaacgucagagaaguaaaaggucugaccaaaggagggccagggcacgaagaaccgauaccaaugucaacauacggguggaaccuagugagacuucaaagcggcguagacguuuucuuuauacccccugaaaaaugugacacucuauuaugugauauuggugaaaguagcccaaacccaacaguugaagcgggaagaacacuccguguuuugaauuuaguugaaaauugguuaaauaacaacacgcaauuuugcaucaaaguuuuaaauccguauaugccaucaguaaucgagaaaauggaggcgcuucaacgaaaauacggaggggcacuggucagaaacccuuuguccagaaacucaacgcaugaaauguacugggugucgaaugcaaguggcaacauuguaucaaguguuaacaugaucaguagaaugcuuauaaaccguuucacuaugcggcauaagaaagcaacauacgaaccagacguggauuuggggaguggaacucgaaacaucggaaucgaaucagaaauaccaaacuuagauauuaucggaaaaagaaucgagaaaauaaaacaagagcaugaaacaucuuggcauuaugaucaagaucauccguauaagaccugggcauaucaugggaguuacgagacaaaacaaacugguuccgcauccucuauggucaaugggguuguucggcuccugacaaagccuugggaugucuugccaacugucacgcagauggcuaugacagacacuacacccuuuggacaacaaagaguauucaaagagaagguggauaccaggacgcaggaaccaaaggaagguacuaaaaagcugaugaaaauuacggcagaauggcucuggaaagaacuugguaaaaagaaaacuccccguaugugcacaagagaagaauuuacaagaaaaguacgaucuaaugcggcucuaggugccauauucaccgaugaaaacaaauggaaaucagcucgcgaggcaguagaggauucacgauuuugggaauugguugauaaagaaaggaauuuacaucuugaaggaaaaugcgaaaccugcguuuauaauaugauggggaaaagagagaagaaauuaggagaauuuggaaaggccaaaggcucaagagccauaugguacauguggcuaggagcgcgcuuccucgaauuugaggcuuuagguuucuuaaacgaagaucauugguuuagucgagaaaauucuuuaucuggaguagaaggggaagggcuucauaaacuaggcuacauauuacgagauguaucuaagaaggaaggaggugcaauguacgcagaugauacagcaggaugggauacacguaucacucucgaggaucucaagaaugaagaaauggucacuaaccacauggaaggcgaacauaagaaacuugcugaagcuaucuucaaguuaacauaucaaaacaagguagugcguguccaacgaccaacaccccgugguacuguaauggauaucauaagccgacgggaucaacgcggguccggacagguagguacuuacggacuuaauacauuuacuaacauggaagcacaguuaauaaggcaaauggaaggugaaggaguauucaaaaauauacaacacuugacaguuacggaggaaguugcugugcacaacugguuagcaaggguaggaagggaacgauugucaagaauggccaucucuggagaugacugcguaguaaaaccccuagacgacagguuugcaaaugcguuaaccgcuuuaaaugacauggguaaaaucaggaaggauauacaacaaugggaaccaaguaagggcuggaaugacuggacacaaguaccauuuugcucacaucauuuucaugaguuaauaaugaaagacggccgaauuuugguugugccauguagaaaucaagaugaacuaauagguagagccaggaucagccagggagcuggaugguccuuaagagagacggcaugcuuaggaaagaguuaugcucaaauguggucucucauguauuuucacaggcgagauuuaagguuagccgcuaacgcaaucuguagugccgucccaucccauuggguaccaacaagucgaacaacuuggucaauacacgcaaaacaugaguggaugaccacugaagauauguugaccguauggaacagaguguggauaagagaaaacccauggauggaagacaaaacaccuguggagucgugggaggaaauccccuaucugggaaaacgugaagaucaaugguguggaucccuaauaggauuaacuucacgugccacuugggcuaaaaacauacaggccgcaauaaaucaaguuagaucacuaaucggaaaugaagaauauaccgauuauaugccuucaaugaagagauuccgucgggaagaagaagaagcugggguacuaugguaa

SEQ ID NO: 22750 - RNA, 9876 nt, Artificial Sequence
  derived and/or modified CDS sequence (opt6) from DENV-2__EU482669__SS-prME
ucagcuggcaugauaauaauguuaauuccuacgguuauggcuuuucaucuaaccacaaggaauggagagccacauaugauuguaggcauccaagaaaaaggaaaaucucuucuauuuaaaacagaggauggaguaaauauguguacucuaauggcaauggaccuuggggaacuuugugaggauacgauaacauauaaaugcccuuuauuaagacaaaaugaaccggaagauaucgacugcugguguaauaguacgucggcuuggguaacauauggaacuuguacaacaacuggagaacacagaagggaaaaacgauccguagcucucguaccgcauguggguaugggguuggaaaccagaacagaaacauggaugagcagcgagggcgcauggaaacacgcacaaagaauugaaacauggauccuuaggcauccuggguuuaccauaauggcagcgauucuagccuauacaaucggcacgacacauuuucaaagaguguuaauauuuauuuuacucacugccguagcuccaucgaugacaaugcgcugcauuggaauaaguaacagggauuucguugaggguguaucagguggauccuggguagacaucguuuuggaacauggcuccugugucacgacgauggccaaaaauaaaccaacuuuggacuucgaacuaauaaaaaccgaagcuaaacaaccagcaacacugagaaaauauuguaucgaagccaaacuaacaaacacaacgacagaaucgcguugcccaacgcagggggagccuucguuaaaagaggaacaagacaaaagauucguaugcaaacauuccauggucgaccguggauggggcaauggaugcggauuguuugggaaaggugguaucgucacgugcgcaauguuuacaugcaagaaaaauauggaaggcaaaauaguccagccagagaacuuagaauauacuauugucguuacuccacacucuggugaggaacaugcuguugguaacgauacgggaaaacauggaaaagaaauaaaaguaaccccacaaucuucaauaacagaaguugaauuaacuggauacgggaccguaaccauggaauguaguccgcguacaggucuggauuuuaacgaaaugguacuauugcaaauggaaaauaaagcaugguugguacauagacaaugguuucuagaucuuccucuaccgugguuaccgggagccgauaaacaagagaguaacuggauacaaaaggaaaccuuaguaacauuuaagaauccacaugcaaagaagcaggauguagugguacuaggaucgcaagaaggagccaugcauacggcguuaacuggcgcgacagagauccagaugucgagcgguaaucuacuauuuacuggacauuugaaauguagacugcgcauggacaaguuacagcuaaagggaauguccuauagcaugugcaccggaaaguucaaagucguaaaggaaaucgccgaaacccaacaugggacgauaguuaucagaguacaauaugagggugacggaucaccauguaaaauaccguuugaaauaauggaccuggaaaagagguauguuuuagguagauugauaacaguaaacccaauaguaacagagaaagacaguccaguaaacaucgaagcggaaccaccauuuggagauaguuacaucauaaucggaguagaaccuggccaacuaaaauuaaacugguuuaagaagggaaguucuauuggacaaauguuugaaaccacuaugaggggugcaaagcguauggcuauucuaggagacaccgccugggacuuuggaucauuaggaggaguauucacauccaucggcaaagcacuucaccaaguuuuuggagccauuuacggggcugcauuuagugguguaaguuggacaaugaaaauauuaauaggaguuauaaucacuuggaucggaaugaacucgaggucaacaucacugucaguaagucuaguauugguugguauagucacccuguauuuaggcgugaugguacaagccgauucggggugugugguaucguggaaaaauaaagaacuuaaauguggaucaggaauauucauaaccgacaauguccauacguggaccgagcaauacaaauuccaaccugaaucacccaguaaacuagcuagugcgauccaaaaggcccaggaagaaggaaucugcggcauacgcucagugacuaggcuggaaaauuuaauguggaaacaaauuacuccagaauugaaccauauacuugcagaaaacgaggucaaauuaacaaucaugaccggugauauaaaaggaaucaugcaagcgggaaaaaggagcuugagaccucaaccuaccgaacuuaaauacucuuggaagacuuggggaaaggcaaagauguuaucuacagaaucauauaaccaaacauuucuaauugacggaccagaaacugcagaauguccuaacacgaauagagcuuggaacucguuagaaguagaagacuauggguuuggaguuuucacaacgaauauaugguugaaauuaaaagaaaaacaggaugcuuucugcgauaguaaauugaugagugcugcaauuaaagauaauagagcaguacaugcagacauggguuauuggauagaaagugcguugaaugacacuuggaaaauugaaaaagccagcuuuauagaagucaaaaauugucauuggcccaaaagucauacacucuggaguaaugguguucucgagagcgaaaugaucauucccaaaaaucuagcaggcccugugagucaacauaauuacagaccaggauaucauacgcaaauugcaggaccauggcaucuuggaaaguuagagauggauuucgauuuuugugacgggacaacagucauugucaccgaagauuguggaaacagaggaccgagucuuaggacuacaacugcaaguggaaaauuaaucacagaguggugcuguagaucauguacacuaccuccauuacguuaucgaggagaagauggcuguugguauggaauggaaauccgcccucuuaaagagaaggaagaaaauuuaguuaauagccuuguaacugcaggccauggacaaguugacaauuucucccuagguguacucggcauggcuuuauuccuggaagaaauguuacguacucgggucgggaccaaacaugccauuuuauuaguagcuguaaguuuuguuacuuuaaucacuggaaacaugucguuuaaagacuuaggcagaguagucguuaugguuggagccacaauggcagaugauauuggcaugggugugacauauuuagcgcuacuagccgcauucaaagugagacccacguucgcagccggucuauugcucaggaaacugacuucuaaagaauugaugaugacaacaauaggaaucguguuacucucacaaucaacaauacccgagacaguacuggaacuaaccgaugcuuuagcacuaggaaugaugguucucaagauagugaggaauauggaaaaguaccaacuugcagugacaauaauggcaauucuauguguaccaaaugcgguaaucuuacagaaugcauggaaaguaucaugcacaauccucgcgguuguaagugugagcccucugcuuuuaacgagcucucaacagaaaacggauuggauaccccuagccuugacaaucaaaggguugaauccuacagcaauauuucuaacgacauuaucacgaacaaauaagaaaaggucauggccauuaaaugaagcuauaauggcgguagggauggugucgauauuagccucgagucuccuuaaaaaugacauucccaugacagggccucuuguugcaggcggcuuacuaacgguauguuacguuuuaaccgggagaucugccgauuuagaguuggaaagagcaacugauguaaaaugggaagaucaagcugagauauccggaagcaguccuauuuuaaguauuaccauuucagaagacgggucaaugucaauaaagaacgaagaagaggaacaaacgcuaacgauuuuaaucaggacaggguuauuaguaaucucaggacucuuuccuauaucaauaccaauaaccgcagcagcaugguacuuaugggaaguuaagaagcagagagccggaguuuugugggacgucccaucaccaccaccaaugggaaaggcugaacuagaagauggggcguaucguauuaagcagaaaggaauacucgguuacucccaaauuggugcaggagucuacaaggaggguaccuuucacaccauguggcacguaacacguggugcuguucuaaugcauaaggggaaacgaauagaaccaaguugggccgauguuaagaaagaucuaauuaguuauggggguggauggaaauuagaaggcgaguggaaagaaggagaggaaguacaaguauuagcauuggaaccgggcaaaaacccacgugcaguacagacaaaaccagggcuuuucaaaacaaauacaggaaccauaggugccguaucccuagauuuuucuccgggaacuucgggcaguccgauaauugauaagaaaggaaaaguugucgguuuauaugguaaugguguaguuacgagaaguggggcguauguuucggcaaucgcacaaacggaaaagagcauugaagauaauccagaaauagaggaugauauauuucgaaagcgaagacuuacaauuauggacuuacauccaggcgcugguaagacaaaaagguauuugccagcgauugucagagaagcgauuaaacguggacuacgaacucucauacuagcgccuacgagagugguugcagcggaaauggaagaagcacuucgugggcuaccaauaagauaccaaaccccugcgauaaaagcagaacacacgggacgcgaaauaguugaucuuaugugccaugcuaccuuuacaaugagguuacucaguccagugagagugccaaacuacaaccuuauaaucauggacgaagcucauuucacagacccugcgucaauagcagcacggggcuacauuaguacaagaguugaaaugggcgaagccgcaggaauuuucaugaccgccacaccaccaggaucacgagacccuuuuccacagucaaacgcaccaauaauagacgaggaacgugagauuccggaacggagcuggaacucgggacaugagugggucacagacuauaaaggaaagacaguaugguucguuccaaguaucaaagcgggcaaugauauagcggcaugccucaggaaaaaugggaagaaaguuauccaguuaaguagaaaaaccuucgauucagaguauguuaagaccagaacaaacgauugggacuuuguagucacaacugacauuucugaaaugggagcaaauuucaaagcagaacguguuauagauccuaggcgauguaugaaaccgguaauacuaacugauggagaagaacguguuauauuagccggccccaugccaguaacacauaguucagcagcacaaagacggggucggaucgggcguaauccgaaaaaugagaaugaucaauauaucuacaugggagagccacuggaaaacgacgaagacugugcucacuggaaagaagcaaaaaugcuuuuggacaacaucaauaccccagaaggcauaauaccauccauguucgaaccagagagagagaaagucgacgcaauagacggggaauaucggcuaagaggugaagcucggaaaacguuuguagacuuaaugagacgaggagaucuuccaguuuggcuugcuuauaagguggcagcugaggguauaaauuaugccgacagaagguggugcuuugauggaauaaagaauaaucaaauucuagaggagaauguggaaguugaaaucuggacaaaagaaggggagcgaaagaaauuaaaaccgagauggcucgacgcacggauauauagugauccucuagcucuaaaagaauuuaaagaauuugcagcggggcgcaaaagccuuacuuugaaucuuauaacugaaaugggacgauuaccgacuuuuaugacacagaaaacacgugaugcauuggauaaccuagcgguguugcacacagcugaagcaggaggacgugcauauaaccacgcgcuuagcgagcuaccggaaacucuagagacauuauuauuacuaacccuauuagcaacgguuacuggaggcaucuuucuguuucuaaugaguggacgugggauuggaaaaaugacccuuggaaugugcugcauaauuacagcauccauauuauuaugguacgcacagauacaaccacauuggaucgcagcaaguauaauauuagaauuuuucuuaauaguauuguugaucccagaaccagaaaaacagagaaccccgcaggacaaccaauuaacauacguuguuaucgccauccuaaccgugguugccgcaacgauggcgaacgaaaugggguuccuugaaaagaccaagaaagaucuggguuuaggauccauagcaacucaacaaccagagucaaauauuuuagauauagauuuaagaccggcaagugcuuggacauuauacgcuguagcaacuacauuuguaacuccuaugcuacgacacucuauugaaaacaguucaguaaauguaagucuaacagcaauagccaaucaagcgacugugcugaugggucuuggaaagggauggccucuaucaaaaauggacauaggaguuccuuuauuagccauuggguguuacagccaggugaauccgauuacauuaacagcagcucuuuugcuuuuaguugcccauuaugcuauuauaggaccgggauugcaagcaaaagcuaccagagaagcgcagaagagggcugcagcgggcaucaugaagaacccgacaguugacggaauaacuguaauugaccucgauccaauaccauaugacccgaaauucgaaaagcaauuaggucagguaaugcuguugauuuugugugucacccaggucuuaaugaugagaaccacuugggccuuaugugaagcccuuacauuagcaacagguccaauaucgacacuuugggaaggaaauccuggaagauuuuggaacacuacaaucgccguauccauggcaaauauauuucgaggcuccuacuuagcaggagccgggcugcuauuuagcauaaugaaaaauaccacaaauacgagaagaggaacggguaacaucggugagacucucggagaaaaauggaaaaguagauuaaaugcuuuaggaaaaucugaguuccaaauauauaagaaaucaggaauacaagaagucgaucgaacccuugccaaagaggggauuaaaaggggagagacagaccaucacgcaguuucacgcggauccgcaaaguuaagaugguuuguagaacgaaauaugguaacaccagaaggaaaagugguggaucuugguuguggacgagggggcuggucguacuauugcgggggccucaaaaauguuagggaaguaaaagggcuaaccaaaggaggaccagggcaugaggaaccaauuccaaugucaacuuacggauggaaucugguacgacuccaaucaggcguagauguauucuuuaucccaccagagaaaugugauacccucuuaugugauauaggcgaaagcuccccaaaucccacuguggaggcaggaaggacccuaagaguuuuaaaucuggucgaaaacugguugaacaauaacacgcaauucuguauaaaaguucuuaauccuuauaugccaucgguaaucgaaaagauggaagcucugcaacgaaaauacggaggggcccuaguacguaauccauugucgagaaauuccacucaugagauguacuggguaucaaacgcuucaggcaacauaguaagcuccguaaauaugauuagcaggaugcuuauaaauagauuuacaaugaggcacaaaaaggcgaccuaugaaccggacgucgauuuaggcagugguacaagaaauauagguauugagucggaaauaccuaaucuagauaucauaggcaaacguauugagaaaauaaaacaagaacaugaaacguccuggcauuaugaucaagaccauccguacaaaacaugggcguaccaugguucauaugagacaaagcaaacugguucagccaguaguaugguuaaugguguugugagacuucucaccaagccgugggacguguuacccacaguuacucagauggcuaugacagacacaacccccuucggacagcaacguguguuuaaagagaaagucgauacacgaacccaggagccuaaagaggguaccaaaaagcuaaugaaaauuacugcugaguggcuauggaaagaguuaggcaaaaagaagacaccaaggauguguacacgagaagaauuuacacggaaaguaaggucaaaugcugcccuuggagcaauauuuacagacgaaaacaaauggaagucugcacgagaggcgguugaagacucccguuucugggaacuggucgacaaggagcgcaauuugcacuuggaaggcaaaugugagacaugcguuuacaauaugaugggcaaaagagagaagaaauuaggugaauuuggaaaggcaaaaggaucgcgugcuauaugguauaugugguuaggugcacgcuuuuuggaguuugaagcgcugggauucuuaaacgaggaccacugguucucacgagaaaauucacuaaguggaguagagggggaaggacuacauaaauuagguuacauacuacgagauguaagcaagaaagaagggggugcaauguacgcagaugacacugccggaugggacaccagaauaacucuagaagaucugaaaaaugaggaaaugguuacgaaccauauggagggugaacauaagaaacuagcagaggcuaucuuuaaacuuacauaccaaaacaaaguagugcgaguucaacgaccaaccccaagaggaacuguaauggauauuauaaguagaagggaucagagagguagcggacaggugggaaccuauggcuuaaacaccuuuacgaauauggaagcacaauuaaucagacaaauggaaggcgaggguguuuuuaaaaccauucaacacuuaacagugaccgaagaaguugccguacaaaauuggcuagcaagagucgggcgugaacgacuaagccguauggccaucucgggcgaugauugcgucguaaaaccgcuagaugaucgauucgcuaaugcacuaaccgcguuaaacgauauggggaagauaaggaaggacauucaacagugggagccaucaaaaggguggaacgauuggacgcagguaccauuuuguucucaccauuuucaugaacuuaucaugaaagaugggagaguauuaguaguaccuuguagaaaucaagaugaauugauaggucgagcgcguauuagccaaggagcagguuggagcuuacgggaaacagcaugccuagguaagaguuaugcucaaauguggagucucauguacuuucaccgcagggaccugcgccuagcugcuaacgcaaucugcagcgcaguaccaagucacuggguaccuacaagccguacgacguggucgauccaugcaaaacacgaauggaugaccacugaggacaugcucacagucuggaacagaguauggauacgagaaaacccuuggauggaagacaaaacaccaguagaaucgugggaagaaauaccauaccuaggcaaaagagaagaccaguggugcgguagcuugaucggacuaacaagcagagcaacuugggccaaaaauauucaagcagcgauuaaccaagucagaucgcugauuggcaaugaagaauauacggauuauaugccaucaaugaaaagauuuagaagagaagaagaagaagcaggaguacuaugguag

SEQ ID NO: 22751 - RNA, 9876 nt, Artificial Sequence
  derived and/or modified CDS sequence (opt6) from DENV-2__EU482670__SS-prME
agcgcaggaaugauuauaaugcuuauacccacaguaauggcuuuccaucugaccacaagaaauggugaaccucauaugauaguaggaauacaagaaaaaggaaaaucucucuuguucaaaacugaagacgggguuaacauguguacccucauggcaauggaucuuggagaacugugcgaagacacuaucacguauaaaugcccauuguuaagacagaaugaaccagaagauauugacuguuggugcaauucgaccucuacauggguaacauauggaacauguacaacgacaggagaacacagacgagaaaagagaagcguggccuuaguaccacacgucgguauggggcuagaaacgagaacagaaacuuggaugucaucagaaggagcauggaaacaugcucaaagaaucgaaacauggauauuaagacauccuggauuuacaauaauggcugccauacuugcauauacgauaggaacaacgcacuuccaaagaguucuaauauuuauacugcugacugcagucgcaccaucuaugacgaugagauguauugguaucucaaauagggacuucguugagggaguauccgggggaucauggguagacauaguauuagagcauggaaguuguguuacaacaauggccaaaaauaaacccacucuugauuucgaacuaauuaaaaccgaagcaaaacaaccggcaacucuuagaaaauauuguauugaggcaaagcugaccaacacaacaacugaaucucgauguccgacacagggagagccuagcuuaaaggaggaacaagauaagcgauucguuuguaaacacaguauggucgaccgaggauggggcaacggaugcgguuuauucgguaagggagguauugugaccugcgcgauguuuacaugcaaaaagaauauggaagguaagauaguacagcccgagaauuuagaauacacuaucguaguuacuccacacaguggagaagaacaugcuguugggaaugacacaggcaaacaugggaaagaaauaaaaguaacuccacaaagcucgauaacggaagcggaguuaacgggauaugggacaguuacgauggaaugcucuccacggacaggauuagauuuuaacgagaugguauuacuacaaauggagaauaaagcauggcuaguucauaggcaaugguuccuugauuuacccuuaccauggcuaccaggagcugauaaacaggagaguaauuggauccaaaaagaaacgcuuguaacuuucaaaaacccucaugccaagaagcaagauguagucguauuagggagucaagaaggcgccaugcauacggcucuuacaggagcaacagaaauacaaaugagcuccgggaauuuacuauuuaccggacauuuaaaaugccgacucaggauggauaaacuacaacuaaaagggaugucguauagcaugugcacggguaaguuuaaaguaaugaaagaaauagcagaaacgcaacaugguacuaucguaauacguguccaguaugagggcgacggaagcccauguaaaauaccguucgaaauaauggacuuggaaaagcgcuacguauuaggaagauuaauaaccguaaauccuaucguuacggaaaaagauucaccuguaaacauagaagccgaaccgcccuuuggagacucguacaucauaauuggaguggagccuggacaacucaaacuaaauugguucaaaaagggcagcaguauaggccaaauguucgaaacaacuaugcguggugcaaaaaggauggcaauauuaggagacacggcuugggauuucgguagucuaggaggugucuuuaccucaauaggcaaggcccuacaccagguauuuggggcgauauauggagcagcguucucaggaguguccuggacaaugaaaauacuaaucggaguaauaauaaccuggauugguaugaacucaaggucaaccagcuuguccgugucauuaguacuggugggaaucguaacacuguacuugggaguaaugguccaagcagauucggguuguguuguuaguuggaaaaauaaagagcuaaaauguggaagcgguauuuucauuacugauaauguucacacuuggaccgaacaauacaaauuucaaccagaaaguccaaguaaacuagcgucagcaauccagaaagcacaagaagaaggaauuugcggaauccgaaguguuacacgccuagagaaccugauguggaaacaaauuacuccugagcuuaaucauauacuugcugaaaacgaaguaaaauuaacaauaaugaccggcgacauaaaggguauuaugcaagcagguaaacgaucucuacgaccccaaccuaccgaacucaaauacaguuggaaaacuugggguaaggcgaagaugcugaguacagaaucucauaaucaaaccuuucuaauugacggcccagaaaccgcagaaugcccuaauacgaacagggcauggaacagccuggaggucgaggacuaugguuuugguguauuuacuacaaauaucuggcucaagcucaaagagaaacaggaugcuuuuugugauucuaaauugauguccgcagccauaaaggauaacagagcaguucaugccgacauggguuacuggaucgaguccgcuuugaacgauacuuggaagauugaaaaggcgaguuuuaucgaagucaaaaauugucauuggccaaagucucauacauuauggagcaauggcguauuagaauccgaaaugauaauccccaaaaauuuagcuggaccagugagccaacacaacuaccggccagguuaucacacacaaguagccggucccuggcauuuaggcaagcuagaaauggauuucgauuucugcgacggaacgaccguaauaguaacagaggauugugggaauagaggaccaagucugagaacaacgacagccagcggcaaacugaucacugaaugguguugccguagcugcacguuaccaccccuaagauaucggggugaggauggaugcugguaugguauggagauaagaccuuugaaagagaaagaagaaaaccugguuaauucauuaguuaccgccggucacggccaaguggauaacuucagucugggaguuuugggaauggcacuauuccuggaagaaauguugcgaacacgagucgggacaaaacacgccauacuucuaguugcaguaaguuucguuacacucauaacagggaacaugucguuuaaggaccucggcagaguggucgucauggucggagccacuauggcagaugacauaggcaugggaguaacuuacuuagcacuacuagcagcauuuaagguacgcccaacauucgcugcggggcuuuugcuacgcaaauuaacaucaaaagaacucaugaugacuacuauagguauuguauuguuaagucaaucaacaauaccugaaacaguacuagaauuaacagacgcucucgccuuaggaaugaugguccuaaaaaucguacguaauauggaaaaauaucaacuggcugugacaauaauggcuauacucugcgucccaaaugccguaauauugcaaaacgcuuggaagguuaguuguacaauauuagcaguuguaagcguaucuccucuauuguuaacuucaucucagcaaaagacggauuggauaccccuagcacuaaccaucaaaggauugaacccuacagcaaucuuucuaacgacucuaagucgaacaaacaaaaagcgcaguuggccacuaaacgaagcgauaauggcuguaggcaugguaucuaucuuagccagcucacugcuuaaaaaugauauaccuaugacgggaccucucguugcggguggauuacuuacuguuugcuauguccuaacaggcagauccgcagauuuagaacucgaaagggcaaccgauguuaagugggaagaucaagccgagauuucagguucuucaccgauuuugucuauuacaaucagugaggacggaucgauguccauuaaaaacgaggaagaagaacaaacuuuaacaauauuaauuagaacaggacucuuagucauaagcggucuuuuuccgauuagcauaccaauuaccgcugcggccugguauuugugggagguaaagaaacaacgugcuggcguccugugggaugugccaagcccaccgccuaugggaaaagcugaguuggaagacggcgcguaucgaauaaagcagaagggcauucucggauacagccaaaucggagccggaguauacaaagaaggaacauuucauacaauguggcacguaacaagaggagcuguuuugaugcauaaggguaagagaauugaaccaucgugggccgauguaaagaaagaucuaaucucuuauggaggcggauggaaacuagaaggugaauggaaggaaggggaggaagugcaaguguuagcuuuggaaccaggcaaaaauccccgugcgguacaaacaaaaccuggacuguucaaaacaaauaccggaaccauaggugcagugucuuuggauuuuuccccgggaacaagcggcagcccaauaauugacaagaagggaaaagucgucggguuauauggaaauggcgucgugacaaggagcggagcguacguuagugcgauagcacagacagaaaagucgauagaagacaacccagagauagaagacgacauauucagaaaaagacgauugacaauuauggauuuacauccgggagccggaaagacaaaacgauauuuaccagccauaguacgcgaagccauuaagaggggacuucgcaccuuaauacuugcaccgaccagggugguugccgccgaaauggaggaggcacugagaggauuaccgauuagguaucagacacccgcaauccgagcagaacauacagguagggaaauaguugaucucaugugucacgcuacauuuacgaugcgacugcuuucgccgguuagaguuccaaauuauaaucucauaaucauggacgaagcucauuuuacagaccccgccaguauugcggcucgaggguacauaucgacucgaguagaaaugggggaagcagcugguauauuuaugaccgcaacuccaccaggaagcagagaccccuucccgcaaagcaaugcuccgauaaucgacgaagaaagagaaauaccugagagaaguuggaacucggggcaugagugggugacugauuucaaagguaaaacuguaugguuuguacccucaaucaaagcaggaaaugauauugcagccugccuucguaaaaacgguaagaaaguuauccagcugucaagaaagacuuucgauagcgaauauguuaaaacuaggaccaacgauugggauuuugugguuaccaccgauauuuccgagaugggugccaauuuuaaagccgaaagaguuauagauccaagaagaugcaugaaaccaguaauauuaacggauggagaagaacgagugauacuagcaggccccaugcccgugacacacaguucugcagcacaacgacgcggacgaauaggaagaaauccgaagaaugaaaacgaccaguauauauauaugggagagccucuugaaaaugacgaagauugugcccacuggaaagaggcuaaaauguuguuggauaacauaaacacgccagaaggaauaauuccguccauguuugaaccugagcgagaaaaaguggaugcaauagauggugaauaucgguugcgaggggaggcaaggaaaacauucguagacuuaaugagaagaggugaccuaccagucuggcuagcauacaaaguugcagcagaaggcauaaacuaugcugaccgucgaugguguuuugacggaaucaaaaauaaucaaauucuugaggaaaacguagaggucgaaauauggacaaaggaaggagaacguaaaaaguugaagccaagaugguuagaugcacgaauauauagcgauccauuagcccuuaaggaauuuaaagaauuugcggcuggacgcaagucacucacucuaaaucugauaacugaaauggggagguuaccuacuuuuaugacucagaaaacgcgggacgcucuugacaaucuagcagucuuacacacggcagaagccggaggacgcgccuauaaucacgcacuaagcgaacuuccggaaacucuagaaacacuguuguuguuaacgcuacuugcgacagugaccggaggaauuuuucuauuccugaugucaggaagaggaauugguaaaaugacacuaggaauguguuguauaauuacagcgagcauccuguuaugguacgcucaaauccaaccucauuggauugccgcauccauuauccucgaguucuucuuaauaguauugcugaucccagaaccagaaaaacaacggacaccucaagauaaccaacuuacauacgucguaauugcaauacuuacugucguagcagcgacaauggcgaaugaaauggguuuccuugaaaagaccaagaaagaucuuggacucgguagcauagcaacccaacaaccggaaucaaacauauuagauauugauuugcggccagcgagcgcguggacacucuacgcuguggcgacaacauuuguuacaccaauguuaagacacucgauagagaauagcucaguuaacgucuccuuaacggcgauagcuaaucaagcgacgguacuuaugggccuaggaaagggauggccacucucuaagauggauauaggaguuccuuuauuagcaauaggauguuauagccaaguaaauccuauaacacuuacggccgcacucuuauuauuaguggcgcacuaugcaauuaucggcccaggauugcaagcuaaagcaaccagagaagcucaaaaacgagcagcugcugggaucaugaaaaaccccacggucgacgggauaacggucauagacuuggauccaauaccauacgacccuaaauucgaaaagcaacuuggacaaguuaugcuacuaauacuaugugugacacaagucuuaaugaugagaacaacgugggcucucugugaggcacucacuuuagcaacagggccuauaaguacuuuaugggaaggcaauccaggacgguucuggaauacuacuauagccguuuccauggcaaacaucuucagaggcagcuaucuugccggagccggacuccuauucaguauuaugaaaaauacaacaaauacaagaaggggcacuggaaauaugggugagacuuuaggugaaaaauggaaaaguaggcuaaacgcauugggaaaaagugaauuucaaauauauaagaaaucagguauacaagaaguugauaggacacuagccaaagaggguauaaaaaggggugaaaccgaucaucaugcaguaucacgagguucagcaaaauuaagaugguuuguggaaagaaacaugguaacuccugaaggaaaggugguggaucuaggaugcggaaggggaggguggucguauuacugcgguggguuaaagaacguacgagaaguaaaaggguuaaccaaaggcgguccaggucacgaggaacccaucccaaugaguacuuacggauggaaucugguucgccuccagucgggagucgauguauucuuuauuccaccagaaaagugugauacacuucugugcgacauuggggaaucgagcccaaauccuaccguagaagccggacgaacacuacgcguauuaaaucuaguagagaacuggcuaaauaacaacacgcaauucuguauaaagguguuaaacccauacaugccgucgguaauagagaaaauggaagcccugcagagaaaauacggaggagcgcuaguaaggaauccacuuuccagaaauagcacgcacgagauguacuggguaagcaacgcuucaggaaauauaguaagcucgguaaacaugauaucaagaauguugauuaaucgguuuacuaugcgucauaagaaggcaacuuaugaaccugauguagaucuggguaguggaaccagaaauauagggauagaguccgaaauaccgaauuuagacauuaucggcaaaagaauagagaaaauaaaacaagaacacgaaacaagcuggcauuaugaucaagaccauccuuauaagaccugggcauaccaugguucguaugaaacuaaacaaacagguagugcaucgucaaugguuaaugggguaguaagacuauugaccaaacccugggacguguuaccaacggucacgcagauggcaaugaccgauacaacaccauuuggucaacagaggguuuuuaaagagaaaguagacacaagaacacaggaacccaaagaagggacuaaaaaguuaaugaaaauaacagcugaguggcuguggaaagaacucggcaagaagaaaacuccuagaauguguacacgagaagaauuuacaagaaaaguaagaucaaaugcugcgcuaggcgcaauuuuuaccgaugaaaauaaauggaaaucagcucgugaggcuguagaggacucccgauucugggagcuagucgauaaagaacgaaauuuacacuuggaaggaaaaugcgaaacaugugucuauaauaugaugggaaaaagagagaaaaagcugggagaauuuggaaaagcuaagggcucacgagcaauuugguauaugugguugggugcaagauuuuuagaguucgaagcgcuagguuuucuaaacgaggaccauugguuuagccgagaaaacagucugucgggagucgaaggagaaggucugcacaaacuuggguacauuuuaagagacguaucuaagaaagaagggggagcuauguacgcagacgauacagcgggcugggauaccagaauaacgcuugaagaccuuaaaaacgaggaaaugguuaccaaucauauggaaggcgagcacaaaaagcuggcugaagcaauuuuuaaacuaacguaccaaaauaaaguugugagaguccaaagaccaaccccacggggaacagucauggacauaauuagccgaagggaccaaagaggaucuggucaaguaggcaccuauggcuuaaacaccuuuacaaacauggaagcacaacuaaucagacaaauggagggcgaaggaguguuuaaaaacauucaacauuuaacuguuacagaagaaguagcaguucaaaacuggcucgcacgaguugguagagaacgacuaucccggauggcaauaucuggagaugauuguguaguaaagccauuagaugauagauucgcaaaugcauuaacagcucuaaaugauauggguaagauaaggaaagauauccagcagugggaaccaucgaaaggguggaaugauuggacucaggugccuuuuuguagucaucauuuucacgaguuaauuaugaaagaugggcgaauacuggucguaccaugucguaaucaagaugagcucauaggcagagcuaggauaucccagggagcuggcuggucacucagagaaacggcauguuuggguaaaucauaugcgcaaauguggagucuuauguauuuucauaggagagaucuaagauuagcugcaaacgcaauauguucugcggugccaagccacugggugccuaccagccgcacgaccugguccauacacgcaaaacaugaauggaugaccaccgaggacaugcucacaguauggaacagaguauggauucgagaaaauccuuggauggaagauaaaacaccugucgaaucaugggaagagauaccguacuuagguaagagagaggaucaauggugcggcagcuuaaucggacuaaccucuagagcgacaugggcuaaaaacauacaagcggcaauaaaucaaguacgaucucuuaucgggaacgaagaauacacugacuauaugccgagcaugaagagguuucguagagaagaagaagaagccgguguucuuugguag

SEQ ID NO: 22752 - RNA, 9876 nt, Artificial Sequence
  derived and/or modified CDS sequence (opt6) from DENV-2__EU482671__SS-prME
ucagcuggaaugauaaucaugcuaauaccuacugugauggcuuuucaucuaaccacuagaaauggugaaccacacaugauaguagguauacaagaaaaagguaaaucucugcuauuuaaaacggaagauggcgugaauauguguacguugauggccauggauuuaggagaauuaugcgaagauacuauuacauauaaauguccguugcuaagacaaaaugaaccggaagacauagauuguuggugcaauucaaccuccacguggguaacuuacggaacauguacgacaacgggagaacaccgaagggagaaaagaucaguagcauugguaccacacguuggaaugggguuagaaacucgaacagaaaccuggaugucaucagaaggcgcguggaaacacgcgcaacgaauagaaacuuggauuuugcgacaccccggauucacgaucauggccgcuauuuuagcauacacuauugguaccacacacuuucaacguguauugauauuuauauuauuaacggcagucgcaccaucgaugacaaugcguuguauagggauuucgaaucgagauuucguugaaggugucagcggaggcaguugggucgacauuguauuagaacauggaaguugcguaacaacaauggccaaaaauaaaccgacucuagauuuugaauuaauaaaaacugaagcaaaacaaccagcuacccuaagaaaauacugcauugaagcuaaauuaaccaacacgacaacggagucacguugcccgacacaaggugaaccaucacuuaaagaagaacaagauaaacgauuuauauguaaacacucaaugguugacagagguuggggcaauggauguggccuauuuggaaaaggagggaucgucacgugcgccauguucacauguaagaaaaacauggagggaaaaauaguucaacccgaaaacuuagaauacaccauuguuguaacaccacacagcggagaggaacacgcagugggaaacgacaccggcaaacacgggaaagagauuaaaguuacaccacaaagcucuauaacggaagcugaauuaaccggauauggaaccguaacuauggaaugcaguccucgaacuggguuagauuuuaaugaaaugguauuacuacaaauggaaaauaaagcaugguuaguccaccggcaaugguucuuggauuuacccuugccaugguuaccaggggcagacaaacaagaaucgaauuggauacaaaaggaaacauuagucacuuucaaaaauccucaugcgaaaaagcaagacgugguuguucuaggcagucaagaaggugcgaugcauaccgcacuaacaggugcaacugagauucaaaugagcucugguaaccuauuauucacaggacaucuuaaaugcagguuaagaauggauaagcuacaauuaaaggguaugagcuacucgauguguacaggaaaauucaagguaguaagagaaauugcagaaacccaacacggaacgauagucauaagaguacaauacgaaggcgauggaucaccauguaaaauacccuucgaaauaauggauuuagagaaaagguacguccuuggacgauuaauaacgguaaauccuauaguaacggaaaaggacagcccaguaaauauagaagcagaaccuccuuuuggagacagcuauauaauuauuggaguagagccagggcaacugaaacuuaacugguuuaagaaagguuccucuauaggucaaauguucgaaacaacuaugaggggugcaaaaagaauggcuauacuaggcgacacugcaugggauuucgggagccuaggugguguauuuacgaguauugggaaagcauuacaucaaguauuuggagcuauauacggugcggcauucagugguguuuccuggacaaugaaaaucuugauaggagugauaaucaccuggauagguaugaauagcagaucuaccucuuugagugugucccuaguauugguuggaauaguuacacuuuaucugggaguuaugguccaagcagacagugguugugugguauccuggaaaaauaaagaauuaaaguguggaucuggaaucuucauuacugauaacguccauacauggacagagcaauauaaguuucaaccagagucaccgucaaaauuggccuccgcaauacaaaaggcgcaagaagaaggaauaugcggaauacgaagcguuacgcggcuagaaaacuuaauguggaaacaaauuacuccagagcucaaucacauauuagccgagaacgaggucaagcugaccaucaugacgggcgauauaaaaggcaucaugcaagcaggcaaaagaagucuaagaccacagccgaccgaauuaaaauauagcuggaaaacauggggcaaagcuaagauguuaaguaccgaaagcuauaaucagacuuucuugaucgauggaccugagacugcagagugucccaauacaaauagagccuggaauagccuagaaguggaagacuauggauucggcguauuuacuacuaauaucugguuaaaauuaaaggaaaaacaagaugcauucugcgauuccaaauugaugagugccgccaucaaagacaauagagcuguccaugccgauaugggauacuggaucgaauccgccuuaaacgacaccuggaaaauugaaaaagccuccuuuauagaaguaaagaauugucauuggccgaaaagucauacauuauggucaaaugguguuuuagaaucggaaaugaucauucccaaaaaucuagcagguccuguaagucagcauaacuaucggccagguuaucacacacagauagcugguccguggcacuuagguaaauuagaaauggacuucgauuuuugugacggaacuaccguaaucguaacggaagacugcggcaaucgaggaccgaguuugaggacuacaacugcaucaggcaaauugaucacugaaugguguugcagaucuuguacgcuacccccgcuaagauacagaggugaagacggguguugguaugggauggagauccgaccguuaaaagaaaaggaggaaaacuuggucaauucauuaguaacagcaggacauggacaggucgacaacuuuagccuggguguacugggaauggcauuguucuuagaagaaaugcuucggaccaggguuggaacaaaacacgcaauucuauuaguugcagucagcuuuguaacauuaauaacaggaaauaugucuuucaaggaccuuggacguguaguaguaaugguuggcgcaacuauggcagacgacaucggaauggguguaacguauuuagcuuuacucgcggcguuuaaaguaaggccuaccuuugcagcgggauugcuauuaaggaaacugacuucaaaagaacuuaugaugacaacaauuggaauaguauuguuaucacaaucaaccaucccugaaacaguguuagaacuuacugacgcguuagcguugggaaugaugguacuaaagauuguaagaaauauggaaaaguaucaacuggcugugacuauaauggcuauccucuguguucccaaugcagucauauuacaaaaugcuuggaaaguuuccugcacgauacuagcagucguauccgucucaccucuauugcuaacuucaucacagcaaaagaccgacuggauaccguuagcguugacaauaaagggguugaauccaacagcuauuuucuuaacuacacuuucgaggaccaauaaaaagagaaguuggccuuuaaacgaggcaaucauggccguugguauggugagcauccuugcuucaucauuacucaaaaacgauauaccuaugacggggccauugguagccgguggacugcucacaguauguuacguguugaccgggagaucagcugacuuagaguuagaacgggcaacggacgucaaaugggaagaccaggccgaaauuucugggaguucuccgauccuaucuauuacuaucagugaagacggaagcaugaguauaaagaaugaagaggaagaacaaacccuaacaauacuuauacguacuggauuacuuguaauuagcggguuauucccgauaucgauaccuauuacagcagcagcaugguaccuuugggaagucaagaaacaacgagcgggggugcuaugggacgugccaucaccgccuccaaugggcaaagcagaauuagaagacggggcguauagaaucaaacagaaaggcauacuaggauauucacaaauuggugcagggguauacaaagagggaacauuccauacgauguggcaugugacuaggggcgcuguauugaugcacaaaggaaaaaggauugaacccaguugggccgacgugaagaaagaucugaucuccuacggaggcggauggaaacuugaaggagaauggaaagaaggugaagaagugcagguacuugccuuggaaccuggcaaaaacccacgggcaguccaaacaaagccuggacuuuuuaaaacuaacacuggaacuauaggggcggugucacuggacuucagcccggguacaucuggaucuccaauaauugauaagaaaggaaaagugguaggauuauacggcaauggaguuguaacuaggaguggagccuauguaagugcaauagcacaaacugaaaaaucaauagaagauaauccugaaaucgaagaugauaucuuccgaaaaaggagacucacgauaauggacuuacauccaggagcuggaaagacuaaacgauaucuaccugcaauuguccgagaggcaauuaaacgaggacuuaggacuuuaauacuagcuccaacgagagucguggcagcagaaauggaagaagcgcuaagaggccucccgauaagauaucagacuccagcaauuagagcagaacacacggggagagagauuguggaucuaaugugccacgcaacauucacaaugaggcuccugucgccuguccgaguuccaaauuacaauuugauaauuauggaugaagcacauuucacagacccagcuaguauagcugcaaggggguauaucaguacacguguugagaugggggaagccgcagguauauuuaugaccgcaaccccucccgggucaagagauccauuuccucaaagcaaugcgcccauaauagaugaagagagagagauuccugagcgcagcuggaacaguggucaugaauggguaacagauuucaaggguaagacagucugguuuguuccaagcauaaaggcgggcaaugauauagcagcauguuugaggaagaacgggaagaaaguuauucaauuaucccgaaaaacguuugacucagaauacguuaaaacccgaacaaacgauugggacuucguagugacaacggauauaucggaaaugggcgcaaacuuuaaagcagaaaggguuauugauccacgacgcuguaugaaaccaguaauucuuacggacggagaggaaagagucauucuagcgggaccaaugccaguaacccacuccagcgcggcacaacgaagaggaagaauugguagaaaccccaaaaacgaaaaugaccaauauauuuauaugggcgaaccgcuagagaacgaugaagacugugcgcauuggaaagaagcaaaaauguuauuagauaauaucaacacaccagaaggcauuauacccucaauguucgaaccggaacgagaaaaaguagaugccauagauggagaauauagauuacguggugaagcgcguaagacauuuguagaucucaugcgacguggcgaucugccaguaugguuggcuuauaagguggcggcagaaggcauaaacuaugcagaucguagauggugcuucgauggaaucaaaaauaaccagauuuuagaagaaaauguugagguugaaauauggacuaaagaaggagaaaggaagaaauuaaaaccccgguggcuagaugcacggauuuacuccgacccacuggcuuuaaaagaauuuaaagaauuugcagcaggaaggaagaguuuaacguuaaacuuaauaacagaaaugggucggcuaccaacuuuuaugacccagaaaacucgugaugcuuuagauaauuuagcgguacuucacacggcggaagcuggaggcagagcguauaaucaugccuuaagcgaacuaccggaaaccuuggaaacccuauuacuacuaacguuauuagccacaguuaccggaggcauauuuuuguuuuuaaugucugguagggguauugguaaaaugacauuaggcauguguuguauaauaacugcaagcauccuguugugguaugcgcaaauccaaccgcauuggauugccgcaaguauaauuuuagaguucuuucugauaguacuuuugauaccagaaccagaaaaacagcggacaccucaagauaaccaacuaaccuacguuguaaucgcaauacuuacugucgucgccgcuacaauggcuaaugaaaugggcuucuuggagaaaacgaagaaagaucuggggcuagguucaauagcuacacaacagccugaaaguaacauccuagacauugaucugcgaccugccagugcauggacacuguacgcgguagcaacuacauucguuacccccauguuacgccauucaauugaaaacagcucaguuaaugugaguuugacugccauugcuaaccaagcuaccgugcuuaugggauugggaaaagguuggccacuaagcaaaauggauauagggguaccguuauuggcgaucggaugcuauagccaagucaaucccauaacacuaacagcagccuuacuacucuuaguagcacauuaugcaauaauaggacccggucuccaagcaaaagccacgagagaagcgcagaaaagagcagcagccgguauaaugaaaaauccaacugucgaugggauaacagucauagaucucgacccuauucccuacgauccaaaguuugaaaagcagcuagggcagguaaugcuucugauccuaugugugacacagguauuaaugaugcgaacaacaugggcguuaugugaggcuuugacacucgcuacgggcccaauaucaacuuuaugggaaggaaaucccgggagauuuuggaauaccacgaucgccguuagcauggcaaauauauuccgagguagcuauuuagccggugcaggcuuauuauucucuaucaugaaaaacacuaccaauacccgcagggggacugguaacaugggagaaacgcuaggggaaaaauggaaaagccgccuaaaugcauuaggaaaaagugaguuucagauauacaaaagaucaggcauacaggaaguggaucguacauuagcuaaagaaggaauaaagagaggcgagacggaccaccacgcaguuucacgaggaucugcaaaacucagaugguucguagaaaggaauaugguaacuccagaagguaaaguaguugaucucgggugcggacgaggaggaugguccuacuacuguggagggcucaaaaacguacgugagguuaaagguuugacgaaagguggaccuggacaugaggaaccuauuccaaugaguaccuauggcuggaaucuaguacgccuacaaucagguguagauguauuuuucauaccgccugaaaaaugcgauacuuuacuaugcgauauaggugaaucaagcccaaauccaaccguggaagcaggacggacacugcgagugcuaaauuugguugagaauugguuaaacaacaauacucaauuuuguauaaaggugcuaaauccuuauaugccgucgguuauagagaaaauggaagcacuucaaagaaaauacgguggagcucuaguacgaaauccacuaucccgaaauuccacccaugaaauguacuggguuaguaacgcuucagguaacauaguaucaucagucaauaugauaaguaggaugcuuauuaaucgguucaccaugcgccauaagaaagcuacuuaugagccugaugucgauuuggggucuggcacucguaacauagggauugagucagaaauacccaaucuugacauuauagggaagcguauagagaaaauaaaacaagaacaugaaacgaguuggcacuaugaccaggaucaucccuacaaaacuugggcguaucacggcucguacgaaaccaaacaaacaggcagcgcgaguaguaugguaaacggaguggucagauugcugacaaaacccugggauguguuaccaacagucacucaaauggccaugaccgauacaacuccauuuggacagcaaagaguauuuaaagagaagguugauacuagaacacaagaaccaaaggaaggaacgaagaaacucaugaaaauaaccgcagaauggcuauggaaagaauugggaaagaagaaaacacccagaaugugcaccagggaggaguuuacgcgaaaaguacgcaguaacgccgcacuuggagcuauuuuuacagacgaaaauaaauggaaaucagcacgagaggcgguagaggauagucgcuuuugggaauuagucgauaaagaaagaaacuuacaccuggaagggaagugugaaacaugcguauauaauaugauggguaagcgcgagaagaaauuaggugaguuuggcaaagccaaaggaucaagggcgauaugguauaugugguuaggagcaagguucuuagaauuugaagcacuuggauuucuaaacgaagaccauugguuuagucgugaaaacagucuuagcgggguagaaggggaagguuuacacaaacuugguuacauccuacgcgacguaaguaagaaagaagggggagcaauguacgcagaugauaccgcugguugggauacuaggauaacuuuagaagaccuuaaaaacgaagaaaugguaacaaaccauauggaaggggagcacaagaaacuagcugaagcuauauucaaauugacauaucagaacaaaguagucagaguacaacguccaacuccaagaggaacaguuauggauauuaucucgcgacgggaccagcgugguagcggacaaguagguacuuauggccucaauacuuucacuaacauggaagcacaauuaauaagacaaauggaaggcgaggguguauuuaaaaauauacaacaucucacagugaccgaagaaguagccguucaaaauuggcuagcacguguuggccgagagcgacuaagucggauggcaaucucaggagacgacuguguagucaaaccgcuagaugauagauucgccaacgcucuuacagcacuaaaugacauggguaaaauaagaaaggauauacagcaaugggaaccgucgaagggauggaaugauuggacucaaguacccuuuugcucacaucauuuucaugagcuaauaaugaaggaugggcgaguauuagugguacccuguaggaaucaggaugaauuaaucggccgagcacgaauuucgcaaggagcaggguggucuuuacgcgaaacagcuuguuuagguaaauccuacgcacaaauguggucacuuauguauuuccauagaagggacuugagacuugcagcaaaugcaaucuguucggcggugccgucccauuggguaccaacaaguagaacuacuuggagcauacaugccaagcacgaauggaugacuaccgaggauauguuaacuguguggaauagaguauggauuagagaaaaccccuggauggaagauaaaacaccuguugaguccugggaagaaauaccuuauuuaggaaagcgagaagaucagugguguggcucauugauaggauuaacaagcagggcuacgugggccaaaaauauacaagcagccauaaaucaaguacgcaguuugauaggaaacgaggaauauacagauuauaugccgucuaugaaacguuuuaggagggaggaggaggaggcugggguauuaugguag

SEQ ID NO: 22753 - RNA, 9876 nt, Artificial Sequence
  derived and/or modified CDS sequence (opt6) from DENV-2__EU482674__SS-prME
agugcagguaugauaauaaugcuuauaccaacuguuauggcauuucauuuaacgacaagaaacggagaaccgcacaugaucguuuccauacaagaaaaaggaaaaaguuuguuauuuaaaacggaagacgguguuaauauguguacauuaauggcaauggaucucggagaacucugcgaagacacaaucacauacaaauguccuuugcuuagacaaaaugaacccgaagauauagauugcuggugcaacuccacaaguacuugggucacguaugguacguguacgaccacuggagaacauagaagagaaaaacgaagcguugccuuaguaccucauguuggaaugggucuagaaacaaggacugaaacguggaugaguagcgaaggagcuuggaaacacgcucaaaggauugaaacauggauacuacggcacccaggauucacaauuauggcagcuauauuagccuacacaauagguaccacccauuuucaacguguauuaauauuuauacuauuaaccgcaguagccccaucuaugacgaugcgaugcauugguauaagcaaucgagauuucgucgaaggcgucagcgggggcucauggguagacaucgugcuggaacauggcucauguguaacuacgauggccaaaaauaaaccuacauuagauuuugaauuaauaaaaaccgaagcaaaacaaccugcgacacuacgaaaauacuguauugaagcaaaauugaccaauacuacaacggaaucuagauguccaacacaaggcgaaccuucacuuaaagaagaacaagauaaacgauucgucugcaaacacaguaugguugaucguggauggggaaacgguugcggcuuauuuggcaaaggugguaucgucacuugugcuauguucacuuguaagaaaaauauggaaggcaaaauaguccaaccugaaaacuuagaauacacaaucguuguaaccccacacaguggagaagaacaugcaguuggaaaugacacagggaagcauggaaaggaaaucaagguuacgccucaaagcaguauaacagaagcagaacucacaggcuauggaacuguaacaauggaauguagcccgaggacaggucuagauuucaaugaaaugguauuacuucagauggaaaacaaagcauggcuuguucaucgucaaugguuucucgauuugccauugccgugguugcccggugcagacaaacaagaaaguaauuggauacaaaaagaaacuuuaguuacguuuaagaauccacacgccaagaaacaagacguaguaguucuugguagccaagaaggcgcaaugcauacagcacuaaccggagccacugaaauucagauguccucagguaaccugcuauuuacaggacaccugaaaugcagacuuaggauggacaaacugcaacugaaaggaaugaguuauaguaugugcacugguaaauuuaaagugguuaaggaaauugcugaaacucaacauggaacuauagugauaagaguucaguacgaaggagacgguuccccgugcaaaaucccauucgaaauuauggacuuagagaaaagauauguuuuaggaagguugauaacaguaaauccuauaguuacggagaaggauaguccaguuaauauagaagcggaaccuccuuucggagauaguuacauaaucauagguguagaaccaggacaacuaaaacucaauugguuuaagaaagggagcaguauuggucaaauguuugagacaacuaugcgaggagcaaaacguauggcaauacucggugauacggcaugggauuucggaaguuuaggcggaguauucacaucaauugguaaagcacuccaccagguuuucggugccaucuauggcgcagcauucagcggugucaguuggaccaugaaaaucuuaauaggaguuauuauuacauggauugggaugaauagccguucaaccagcuugucggugagucucguuuuaguaggcauagucacacucuaucuagguguuaugguucaggcagauucagguuguguagucucauggaaaaauaaggaauuaaagugugggagugguaucuucauaacagauaacgugcacaccuggacugaacaguacaaauuucaaccggaaaguccaagcaagcuagcaagugccauacaaaaggcccaagaagaaggaauaugcgguauuagaucaguaacccgccuagagaauuuaauguggaaacaaauuaccccagaguuaaaucauauacucgcagaaaaugaaguaaaauugacuauuaugacaggagauauucgugguauaaugcaggcaggcaaaaggagccuaaggccucagccaacagaauuaaaauacucuuggaagacuugggggaaggcgaaaauguugucaacagagucguauaaucaaaccuuucugauugauggccccgagacagcugaaugucccaacaccaauagggcauggaauagucuagaaguagaagauuauggcuucggcguauucaccacaaauauauggcugaagcuaaaagaaaaacaagaugcauucugugauagcaaauugaugagcgcagcuauaaaagacaauagagcaguucaugcugauaugggauauuggauugagucagcguugaacgauaccuggaagauagaaaaagcaucguucauagaagugaaaaacugucauuggccaaaaagccauacuuuguggucaaauggaguacuagagagugaaaugauaauaccaaagaacuuagcagguccgguaagccaacauaauuacagacccggguaucacacacaaaucgcggguccguggcauuuaggaaagcuagaaauggacuuugauuucugugauggaacgacggucauaguaaccgaggauuguggcaacagaggcccaagucuaagaaccaccacugcaucagguaaacucauaacggaauggugcugucgaucguguacuuugccaccucugcguuaucguggcgaagauggauguugguauggaauggaaauuagaccacucaaagagaaagaagagaacuugguuaacucauuagugacugcgggacaugggcaaguggauaauuuuucacuaggaguauuagggauggcuuuauuccuugaagaaaugcuccgaacgagagucggcacgaaacaugcuauucuguuaguugccgugucguuuguuaccuuaauuacgggaaauaugaguuucaaagaucugggaagagucguaguaaugguaggagcaacaauggcugaugauauuggaaugggggugaccuauuuggcuuugcuggcggcguucaaagucaggccgacauuugcggcuggacuccuauuaagaaaacuaacuagcaaagaacugaugaugacgacgaucgguauuguucuacuaucacaaaguaccauacccgagacuguacuugagcuaacugaugcacuagcucucggaaugaugguacuaaaaauagucagaaacauggaaaaguaucaauuggcuguuacaauaauggccauacuaugugugccgaaugcuguaauacuacaaaaugcauggaaagugaguuguaccauccuugcagugguaucugugucuccauuacuacuaaccagcagucaacagaaaacugauuggaucccucuggcacuuacgauuaagggacugaauccgaccgcaaucuuuuuaacaacccuuagucgaacaaauaaaaagcggagcuggccauuaaacgaagcuauaauggcagucggaauggugucaauauuagcuucuagccucuugaagaaugauauuccuaugacugguccauuaguagcaggaggauuacugaccguauguuacguacucacaggacggagugcugaucuggaguuggagagggcgacggauguuaagugggaagaccaagccgaaauuucggguucaagcccuauauuaaguauaacgauaagcgaagauggcaguaugaguauuaagaacgaagaagaagaacaaacgcugacuauauuaauaagaacgggauugcuaguaauaaguggcuuauuuccaauauccauaccaauaacggccgccgccugguacuugugggaaguaaagaaacaaagagccgguguguuaugggauguaccuucaccaccgccaaugggcaaggccgaauuagaggacggugccuauagaauaaaacagaaagggauucuaggacauucacaaauuggugcaggagucuauaaagaaggaacuuuccauacaauguggcacguuaccaggggcgcugugcuaaugcauaaagggaagagaauagagccaaguugggcagacgucaagaaagauuuaaucucauauggcggaggguggaaacuagaaggagaauggaaagaaggagaagagguucaaguauuggcacuugagccgggcaaaaaccccagagcgguacaaacgaagccaggacuauuuaaaacgaacaccggcacaauaggagcugugagcuuagacuucucuccaggaacaaguggguccccaauuaucgacaagaaaggaaaagucgugggauuguauggaaauggaguaguaacacguaguggagcauacguaagcgcaaucgcccaaacagagaaaaacauugaggacaacccagaaaucgaagaugacauuuuuagaaaaagacgccuaacuauaauggauuuacacccgggagcaggaaaaacuaaaagguauuugccugcaauaguaagggaagcuauuaaaagagguuuacgcacuuuaauuuuagcgccuacaagaguaguagcugcagagauggaagaggcauugcggggacuaccuauaagauaucaaacaccagccauuagggcagaacauacaggacgggaaauaguugaucucaugugucacgcgaccuuuacaaugagauuacugagccccguaagaguaccaaauuacaaucuaauuauaauggacgaagcucacuuuacggaccccgcuucuauagcggcuagagguuauauuucaacgcgagucgaaaugggugaggcggccggaauauucaugacugccacuccacccgggagucgggauccguuuccacaauccaacgcacccauaauagaugaggaacgggaaauuccagagcgauccuggaacucaggacacgaauggguaacagauuucaaaggcaaaaccgucugguucguaccaagcauaaaagccgguaaugauauagccgcaugccuaaggaaaaaugguaagaaaguaauacaauugucacggaaaacauuugacucagaauauguuaaaacacgaacaaaugauugggauuucgucguaacaacagacauauccgaaaugggagcaaauuucaaagcagagagagucaucgacccuagaaggugcaugaaaccugugauuuugaccgauggagaggaaagagucauacuagcgggacccaugccaguuacgcauucaucggcagcucagcgcagaggucgaaucggucgaaacccaaagaacgaaaacgaucaguacauauauaugggugagccuuuagaaaaugaugaagauugcgcacacuggaaagaagcaaaaaugcuguuagauaacaucaauacuccagaagggauaauacccaguauguuugaaccggagagagaaaaggucgaugcaauagauggugaguauagguugagaggagaagcacggaaaaccuuuguagaucugaugagacgaggcgauuugccaguuuggcucgcauauaagguagcagcugaagguauaaacuaugcggauagacgguggugcuucgauggcaucaaaaauaaccagauccucgaagaaaacguugaaguagagauauggacaaaagagggagaaagaaagaaacucaaacccaggugguuagaugcacggauauacucugauccccuugccuuaaaagaauuuaaagaguucgcugcaggaaggaaaagccuaacucuaaacuugauuacugaaauggggcgcuuaccuacguuuaugacucagaagacucgagacgcauuagauaaucuugcaguauuacauacugcagaagcaggaggcagagcauacaaccaugcguuaagugaauuaccggaaacauuggaaacgcuucuucuauugacccuacuagcuaccguaacaggaggcaucuucuuauucuuaaugucagguagaggaauuggaaagaugaccuuaggaauguguugcauaauuacagccagcauauuacuaugguaugcacaaauccaaccgcauuggaucgcagcaucaaucauuuuagaauuuuuccuaauuguacuguuaaucccagagcccgaaaaacaacgcacaccucaagauaaccaacucacuuacgucguuauagcgauauuaaccguuguggccgcaacaauggcgaaugagaugggauuucuugagaaaacgaagaaagacuuaggacuuggaucuauugcaacacagcaaccugaauccaauauauuagauauagauuugagaccggccagcgcguggaccuuauaugcgguggcaaccacauuuguaacaccaaugcugagacauagcaucgaaaacucaaguguuaaugugucccuuacugcuauugcaaaucaagcuacgguauuaaugggucuaggcaaaggauggccccuaagcaagauggacauuggaguaccucuucuugccauaggguguuauagccaaguaaauccgauaacuuuaacugcugcguugcuacugcuuguagcucacuaugcuauaauagggccagguuugcaagcuaaagcgacgcgugaagcucagaaaagagcggcugcgggcauaaugaaaaauccaacaguugacgggauaacgguaauugauuuggaucccaucccauaugauccaaaauuugaaaagcagcuaggccaaguaauguuacuaauucuaugcgugacucaagugcuaaugaugcguacuacgugggcauuaugugaggcauuaacgcuggcuacaggaccgauuucaacucuaugggaaggcaauccggggagguuuuggaauaccaccauagcggugagcauggcgaauauauuuaggggaaguuaucuagcgggagcuggauuauuauucucgauaaugaaaaauacaaccaauacacgucguggaaccggaaacauaggcgaaacacuaggagaaaaauggaaaucuagauuaaaugcacuaggcaagucugaauuucaaauuuauaagaaaagugguauacaagaaguggacagaacacuagcuaaagaagggauaaaaagaggggaaacagaucaucaugcggugucccggggauccgcgaagcuaagaugguuugucgagcgaaacauggucacaccagaagguaagguuguagaccucgggugcggaaggggagguuggagcuacuauuguggaggacuuaagaauguaagggagguuaaggggcugacaaaagggggaccaggccaugaagaaccuauaccaaugagcacauacgguuggaauuugguccggcuacaaucaggcguagauguuuucuuuauaccuccugaaaaaugcgauacacuauugugugauauuggggagucaucaccaaauccaacgguggaagcagggaggacguugcgcguguugaacuuaguagagaacuggcucaauaacaauacccaguuuuguauuaaaguuuuaaauccguauaugccuaguguuauagagaaaauggaggcgcugcaaagaaaauauggaggugcacugguuagaaauccucuaagucgcaauaguacacaugagauguacugggucaguaacgcgagugguaauaucguaucaucagugaauaugaucucuagaaugcuuauaaacagauucacaaugagacauaagaaagcaacauaugagccggauguugaucugggaucagggacuagaaauauaggcauugaauccgaaaagcccaaucuugauauaauugguaaaaggauugagaaaauaaaacaggaacacgaaaccagcuggcacuaugaccaagaucaucccuacaaaacaugggcauaccaugguucauaugaaacuaagcaaacgggcagugcaucaaguaugguuaaugguguuguaagacuccuaacaaaaccaugggauguacugccaacuguuacacaaauggcgaugaccgauacgacgcccuucggccaacaacguguauuuaaagaaaaaguagauacacgaacucaagaaccuaaagaaggcacaaagaaacucaugaaaauuacagcagaauggcuguggaaggagcuaggaaagaagaaaacgccaaggauguguacaagagaagaguucacaagaaagguucgaucaaacgcugcgcugggcgcuauauucacugaugagaacaaguggaaaagugcacgugaagcgguugaagacucacgauuuugggaauugguggauaaagaaagaaauuuacaucuugaggguaaaugcgaaacuuguguguauaauaugaugggcaaacgugagaagaaauuaggagaguucggaaaagcaaaggguucacgcgcaauuugguauaugugguuaggugcaagauuucuugaauuugaagccuuaggauucuuaaacgaagaucacugguuuucucgcgaaaacucguuaagugggguagaaggugaaggauuacacaaguuaggauauauacuucgugacgucucgaagaaagaaggaggggccauguaugcagacgacaccgcaggaugggauacuaggaucacucucgaggauuuaaagaacgaggagaugguuaccaaccauauggagggagaacacaagaaauuggcugaagcuauauucaagcugacauaccaaaacaagguaguaagaguacaacguccuacgcccagaggcacgguaauggauauaauaucaaggagggaccagcgaggaagugggcaagucgguaccuacgggcuuaauacauuuacaaacauggaggcacaacuaauuagacaaauggaaggggaaggugucuuuaaaaauauucaacaccugacugugaccgaagaaguugcaguacauaauugguuggcacguguuggcagagaaagauuaagucgcauggccauaaguggugaugauugcgucguaaagccacuugaugauagauuugcgaaugcauuaacggcgcuuaacgauauggggaagaucagaaaggacauacaacaaugggagcccucuaagggauggaaugauuggacgcaaguaccauucuguucgcaucacuuucacgaacuaauaaugaaggauggucggguguuaguuguaccuugucgcaaucaagacgagcuaauaggcagagcacgaaucucucaaggagcuggguggagccuucgagaaacagccugccuaggcaagucauacgcacaaauguggagcuuaauguacuuucauagacgagauuuaagauuggcagccaaugccaucuguagugcaguaccaucucacuggguacccacgucgagaaccacauggucaauacaugccaaacacgaguggaugaccacugaagauauguuaacaguauggaaccgaguguggauuagagaaaauccauggauggaggacaaaacgccaguagaaucaugggaagaaauaccuuacuuggguaaaagggaggaccaauggugcgguucguuaauaggacucacuucuagagcaacuugggcgaaaaauauccaagcugcuauuaaucaaguucgaaguuuaauagguaaugaggaguauacagauuacaugccgucuaugaaacguuuucgccgggaggaagaggaagcuggaguucucugguaa

SEQ ID NO: 22754 - RNA, 9876 nt, Artificial Sequence
  derived and/or modified CDS sequence (opt6) from DENV-2__EU482676__SS-prME
ucggcaucuaugauaaucauguuaaucccuacaguuauggcuuuucaccuuacuacuagaaauggggaaccucacaugauaguuggaauacaggaaaaagguaaaucgcuuuuauuuaaaacagaagacgggguuaacauguguacacuuauggcgauggaccuaggagaacugugcgaagacacgauaacauauaaaugucccuuauuacgacaaaacgaaccugaagacauagacuguugguguaacaguacaaguacguggguaacauauggaacauguacaacuacuggagaacaccgacgcgagaaaagaagcguugcauugguuccucauguggguaugggauuggaaacaagaacagaaaccuggaugucaucagaaggagcauggaaacacgcacaaagaaucgaaacguggaucuuaagacauccugguuucacuauaauggcagcaauacuugcuuauacgauaggaacuacgcacuuucaaagaguacuaauauuuauacuacuaaccgcuguagcacccucuaugacaaugcgaugcauagguauaaguaauagagacuucguugaaggugucucuggagggaguuggguagauauuguucuagaacacgggucaugcgugacaaccauggccaaaaauaaaccuacacucgauuuugaacuuauaaaaacggaagcaaaacaaccggcaacacuaagaaaauauugcaucaaagcaaaauuaacgaacaccacaaccgaauccagaugucccacccaaggcgaacccucacuuaaagaagaacaggauaaaagauucguauguaaacauucaauggucgacagggguugggguaacggaugugggcuauuugguaaagggggcauagucacgugcgcaauguuuacauguaagaaaaauauggaaggccgaauaguucaaccagaaaauuuagaauauaccauuguagucacaccgcauaguggugaagaacaugcgguagguaaugacacaggaaaacauggcaaagaaaucaaaguuacuccccaaucaagcauuacagaagcagaauuaacuggauauggcacugucacuauggaaugcaguccacgcacgggccuagauuuuaaugaaaugguguuacuacagauggaaaauaaagcaugguuaguacauaggcaaugguucuuagacuuaccgcuaccuugguuaccgggugcagauaaacaggaguccaacuggauacaaaaagaaacguuaguaacguucaaaaacccacaugccaagaaacaagauguagucguuuuaggaucucaagaaggugccaugcauacagcucucaccggugccacagaaauacaaauguccuccgggaaucuacucuuuacugggcaucuaaaauguagacuaagaauggacaaauuacagcucaaaggaauguccuauucgauguguacuggcaaauuuaaagugguuaaagaaaucgcugagacacagcacgguacaauaguaauaagaguucaauaugaaggugacgggucuccauguaaaauaccauucgaaauuauggaucuagagaaaagauauguucuagguagauuaauuacgguuaauccaauagugacggaaaaagauucgccagucaauauugaagcagaacccccauucggggauaguuacauuauaauuggcgucgaaccuggacagcuaaaauuaaacugguuuaagaaaggaucuuccauaggccaaauguuugaaacaacaaugagaggcgcaaaacguauggcgauauuaggagauacagcuugggacuuuggaucgcuuggcgguguguucacgucuauaggaaaagcacuucaucaaguuuuuggcgcuaucuauggcgcagccuuuagcggaguuuccuggaccaugaaaauauuaauagggguaaucauaacuuggaucgggaugaacucccgcucgacuucucucucaguuucucuuguguuggugggaauaguaacucuauacuuagggguuauggugcaagcggacucagguugcguaguaaguuggaaaaauaaagagcugaaaugcggaagugguauauuuauaacugauaauguucacacuuggacugaacaauacaaauuucaaccugaaucuccaucgaaacuagcaucagcgauucaaaaagcacaagaagaagguaucugugguauacgaucuguaacuaggcuagaaaauuuaauguggaaacaaaucacacccgaacuuaaucauauauuagcugagaaugaaguaaaacucacgauuaugacaggagacauaaaaggaauuaugcaagcgggaaaaaggagccugagaccacaaccaacagagcuuaaauacucauggaaaacaugggguaaagccaaaauguuaucgacugaaaguuauaaccaaacauuucuaaucgauggaccggaaacagccgaaugcccaaauaccaauagagcguggaacucucucgaagucgaagacuauggauuuggaguauuuacaacaaacauuuggcugaaacucaaagaaaaacaagauguauuuugugauaguaaacugaugucagccgcaauaaaagauaauagagcuguacaugcggauaugggauauuggauugaaagugcuuuaaacgacaccuggaaaauagaaagggccucauucauagaaguuaaaaauugucacuggccaaaaucucacacacuauggucaaacgguguuuuagagagcgaaaugauaaucccgaaaaaucuagcugguccaguaucccagcauaacuaucguccaggauaccauacucagauugcagguccuuggcaucuagguaaacuagaaauggacuuugauuucugcgacgguacaacuguuauuguuacagaagacuguggaaacagagggccaucacuaagaacaacaaccgccucuggaaaacuaaucacagaaugguguugcagaucguguacacuuccgccuuugagauaucgcggugaagacggauguugguaugguauggaaauacgacccuugaaagagaaggaagagaacuuaguuaauucucuaguaacggccggucacggucaagucgauaauuucagcuugggcgugcugggaauggcgcuauucuuagaagaaauguugagaacaagaguagguacgaaacacgcaauuuuauuaguugcaguaucauucgucacccugauuaccggaaacaugucuuuuaaagaucucggacgaguugucguaaugguaggugcaaccauggcugacgacauagggaugggagugacuuaucuagcccuacuagcggcuuuuaaaguacgaccuacguucgcggcuggacucuuauugcgaaaguugacgucaaaggaguugaugaugacuaccauaggcaucguacuucuuagucagucgacaauccccgaaacgguacuugaacuuacugaugcccuggcacuugguaugaugguucuuaaaaucgugaggaacauggaaaaauaucaauuggcggucaccauaauggcuauuuuauguguuccuaacgcgguaauucuucagaacgcuuggaaaguaucauguacaauccuggcaguugugaguguaaguccacucuuacuaacgucaucacaacaaaagacggauuggauaccguuggcccuaaccauaaagggacuaaauccuacugcaauuuuccuaacuacucucagccguacuaacaaaaagaggucauggccucucaaugaagcaauaauggccguaggaaugguuucuaucuuagcuucauccuuacuaaagaaugauauaccaaugacgggaccuuuaguugcugguggcuuacuaaccguaugcuauguccucacuggcagaucugcagacuuagaacuggaaagggcaacagauguaaaaugggaagaucaagcagaaauauccgggucuuccccuauacuuaguauaacaauaagugaagacggaucuaugucuauuaaaaacgaggaagaagaacaaacuuuaacaauccuaauaaggacaggucuuuuaguaauuagcgguuuauuuccaauaagcauuccaaucacggcagcagcaugguaucuuugggaggugaagaaacaaagagcaggaguauuaugggauguaccuucgccuccacccauggguaaagccgaauuagaagacggagcauacaggauaaagcagaaaggaauacuaggguauucgcaaauuggugcuggaguauacaaagaaggaacauuucauacgauguggcacguaacacggggagcaguucugaugcacaagggaaagcgcaucgaaccaucaugggcagaugucaagaaagauuugauuucguacggcggcggguggaaacuagaaggggaauggaaggaaggcgaagagguucaaguguuggcucuagaaccgggcaaaaauccaagagcgguccaaacuaagccuggccuauuuaagacgaacacuggaacaauaggugccguaucuuuggauuuuucaccgggaacguccggaaguccaauuaucgacaagaaagggaaagucgugggauuauacgguaauggaguaguaacgagaucaggggcuuauguuuccgcgauagcccaaaccgagaaaagcauugaggacaaucccgagauugaagacgauauuuuuagaaaacgacgacuuaccaucauggauuugcauccuggagcggggaagacgaagagauaucuacccgcuauaguacgagaagcuauuaaaaggggccuucguacacuuauuuuagcccccacaagggugguugccgcagaaauggaagaagccuuacguggauuaccaauccgauaucaaacuccggcuauucgagcagaacauacggggcgagaaaucguagauuuaaugugucacgccacuuuuacaaugcgguuacuaagcccaguaagaguaccaaauuacaaccuaauaauaauggaugaggcccauuucacggacccggccagcauugcagcacguggcuacauuagcacaagaguugaaaugggagaagcggcuggcauauucaugacagcaacaccacccggcaguagggauccauucccacaauccaacgcgcccauuauugaugaagagagagaaauaccugagcggucguggaacuccggucacgaauggguuacagauuucaaggguaaaacuguaugguuuguuccuagcauaaaagcuggcaaugauauagcggccugccuaagaaagaacggcaagaaaguaauucaguuaagccgaaagacguucgacagugaauaugugaaaacaagaacaaacgacugggauuucgucguaacgaccgacauuagugagaugggagcuaauuuuaaagcggaacgaguuauugacccaagacgaugcaugaagccuguuaucuuaacugacggagaagaacgaguaauuuuagccggccccaugccagugacccacucuagugcagcacaaagaagagguagaauuggacgaaaccccaaaaacgaaaacgaucaguacauauauaugggggagccucucgaaaacgacgaagauugcgcacacuggaaagaagcgaagaugcuuuuagauaacauuaauacaccagagggaauaauccccagcauguucgaaccagaaagagagaaaguagaugcaauugacggagaauaccgauuaagaggggaagccagaaaaacauuuguagaucugaugcgucgcggagaucuuccugucuggcuagcuuauaaagucgcagcagaggguauaaauuaugccgacaggagaugguguuuugacgguauuaagaauaaucaaauuuuagaagaaaacguugagguugaaauauggacuaaagaaggagagaggaagaaacuuaaaccucgauggcucgaugcaaggauauacucagacccgcucgccuugaaagaguucaaggaauuugcugcagguaggaaaucgcuaacucugaaucugauuacagagaugggacgacuaccgacauucaugacacaaaagacacgggaugcauuagauaauuuagcaguauuacacacagcagaagcaggagguagagcauauaaccaugcacuaagugaauugccagagacccuagagacacuauuauuauuaacucuguuagcaacuguaaccggugguauuuuccucuucuuaaugaguggcagaggcauagggaaaaugacguuagggaugugcuguauaaucacugccucgauauuauuaugguacgcacaaauccagccgcauuggaucgccgcaaguauuauuuuggaauuuuuccugauugucuuguugauaccagaaccagaaaaacaaagaaccccgcaggauaaucaacuaaccuauguagugauugccauuuugacgguaguagcagccacaauggcuaaugagaugggauuuuuggagaaaacaaagaaagacuuuggauuagguuccauugcuacgcagcaacccgaaaguaauaucuuggauauugaccuacguccggcgagugcuuggacccuauaugcgguagcgacuaccuucguaacaccgauguuacgacauucuauagaaaauucaagugugaacguaucauuaacagccauugcuaaucaagcaacagucuugaugggacuaggaaaaggauggccguuaucaaaaauggauauuggugugcccuuauuggcuauuggcugcuauagccaagugaacccuaucaccuuaacggcugcauuguugcuccuugucgcucauuacgcuauaauuggcccaggucuccaagcaaaagcgacacgggaagcacaaaagagagcugcggccggaauaaugaagaauccuacaguagauggcaucacuguaauagauuuagaccccauaccauaugacccaaaguucgaaaaacaauuaggccaaguaaugcugcuaauuuuauguguaacgcaagugcuuaugaugcguacuacaugggcccuaugugaagcgcuaacucucgcgacaggaccaauauccacuuuaugggaagguaaucccggaagauuuuggaauaccacuauagcuguaucaauggcaaauauuuuucguggaucauauuuggcaggcgcaggucucuuauuuaguauuaugaaaaauacuacaaacacccgacgcgguaccggaaacaucggagaaaccuuaggagaaaaauggaaaucaagacuuaacgcacucggaaaaucagaguuccagauauacaagaaaucgggcauacaagaaguagaccguacauuagccaaagaagggauaaaacguggggaaacugaucaucaugcagugaguagaggaagcgcaaaacugagaugguuuguagaaaggaacaugguaacccccgagggcaaagucguugacuuaggcuguggucguggagguuggaguuacuacugcgguggacugagaaacguuagagaagucaaaggucuaacaaagggagggccaggucacgaagaaccuauaccaaugagcacauauggauggaauuuaguuagauuacaaagcgguguugauguauucuuuauaccuccugaaaaaugugauaccuuacuuugugauaucggagaaucaagcccuaauccaacaguugaggcuggacgcaccuuaagaguacuaaaccugguugaaaacugguuaaauaacaacacacaauuuugcauuaaaguauuaaacccauacaugccuagugugauagagaaaauggaggcuuugcaacgcaaauauggaggggcgcuuguuagaaauccguuaagcagaaacaguacucacgaaauguauugggugucgaacgcgucugguaauauaguaucaagugugaacaugaucucuagaaugcuaauaaaucgcuucacaaugcgccauaagaaagcuacauacgaaccagauguggaucuagggucgggcacacguaauauugguaucgaaucagaaauaccaaaucuugauauaauagggaagaggaucgagaaaauaaagcaagaacaugaaacgaguuggcauuaugaccaagaucauccauacaaaacgugggcguaccacgguaguuacgaaacuaaacaaacagggucugcuaguucaauggucaaugggguaguacgucuacucacuaaaccgugggacguauuaccaacaguaacucaaauggcaaugacggacacgacucccuucggccagcaaagagucuucaaagagaaaguugauacaagaacccaagaaccaaaggaagggacuaagaaauugaugaaaauaacugcagaguggcucuggaaagaauuaggcaagaagaaaacaccaagaaugugcacucgugaagaguucacuagaaaagugagaagcaaugccgcuuuaggggcuauauuuaccgacgagaacaaauggaaauccgcacgcgaagcuguggaagacucaagguuuugggagcucguggauaaagaaagaaauuuacacuuagaagguaaaugugaaacaugugucuauaacaugaugggcaaaagagagaagaaauugggggaguucggcaaagcuaaaggaagucgugcgauuugguacaugugguuaggugcucgauucuuagaauuugaagcauuaggguuccucaaugaggaucacugguucagcagagaaaauucguuaucggguguggaaggggagggucuucauaaacuaggauacaucuuaagggacguauccaagaaagaaggaggugcaauguacgcggacgacacggcgggaugggauaccagaaucacguuggaagacuugaaaaaugaggaaauggucacaaaccauauggaaggggaacacaagaaauuagcagaagcgaucuuuaaauuaacauaucagaacaaagucguaaggguacaacggcccacaccgcgaggaacgguaauggauauaauuaguaggagggaucaacgagggucaggacaaguugguaccuauggcuuaaacacauuuacaaacauggaagcacaacuuaucagacagauggagggggaaggcguguucaaaaauauucaacaucucacgguaacagaagaaguugcagugcaaaauuggcuagccagaguaggacgugagcgacuuaguaggauggcaauauccggagaugauuguguaguaaaaccauuagaugaucgguucgcaaacgcacuaacugcccugaaugauauggggaaaauaagaaaagacauacagcaaugggaaccuagcaaagguuggaacgauuggacacaaguaccuuuuugcagucaucauuuucaugagcugauaaugaaagauggaagaguacugguuguacccugucgaaaccaagaugaauugauagguagagcacgaauaucgcaaggggcuggauggucauugagagaaacagcuuguuuagguaagagcuacgcgcaaauguggucauuaauguacuuccauagacgagaccuacgacuagcggcaaaugccauuuguucggccgucccaucucauuggguaccaacaucacgaacaacauggaguauucacgcuaaacacgaguggaugacgaccgaggacaugcuugcuguuuggaacaggguauggauccgugaaaaucccuggauggaggacaaaacgcccguugaaucgugggaagaaauaccguaucuaggcaaaagagaagaucaauggugcggaagucuuauaggauuaacaaguagagccacuugggcaaagaauauucaagcagcuaucaaucaaguaagaucuuugauagggaacgaagaauauacggacuacaugccuaguaugaaacgauuucgcagagaggaagaggaagccggaguuuuaugguga

SEQ ID NO: 22755 - RNA, 9876 nt, Artificial Sequence
  derived and/or modified CDS sequence (opt6) from DENV-2__EU482677__SS-prME
ucggcuggaaugauaauaaugcuaauaccaacaguaauggcauuucauuuaacaacaagaaauggugaaccucauaugauaguugguauucaggaaaaagguaaaucucuucuuuuuaaaacagaagacgggguaaacaugugcacacuaauggcaauggauuuaggagaacuuugugaagauacuauuacauacaaaugcccgcuacuacgucaaaaugaaccagaagacauagauuguugguguaauucuacgucgacauggguuacauauggcacuugcacaacgacaggggaacaucguagagaaaaacgcaguguagcacucgucccacauguugguauggguuuagaaacuaggaccgaaacguggaugucaucugaaggagcauggaaacaugcccaaagaauagagaccuggauacuaagacacccagguuucacaauuauggcugcgauucuugcauacacuaucggaacuacacauuuucaaagggucuuaauauuuauauuacuaacugcugucgcaccuagcaugacuaugcgcuguauugggauuaguaauagagauuuuguagaaggaguaucaggcggguccuggguugauaucguacuggaacacggcucuuguguuacuacgauggcuaaaaauaaaccuacuuuagauuuugaacucauuaaaacagaggcaaaacaacccgcuacauuaagaaaauacugcauagaagcuaaacugacaaacacaaccacagaaucaagaugucccacacagggggaaccaagccuaaaagaagaacaagauaaacgauuugucuguaaacacaguaugguagaccgaggauggggaaaugguugcggucuauucggaaaaggcgguauuguuacgugugcuauguucacauguaagaaaaauauggagggcaaaauaguacaaccugaaaauuuagaauauacaauagugguaacgccucauaguggcgaagaacaugcuguuggaaaugacacaggaaaacacggaaaagaaaucaaaguaacaccacagucaaguauuacagaagcggaauuaacuggauacggcacggucacuauggaauguagucccagaacgggacuagacuuuaaugaaauggugcugcuacaaauggagaauaaagcgugguuagugcauagacagugguucuuagaucugccguuaccuugguuaccuggcgccgacaaacaagagaguaacuggauucaaaaagagacccuaguaacuuuuaaaaauccccaugccaagaaacaagaugucgugguauuaggaucucaagaaggugcaaugcauacagcauuaacaggugcgacagaaauacagaugaguuccggcaauuuacucuuuacugggcaucugaaaugucgcuuacggauggauaaauugcaauuaaaaggcauguccuauucgauguguacuggaaaguucaaaguaguaaaggagauagcagaaacgcaacauggcacuauuguuauccgaguucaguacgaaggagacggaucaccuuguaagauuccuuuugaaaucauggauuuagagaaaagauauguccugggcagacuuauuacaguaaacccaauugucacugaaaaagauuccccugugaacauagaggcggagccaccuuucggcgauucguauauuauuauaggcguggaaccaggccaacuaaaauugaacugguuuaagaaagguagcucaaucggccagauguuugaaacaacaaugagaggagccaagcgcauggccauacucggugauacagccugggauuuuggcaguuuggguggaguauuuacuucaaucgguaaagcacuacaccaagucuuuggggcgaucuacggcgcggccuuuagcggugucucuuggaccaugaaaauucuuauuggagugauuauuacguggaucggcaugaauagucgaucgacaagucuuucaguaagccuuguauuagucggcauaguaaccuuauauuuaggcguaaugguacaagcagacucaggauguguuguauccuggaaaaauaaggaauuaaaaugcggcagcggcauuuuuguaacugauaacguccauacauggacagaacaauacaaauuccaaccugagaguccaucaaaguuggcuagcgcgauacaaaaagcucaagaagagggcaucugcgguauacguagugucacacguuuagaaaacuuaauguggaagcaaauuaccccagaguugaaccacauacuagcugagaacgaaguaaaacuaacuauaaugacaggagacaucaagggaaucaugcaagcagguaagcggucccuaagaccacaaccuacagaauuaaaauacuccuggaagacuuggggcaaggcaaaaaugcucucuacagaaaguuauaaucaaaccuuuuugauugauggcccugaaacagcagaauguccgaauacuaaccgugcauggaacucacuagaaguagaagauuauggguuuggaguauuuaccacaaauauauggcucaaacugaaagaaaaacaagaugcguucugcgacucgaaauuaaugagugcggcuauaaaagauaaucgagcggugcacgcagacaugggauacuggauagaaagugcacucaacgacacguggaaaauagaaaaagcguccuucaucgaagucaaaaauugucauuggccuaaaucacauacguuguggucgaauggaguucuggaaagcgagaugauuauacccaaaaaucuagcgggccccgugucacagcauaauuauagaccuggauaucauacacaaauagcggggccuuggcaccuggguaaacuggaaauggauuucgacuuuugugacgguacaacuguuaucguaacagaagauuguggcaauagggggcccucgcuucgaacaacaacagcgucagggaaacucauaacugaauggugcuguagaucguguacccuaccaccucuccgauaucgaggagaggauggcugcugguaugggauggaaauacguccauuaaaggaaaaagaagaaaaucuugugaauaguuuaguaacagccggccaugggcaaguggauaacuucagucuugggguauuagguauggccuuauuuuuggaagaaaugcuacgaacaaggguugguacaaaacaugcaauacucuugguggcaguuagcuuugucacucuaauuaccggaaacaugagcuucaaagaccuagguagggucgugguuaugguaggagcaacaauggcugaugacauagggauggguguuacguaucuugcacuucuggcagcauucaaaguacgaccaacauuugcagcgggauugcuacuucguaaauugacguccaaagaauuaaugaugacuacuauaggaauuguauuacucagucaaaguacaauaccagaaacugucuuagaacugacagaugcgcuugcauugggaaugaugguauuaaaaauagucagaaauauggagaaauaccaacuagcugucacaaucauggcuauucuaugcguaccuaaugcgguuauucuacagaacgcguggaaaguaucguguacuauauuagcagucgugucaguaucaccacuccuauugacaaguucacaacagaaaacugauuggauuccauuagcccugacaauaaaaggauuaaacccaaccgccauauuucuaacgacauuaucgcguacgaacaagaaacgguccuggccucuaaacgaggcgaucauggcagucggaauggugucuauucuugcaucaucccuccucaaaaacgacauaccaaugacagggccacucguggcaggaggauuacucaccguaugcuauguacucaccggacguucugcagaucuugagcucgaacgcgcaacagaugugaaaugggaagaucaagcggagaucucaggaaguucaccgauuuuauccauaacaauaucagaagauggaaguaugucaaucaaaaaugaagaagaagaacagacccuaacgauccuuauacgaaccggguuacuggucauaucaggccuuuuucccauuucuauaccaauuacggcugcagcuugguaucuaugggaagucaagaaacaaagagcaggaguacucugggauguuccaucaccaccacccaugggcaaagcagaauuagaagauggugcuuaccguauuaaacagaaggggauauuaggauauucacaaauuggagcgggaguuuauaaggaaggaacuuuucauacaauguggcaugugacuagaggagcuguuuuaaugcacaaaggcaaaagaaucgagcccaguugggcggacgucaagaaagacuuaauuaguuacggagguggguggaaacuggaaggcgaauggaaagaaggggaagaaguacagguauuagcacuagagccuggcaaaaauccgcgagcaguccaaacaaagcccgggcuguucaaaaccucaacuggaacaauuggggcgguaucacuugacuuuucuccaggaacaaguggauccccuauaauagacaagaaagguaagguugugggauuauaugguaacggaguagucaccagaucaggugcuuauguuucugcaauagcacagaccgaaaagagcauagaagauaauccagaaauagaagacgacaucuuucgcaaacggcguuuaacaauaauggauuuacauccuggcgcaggaaaaacuaagcguuacuuaccugcaaucguacgagaagcaaucaaacgcggauugcgaacauugauauuggcuccgacuagagugguagcugccgagauggaggaagcacuaaggggauugcccaucagauaucaaacuccggcuauuagggcugaacauaccggacgugaaaucguagaucucaugugucacgcuacauuuacaaugagacuauuaucucccguacgcguaccuaauuacaacuuaauaauaauggacgaagcccauuuuacagaccccgccucaauugccgcgagagguuauaucagcacccgugucgaaaugggugaagcagcuggaauauuuaugacggcuacuccaccaggaucccgagacccauucccacagucuaacgcaccaaucauagaugaagaaagggagauaccggaaagaaguuggaacucgggccaugagugggugacugauuuuaaaggcaagaccguuugguuuguuccaucaaucaaagcaggaaaugauauagccgcuugucuuaggaagaaugggaagaaagucauacaacuuucacgaaagacauuugacuccgaauaugucaaaaccaaaacaaaugauugggacuuuguagucacaacggacauaagcgaaaugggagccaauuucaaagcagaaagagucauugauccacgcagauguaugaaaccagugauacuuacggauggggaagaaaggguaauucuagcagguccuaugcccguaacacacagcucggcagcucagcggcggggcaggauagguagaaaccccaaaaaugaaaacgaccaauacauuuacaugggugaaccuuuggagaaugacgaagauugugcgcauuggaaagaagcuaaaaugcuguuagauaacauuaacacucccgaagguauuaucccaucaauguucgaaccggaacgagaaaaggucgacgcuauagacggagaauauagauugcggggcgaagcaaggaaaacauucguggaccuuaugcguaggggcgauuuaccaguuugguuggcauauaagguagcagcagaagggauuaauuaugcugauagacggugguguuucgacgguauaaagaauaaucagauucuugaggaaaacguugaaguugaaaucuggacuaaagaaggagagcgaaagaaacuuaaaccacguuggcuggaugcccgaauauauucugauccacuagcauuaaaagaauuuaaagaguucgcagcugguagaaaaagucuaacuuuaaaucuuauuacggaaaugggucgauugccgacuuuuaugacacagaaagcuagggaugcauuggauaaucuugcaguuuugcauaccgcggaggcaggagguagggcauacaaccacgcauuaagugaacuuccugagacacucgagacacucuuauugcugacuuuauuggcuacaguuacuggagguauuuuucuauuuuuaaugaguggaagggggauagggaaaaugacacucgguauguguugcauaauuaccgccucaauacuuuugugguacgcacaaauacaaccucauuggaucgccgcaucuaucauccucgaguuuuuccucaucguccuacucauuccagaaccggaaaaacaacggacgccgcaggacaaucagcuaacauaugucguuauagcaauacuaacuguaguugcggcgacuauggcgaacgaaaugggcuuuuuggaaaagacuaaaaaggauuugggauuaggcagcauagcgacacaacaaccagaaagcaacauucuggauauagaccugaggccggcgagugcauggacccucuaugcggucgcuacaacuuucguuacucccaugcuaagacauucuauagagaacaguucagugaauguauccuugacagcuaucgccaaccaagcaacuguucuuaugggucugggaaaaggcuggccacuuucuaaaauggauaucggaguuccucuauuagccaucggauguuauagucagguuaaucccauuacauugaccgcagcauuacuacuuuuaguugcccauuaugcaauuauaggcccuggucuucaagcaaaggcuacaagggaagcucagaaaagagcagcagccggaaucaugaaaaaucccacagucgauggaauaacuguuaucgaccuugauccuaucccguacgacccaaaguuugaaaagcaacuaggucaggucaugcuauuaauccuaugcgucacucaaguccuaaugaugagaacaacaugggcacuaugugaggcuuuaacccuagcaacaggcccuauaaguacucuuugggaaggaaacccaggaagauucuggaauacgaccauugcagucagcauggcaaacauuuuccgugguagcuauuuagcuggagcgggacuucuauuuucaauaaugaagaacacuacaaauacuagacgugguacgggaaauauaggcgaaacacuuggagaaaaauggaagagucgacucaacgcacuaggaaaaagugaauuucaaacuuacaagaaaucuggaauccaggaagucgacagaacauuagcuaaggaaggaauuaaacgaggcgaaacugaucaucaugcaguuagcagagggucugcaaaauuacggugguuuguagaacgaaacaugguaacaccugaaggaaaggugguagacuuaggcugcggaagaggaggguggaguuauuauugcggaggguuaaagaacguacgagaaguuaaggguuuaaccaaaggaggccccggacaugaagaaccaauaccgaugagcacauaugguuggaaucuuguccgacuacaaucggguguagacguauucuucauaccuccagaaaaaugcgauacacuauugugugauaucggagaaagcaguccaaaucccacaguugaagccggccgaacucuuaggguauuaaaccugguugaaaauugguuaaauaacaauacacaauuuugcaucaaaguauugaacccauacaugccuuccguuauugagaaaauggaggcacugcaaagaaaauacggcggagcgcucguccguaauccuuuaaguagaaacuccacccaugaaauguacuggguaucuaaugcuucaggaaacauaguaagcucagucaauaugauaagcagaaugcuaaucaauagauuuacuaugcgacacaagaaagcgacauaugagccagauguagaucuggguucaggaacgagaaacauagggaacgaauccgaaauaccaaaucuagauauaauugggaaaaggaucgagaaaauaaaacaggaacaugaaacgaguuggcauuaugaccaagaucauccguacaaaaccugggcuuaucauggaucauaugaaacuaaacaaaccgguucggcaucuagcaugguaaaugggguugucaggcuacuuacuaaaccaugggaugugcuaccgacgguaacacagauggcaaugacagauacuacaccauuuggucaacaaaggguauucaaagagaaaguggauacacgaacacaggagccgaaggaagggacaaagaaauuaaugaaaauaaccgcugaaugguuauggaaagaacucggcaagaagaaaaccccaagaauguguacaagagaagaauuuacacgaaaagugaggagcaacgcagcacuaggagccaucuuuaccgaugaaaacaaguggaaaagcgccagagaagcgguggaagauucgagauuuugggagcuuguagauaaagaacgaaacuuacaucuugaaggaaaaugcgaaacuugcguauacaauaugauggguaaacgugaaaagaagcugggcgaauuuggaaaagcaaagggaucuagagcaauaugguauauguggcucggggcuagauuuuuagaguucgaggcucuuggauucuuaaacgaggaccacugguuuagccgcgaaaauucauuaucuggugucgaaggagaaggucuccauaaguuggguuauauauuaagagaugucuccaagaaagaaggaggggcuauguacgccgaugacacagccggaugggauacaaggauaacauuggaggaccucaaaaaugaggagaugguaacaaaucacauggagggggaacauaagaaauuggcagaagcaauauucaaacuaacauaccagaauaaaguuguaagaguccaacggccuacaccaagggguaccguaauggacauaauuaguaggagagaccaaaggggcagcggccaaguaggaacuuacgggcuaaauaccuuuacgaauauggaggcacaauugauaagacaaauggaaggggaaggaguauucaaaaacauucaacaccuaaccguuacagaagagguagcugugcagaauuggcucgcuagagucggaagggaaagguuaucacgaauggccauuucgggcgaugauuguguaguaaaaccauuggacgacagauuugccaacgcauuaacagccuugaaugacaugggaaagauaagaaaagauauacagcaaugggaaccuuccaaaggauggaaugauuggacacaaguaccauucugcucccaccacuuucaugaacuuauaaugaaagacggccgaguauuagucgucccuugucgaaaucaagaugaguuaauaggaagggcaaggaucagccaaggggcuggauggagccuaagagaaacugcaugucuaggaaagucauacgcacaaauguggucucuuauguacuuucaccgcagagacuugagguuagcagcgaaugcaaucuguuccgccguuccaucccauuggguaccaacaagucguacaaccuggucaauccaugcuaaacacgaauggaugacaaccgaagacauguuaacaguuuggaacaggguauggauacgagaaaauccuuggauggaagauaaaacacccguagaaucuugggaagaaauacccuauuuaggaaaaagagaagaucaguggugcggaucauuaaucggccuuacaucaagagcaacgugggcuaaaaacauacagguugccauaaaccaaguaagaucuuugauaggcaacgaggaauacaccgacuacaugcccucuaugaaaagauuucgucgagaagaggaagaagccggcguacuaugguag

SEQ ID NO: 22756 - RNA, 9876 nt, Artificial Sequence
  derived and/or modified CDS sequence (opt6) from DENV-2__EU482678__SS-prME
ucagcgggcaugauaauuaugcuaauuccaacgguaauggcauuucauuuaacuacaagaaacggggaaccacacaugauuguagguauccaagaaaaagguaaaagccuguuauucaaaacggaagauggagugaauauguguacuuugauggcaauggacuuaggagaacucugugaagacacaauuacauauaaauguccuuuauuaagacaaaacgaaccugaagacauugacugcugguguaauucaaccucaacuuggguaacuuacgguaccuguacuacuacuggagaacauagacgcgagaaaaggagcguagccuuaguuccgcacgugggaaugggguuggaaacgaggacagaaacguggaugucgucugaaggggcauggaaacacgcucaaaggauugaaacauggauauuacgacacccggguuucacaauaauggcugcuauauuggccuauacgauuggaacaacacacuuccaaaggguguuaauauuuauacuccuuacggcaguggcuccaaguaugacgaugagaugcauuggaauuagcaacagagauuucgucgaaggaguaucgggaggcaguuggguagauauaguacucgaacaugguucauguguaacaaccauggcuaaaaauaaaccuacacuugacuucgaacucauaaaaacagaagcuaaacaaccagcuacauuaaggaaauacugcauugaagcuaaacuuacaaauacgaccacagaaagucggugucccacacagggugaaccaagucuaaaagaagaacaagauaaaagauucgucugcaaacacucaaugguggaucguggcuggggaaauggauguggguuauuuggaaaaggaggcaucgucacaugcgcgauguuuacaugcaagaaaaauauggaagguaaaauuguucaaccggagaaucuggaauacacgauaguuguaacgccucauagcggagaagaacacgcaguugguaacgauacagguaaacauggaaaagaaaucaaaguaacaccacagucaucaauaacugaagcagaacuaacagguuauggcacgguuacaauggagugcucuccgcguacuggccuagauuucaacgaaaugguacuacuacaaauggagaauaaagcaugguugguacauagacaaugguucuuagacuuaccauugccauggcuaccuggugcugaugaacaagaaaguaauuggauacaaaaagaaacucuaguaacauuuaaaaauccacacgcaaagaaacaagacguagugguauuagguucgcaggaaggagcgaugcacacggcuuugacgggugcaaccgagauacaaaugagcucagggaaccucuuauuuacuggacauuuaaaauguagacuacgaauggacaaacuacagcucaaagggaugagcuauucaaugugcacugggaaauucaaaguaguaaaagaaauugcagaaacucaacauggcacaauuguuauaagaguucaauacgaaggggacggaagcccauguaaaauaccguuugaaauaauggaccuagagaaaagauacguauuagggcguuuaauaacaguuaaccccauaguuacagaaaaggacagccccgucaacauugaagcggaaccucccuuuggagacucauacauaaucaucggaguagagcccggucaauugaaacuaaacugguuuaagaaaggaucaucaauagggcaaauguuugaaacuacuaugcgaggcgcaaaacgcauggcuaucuuaggugauacagcgugggauuucgguagcuuggguggaguauuuacauccauuggcaaagcauuacaucaagucuuuggggcaauauacggcgcugcuuuuagcgguguaucuuggacaaugaaaauauuaaucggcgugauuauuacauggauugguaugaacucaagaaguaccucuuuaucaguuaguuugguccuagugggaauagucacuuuauaucuaggcgugaugguacaagcagauucaggcuguguuguuagcuggaaaaauaaggaauuaaagugugguucggguauuuuuauaacagauaauguacauacguggacggaacaguauaaguuucaaccagagagcccaaguaaauuggccagugccauccaaaaagcacaagaagaggguauuuguggaauaagaucuguaacaagguuagaaaauuugauguggaaacaaauaacgcccgaacugaaccacauauuagcagaaaacgaagucaaauuaacaauaaugacuggggauauaaaagguauuaugcaagcaggaaaacgaucauuaagaccacagccaacugaacuuaaauauagcuggaagacgugggggaaagcaaagaugcuuaguacugagaguuauaaucaaaccuucuuaauagauggaccggaaacaacagaaugcccaaacaccaauagagcauggaacucucuagaaguugaagacuauggauucggaguguucacgaccaauaucugguuaaaacuuaaggaaaaacaagaugccuucugugacuccaagcucaugucagcugccauaaaagauaaucgcgcuguacaugcugacaugggcuacuggauugaaucagccuugaacgauacuuggaagauugaaaaagccucauuuauagagguuaaaaacugccacuggccgaaaucccacacucuauggaguaauggaguuuuagagagugaaaugauuaucccgaaaaaucuagccggcccugugucucaacacaauuauagaccggguuaccacacacaaauagcaggcccauggcauuugggaaaguuagaaauggauuuugauuuuugugaugguacaaccguuauaguaaccgaggauugcggaaauagaggaccaaguuugagaacaacaacugcaucaggaaaguuaauuacugaaugguguugcagaucaugcacacuucccccucugcguuaucguggagaggacgggugcugguauggaauggagauaagaccacuuaaagaaaaagaagaaaauuuaguaaauucguugguuacggcagggcauggccaaguugauaauuuuagccucgguguauuagguauggcccuauuuuuggaagaaaugcuccgaacaaggguuggaacuaaacacgcgauacuacucguagcgguaucauuuguaacacugauuacgggaaacaugagcuucaaagacuuggguagaguugugguaaugguaggagcaaccauggcggacgacauaggaaugggugugacauauuuagcauuguuagcagcguucaaaguaagaccuacuuuugcagcggggcuccuguugaggaaauuaacaucaaaggaacuaaugaugaccacuauuggaauaguacugcuuagccaauccacaauacccgaaacuguucuggaauugacugaugcauuagcucuugggaugaugguuuugaaaaucgugagaaauauggaaaaauaucaacuugcuguuaccauuauggcgauuuuauguguuccaaaugcuguaaucuuacaaaacgcguggaaaguaagcuguacaauacuagcugucguaaguguuucccccuuacuacugacaaguucucaacagaaaacugauuggauaccauuagcacuagcaauaaaaggacuuaauccuacugcgauauuuuuaacuacacucaguagaacuaacaagaaaagaucauggcccuuaaaugaggcaauaauggcgguugggaugguaucaauauuagcuagcagcuuguuaaagaacgacaucccaaugacaggacccuuaguugcggguggauugcuaacuguauguuauguauuaacaggaagauccgcugacuuggagcuggaacgugccaccgacgugaaaugggaggaccaagccgaaaucucugggucaaguccuauacuaaguauuacuauaucagaagacgguucaaugaguauuaaaaaugaagaggaggagcaaacuuuaacaauucuuauacgcaccggacugcuuguuaucaguggucuuuucccaauaucaauaccuauaacagcagcagccugguauuuaugggaaguaaagaaacaaagagcagggguuuuaugggauguuccuucaccaccaccaauggguaaagcagaacuagaagauggugccuauagaauaaaacaaaaaggaauuuuaggauacucacagauaggggcaggaguuuauaaagaggggacuuuucauacuauguggcacguuacgcgaggugcuguguuaaugcacaaaggcaaaagaauagagccaucuugggccgacguuaaaaaggaccuuauauccuauggaggugguuggaaacuagaaggugaauggaaggaaggcgaggaaguccagguccuagcauuagagccggggaaaaauccaagagcgguucaaacaaagccaggucuguucaagacaaacacugggaccauuggagcagucucacucgauuucagccccggaacgucaggaucuccgauaauagacaagaaagggaagguaguuggacuauacggaaacggaguaguaacucgaaguggggcauauguaagugcuauugcgcagacagagaaaagcauagaagacaauccggaaauugaggaugacauuuucagaaaacggcgacuaaccaucauggaccuucauccaggggcaggaaaaaccaaaagauacuuaccagccauaguacgagaagcuauuaaacguggacuuagaacauuaaucuuagcaccgacucgaguuguagcagcugagauggaggaagcguuacgagguuugccuauacgauaccagaccccggcaauucgagcagaacacacuggacgagaaauuguagaucuaaugugccacgccacauuuacuaugagguuauuaagcccaguucguguaccaaauuauaacuuaauaaucauggacgaagcccauuucacugauccagcuucuauagcagcucguggauacauuaguacgaggguagaaaugggagaggcagcggguauuuucaugacagcaacuccuccuggaagccgugauccauuuccacaaaguaacgcaccaauuauagaugaagaaagagaaauuccugaacguaguuggaauacaggucaugaaugggugacugacuucaaagguaaaacgguuugguuuguucccucaaucaaagcuggaaacgacauagcggcuuguuugaggaaaaaugguaagaaaguaauacaacuaaguagaaagacuuuugauuccgaauauguuaagacacgcacuaacgauugggacuucgugguaacuacagauauaucugaaaugggggcaaauuuuaaagcagaacgcguuauagauccccgaaggugcaugaaaccugugauucuaaccgauggagaagaacguguuauauuagcaggaccaaugccugucacacacagcagugcagcacagcgucgaggcagaauaggacguaaccccaaaaaugagaacgaccaauauauuuacaugggcgagccacucgaaaacgacgaagauugcgcacauuggaaggaagccaaaauguuacuugacaauauaaauacuccagaggguauaaucccgucaauguuugagccugagcgugaaaaggucgaugcuauagacggagaauauagauuacguggugaagcgagaaaaacguuugucgaucuaaugcgaaggggagaucuuccgguauggcuugcauacaagguagcagcagaagguauaaacuaugccgacagacgaugguguuuugaugggaucaaaaauaaccagauauuagaagaaaauguggaaguugagaucuggacuaaagaaggagaaagaaagaaauuaaaaccuagaugguuggaugcucgaauauacucagauccgcucgcacuuaaagaauuuaaagaguucgcugccgguagaaagucuuuaacguuaaauuuaaucacugaaaugggaagguuacccacauuuaugacacagaaaacucgagaugcccuugauaaccucgcuguucuacauacggcagaggccgguggcagagccuacaaccaugcucuuucggaacuaccagaaaccuuagaaacacuauuauugcuaacauuacuugccacaguaaccggcggcauauucuuguuccuaaugucaggcagagguauagggaagaugacuuugggaauguguuguauaaucacagccaguauucuauuaugguaugcucaaauacaaccacauuggaucgcugcaagcauaauacuggaguucuuucuaauaguccuacuuauacccgagcccgaaaaacaacgaacaccacaagauaaucagcuaacguaugugguaauagcaauauuaacgguaguagcagcgaccauggcuaacgagaugggcuuccuagagaaaaccaagaaagaucuaggauuggguagcaucgcaacacaacaaccagaaucuaauaucuuagauauagauuuacgcccagcaucagcauggaccuuauaugcaguggccacgacguucguaacgccuauguugcgucacaguauugaaaauucgagcgucaacgugaguuuaacggcaauugcuaaucaggcaacaguacuaaugggauuaggaaagggguggccacucuccaaaauggacauaggcguucccuuauuagcgauugguuguuacagccaaguaaacccuauaacacuaacagcagcacuauugcugcugguugcucacuaugcuauuauuggaccaggcuugcaagcuaaagcuacacgcgaggcucagaaaagagccgcagccggaauuaugaagaauccuacggucgacggaauaacaguaauagacuuagaucccauaccguaugacccaaaguuugaaaaacaguuaggucagguaaugcuacuuauauugugugucacacaggucuuaaugaugcgaacgacgugggcacugugugaagcacuaaccuuggcgacuggaccaauauccacauugugggaaggaaacccuggacguuucuggaauacgacaauagcuguuagcauggcuaauauauuccggggcucauaucuagcgggugcaggauugcuguucucaauuaugaaaaauacaacgaauaccaggagaggcacaggaaauauaggagaaacucuaggagaaaaguggaaaaguaggcuaaaugcacuaggaaaaucggaauuucaaauauacaagaaaaguggcauucaagagguagauagaacuuuggcaaaagaaggaauaaaacggggagaaacugaucaccaugcaguaucucgagguucugcaaaacuaaggugguuuguagaacgaaacaugguaacacccgaaggaaaaguaguugacuugggcugcggcagagguggcugguccuauuacugcggaggcuugaaaaacguccgagaaguaaaagguuuaacuaagggagguccaggacaugaggaaccaaucccaaugucgacauacggauggaacuuaguacgauuacagagcgggguagauguauucuucauaccaccggaaaaaugugacacuuuauuaugugauaucggagaaaguucuccaaauccuacaguagaagcaggacggacacugcgaguauugaauuuaguagaaaacugguugaacaacaauacccaauuuuguauaaaaguucugaauccauauaugccaucuguaauugagaaaauggaggcuuugcaaagaaaauacgguggagcauuaguucgaaacccacuaucaagaaauucaacacaugaaauguauugggugucaaaugcauccggcaauauagucagcucaguaaauaugaucucacgaaugcuaaucaaccgcuucacaaugagacauaagaaagcgaccuacgaacccgacguugauuuaggaucgggaacacgaaacauaggaauugaaucggagaucccaaacuuagacaucauaggaaaacgcaucgagaaaaucaaacaagaacaugaaacaucguggcauuacgaucaagaccauccauauaaaacaugggcauaucauggcaguuaugaaacaaaacaaacugguagcgcaucuucaaugguuaauggaguaguucggcucuuaaccaagccgugggauguauugccaacggugacgcaaauggcuaugacggacacuacuccauuuggacaacaacguguauuuaaagaaaaagucgacaccagaacacaagagccgaaggaaggaacaaagaagcuaaugaagauaacugcugaguggcuauggaaagaacuugguaagaagaaaacaccacggauguguacucgcgaagaguuuacacgaaaaguccggucuaacgccgcgcucggugcgaucuuuacugaugaaaauaaauggaaaagugccagagaagcuguugaagacaguagauuuugggagcuuguggauaaagaaagaaaucuacaccuagaggggaaaugcgaaacuugugucuacaauaugauggguaaaagggagaagaaauugggcgaguucgguaaagcgaaagguucgagagcuaucugguacauguggcugggagcucgauuccuagaauuugaagcccugggauuuuuaaacgaagaucauugguuuagucgagagaacucauuaucgggaguagagggugagggacuucauaagcucgguuauauucuuagggauguaagcaagaaagaaggaggugccauguacgcagaugauacugcggguugggauacaaggaucacacuagaggaucuaaagaaugaagaaauggucacuaaucacaugaaaggugaacauaagaaauuagcagaagcgauauucaaacucacuuaucaaaauaaaguagucaggguccagcgacccaccccgcgugguacagucauggacauuaucagcaggagggaccaacgagggaguggacaggucgggacauacgguuuaaauaccuucacuaauauggaagcucaauugauucgccaaauggaaggcgaaggaguguuuaaaaacauacagcauuuaacuguuaccgaagaaguugcuguacaaaauuggcuggcacgaguugggagagaacguuugucgcggauggcaauuucaggugacgauugcguaguuaagccuuuagaugauagauuugcaaaugcccuaacugcguugaaugacaugggaaagauucgaaaagauauucaacagugggagccaagcaaagguuggaacgauuggacgcagguccccuucuguucucaucauuuucacgagcuaaucaugaaagacggacgcguccucguggugccauguaggaaccaagacgaauuaaucgguagagccaggauaagucagggugcaggguggaguuuacgagaaacggccuguuugggcaaauccuacgcacaaauguggagucuaauguacuuccacagaagagaucuacgucuugcugcaaacgccauuuguagugcaguacccagucauuggguaccuacaucucggacaacuuggucaauucacgcaaaacacgaguggaugaccaccgaggacauguuaacuguauggaaucgcguauggauaagggaaaauccguggauggaagacaaaacgccggucgaaucuugggaagaaauuccuuaucuaggaaaacgagaagaccaauggugcggaagccuaauagggcucacuuccagggcaaccugggcuaaaaauauacaggcugcaauaaaucaaguacgcucacugauagggaaugaagaauauacagacuauaugccaucaaugaaaagguuccggcgagaagaagaagaggcgggaguacuuugguga

SEQ ID NO: 22757 - RNA, 9876 nt, Artificial Sequence
  derived and/or modified CDS sequence (opt6) from DENV-2__EU482679__SS-prME
ucagcagggaugauaauaaugcuaauaccuacugucauggcauuccaucuaacuacgcggaauggugaaccgcauaugauuguuggaauccaagaaaaagguaaaucacuauuauuuaaaaccgaagauggggugaauauguguacauuaauggcuauggauuuaggagaauugugcgaagacacgaucacauacaaaugcccacuuuuaagacaaaaugaaccagaagauauugauugcuggugcaauucaacaucuacauggguuacauaugguacauguaccacuacgggggaacaccgucgugagaaaagaagcguugcauuaguuccacauguagguaugggauuagaaacacgcacugaaacauggaugucaagcgaaggugcauggaaacaugcacaaagaauagaaacuuggauacuaagacaucccggauucacgauaauggccgcaaucuuagccuauacaauaggaacuacacacuuccaaagagucuuaauauucauacuacuaacggcaguugcuccaagcaugacgaugagaugcauuggaauuaguaacagagauuuuguagaagguguaucaggaggaucguggguugauauuguucucgagcacggaaguugcgugacuaccauggccaaaaacaaacccacucuggauuuugaauugauaaaaacagaagcaaaacaaccagcaacacuaagaaaauauuguauagaggccaaauugaccaauacaaccacagagucaagauguccgacacaaggagaaccuucguugaaagaagaacaagauaaaagauuuguaugcaaacauaguaugguagauagagggugggguaacggauguggucucuuuggaaaaggaggaauaguaacgugugcaauguuuacaugcaagaaaaauauggaaggaaaaauuguacaaccagaaaacuuagaauauacuauugucguuacaccgcacaguggugaagaacaugccguaggaaacgacacuggaaaacacggaaaagaaauaaaagucaccccacaaagcagcauaacugaggcagaacucaccggauacggaacuguaacuauggaguguuccccaagaaccgguuuggacuuuaaugaaaugguuuuacuucaaauggaaaacaaagcgugguuaguucaucgacaaugguucuuagaccuuccauuacccugguuaccuggagcagacaaacaagaaaguaacuggauacaaaaagagacauugguaacguucaaaaacccacacgccaagaaacaggaugucgugguacuaggaucucaagagggcgcuaugcauaccgcguuaacuggagcaacagagauacaaaugucgagcgggaauuugcuauucacaggucaucucaaaugucgccuucguauggauaaacuacagcugaaagguaugucauauaguauguguacaggcaaauuuaaaguaguuaaagagauagcggagacacaacaugguacuaucguaauccgaguucaauaugagggugacgggucgccaugcaaaauuccauuugaaauaauggaccucgagaaaagauauguacucggacgcuuaauaacagucaacccaauagugacugaaaaagauagcccaguuaauaucgaagccgaaccaccauucggugauagcuauauaauuauugguguagaacccggccaacugaaacucaauugguucaagaaagguucguccauaggacaaauguucgaaacaacaaugcguggugcaaaacgcauggccauacuuggagacacggcaugggauuuuggaucucuuggagguguguucacaaguauagguaaggcuuuacaccaggucuuuggcgcaauuuauggugcagcauucucaggcguuucguggaccaugaaaauacucauaggagugauuaucacuuggauuggaaugaauagccguagcacuagccuuucagucagucuaguucuagugggcaucgucacccuuuauuuagguguuauggugcaagcggauaguggauguguuguuucuuggaaaaacaaagaacuaaaauguggaucagggaucuucauuacagacaauguacauacuuggacggaacaauacaaauuccaaccagagucaccuaguaaauuagccagugccauacaaaaagcccaagaagaagguauauguggaauaagaucuguaacuagacuggaaaaucucauguggaaacagauuacuccagaauuaaaucauauucucgcugaaaacgaggucaaguuaacaauuaugaccggagacauaaaaggaauaaugcaagcggguaagaggagcuugcgaccgcaaccgacagaacuaaaguacagcuggaaaacguggggcaaagcaaagauguugucgacugaaucccauaaucaaacauuuuuaauagauggcccagaaacggcagaaugcccaaauaccaacagagcuuggaacucauuggaaguagaagacuacgguuuuggcgucuuuaccacuaacauauggcuaaaacuuaaagagaaacaagaugccuuuugugauagcaagcucaugagcgcagcaauaaaagauaacagagcagugcaugcggacaugggauauuggauagagucagcucuaaacgauacuuggaaaauagaaaaagcauccuuuaucgagguuaaaaacugccacuggccaaaaucucauacacuauggucaaacggugucuuagaaucugagaugauaauuccuaaaaaucucgcuggcccaguaucacaacacaacuaucgaccuggcuaucacacccaaauagccggaccuuggcauuuaggaaaauuagaaauggauuuugauuucugugauggaaccacgguaauagugacugaagauuguggaaauaggggacccucauuacguacaacgaccgccucugguaaacuaaucacagagugguguugccgaagcuguacccuuccgccccuacgauauagaggugaagacgguuguugguacggaauggaaauuaggccauuaaaagaaaaagaagaaaaccuaguuaauagccugguaacggcgggccauggccaaguagacaauuuuucucuaggaguauugggaauggcauuguucuuagaggagaugcucagaacgcgcgucggcacuaagcacgccauucuauuaguugcagucucauuuguaacuuugauaacaggaaacaugaguuuuaaagacuuagguagaguggugguuaugguaggagcaacuauggcagacgauaucggaaugggaguaacauauuuagcauuguuagccgcuuuuaaagugagaccgacauuugccgccgggcuauuauuaaggaaacugaccaguaaagaauuaaugaugacgacaauagguaucguccucuuaucucaaagcacaauaccugaaacuguucuagaauugacagaugcacuagcacuugguaugaugguccucaaaauaguuaggaacauggaaaaguaucaacuagcuguuacaaucauggcaauauuauguguaccgaacgcugucauuuuacaaaacgcuuggaaaguuucaugcacaauauuggcaguaguaucgguuucuccuuuacuguuaaccucaagccagcaaaagacagacuggauaccauuagccuugacaauuaagggucuuaauccaacagcuauauucuugacaacguuaucaaggacaaacaagaaaagaucauggccacugaaugaagccauuauggcgguagggaugguaaguauacuggccagcucucuuuugaaaaaugacauacccaugacugggccgcuaguagcaggggguuuauugacuguuuguuauguccucacugggagaucggcggauuuagagcucgaaagagcaacugauguuaaaugggaagaucaagcagaaauuaguggaucaagccccauucuaucaauaacgauuuccgaagauggaucuaugucaaucaaaaacgaggaagaggaacaaaccuuaacaauucucauaaggacggguuuacucguuauuucuggguuauuuccuauuaguaucccuauaacugcugcugcaugguauuuaugggagguuaagaagcaacgggcaggcguucuaugggacgucccaucaccuccaccaauggguaaagcagagcuagaagacggugcuuacagaauaaaacagaagggcauauuaggauauucucaaauaggagccgguguuuauaaagaagggacguuccacacaauguggcacguaacacgaggggccguguuaaugcauaaagguaagagaaucgaaccuucuugggcggaugucaagaaagaccuaauuucuuacggagggggauggaaguuagaaggugaauggaaagaaggagaggaaguucagguacuagcacuugaaccaggcaaaaauccacgggccguacagacaaagccggggcuauucaaaaccaauacgggaaccauaggagcagugagucuagauuuuagcccuggaacaaguggaaguccaauaauugauaagaaaggcaaaguugucggacuguacggcaauggaguggucacacgaagcggugcguauguaucggcgaucgcgcaaacggaaaagagcauagaggacaaucccgaaauugaagacgauaucuuuagaaaaagacgucugacuauuauggaccuccacccaggggccggaaaaacuaaaagguaccuuccugcaauaguacgagaagcaauuaaaaggggauugaggacauuaauauuagcuccuacuagaguaguagcggcagagauggaagaagcauuaagagggcuaccaauuagauaccaaacuccggcaauuagggcggaacacacaggaagagagauaguggaucuaaugugucaugcuacuuucacaaugcgcuuacucucgcccauaagaguaccuaauuacaaucuuauaauaauggacgaagcucauuuuacagauccugcaaguaucgcagcgagaggcuauauaaguacucgaguugaaaugggcgaggcugcgggaaucuucaugacagcaacuccgccagguucucgagacccuuucccgcaaagcaaugccccaaucauagaugaagaacgggagauuccugagagaaguuggaacaguggucacgaauggguaacugauuuuaagggaaagacuguuugguuuguaccaucuauuaaagcuggaaacgauaucgcugcgugcuuaaggaaaaacggcaagaaaguuauacaauuguccagaaagacauucgacucugaguauguaaaaacaagaaccaacgauugggauuuuguuguuacaacagauauauccgaaaugggagcaaauuuuaaagcagaacgagucauagauccccguagauguaugaaaccggugauacugacagacggugaagagagagugauauuagccgggccaaugccugugacacacucuuccgcggcucaacgaagaggaagaaucggaagaaacccgaaaaacgaaaacgaccaauacauuuauaugggcgaaccacuggaaaaugacgaggauugugcccauuggaaagaggcgaaaaugcuucuagauaauauuaauacucccgaaggcauuauuccaagcauguucgaaccggaacgugaaaaaguagacgccauugauggggaauauagauuaaggggugaagcgagaaaaacuuuuguagaucuaaugcgaagaggagaucuacccguguggcucgcauacaagguugcugcagaaggaaucaacuacgcagaucgacgauggugcuucgacggaaucaaaaacaaucagauacuagaagagaacguugagguggaaauuuggacuaaagaaggggaaagaaagaaacuaaaaccgagauggcuagacgcaagaauuuacucugacccccuagcucuaaaagaauuuaaagaguucgcagcaggaagaaaaucuuugacacuuaauuugauuacugaaaugggucguuugccuaccuucaugacgcagaaaacccgagacgcacuagacaauuuagcuguucuacacaccgcagaggcgggaggcagagcauauaaccaugcuuuaagugagcucccagaaacacuagaaacguuauugcugcuaacacuuuuagccacuguaaccgguggcauuuuucuuuuucugaugucuggacgagggauuggcaaaaugacacuaggaaugugcuguauuauaacagcuuccauacugcuaugguacgcucagauucaaccgcauuggauagcugcaucaauuauccuugaguucuuucuaauagucuuacuaauaccagagccggagaaacaaagaacaccgcaagauaaccaacuaacguauguaguuauagcgauauuaacggucguugcggcaacuauggcaaacgaaaugggauuuuuagagaagaccaagaaagaucuggggcuuggaaguauugcgacccaacaaccugaaaguaauauacuugacaucgacuuaaggccagccagugcuuggacacuauaugccguagccacgacauucguuaccccaaugcuaaggcacucaauagagaacaguucugucaacguaaguuuaaccgcgauugcaaaccaagccacaguguuaaugggauuaggaaaaggauggccucuauccaaaauggauauaggcgucccauuguuggcgaucggaugcuauucgcaagucaauccaauaacguugacagcagcacucuuacuuuuaguugcccauuaugcgauaauaggaccuggguuacaggccaaggcaacaagagaggcucagaaaagagcagccgcuggaaucaugaaaaauccuacgguagacggaauuaccguaaucgacuuagacccaauuccuuaugaccccaaauuugaaaaacagcugggacaaguaauguuguuaauauuaugugugacgcaaguauuaaugaugagaacaacgugggcauuaugcgaagcccuaacacuggccacuggaccuaucagcacauuaugggagggaaauccaggaagguuuuggaauacaacaauugccguaucaauggcuaacauuuuuagaggcaguuacuuggccggugcaggacuuuuguucagcauaaugaaaaacacuacaaauacucggcgugguacgggcaacaugggugaaacacugggcgaaaaauggaagaguaggcuaaaugcacuaggaaaaagugaauuucagaucuacaagaaaucaggcauacaagaaguagaccgcacuuuagcgaaggaagggauuaaacgaggagaaaccgaccaccaugcuguaaguagaggguccgcaaaauuacguugguuugucgaaaggaauaugguaacaccugaaggaaaaguuguagaucuagguuguggucguggcggauggucguauuacugcgggggccucaaaaauguuagagagguaaaaggguuaacaaaggguggaccuggacaugaagaaccuauuccgaugucgacauacggauggaauuuagugagguuacaaagcggggucgauguauuuuucauaccgccagaaaaaugugauacccuccuuugcgauauaggcgaaucaagcccaaauccuacaguggaagcuggaagaacuuugagaguuuugaaucuuguggagaauugguugaacaauaacacacaauuuuguauuaaaguguugaauccauacaugccuagcgugauagaaaagauggaagcacugcaacgcaaguaugggggagcauuagucagaaauccucuaagucgaaacucaacacaugaaauguacuggguauccaaugcuagcgggaauauugucucuucaguaaauaugauaagucguauguuaaucaaccgauuuacuaugcgucauaagaaagcuacauacgaaccagauguagaucuuggaucagguacacguaauaucggcauagagagcgaaauaccaaacuuggauauaaucgggaagcguauagaaaagauuaaacaagaacacgaaacuucuuggcauuaugaucaggaucauccauacaagacaugggcauaucacggaucauaugaaacuaaacaaacuggcucagccagcaguaugguuaauggaguaguucggcuuuuaacaaaaccuugggauguuuuacccacagucacccaaauggccaugacagacaccacaccuuucggucaacaaagaguuuucaaagaaaaaguggauacaagaacccaagaaccgaaggaaggaacuaagaaauuaaugaagauaaccgcggaauggcucuggaaagaguuagggaagaagaaaacaccccgcaugggcacuagggaggaauuuacaaggaaaguucgauccaaugcagcuuuaggagcuauuuuuacagacgaaaacaaauggaaaagcgcaagagaagcgguugaagauucaagauuuugggaguuaguagauaaagaacgaaaucuacacuuggaagggaaaugcgaaacauguguauauaacaugaugggcaaacgcgaaaagaaauugggggaauuugggaaggcuaaagggaguagggcaauuugguacauguggcuaggggcuagauucuuagaguucgaggcgcucggauucuuaaaugaagaccauugguuuucaagggaaaacucucuaucugggguggaaggagagggucuucacaaguugggcuacauccuacgagacguaucgaagaaagaaggaggugcuauguaugcagaugauacggcaggcugggacacccgaauuacauuagaggaucugaaaaacgaggagaugguaacaaaccacauggaaggagaacauaagaaacuagcggaagcaauauucaagcugaccuaucagaauaaggugguacgaguacaaagaccaacuccaaggggaacuguaauggauauaauuucuaggcgugaccagcgaggaaguggacaagucggaacuuacgggcuaaacacuuuuacuaauauggaagcgcagcuaauccgacaaauggaaggugaaggcguauuuaaaaauauacagcaucugaccgugaccgaggaaguggcaguucaaaauuggcuggcuaggguuggucgagagagguugucuaggauggcaauuucaggagaugauugcguaguuaaaccacuagaugaucgauuugcgaaugcuuuaacugcacuuaacgacaugggaaaaauaagaaaagauauccaacaaugggaaccaucaaaaggcuggaacgauuggacacaagucccauuuuguucucaccauuuucacgaauugauaaugaaagaugggcgggugcuaguaguaccaugccgcaaccaagacgaauuaaucggacgagcgagaauuucgcaaggugcaggcuggagucuaagagaaacugcaugcuuaggaaagucauaugcccaaauguggaguuuaauguacuuccaucggcgggaucucagauuagcagccaaugcaaucuguucugcaguuccaucccauugggucccaacaagucgaacaacauggaguauucaugcaaagcaugaauggaugacuacagaagauaugcuaacgguauggaaucgaguauggauucgagaaaacccauggauggaagauaagacuccaguagaaucuugggaggaaauaccguauuugggcaagcgugaagaucaauggugugguucuuuaauuggauugacaaguagagcaaccugggccaaaaacauacaagcagcaauaaaccaaguaagaucucugaucgguaacgaggaauauacugauuauaugccuaguaugaaacgauuucguagagaagaagaggaagccgggguauuaugguaa

SEQ ID NO: 22758 - RNA, 9876 nt, Artificial Sequence
  derived and/or modified CDS sequence (opt6) from DENV-2__EU482774__SS-prME
agcgcagggaugauaauaauguugaucccaacgguaauggcuuuccaccuuacaacaagaaacggugaaccacauaugaucguagggauucaagaaaaaggaaaaagucuucuauuuaaaacagaagacgggguuaauauguguacucuaauggcgauggacuuaggggaacuuugcgaagauacuaucacuuacaaauguccucuucuuaggcaaaaugaaccagaagauauagacuguugguguaauucaacuagcacauggguaacauaugggacgugcacuacuaccggagaacacagacgugagaaaaggucgguggcacugguaccacacguggguauggggcuagaaacacgaacggaaaccuggaugucauccgaaggagcuuggaaacaugcucaaagaauugaaaccuggauacuucgccaucccggauuuacgauaauggcagcaauauuggcuuacaccauaggaaccacucauuuccaaaggguauuaaucuucauauuauuaaccgcaguugcaccaaguaugacaaugcgcugcauuggaauuaguaaccgcgauuucguagaaggcguuucaggugguagcuggguagauauuguccuggaacauggcaguugcguaacgacuauggcuaaaaauaaaccaacguuagacuuugaauuaauuaaaacggaggccaaacaaccggcuacucuaagaaaauacuguaucgaagcaaaauugacaaauaccaccacggaaucaagguguccaacgcagggggagccaucuuuaaaagaggagcaagauaaaagauuugucuguaaacacucaaugguagacagagguugggguaauggaugcggauuauucgggaaaggagguauaguaacgugugccauguuuacaugcaagaaaaauauggaaggaaaaauaguacaaccagaaaaucuugaauacacuauaguagucacgccacacuccggugaggagcaugcgguagguaaugacaccgguaaacacggaaaggagauaaagguuacuccacaaucgagcauaacagaagcagaauugacaggauaugguacaguuaccauggaguguaguccaagaacaggacuagauuuuaaugaaaugguguuauugcaaauggaaaauaaggcuuggcuaguucaucgacaaugguucuuagaccuaccacuacccugguuacccggugcagauaaacaagaaucaaacuggauacagaaagaaacgcuagugacauuuaaaaacccgcaugccaagaaacaagacgucguaguucuaggcagucaagaaggagcgaugcauacugcacuaacaggagcaacugagauacaaaugucgagcggcaaucuacuguuuacagggcaucuaaaaugcagacuaaggauggauaagcuccaacugaaagguaugucauauaguauguguacagguaaauuuaaaguaguaaaagaaauagcugaaacacagcaugguacuauuguaauacguguccaauacgaaggagacggcucaccauguaagaucccauuugaaaucauggauuuagagaaaagguauguacuugggcguuugauaacagucaacccgauugucacggagaaagauuccccuguuaauauugaggcagaaccaccauucggagauaguuauauuaucauuggaguagaaccaggacaacuuaaacuaaacugguuuaagaaagggaguucaauuggucagauguucgaaacgacaaugagaggagcgaaaaggauggcgauauuaggcgauacggcaugggauuucggcucucuaggagggguauucacaagcaucggaaaagcauuacaccagguguuuggugccauuuacggagccgcauuuagcgguguuuccuggaccaugaaaauuuuuauuggcgugauaauuacauggauagguaugaauagucguaguacaagucucucaguaucacuggucuuaguagggaucguuacuuuguacuuaggaguaaugguacaggcagacuccggguguguagucucuuggaaaaacaaggaacugaaaugcgggucaggcauauuuauaacagauaaugugcauacauggacagaacaguacaaguuccaaccagagucgccaucuaaguuagccuccgcgauacaaaaagcccaagaagagggaauaugcggaauaagguccguuacacgguuagaaaaccuaauguggaagcaaauaacaccugagcugaaccauauuuuagcagaaaacgaagucaaacucacgauaaugacaggggauauaaaagggauuaugcaggccggaaagagaucauuacguccgcaaccaaccgaauuaaaauauuccuggaaaacaugggggaaagcaaaaauguuaaguacagaaucccacaaccagaccuuuuuaauagacgggccagagaccgccgaauguccaaauacuaaucgagcauggaacucucucgaagucgaagauuauggcuuugggguauuuacuacgaauauauggcugaaacuuaaggaaaaacaagaugcauuuugcgauuccaaguugaugagugcugcuauaaaagauaacagggcgguacaugcugacaugggauauuggauagaaagugcccuaaacgacacauggaaaauagaaaaagccagcuuuauugaaguuaaaaacugucacuggccaaaaagccauacccuguggucaaaugggguacuagaaagugagaugaucauuccuaaaaaucuagcaggaccaguaucacaacauaauuauagaccugguuaccauacgcagauugccgguccuuggcaccuugggaaacuggaaauggacuuugauuucugcgauggcacuacaguaauaguaacggaggacuguggaaacaggggcccaucucuaagaacgaccacagccucaggcaaauuaauaacugaauggugcugucgauccugcacccugccgccacugcgguauagaggagaagacgguuguugguauggaauggaaauaaggcccuuaaaagaaaaagaggaaaacuugguaaauucccuugucacagccggacacggucaaguugauaauuucagccucggaguccuggggauggcccuauuuuuggaggaaaugcuuaggacucgaguagggacaaaacacgcaauacuauuaguagcuguaaguuuuguuacacuaaucacaggcaacaugucauuuaaggaucucggacguguaguaguuaugguaggggcaacaauggcagaugacauuggaaugggagugaccuacuuagcauuauuagccgcuuucaaagugcgaccuacguuugcugcuggacugcuacuucgaaaacuaaccaguaaggaauuaaugaugacaacgauugggauugugcuacugucccagucuacuauacccgaaacaguuuuagaguuaaccgacgccuuggcguuggguaugaugguauuaaaaauaguucgaaacauggagaaauaccaacuugcgguuacaaucauggcgauucuuugcgugccuaaugcagucguauugcagaacgccuggaagguaucuuguacaauucucgcgguggucagcguaaguccucugcuccuaacuucaucacagcagaaaacggacuggauaccucuugcuuuaacaaucaagggacugaaccccacugcaauauuucuaaccacacugagcagaacaaauaagaaacguucuuggccacuaaaugaagcgauaauggcaguaggaaugguauccauacucgcuagcucauuacuaaagaacgauaucccgaugacaggaccgcucgucgcaggcgguuuauuaacgguuuguuauguacuuacugggcggucugcugaccuugaguuagagcgcgcuacagauguuaaaugggaagaucaagcugaaauaucuggcaguucaccuauacuuagcaucacuaucagugaggauggaucuauguccaucaaaaacgaggaagaagaacaaaccuuaacuauacucauaagaaccggccuucuaguaaucucaggucucuucccuaucucaaucccgauuacugcagcggcaugguaccuaugggaaguaaagaaacaaagagcaggagucuuaugggauguuccgagucccccuccgaugggaaaagccgaauuagaagauggagcuuauagaauuaaacaaaaagguauuuuagguuauucacaaaucggugcuggagucuacaaagaagguacuuuucauacgauguggcaugugacgcggggagccgugcugaugcauaaggguaaaagaauugaaccaucaugggcggacgucaagaaagaucuaauuucguauggaggcggcuggaaauuagaaggugaauggaaagagggugaagaaguacaaguacuugcacuagaaccagguaaaaacccacgggcuguacaaacaaaaccaggcuuauuuaaaacaaauacagggacgauuggcgcgguuucauuagauuucucgccaggcaccagcggcucgccaauaauagacaagaaagguaaaguagucggcuuauauggcaauggaguggucacccggucgggcgccuauguaagugcuauagcccaaaccgaaaagucaauagaggauaacccagaaauugaagacgacauauuucgaaaacgcagauuaacuaucauggaucuucacccaggagcggggaaaacgaaacguuauuugcccgccaucguuagagaggcuauuaaacgaggccuaagaacucuaauccuagcacccacucguguaguggcagcugaaauggaggaagcauuaagaggucuaccaauucgguaucagacgccugcuauaaaagcagaacauaccggcagagaaaucguagaucuuaugugccaugcaacuuucacaaugcgccucuuaucaccagugcgagucccuaauuauaacuuaaucauaauggacgaagcacacuucacggauccagcuuccauagcagcacgcggauauauaucaacacgaguagaaaugggugaagcagcaggaaucuuuaugacugcuacaccgccagguucaagagauccuuuuccacaaucaaaugcaccuaucauugacgaagaaagggaaauaccugagagaucuuggaacucuggacacgaauggguaacugacuuuaaaggaaaaacuguaugguuuguacccagcauaaaagcaggaaaugacauagcagccugccuacgaaagaacggcaagaaagucauacagcucucucggaaaacauuugauagcgaauacgucaaaaccaggacaaaugacugggauuucgugguuacuacugauauuagugaaaugggugcaaauuuuaaagcagaacgagugaucgacccaagaagaugcaugaaaccaguuauauuaacagauggagaggaaagagucauccucgcuggccccaugcccguuacccacuccagugcagcgcaaagaagaggacguauuggacguaauccgaagaaugaaaaugaucaauauaucuauaugggagaaccacuugagaacgaugaagauugugcgcauuggaaagaagcgaaaaugcuuuuagacaauaucaauacaccagaaggcaucauaccuucaauguuugaaccagaacgggaaaaaguugaugccauugauggagaauaucgacuaagaggagaagcacgaaagacauuuguggaccuaaugagaagaggggauuuaccaguauggcuagcauauaaaguugcagcagaagguauaaauuacgcugauagacguuggugcuucgacggcaucaaaaauaaccaaauuuuggaggagaauguugagguugagauuuggacuaaggaaggugaacgcaaaaagcuaaaaccucgaugguuagacgcuagaaucuauucugauccccucgcauuaaaagaauuuaaagaauuugcggccggacguaaaucacuaacccucaaucugauaaccgagaugggucggcuaccaacuuuuaugacccagaaaacucgggaugccuuagauaauuuagcuguauuacauacagcugaagccggagggcgagccuacaaucaugcacuuucagaacuucccgaaacauuagaaacccuauuauuacuuacgcucuuagccacaguuacagggggaauauuuuuauucuugaugucuggacguggcauugguaaaaugacacugggaauguguuguaucauuacugcaucgauccuucuaugguaugcacagauucaaccucacuggauugcagcauccauaaucuuagaguucuuucugaucguccuucuaauuccggagcccgaaaagcagcgaacaccucaggauaaucagcuaacauaugugguaaucgcaauuuuaacgguaguggcagcaacaauggcaaacgaaauggguuuucucgagaaaacuaagaaagaucuaggcuuagggagcauagcaacgcagcaaccagaaaguaauauacucgauaucgacuugagaccugcuucagcauggacccuauaugcuguggcaacaacuuuugugacaccaaugcucaggcauaguauugaaaacagcaguguaaacgugucuuuaacagcuauugcgaaccaagcuacaguucuuauggggcuaggaaaaggguggcccuuauccaaaauggacauugguguaccacuucuagccauaggauguuauagccaaguaaauccaauuacgcuuacagcagcacuccuccuucugguagcacauuaugccauuauugguccagguuuacaggcuaaagcuacacgggaggcacaaaaacgagcagcagcggggauuaugaagaauccaaccguagauggaaucacaguaauagauuuagauccgauaccuuaugaccccaaauuugagaaacaauugggacaaguaauguuauuaaucuuaugcgucacucaagucuuaaugaugagaacgacuugggcccugugcgaagcgcuaacccuagcgacaggcccgauaucaacauuaugggaagguaauccaggaagguuuuggaacaccacaauugcgguaucuauggcaaauauauuuagaggauccuacuuagcuggcgcaggacuacuauucaguauaaugaagaacacaacaaauacaaggaggggaacggggaauauaggggaaacuuugggagaaaaauggaaguccagauuaaacgcguuagguaaaagugaauuucaaauauauaagaaauccggcauacaggagguugauaggacgcuugccaaagaaggaauaaaaagaggagaaacagaccaucaugcugugucaagaggcucagcaaaauuacguugguucguugaacguaauaugguuacuccugaaggaaaaguuguagaccuuggcugcggccgagguggauggaguuacuacugugguggucucaaaaauguaagggaggucaaaggacuuacaaaaggagggcccggucaugaggagccuauucccaugucaaccuaugguuggaacuugguuagauuacaaagugguguagauguauucuuuauuccuccagaaaaaugcgauacauuacuaugcgauauuggagaauccagcccaaacccaacuguugaagcgggaaggacauuacgaguacuaaaucuaguugaaaauuggcuuaauaacaacacccaauucuguauuaaaguauugaauccauauaugccgaguguuauagagaaaauggaagcacuucaaaggaaauaugggggagcauuaguccggaacccuuugucuagaaauucaacgcaugaaauguauuggguaucaaaugcaucuggaaauaucguaaguucaguaaacaugaucucaaggauguuaauaaaccguuucacgaugagacacaagaaagcaaccuaugaaccggaugucgaccuggggaguggaacacgaaauaucggaauagagagcgaaauaccaaaccuagacauaauaggaaaacguauugagaagauaaaacaggaacaugagacaucauggcauuacgaucaagaucauccauauaaaacaugggcuuaucacgguuccuaugagacaaagcagacggggucagccucuucgauggucaacggcguggugcgacuacuuacuaaaccaugggacgugcucccaacaguuacacaaauggcaaugacugacacgacuccguuuggacaacaaagaguguuuaaagagaaaguugauaccagaacccaagaacccaaagaagggaccaagaaacuaaugaaaauaaccgcgaaguggcuauggaaagaacuggggaaaaagaaaacgccaagaauguguacccgagaagaguuuacaagaaaagugcguucuaaugccgcauuaggagcgaucuuuacagaugagaauaaauggaaaagcgcucgugaagcgguagaagacucuagauuuugggaacuuguugauaaagaacguaacuuacauuuagaaggcaaaugcgaaacaugcgucuauaacaugaugggaaagagagagaagaaauuaggagaauuugguaaagcgaaggguagucgagcaauaugguauaugugguuaggugcacgauuucucgaguucgaggcauuggguuuccuaaacgaagaucacugguuuagccgggaaaauucauuaucuggaguagaaggugaaggacuccacaaauuaggauauauauugcgggacgucagcaagaaagaaggaggcgcgauguacgcggaugacacugcuggaugggacacucgcauaacauuagaagaucuuaagaaugaagagaugguaaccaaucacauggaaggagaacacaaaaaguuagcggaggcgauuuuuaaauugacuuaccaaaacaaggugguacgaguucagcggccaacuccaagggguacgguuauggauauuauuagccgacgcgaccaaagagguuccgggcaaguaggcacuuauggccuaaauacuuucaccaacauggaggcacaauuaauuagacaaauggaaggcgagggcguuuuuaagaacauacaacauuuaaccguuaccgaagaaguagcaguucaaaauugguuagcaagaguaggacgagagagauugagucgaauggccaucucuggugaugacugugucguuaaaccauuagacgaucguuucgcaaaugcguugacagcuuugaaugauaugggcaaaauacgaaaagacauccaacaaugggaaccgucgaagggcuggaaugacuggacucaagucccuuuuuguucacaccacuuccacgaacucauaaugaaagauggacgaguuuuaguagucccgugucgaaaucaagaugaauuaauugggcgagcucgaauaagccaaggugcaggauggucacuacgagaaaccgccuguuuagguaagucauaugcacagauguggucacuuauguacuuccauagacgcgauuuaagauuagccgcuaaugcaaucugcagcgccguaccgucacauugggugccuacaagcagaacuacuuggucaauacaugcaaaacacgaguggaugacaacggaggauauguugacuguuuggaaucguguuuggauacgagaaaauccuuggauggaagacaagacaccagucgaaucgugggaggaaauuccauaucuaggcaaaagagaagaucaauggugcgggaguuugaucggccuuacuagcagagcaacuugggcuaagaauauccaagcggcaauaaaucaaguacgaucguuaauagguaaugaggaauacacagauuauaugccgagcaugaagagguucaggcgagaagaagaagaggcggguguccuaugguaa

SEQ ID NO: 22759 - RNA, 9876 nt, Artificial Sequence
  derived and/or modified CDS sequence (opt6) from DENV-2__EU482775__SS-prME
ucugcggguaugauaaucaugcuaauaccaacagucauggcauuucaccuaacaacaaggaauggggaaccacauaugaucguuggaauacaagaaaaaggaaaaucacuauuauuuaaaacagaagacggaguaaauauguguacucugauggcgauggacuuaggagaauuaugugaagacacaauaacuuauaaaugcccacuacuaagacaaaaugaaccggaagacauagauugcuggugcaauucuacuucaacauggguaacauauggaaccuguacaacaaccggggaacauagaagggaaaaacgaucagucgcauuagugccucacguugguaugggauuggaaacucgaacggaaacauggaugaguuccgaaggugcauggaaacacgcgcaacgaaucgaaaccuggauucuaagacauccaggcuuuacgauaauggcugcgauuuuagcauauaccauaggaacaacucauuuucaaagaguacuuaucuuuauacuuuuaacugcaguagcaccuucgaugacgaugcgguguaucgggauaucaaauagggacuucguggaaggagucaguggagggagcuggguagacauuguccuugaacacgguaguuguguuacaacgauggcuaaaaauaaaccaacauuagacuuugaauuaauaaaaacugaagcgaaacaaccagcaacucuccgaaaauacugcauagaagcaaaacugaccaauacuaccacagaaagccgguguccaacgcaaggugaaccaucacucaaagaagaacaagauaaaagguuuguuuguaaacacucaaugguugaucggggaugggggaaugguugcggacuauuugguaaaggaggaauaguuaccugugcuauguucacauguaagaaaaauauggaaggcaaaauaguucaaccugaaaauuuagaauauacaauuguggucacuccccacucuggcgaagaacaugccguagguaaugacaccggcaaacacgggaaagaaauuaaaguuaccccacaaucgagcauaacugaagcugaacugacgggauacggaacuguaacuauggaaugcucuccuagaacuggcuuggauuucaaugaaauggucuuacuucaaauggaaaacaaggcuugguugguucacagacaaugguuccuagaccucccucucccguggcucccuggagcggacaaacaagaaucuaauuggauucaaaaagaaacucuuguuacuuuuaaaaauccgcaugccaagaaacaagauguuguaguauuagguucucaagaaggcgccaugcacacggcucuuacuggugcuacugaaauucaaaugaguagugguaaucuacucuuuacaggucaucuuaaaugucgauuaaggauggauaaauuacaguuaaaaggcaugucauauagcauguguacggguaaauuuaaaguaguaaaagaaauagccgaaacucaacaugguacaauagucauuagggugcaauaugaaggagacggguccccguguaaaauuccauucgaaauaauggacuuagagaaaagauacguauugggucgauugauaacaguaaaucccauuguaacagaaaaagauaguccagugaacauagaagcagaaccuccauucggagacagcuauauuauuauaggagucgaaccuggucaguuaaagcuaaacugguuuaagaaaggaaguucuauugggcaaauguuugaaacaacaaugcgaggugcaaagagaauggcaauuuuaggggauacggcuugggacuuugggucacuaggaggaguuuuuacgaguauaggaaaagcacuucaccaagucuuuggagcuauauauggggccgcauucagcgggguguccuggacaaugaagauacugaucggcguaauaauaacauggauugggaugaacucacguucaacaagccucucaguaucauuggugcucgucggcaucguuacauuauaucuaggagugaugguucaggcggauucagguugugucguaaguuggaagaauaaagagcugaaauguggaucggguaucuucauuacagacaauguacauacauggacagagcaauacaaauuucaaccagaaucuccaaguaagcuggcuagcgccauccaaaaagcacaagaagagggaaucugugguauccggucgguaacaagauuagagaauuuaauguggaaacaaaucacuccggagcugaaccacauuuuagccgaaaacgaaguaaaacucacgauaaugacgggcgauauuagaggaaucaugcaagcaggcaaaagauccuuacgcccucagccaaccgaacuaaaguauaguuggaaaacuugggguaaagcgaaaauguuaucuacagaaagcuauaaccagaccuuucuaauugauggaccagagacagcugaguguccaaauacaaauagagcauggaacagccuggagguagaagauuaugguuuuggaguauucacaacgaauauaugguugaaauuaaaagagaagcaggacgcuuuuugcgauaguaaauuaauguccgcagcaauaaaagauaacagagcaguacacgcugacaugggcuacuggauagaaucagcucuuaacgauaccuggaaaauagaaaaggcuucauuuauagagguaaagaauugucacuggccgaaaagucauacacuauggucuaauggaguccuagagucagagaugauaauuccaaagaauuuggccgguccgguuucacaacacaacuacagaccuggauaucacacucaaauagcaggccccuggcaucugggcaaacucgagauggacuuugacuuuugugaugguacgacaguaauagucaccgaggacugcggcaaccgcggaccuucauuaagaacgacgacagcaucaggaaaacuaauaacagaaugguguugucggaguugcacguuaccaccacugcgguaucgaggagaagauggauguugguacgggauggaaauacgaccuuuaaaagaaaaagaagagaauuugguaaauagcuuagugaccgcuggacauggacaaguugauaacuucucauuggguguauuggggauggcgcuauuucuggaggagaugcugcgcacaaggguaggaacgaaacaugcaauauuauuaguugcgguaucauuugucacguugaucacaggaaacaugagcuuuaaagauuuaggacgcguagucguuauggucggugccacaauggcugaugacauagggaugggaguuacuuaccuagcgcuccuugcugcauucaagguucggccuacguucgcggcuggauuacugcuucgaaaacuaacaucaaaggaguuaaugaugacaacaauagguauugucuuguugucucagucuacaaucccugaaacaguuuuagaacuaacugaugcauuggcacuuggcaugauggugcuaaaaaucgugagaaauauggaaaaauaccaacuagcaguaacuauaauggcaauucuauguguuccaaaugcaguaauucuucagaaugcguggaaaguuucauguaccaucuuagccguagucucggucaguccucuacuccuaacaagcagccaacagaaaacggauuggauucccuuggcauuaaccauuaaaggacucaacccuacugcaauauuccuaacgacacuuucgcgcacuaauaagaaaagaagcuggccucuaaaugaagcaauaauggcuguaggaauggucagcauucuagcgucuuccuuauuaaagaaugacauacccaugacagguccacuuguggcaggaggccucuuaacuguuuguuaugucuuaacugggcguagugcugaccuggagcuagaaagagccaccgauguuaaaugggaagaccaggcagaaaucaguggaagcagucccauucucuccauuacuauaucagaagacgguucaaugaguauuaaaaacgaagaagaagaacagacauuaacaaucuuaauacgaacuggacuauuagucaucaguggucuauuccccauaagcauccccauuacugcggcugcaugguaucugugggaagugaagaagcaaagagcaggcguacuaugggaugucccaucgccuccacccauggguaaagcagagcuagaagauggagcuuacagaauaaaacaaaaaggaauccuaggauacagccaaauaggggcuggugucuauaaagaaggaacauuccauacuauguggcaugugacacggggagcgguucugaugcauaaaggcaagaggauagaaccaaguugggccgauguacgaaaggaccuaauauccuacggagggggauggaaacucgaaggagaguggaaagagggcgaagaagugcaaguuuuagcguuggagccugggaagaauccuagagcaguucaaaccaaaccuggccuuuuuaaaacuaacacagggacaauuggagcggucaguuuagauuuuagcccaggaacuucuggaucaccuauaauagauaaaaaggguaaaguuguagguuuguacggcaacggaguagugacuaggagcggggcguacguaagugcgauagcacagacugaaaaguccauagaagauaauccagaaauagaagacgauauauucagaaagagaagauugacaauuauggauuuacauccaggcgcugguaaaacgaaaagauauuugccagcaauagucagagaagcuauaaagcgcggucuuagaacucuaauauuggcucccacuaggguaguggcagcggaaauggaggaggcuuugaggggucuaccaauacguuaucaaaccccugcuauaagagcggaacacacuggucgagagauaguagaucuaaugugccacgcgacguucacuaugcgacugcucucgccuguacgaguucccaauuauaaucuaauaaucauggaugaggcgcauuucacugauccugccucaauugcagcaaggggcuacauuucgacgaggguagaaaugggagaggccgccggaauauuuaugaccgcuaccccgccagguagcagagacccauuuccgcaguccaacgcaccuauuauugacgaagagagggaaauuccagagagaaguuggaacuccgggcacgaauggguaacagauuucaagggcaagacaguuugguuuguaccuaguauaaaggccggcaaugacaucgcugcgugucuccgcaaaaaugggaagaaaguaauacaguuaucgagaaaaacauuugauuccgaguauguuaaaacacguaccaaugauugggacuucguuguaaccacagacauaagugaaaugggagccaacuucaaggcugaacgaguaauagacccaaggagauguaugaaaccagugaucuuaacugauggagaggaacgagucauucucgcagguccuaugccaguaacacacaguagcgccgcacaaagaagaggacguauaggaagaaauccuaaaaaugaaaaugaccaauauauauacaugggagaaccauuagaaaacgaugaagauugugcacauuggaaagaagcuaaaaugcugcuugacaauauaaauacaccugaagguauaaucccaaguauguuugaaccagagagagaaaagguagaugcuauugacggagaguaucgcuuacguggagaagcuaggaaaacauuuguagaccuuaugcgacguggggauuuaccuguaugguuagccuacaaaguugcggcugaaggaauaaauuacgccgaccgccgguggugcuuugacgguaucaagaauaaucaaauucuagaagaaaaugucgaggucgaaauauggacuaaggaaggagagcgcaagaaacuuaaaccgagguggcucgaugcucggaucuauagugacccgcuagcgcuuaaagaauuuaaagaauuugcugcuggacggaaaucccuuacucuuaauuugauaacagaaaugggaagacugccuacuuucaugacacagaaaacuagggaugcccuagacaauuuagcuguucuccauacugcagaggccgguggucgagcauauaaucacgcucuaucagagcuuccagaaacgcuagaaacacuacuucuacuaacucuucuagcuacuguaacgggugguauuuuucucuuccuaaugaguggcagggguauuggaaaaaugacauuaggaaugugcuguauaauuacugcaucaauauuauugugguacgcucaaauacaaccacauuggaucgccgcgagcauuauauuagaguucuuuuuaauuguguuacuuauaccagagccggaaaagcaaagaaccccacaagacaaucaauuaacauauguaguaauagcaauacuaacagucguagcggccacaauggcuaaugaaaugggauucuuagagaaaacuaagaaggaucuaggucuggggucgauagcaacgcaacaaccagaaucgaauauauuggauauagaucucagaccagcgucagcuuggacuuuguaugcuguggcuacaacauuuguaaccccaaugcucaggcauaguauugaaaauucaucaguaaaugugucgcuaaccgcuauagcgaaucaggcuacuguguuaaugggacuaggcaaaggauggccacuauccaaaauggauauuggagucccacuuuuagcaauagguugcuauucacaagugaacccaauaacacuaacagcugcccuacuacuccuaguagcucacuacgcaauaauagguccuggucuucaagccaaggcuacgagagaagcacaaaaacgugcggcagcagguauaaugaaaaauccgaccguagacgguauuacuguuauagauuuagauccuauucccuacgacccuaaauucgaaaaacagcucggucaaguaauguuauuaauuuuaugugucacacagguacugaugaugcggacgacgugggcacucugcgaagcacuaacccuagcgacuggacccauaucaacgcugugggaagguaaucccggacgguucuggaauacaaccaucgcuguuucaauggcaaauauauuucggggaucguaucucgcgggagcaggcuuacuauuuaguaucaugaaaaauaccacuaauaccagacgaggaacgggaaauauuggggaaacguuaggcgagaaauggaagaguagauuaaaugccuugggaaagucagaguuccaaauauauaagaaaucgggcauucaagaggucgaucguacucuagcgaaagaagggaucaaacggggcgagacggaucaucacgcaguuucaaggggcucggcuaaauuacgaugguucguagagaggaauaugguaaccccugaagggaagguggucgaucuaggaugcggaaggggaggaugguccuauuacugugggggacuaaagaauguaagagaagucaaaggauuaaccaaaggugggcccggacaugaagaaccuaucccaaugucaacauauggcuggaaucugguuagauuacaaucaggugucgacguauucuuuauaccaccggaaaaaugcgauacgcuauuaugugauauuggugaguccucuccuaacccgacaguagaagcagggagaacguuacggguauuaaaccucguugaaaacuggcuaaauaauaauacacaguuuuguauaaaaguauuaaauccuuauaugccaucuguaauagagaaaauggaagcacuucagaggaaguauggaggugcacuuguaagaaauccguugucaagaaacucgacacacgaaauguauuggguaucaaaugcuaguggaaauauaguaagcuccgucaacaugauaaguagaauguuaaucaacagauuuaccaugaggcacaaaaaggcgaccuacgaaccugaugucgacuuggggaguggcacaagaaauauagguauugaaagcgaaauuccgaaccucgauaucauugggaaaagaaucgagaaaauuaaacaagagcaugaaacgaguuggcacuaugaccaagaccaucccuauaaaacaugggcuuaucaugguagcuaugaaaccaaacaaacagggucugcuucuuccauggucaacggcguugugcgccugcugacaaaacccugggacguuuuacccacagucacucaaauggcuaugacagauacgacaccguuuggacaacagagaguauucaaagagaagguugauacucgaacccaagaaccgaaggaaggaaccaagaaacuaaugaaaauaacagcugaauggcuuuggaaagaacucgguaagaagaaaacaccacggauguguacacgugaggaguucacucggaagguccgcuccaacgcagcuuuaggcgcaaucuuuacugacgagaacaaauggaaaucagcgcgagaagcaguagaagauagccguuuuugggaauuaguagacaaagaaagaaaucuucacuuagaaggaaagugcgaaacauguguauacaacaugaugggaaaaagggagaagaaauugggggaguuuggaaaagccaaaggaagcagagccaucugguacaugugguuaggcgcgagauucuuagaguuugaagcgcuuggauucuugaaugaagaccauugguucaguagagagaauagccuaagcggcguagagggagagggcuuacacaaguugggguauauuuugagagaugucucuaagaaagagggcggugcaauguaugcggaugauacagcgggcugggauacucggaucacgcuagaagaccucaaaaaugaagagauggugacuaaccauauggaaggcgaacacaaaaaguuagcagaagccaucuucaaacucacuuaucaaaacaagguuguacgcgugcagagaccuacuccgagaggaacaguuauggacauaauaaguagacgugaucaacgggggagcggucaaguuggaacauauggccucaacacguuuacuaacauggaggcccaauuaauuagacaaauggaaggcgaagggguuuuuaaaaauauacaacaucuuacagucacugaagaaguagcaguccacaauuggcuagcucgaguggggcgugaaagauuaucccgaauggcgauuuccggugacgauuguguuguaaaaccacuagaugaucgauuugcaaacgcacucaccgcuuuaaacgauaugggaaaaauacgaaaggauauucagcaaugggaaccuuccaaaggguggaaugacuggacacagguaccauuuuguucucaucacuuccaugaacuaaucaugaaggacggccgagugcuaguuguaccauguaggaaucaagacgaacucauugggcgggcgcgaauaagccaaggugcagguuggucuuugagagagacugccugucuuggaaaaucauaugcccaaauguggagcuugauguauuuccauaggagagaucuaagauuagcagcuaacgcaauuugcucagcaguuccaagccacuggguuccaaccagccgaacaacauggucaauacaugcgaaacaugaauggaugacaaccgaagacaugcucacgguauggaaucguguuuggauaagggagaacccuuggauggaagacaagacgccgguagaaucaugggaagaaauuccuuaucuagguaagagggaagaucaauggugcgggagucugauuggacucacaucaagggcaacaugggccaaaaauauacaagcggcgaucaaucaaguuagguccuuaauaggaaaugaagaauacacagauuauaugccuagcaugaaaagauuccggagggaagaagaggaagcugguguguuaugguaa

SEQ ID NO: 22760 - RNA, 9876 nt, Artificial Sequence
  derived and/or modified CDS sequence (opt6) from DENV-2__EU482776__SS-prME
agugcgggaaugauuauuauguuaauuccaacaguaauggcauuucacuuaacaacacguaacggagaaccacauaugauaguugguauucaagaaaaagguaaaaguuuacuauuuaaaacagaagauggaguaaacauguguacacuaauggccauggacuuaggagaauuaugcgaagauaccauaacuuauaaauguccguuacuacgucaaaaugaaccagaagauauagacugcuggugcaauucaacauccaccuggguaacauacggcacgugcacgacaacaggagaacaucgcagggagaaaaggucaguugcucuaguaccacacguugggaugggauuggaaacucgaacugaaacauggauguccucggaaggggcuuggaaacacgcacaaagaauagaaaccuggaucuuaagacacccuggguucacaauuauggcagcaauuuuagcuuauacaauaggaacgacacacuuccagaggguacuaauauucauucuacuaacagccguagcaccaaguaugacuaugcgaugcauugguauuagcaaccgagacuuugucgaagguguuuccggggguaguuggguagauaucguucuagaacacggcucauguguuacuaccauggcgaaaaacaaaccuacucuagacuuugaauugauaaaaacagaagcuaaacaaccagcuacuuuaagaaaauauuguauagaagcaaaacuaaccaauacaacaacagaaagcagaugcccgacacaaggagagccgucguuaaaagaggaacaagauaaaagauucgucugcaaacauucuaugguagauagagguuggggaaacggguguggucuuuucggcaaaggaggaauagugaccugugccauguuuacauguaagaaaaauauggaagguaaaaucguacagcccgagaaucucgaguauacgaucguuguuacgccacacucaggcgaggaacaugcuguagggaaugauaccggaaaacacggaaaagaaauuaaaguaaccccucaaucuucgauuacugaagcagagcuaacuggcuacggaacuguuacaauggaaugcaguccucggaccgggcuagauuucaaugaaaugguguuacuucaaauggaaaauaaagcauggcugguccacagacaaugguuccuugauuuaccauuacccugguugcccggugcagacaaacaagaaucuaauuggauacaaaaggagacucuggucacuuucaagaacccacacgcaaagaaacaagauguagucguuuuagguucccaagaaggagcaaugcauacggcguuaacuggagcgacagaaauacagaugaguucagguaaccuacuauucaccggacacuuaaaguguagacuaaggauggauaaauuacaacuuaaggguaugagcuauucaaugugcacuggaaaguucaagguaguaaaagaaauagcagagacccaacaugggacgauagugaucagaguucaauacgaaggagauggaaguccuuguaagaucccauuugagaucauggauuuagaaaagagauauguacucgguagguuaauaacaguaaauccaauagucaccgaaaaagacucaccaguaaauauagaagcggaaccaccauuuggugauagcuauauaauaauaggcguagagccaggccaguugaaauuaaauugguuuaagaaaggcucgucaauaggccaaauguuugaaacaaccaugagaggagcuaaaagaauggccauauugggagacacugcuugggauuucgggagucucggaggaguauuuacaaguauuggcaaggcguuacaccaaguauucggugcaauauacggagcagccuuuuccggaguaucauggacaaugaagauccuuauagguguuauuauaacguggauugguaugaacucacgcaguacauccuuaucaguaucucuaguucuuguuggaauagugacacuauaccucgggguaaugguacaagcugacagcggaugcguaguaucuuggaaaaacaaagaacuuaaguguggaucagggauuuuuauaacggacaauguccauaccuggaccgaacaauauaaauuucagccagagaguccaagcaaguuggcuucagcaauucaaaaggcacaagaagaagguauuuguggcauucgcucaguuacccgucuggaaaaucugauguggaaacaaauaacaccagaacugaaccacauccucgcagaaaaugaaguaaaguuaacaaucaugacaggugauauaagggguauuaugcaggcggguaaaaggucauuaaggccccagccuacugaacucaaauacucauggaagacauggggaaaagcaaagauguuguccacagagaguuacaaccaaacauuccuaauugauggaccggagacagcggagugccccaauacuaaucgagcuuggaacucccuggaaguagaagauuacggauuuggaguauucaccacuaauauuugguuaaaacuaaaggaaaaacaagaugcguucugugacaguaaacuaaugucagcagcaauuaaagauaacagagcaguccaugcagauaugggauauuggauagagagcgcuuuaaacgauacuuggaaaauagagaaagcaucauucaucgaggucaaaaacugccacuggccgaaaagucauacauuauggucaaauggaguacucgagucugaaaugauuauacccaaaaaucuggcaggaccaguaucacaacauaacuaucguccagguuaucacacucaaauagcagggcccuggcaccugggaaaacuugaaauggauuuugauuucugcgacgguacaacaguuauaguuaccgaggacugugguaauagagggccaagucuacgaacgacaacugccucagguaaacuaaucacugaguggugcugucgcucauguacguugccgccucucagguauaggggagaagacggcugcugguacgggauggaaauacguccacuaaaagaaaaagaagaaaaucuaguuaacucuuuaguuaccgcuggacauggacagguagauaauuucucuuugggcgugcuaggaauggcauuguuucuagaagaaaugcuuagaacaagaguugguacaaagcaugcaauucuucucguugccgucucauucguaacauuaauuacgggaaauaugagcuuuaaggaucucgguagagucguaguuauggugggggcuacgauggcugacgauaucgguaugggcguaacauaucuagcauuacucgcagccuacaaagugcguccuaccuuugccgccgguuuguuauuaagaaaacuaaccaguaaagagcucaugaugacaacaaucgggauagucuugcucucgcaauccacgauaccggaaacuguauuagaauuaacagacgcauuagcguuagguaugauggugcuuaagauaguuaggaauauggagaaguaucaacuagcgguaacuauaauggccaucuugugcgugccgaaugcggucauccuccaaaacgcuuggaaggcuuccuguacaauacuagcaguugucucgguaaguccgcuacuauugacaucaucucaacagaaaaccgauuggauucccuuagcacuaacgaucaagggucuuaauccuacggcuauuuuccucacuacacugagucgcacaaacaagaaacgaucguggccucuaaacgaagcaauuauggccguagguauggugucaauuuuggcuucgagucugcucaaaaaugauauucccaugaccggaccguugguugcugguggacuccuuacaguuuguuauguauugacaggcagaucugcagaucucgaguuagaacgcgcaacggacgugaaaugggaagaucaagcagaaauuucgggcagcucuccaauucuauccauaacgauuucggaagaugguucaaugucuaucaaaaaugaagaggaggaacagacauuaacuauacucauuagaacagggcuauugguuauaucggggcuauuucccauuucaauaccuaucaccgccgcagccugguaucuaugggaagucaagaaacaaagggcaggaguauuaugggauguaccaucaccaccaccaaugggaaaggcagaacuugaagauggcgcauacagaauuaaacaaaaagguauucucggauacagucagauaggagcgggaguauauaaagaaggcacauuucauacuauguggcacguaacacgaggggcaguacuuaugcacaaagggaagcguauugaaccgucuugggcagacgucaaaaaggaccugauaucauacgggggcgguuggaagcuagagggagaguggaaggaaggugaggaaguacagguacuugcacuagagccuggcaagaauccacgagcuguccaaacuaaaccgggauuguuuaaaacuaauacuggcacuauaggggcagucucgcuagacuucucccccggcacaucugguucaccaauaauugauaagaaagggaaaguuguaggcuuauacggaaauggcgucgugacaagaucgggagcguaugucucagcaauugcacaaacugaaaaaucgaucgaggauaaucccgaaauagaagaugacauuuuccgaaaacgacguuuaacuauaauggaucugcacccuggcgccggaaaaacuaagagauaucucccugcaauuguuagggaggcgaucaaaagagguuuaaggacucuaauauuagcaccuacucggguaguugcagcagaaauggaagaggcuuugagaggauuaccuauacgauaccaaaccccggcaauaagagcagaacauacuggcagagaaauaguugaccugaugugccacgcaacauuuacaaugagauuauugucgccagugcguguaccaaauuauaaucucauaauaauggacgaggcgcauuuuacggauccugcaucaauagcagccagaggauacauuucuacucgaguagagaugggagaagcggcggggauauucaugacagcuacaccuccaggaucuagagacccuuuuccucaguccaacgcaccaauuauagaugaagaaagagaaauaccugaaagauccuggaacaguggacaugaauggguuacagauuucaaagggaaaaccguaugguucguuccaagcauaaaagccggaaacgacauugcagccugcuuaaggaaaaauggcaagaaaguuauucaacucucacgaaaaaccuuugauuccgaauacguaaaaaccagaacaaacgacugggacuuuguuguaacgacugacauuucagaaaugggagcgaauuuuaaggcggaaagaguuauagauccgcggaggugcaugaaaccugugauacuuacagauggcgaagaaagagucauauuagccggaccaaugccuguuacacacaguucagcggcacaaagacgaggccggauugggcgaaaccccaaaaaugaaaaugaccaauacauauacaugggggaaccauuagaaaaugaugaagacugugcacauuggaaagaggcaaaaaugcuacuugauaauauaaacacaccagaaggcauaauaccuucuauguuugaaccugaacgugagaaggucgacgccauugauggagaauaucgauugcgcggggaggcgcguaaaacauuuguagaucuaaugcgaaggggugauuugccuguauggcuugcauauaagguagcggcggagggaauuaauuacgccgaccgaagauggugcuucgauggaauuaaaaauaaccaaauacuggaagaaaacauggaaguagaaauuuggaccaaagagggcgaaaggaagaaacuaaaaccgagauggcucgaugcaagaauuuacuccgauccauuagcgcuuaaagaguuuaaagaauuugcggcaggacgaaaaucauuaacucucaaucuuauaaccgagaugggcagacuucccacauuuaugacgcagaaaacaagggacgcccuugacaauuuagcuguccugcacacggcugaagccggggguagagcguacaaccaugcacuaucugagcuccccgaaacauuagaaacacucuuacuucucacgcugcuugcaaccgucacagggggaauauuuuuauuccucauguccggaagaggaauuggcaaaaugacauuaggaauguguuguaucauaacggcaaguauacuuuuaugguaugcgcaaauucaaccgcacuggauugcugcaucaauaauuuuggaguucuuucucauaguauuauugauuccagaaccggaaaagcagagaacaccgcaagauaaccaauugacguacguagugauagccauacuuacuguuguagcggccacaauggcaaaugagaugggauuccucgaaaagacaaagaaagaucuaggucuuggcucuaucgcuacgcagcaacccgaaaguaacauacucgauauagaccuaaggcccgccagugcauggacucuuuacgccguggcgacuaccuuuguaacaccaaugcucagacacucaaucgagaacaguuccguaaacgugagcuugacagcuauagcaaaccaggcuacuguucuaauggguuuagguaaaggauggcccuuaagcaaaauggauauaggggugccacuucuagcaauaggaugcuacucccaaguaaauccuauaacccucaccgcggcucuacuuuuacuuguagcacauuacgcaaucauugguccuggucuccaagcaaaagcuacccgagaggcacaaaaacgggcagcggcagguaucaugaagaauccaacaguggacggaauuacaguuauugauuuagauccaaucccuuacgaucccaaauuugaaaaacaguugggacaaguaauguugcucauacucuguguuacacaagucuuaaugaugagaacaaccugggcuuugugcgaggcccuaacuuuggcuacaggaccgauaaguacguugugggaagguaaucccggcagguucuggaacacaacgauagcgguuagcauggcgaauauuuuuaggggaaguuaucucgcaggagcuggauuacuauuuaguauaaugaagaauacuaccaauacacgaagagguacaggaaacauuggagagacauugggcgagaaauggaaaucucgauugaacgcgcucggaaaauccgaguuccaaauauacaagaaaagugguauucaagaaguagaucggacccuugcaaaagaagguaucaagcgaggugaaacugaucaucacgcugugucaagagguagugcuaaacugcgaugguuuguagagaggaacaugguuacacccgaggggaaagucguagaccuuggaugcggucguggagguuggagcuauuacugcggaggacuuaaaaauguacgugagguuaaaggucuaacaaaagguggaccaggacaugaagaaccgauaccgaugucuacuuauggauggaauuuagucagauuacagucaggaguagauguauucuucauacccccagaaaaaugcgauacucugcucugugauauaggagagucaucucccaauccgacagucgaagcgggaaggacucuuaggauccuaaaccuuguagaaaauuggcuaaacaacaacacccaguucuguauuaaaguacuuaaccccuacaugccuucuguaauagagaaaauggaagcacugcaacggaaguacggaggcgccuuaguucgcaaccccuuaagccgaaauaguacacaugagauguauuggguuucaaacgcuagcgguaauauagucucuucggugaacaugauaucgcgaauguuaauuaauagauuuacaaugagacauaagaaagcgacauaugaaccagauguagaccuggguuccggaaccagaaauaucggcauagaauccgaaauccccaacuuagauauaauaggaaaaaggauagagaaaauaaaacaagaacaugaagcaucguggcacuacgaccaagaccaucccuacaagaccugggcauaccacggcucuuaugagacuaaacagacaggaagugcaucuucaauggugaaugggguugucagacuccuuaccaaaccuugggauguccuaccgacgguuacucaaauggcgaugacggauacgacaccuuucggacagcaaaggguauucaaagaaaaaguagauacuagaacccaggagccaaaagaagggacaaagaaacuaaugaagauaacggcagaauggcuauggaaagaacugggcaagaagaaaacaccuagaauguguacaagggaagaauuuacccgaaaagucaggucaaaugcagcacuaggcgcuauauuuacagacgaaaauaaauggaaaucagcaagagaagcuguggaggauucccgauuuugggaacugguggacaaagaaagaaaucuacaucuagagggaaaaugugaaacgugcguauauaacaugauggggaagagagagaagaaauuaggugaguuuggcaaagccaagggauccagagcaauaugguauauguggcuaggggcacgauuucuggaauuugaggcauuaggauuccuaaaugaagaucauugguuuucaagggagaauagucuuagcggaguagaaggagaagguuuacacaaauuggguuauauauuaagagaugucucaaagaaggagggcggcgcaauguaugcugacgacaccgcaggaugggacaccagaauuacacuagaggaucucaaaaaugaagaaaugguaacgaaccacauggaaggagaacauaagaaauuagcagaagcuauauuuaaauugacguaucagaauaaagucguacgaguucaaagaccaacgcccagaggaacaguuauggauaucauuagcagacgagaucaacgggguucaggacaaguagguacguacggucuaaauacguucacuaacauggaagcacaauuaaucaggcaaauggaaggggaaggcguuuucaagaauauacagcacuuaacagucacagaggagguagcuguccauaacugguuggcucguguuggcugcgaaagacuaagucgaauggcaauauccggagacgacuguguuguuaaaccacuagaugauagauucgccaaugcguuaacagcacuaaaugauaugggaaagaucagaaaagacauacaacagugggagccaucaaaaggcuggaaugacuggacccaaguuccauuuuguagccaucacuuccaugagcuaauuaugaaagauggaaggguacucgucguaccuugcagaaaccaggaugagcuaaucggcagagcgcgaauaucacaaggggcggguuggucccuaagagaaacagcguguuuaggcaaaucguaugcacaaauguggaguuuaauguacuuucauagacgugacuuacguuuggcagcaaaugcaauaugcagcgcugugccaucacauuggguaccuaccagucgaacgacauggucaauccacgcuaaacaugaauggaugacuaccgaagauauguuaacagucuggaauagaguuuggauacuagaaaaucccuggauggaagauaaaaccccaguagaaucgugggaagaaauaccauauuuaggaaaaagagaagaucaaugguguggaucacuuauaggguugacaaguagagcaacaugggcgaaaaacauacaggcggcuauaaaccaaguacgcagucugauaggaaaugaggaauauacagauuacaugccaagcaugaagagguucagaagagaggaagaagaagcgggagucuuaugguaa

SEQ ID NO: 22761 - RNA, 9876 nt, Artificial Sequence
  derived and/or modified CDS sequence (opt6) from DENV-2__EU482777__SS-prME
agugcaggaaugauuauaauguugauuccaacugugauggcauuucacuuaacaacgagaaauggagaaccacauaugauuguaggaauacaagaaaaaggaaaaucacuacuauuuaaaacggaagacggaguaaauauguguacguuaauggcaauggauuuaggagaauuaugugaagauacuauaacauacaaaugcccgcuuuuacgacaaaaugaaccagaagacauagacuguuggugcaauucaacgucuacauggguaacauacggaaccuguacgaccacaggggaacauagacgagaaaaacgaucggucgcucuagugccucacguagguaugggucuagaaacacggacugaaacuuggaugagcuccgaaggggcauggaaacaugcgcagagaauugaaacuuggaucuugagacauccaggauucacaauuauggcggcaauucuagcauauacgauaggaacaacccauuuucaaagaguguuaauauucauuuuauuaacugcuguugcuccuaguaugacaaugcgcuguauuggaauuucaaauagagauuuuguggaagguguuucggguggaucaugggucgauauuguccuugaacauggaucuugcgugacaacuauggcuaaaaauaaaccuacccuugauuuugaacuaauuaaaacugaagcaaaacagccggcaacccuacgaaaauauuguauugaagcaaaauuaacgaauacuacaaccgaaucacgcuguccgacucagggugaaccgucccugaaagaagaacaagauaaacgcuucguuuguaaacauucgauggucgaccgaggauggggaaacggguguggccuauuuggaaaaggagguauaguuacaugcgcaauguucacauguaagaaaaauauggaaggaaaaaucguacagccagaaaacuuagaauacacaauagucguaacaccccacucaggagaagaacaugcugugggcaaugauacaggaaagcacggaaaagaaauaaagguaaccccucaaagcucaaucaccgaagcugaacuaacagguuauggaaccguaacuauggaaugcucuccacguaccggguuagauuuuaacgagaugguacuuuuacaaauggaaaauaaggcuugguuaguucaccgccaaugguuucuagaucuaccguugccaugguuaccuggagcugacaaacaagaaagcaacuggauucaaaaggaaacucucguuacauucaaaaauccucacgccaagaaacaggaugugguagucuuaggaagccaggagggggcgaugcauacggcauuaacuggggcuacagaaauccaaaugagcuccgguaaccuuuuauucaccggacaucucaagugcagacuuagaauggauaaacuucaauugaaaggaaugucuuauagcauguguaccggaaaauucaaaguugucaaagaaaucgcagaaacccaacauggaaccauaguuauaagagugcaauacgagggcgacgguucccccugcaaaaucccauuugaaaucauggacuuagaaaaacguuauguccuaggucguuuaauaacugucaacccuauaguuacagagaaagauucuccuguaaauauugaagcagaaccgccauucggugauucuuacauaauaauaggggucgagcccggacaguuaaaacuaaacugguuuaagaaagggagcaguaucggucaaauguuugagacuacuaugagaggagccaaaagaauggcgaucuugggggacaccgccugggauuucggaucacuuggggguguguucacuagcauuggaaaggcguuacaucaaguuuucggagcuaucuauggagccgcuuucucaggaguuucauggacaaugaagauacuaauaggagugauaauaacauggauugggaugaacaguagaaguacuucacuuucggugagccuugugcuugugggaaucgucacucuuuaucucggagucaugguccaagcagacucaggcuguguuguaucauggaaaaacaaggaauuaaagugcgguagcggcaucuuuauaacagacaacguucacacauggaccgaacaauacaaauuucaaccugaauccccuucaaaauuagcuagcgccauccaaaaagcacaggaggaagggauauguggaauacgcucuguaacacgauuggaaaaucuaauguggaaacaaaucaccccagagcuaaaucauauucuagcugaaaacgaaguaaaauuaacaauuaugacaggagauauaaaagggaucaugcaagcgggcaaaagaaguuuaaggccacaacccacagaguuaaaguauucguggaaaacauggggaaaagcgaaaauguuaucaacagaaucuuacaaccaaacguuccuaauugaugguccagaaacagcggaguguccaaacacgaaccgugcuuggaacucuuuagaaguugaagauuauggauucgguguuuucacaacaaacauuuggcuuaagcuaaaagagaaacaagaugcauuuugugauaguaaauugauguccgcagcaauuaaagacaauagagcaguccaugcugacauggguuauuggauagaaucugcgcuaaaugauacuuggaaaauagagaaggcuucauucauugaagucaaaaauugucauuggcccaagucgcauaccuuguggucaaaugggguucucgagucggaaaugauuauucccaaaaaccuugcuggcccgguaucucagcacaauuauaggccaggauaccacacccagaucgccgggcccuggcaucucgguaaauuagagauggacuuugacuuuugcgaugggacaacaguaauuguaacagaagauugcgggaauaggggcccaucauuaaggacuacaacagcuagugguaaacuaauuacagaauggugcugcaggucaugcacucuucccccgcuucgcuaccgaggagaagacggcugcugguacggaauggagaucaggccauugaaagaaaaggaagagaauuuaguaaacagucuaguaacagccggacauggccaaguggacaacuuuucguuaggaguucucggaauggcccuguuucuagaagaaaugcuaagaacucgcgucggaacgaaacaugcgauauuauuaguagcaguaaguuuuguuacgcuaaucacaggaaauaugucuuuuaaggauuugggccguguaguaguaauggucggugcgacaauggcagaugacaucggaauggggguaacauauuuagcguuauuagcugcguucaaaguacgaccgaccuuugcugcaggccuauuacuaaggaaacucacauccaaggaauuaaugaugacgacaauaggaaucguacuacuaucacaaaguacaaucccugaaacagugcuugaacuaacagacgcacuagcguuaggaaugaugguccugaaaauaguaaggaauauggaaaaauaucaacucgccgucacuaucauggcaauauuguguguuccaaaugcagucauacuacaaaaugcauggaaaguuucauguaccauauuggccgucguaagugucucuccgcuauugcuaaccaguagucagcagaaaacggauuggauaccgcuagccuuaacaauaaaaggauuaaauccaacugcaauauuccuuaccacguugucaagaacgaauaaaaagagaucuuggccacuaaacgaagcuaucauggcaguugguaugguaaguauauuagcuucuagccuuuugaaaaaugacauaccgaugacggggcccuuggucgcaggcgguuuacucaccguuuguuauguuuuaacaggucggucagcagaccuugaguuggaacgagcgacagauguuaaaugggaggaucaagcagagauuuccggaucgaguccuauauuaucaaucacaauuuccgaagaugggagcaugagcauuaaaaaugaagaagaagaacagacauuaacuauacuuauccgcacuggcuugcuaguuauaucagguuuauucccuauaucuauacccauuacagcagcugcaugguaucuuugggaagucaagaaacaacgagcugggguauuaugggacgucccaucuccgcccccuauggguaaagcugaguuagaagauggagcguauagaaucaagcagaaggguaucuuaggcuacagucaaauaggagccgguguauauaaggaagggacuuuccacacaauguggcacgucacacguggagcugugcugaugcacaagggaaaacgaauagaaccgaguugggccgauguuaagaaagauuuaaucucauacggcggugguuggaaauuagaaggagaguggaaggaaggagaagaagugcagguacuagcacucgaaccugguaagaauccaagggcaguacagacaaaaccgggacuauuuaagacaaacacuggaacaaucggggcaguaucacuugauuuuucuccagguacaucagguucaccgauaauugacaaaaagggaaaaguaguaggacuguauggcaaugguguaguaacaagaucaggagcauauguuagugcuauagcucagacagagaagaguauagaggauaauccagaaauugaggaugauauauuccgaaagaggcgucuuacuauaauggaucuacacccuggagcugguaaaacaaaacgauaucuaccugcaaucguacgagaagcuauuaagaggggccuacgcacauuaauauuagcaccaacaaggguaguugccgcagagauggaagaagcgcuacgggguuuaccgauccgauaucaaaccccagcgauuagagcagagcacacaggacgugaaaucguggaccuuaugugucaugcaacguucacaaugagacuccucucaccaguaagaguaccaaauuauaauuuaauuaucauggaugaagcccacuuuacugacccugcaagcauugcagccagagguuacaucucuacaagaguagaaaugggagaggccgcagguauauuuaugacagcaacuccaccagggucgagagaccccuucccacaaucgaaugccccgauaauugacgaagagagggaaauaccggaaagaucauggaauagcgggcaugagugggugacggauuucaaaggcaaaaccguuugguuuguaccgucuauaaaagcgggaaacgauauagcugcaugucugaggaaaaauggcaagaaaguuauucaguuaagucgaaagacguuugacagugaauauguaaaaacccgaaccaaugauugggauuucguaguaacaaccgacauaagcgaaaugggagcuaacuuuaaggcagaacgaguaauugauccaaggagauguaugaaaccaguaauccugaccgauggagaagagaggguuauacuagcggguccaaugccagucacucauaguagcgccgcccagcguagaggaagaauaggaagaaacccgaaaaaugagaacgaucaguauauauauaugggcgaaccguuagagaaugacgaagauugugcgcauuggaaagaagccaaaaugcuucuagauaacaucaauacuccugaagggauuauaccaaguauguucgaaccagaaagggagaaagucgaugccauagacggagaauauagauugagaggggaagcacguaaaacuuuugucgaccucaugaggagaggugaucuccccguuuggcuagcuuauaaaguugcagcugaagggauaaauuacgcugauagaagaugguguuucgacgguaucaaaaacaaucagauucuagaagaaaaugucgagguagaaauuuggacgaaagaaggagaacguaagaaauugaaaccucggugguuagaugcaaggauauauucagauccucuugcauugaaagaauuuaaagaauuugcagcaggcagaaaaucuuuaacuuuaaauuuaauuacggaaauggguagacuaccaaccuucaugacacagaaaacaagggaugcauuagacaacuuagcaguccuccauacagcagaggcaggcgguagagcauauaaucaugcauuaucagaacuuccugaaaccuuagaaacucuauuguuauuaacacuccuugcuacagugaccggaggaaucuucuuauuuuugaugaguggcaggggaauaggcaagaugacacuaggaaugugcugcauaauaacagcgagcauauugcuuugguacgcccagauucaaccucacuggauagcagccucuauaauucucgaauuuuucuuaauaguacuacugauaccggaaccugaaaaacagaggacuccacaagauaaucaacuaacauaugucgucauagcuauauuaacuguaguagcagcaacuauggcaaaugaaaugggguucuuagagaaaacuaaaaaggacuugggauuaggcucaauugcgacacagcaaccggaaagcaauauucuugacauagaccugcgaccggcgucagcauggacucucuaugcaguagcaaccaccuuugugacacccauguuacgacacucaauagagaacaguucaguaaacguaagucuaacagcuaucgcaaaucaagccacgguuuugaugggcuugggaaaaggauggccuuugucgaaaauggauaucgggguaccacuguuagcaauaggcuguuauagccaaguaaaucccauaacucugacagcagcacuauuacugcuuguagcccauuacgcuauuaucggacccgguuugcaagcgaaggcaacgagagaggcgcagaaacgagcagccgcaggaaucaugaagaacccaaccguagauggcauaacgguuauagauuuagaucccauaccauacgaccccaaguuugagaaacaauuaggacagguaaugcuuuuaauauugugcgucacgcagguacucaugaugcguacuacaugggcacuaugcgaggcauuaacacucgcuacuggacccaucucuacccucugggaagguaacccaggcagauuuuggaauacgacaauagcaguuuccauggccaauaucuuccgcgguuccuaccuagccggggcgggacuguuauuuagcauaaugaaaaauacaacaaauacaaggagaggaacggggaauaugggugagacacuaggagaaaaauggaaaaguaggcucaacgcucuaggcaaaagcgaguuccaaauauacaagaaaagugggauucaagaggucgaucgaacgcuugcuaaagaaggaauuaagcgaggggaaacggaucaccacgcgguaucgcgcgguucagcuaagcuccgaugguucgucgaaagaaacaugguuacaccggaagguaaaguuguugauuuaggcugugggaggggagguuggucauauuauugcgguggucucaaaaacguaagggaaguaaaaggacuuacuaaagguggaccuggacaugaagaaccuauacccaugucaacauauggauggaaucuggucagauuacaaucugggguagacgucuucuuuauaccaccagagaaaugcgauacucuccuaugugauaucggugaauccucccccaauccaacgguugaagcgggacgaacacugcgcguauuaaauuugguagagaacugguuaaacaacaacacucaauuuuguauaaaaguucugaauccauauaugccaucagucauagagaagauggaagcacuacaaagaaaauaugggggagcccuaguaagaaacccgcucucacgcaacaguacacacgaaauguauugggucagcaacgccucuggaaacaucguaucaucuguuaauaugauaucaaggauguuaaucaaccgauucacaaugagacacaagaaagcaacauaugaaccagauguagaccuaggaucaggcacaagaaauauagggauagaaagugaaauuccaaaucuagacaucaucggaaaacgaauagagaaaauuaagcaagaacaugaaacuucguggcacuaugaccaagaccacccauauaaaacgugggcuuaucacggaagcuaugaaaccaaacaaacugggagcgccucaagcaugguuaacggugucguuaggcuauuaacaaaaccuugggauguacuaccgaccguuacucaaauggccaugacggacacuacaccguucggucaacaaaggguuuuuaaggaaaaaguagauacuagaacucaagagccaaaggaaggaacaaagaaauuaaugaaaauaacagcugaaugguuguggaaagaauuggguaaaaagaaaacuccaaggauguguacaagagaggaguuuaccagaaaaguaaggucaaaugccgcauuaggagcaauauucacugaugagaauaaauggaaaucggcaagggaggcuguugaagauucgcgauucugggaacucguggauaaagaaagaaacuugcaccuagaagguaaaugcgagacuugcgucuacaacaugauggguaaaagggagaagaaacuaggggaauuugggaaagcaaaagguaguagagcuauaugguauaugugguuaggagcaagauuucuggaguucgaagcucuuggcuuccuaaaugaagaucauugguuuagucgugaaaauucccuaucugguguugaaggugaggggcuacacaaguuagguuacauacuaagggacgugucuaagaaagaaggcggagcgauguaugccgacgauacagcgggaugggauacacggauaacgcucgaagaucucaagaaugaggagauggucaccaaccacauggaaggagagcauaagaaacuggcugaagcuaucuucaaacucaccuaucagaauaaaguagugagaguccaaagaccaacuccgcguggaacgguaauggauaucauaucucgaagagaucaaagagguucaggacaaguaggcacauacgguuuaaauacauuuaccaacauggaagcucaacucauaaggcaaauggaaggagaaggaguuuuuaaaaauauucaacaucugacuguaaccgaggaaguugcggugcagaauuggcucgcuaggguuggaagagagcgauugagcagaauggcaaucucaggggacgacuguguagucaaaccgcuagaugauagauucgcuaaugccuuaacagcguugaaugauaugggcaaaauacgaaaagauauucagcaaugggaaccgagcaaagguuggaacgauuggacucaaguaccauuuuguagucaucauuuccacgaauuaauaaugaaagaugguagagucuuaguaguaccauguaggaaccaggacgaauuaauagggcgugcccgcaucagccaaggagcuggauggucacuacgcgaaacagcgugccuugguaaaagcuaugcgcaaauguggucucuuauguauuuucauagaagagacuuaagguuagcagcaaaugccauauguagugcaguuccuagucauuggguuccuacaucacgcaccacguggagcauacacgcaaaacacgaguggaugacaacggaagauaugcuuacaguauggaaucgaguuuggauaagagagaacccauggauggaagacaaaacgccugucgagucuugggaggaaauuccauauuuaggcaaacgagaagaucagugguguggaucauuaaucgguuuaacuucccgagcgacaugggcuaaaaacauccaagccgccauuaaccaaguucgcagucuaaucggcaacgaggaauauacagauuauaugccaagcaugaaaagauuucggagagaagaagaagaggcaggaguucuaugguaa

SEQ ID NO: 22762 - RNA, 9876 nt, Artificial Sequence
  derived and/or modified CDS sequence (opt6) from DENV-2__EU482778__SS-prME
acggccgguguaaucaucaugcuaauaccgacugcaauggcauuccaucucaccacgcggaauggugaaccucauaugauugugggaagacaggaaaaaggaaaaaguuugcuuuucaaaacagaagauggaguaaauaugugcacauugauggcaauagacuuaggagaauuaugcgaagauacaauaacguacaaaugcccucuacucagacaaaaugaacccgaagauauagauugcugguguaacucuacuucaacuugggugacguauggaacauguaccacaacaggagaacaccgucgcgagaaaagaucuguugcacuuguuccccaugugggaaugggauuagaaaccagaacagaaacguggauguccuccgagggugcauggaaacacgcucaaagaaucgaaacuuggauccuucgccacccuggauuuacgauaauggcagcgauccuugcauauacaguaggaacaacacacuuucagagggcacuuauuuuuauacuucuggccgccgucgcaccaucaaugacaaugcgauguauagguauuucgaacagagacuuugucgaaggaguaucaggagguagcuggguugacaucguuuuagagcaugguaguuguguaacuacuauggcgaaaaacaaacccacacuagauuuugaacuuauuaaaaccgaagcaaaacaaccggcaaccuugcggaaauauugcauagaagcaaagcuaacaaauacuaccacagaaagccgaugcccaacacaaggagagccaaguuugaacgaggagcaagauaagcgauuuguauguaaacauaguaugguugauagaggauggggcaacggauguggucucuuuggaaaaggcggaauaguaacaugugcuauguucacauguaagaaaaacauggaagggaaaauaguccaaccagagaaucucgaguauacaauaguaauaacuccacauucaggcgaagaacaugcaguaggaaaugauacagguaaacauggaaaagaaaucaaaauuacaccacaaagcccaauuacagaggcagaacuaacaggguauggaacaguuacgauggaaugcaguccucgaaccggccuugauuuuaaugagaugguucuacuacaaauggaagacaaagcgugguuagugcacagacaaugguuccuagacuugcccuugccauggcugccaggagcagacacucaaggaucgaauuggauacaaaaagaaacguugguaacauucaagaacccgcaugcuaagaaacaagacguugucgucuuaggaagccaagagggcgcaaugcauacagcguuaacgggggcaacagaaauucaaaugucaagcggaaaccuauuguuuacaggccacuuaaagugcagguugagaauggacaaacugcaguuaaagggaaugaguuauucuauguguaccggaaaauucaaaaucguaaaagagaucgcugaaacacaacaugguacgauagucauuagaguacaauacgaaggagacggaagccccuguaagauucccuuugaaauaauggacuuagagaaacgccacguccuuggacgauuaauaaccguuaacccaauaguaaccgagaaagauaguccggugaacauagaggcagaaccaccuuuuggagacaguuacauaauuauuggaguugaaccuggacaguuaaaacugaacugguuuaagaaaggaagcaguauuggacaaauguuugaaacaacaaugaggggagcgaagaggauggcgauacuaggcgacacugcuugggacuucggcagucuuggugggguauucacaaguauuggcaaagcacuucaucaaguauuuggugcaauauacggcgcagcauuuucuggaguuucuuggaccaugaagauccuaauaggaguuaucaucacuuggauugguaugaauagccgaucgacaaguuuaagugugucccuuguacuggucgguguaauaacacuauaccuaggugcaaugguucaggcugauagcggaugugucgugaguuggaaaaacaaagaauuaaaguguggcaguggaauauucaucaccgauaacgugcacacuuggacagaacaauauaaguuucaaccugaaaguccauccaaguuggccagcgcgauacaaaaggcucaugaggaaggaauaugcggcauaagaagcguaacgcgauuagaaaacuuaauguggaagcagauaacuccagaauugaaccauauacucucugaaaacgaagucaaacucacgauuaugaccggggauauuaaagggaucaugcaggcaggaaaacgaucuuugcgaccccaacccacagagcucaaauauagcuggaaaacaugggggaaagcaaaaaugcuaucaacagaaagccacaaucaaaccuuucucauugacggcccugaaacagccgaauguccaaacacuaaucgagcauggaauagucuagaaguggaagauuauggauuuggcguuuuuacaacaaacauaugguugaaacuuagagaaaaacaagacguguuuugugauuccaaauuaaugucugcagcaauaaaagacaacagagcugugcaugcugauauggguuauuggauugaguccgcacucaaugauacuuggaaaauggaaaaggcaucauuuauugaggucaaaaauugucauuggccaaaaagccauacacucuggucaaauggaguguuagagagugaaaugaucaucccaaaaucauuugcgggaccagugucccaacauaacuaccguccuggguauuauacccaaacugcaggacccuggcacuugggaaaacucgaaauggauuuugacuuuugugaaggcacuacggugguaguuaccgaagauugugguaaucgagguccgagucuuagaacaacuacagccucagggaaauuaaucaccgaguggugcuguagaucuuguacacuaccaccacuccgguauagaggugaagauggauguugguaugggauggaaauacggccguuaaaggagaaagaggaaaauuuggucaacucguuagucacugcagggcaugggcaaauagauaauuuuucauuaggcguguuggggauggcacuguuccuagaggagauguuacguacccguguuggcaccaaacacgcgaucuuauuggucgcaguuucauuuguaacgcugauaacgggaaauaugaguuuccgagaucugggacgaguuaugguaauggucggugcagcuaugacggacgacauagggaucggcguaacguaccuagcucuauuagcagcauucaagguucgaccaacuuucgcugcaggauuauuauugcgaaaguuaacaucgaaggagcugaugauggcuacaauuggaauagcucuauuaucacagagcaccauuccagaaacaauacuagaacugaccgaugcauuggcgcuaggcaugaugguguuaaagaucguucggaacauggaaaaguaucaauuggcgguaacuauaauggcuauaagcugcguuccgaacgccguaaucuugcaaaaugcguggaaaguuuccuguacgauauuagcaaccguaucgguuagccccuuacuucuaacaaguucccaacaaaaagccgacuggaucccuuuggcauugacgauuaagggguugaauccuaccgcaaucuuccuuaccacucuuagccgaaccuccaagaaaagauccuggccacuuaaugaagcuauaauggcugucggcaugguaucuauacuugcaucuagucuucuaaagaaugauauaccaaugacugggccauugguagcagggggacuucuuaccguuuguuauguacuaacaggucgguccgcugacuuagaauuagaacgagccacugaugugaaaugggaggaccaagcggaaauuucagguucaaguccaauauuaagcauuacaauagcagaagauggaucgaugagcauuaaaaaugaagaggaagaacagaccuugacaauccucauacguacugggcuuuuaguuauaaguggucuauuuccagucucaauaccaaucaccgcugcagcaugguauuuaugggagguaaagaaacaaagagccgguguucugugggacguuccaagucccccaccagugggaaaggcugaacuagaagauggcgcguauagaauaaaacagaaagguauauuaggauauagccaaauaggugccgggguauacaaagaggguacuuuucauaccauguggcaugugacgagaggcgcagugcuuaugcauaggggaaagagaauagaaccaagcugggcugaugucaagaaagaccuaauaucauacgguggaggguggaaacuugagggagaauggaaagaaggggaagaagugcaaguguuggcccuggaaccaggcaaaaacccacgagcagugcaaacaaagccaggcuuauucaaaacgaauacugggacuaucggagcagucucacucgauuuuaguccaggcacaucaggaucaccaaucgucgauaagaaagggaaaguaguaggauuguaugguaacgguguuguuacuagaaguggagcauauguaagcgcaauagcucaaacggagaaaagcauugaagauaacccugagauagaagaugauauauuuaggaagaaacgauuaacaauuauggacuuacacccuggagcaggcaaaacuaaaagauaucucccugcaauugugcgugaagcaauaaagagaggacuuagaacgcucauauuagcaccgacacguguaguagcagcagagauggaggaagcacuuaggggacuaccaauccgguaccagaccccagccauaagagcagaacauacugguagagaaauuguugaccuuaugugccaugccaccuucacaaugagacuuuugucgccaguuagaguacccaauuauaaccucauuauuauggaugaggcgcacuuuacggauccagcaaguauagcugcucgaggauacauuucaacccgaguagaaaugggcgaagcggcuggcaucuuuaugaccgcuacuccaccuggaucgcgagauccuuuuccgcagucuaaugcaccuauuauggacgaggaacgagaaauacccgaacgauccuggaacucaggacaugaauggguaacugacuuuaaaggaaaaacuguaugguuugugccgaguauaaaggcagguaaugauaucgcugcauguuugaggaaaaacggcaagaaagucauucaacucucuagaaaaacauuugauagugaauauguaaaaacaaggacaaacgauugggauuucgugguuacgacggacauaucugaaaugggagcuaauuuuaaagccgaacggguaauagauccaagaagaugcaugaaaccagugauacucacggauggcgaagagagggucauauuagccgggccaaugccaguaacacauucgucugccgcucaaaggcgcggucguauugguagaaaccccaaaaacgaaaaugaucaauauauuuauaugggugaaccgcuugaaaaugaugaagacugcgcacauuggaaagaagcuaaaaugcuacuagacaauaucaacacuccugagggaauuauacccagcauguuugagccagagcgugagaaaguagacgcaauagacggggaauaccgccuacgcggcgaagcucgcaaaacguuuguugaccucaugagaaggggugauuuaccagucuggcuggcauacagaguggcagcggaaggcauaaauuaugcugauagaagauggugcuucgauggaguaaagaauaaccaaauccuagaagagaacguagaaguugaaauauggacuaaagaaggagaaagaaagaaauuaaagccuagguggcuagacgcaaggauauacagcgauccccuagcucucaaagaauuuaaagaguucgcggcagguagaaaaagccuuacgcuaaaucugaucacggaaaugggaagauuaccaaccuuuaugacccaaaaagcaagagaugcuuuggacaaccuagcuguccuacauacggcggaagccggugggagagcuuauaaccaugcucuaagugagcuuccagaaacauuggaaaccuuacuacucuuaacacucuuagcaacgguaaccggagguauauuucuauuuuuaaugucaggaaaaggggucggaaaaaugacccuaggaauguguugcauaauuacugcaaguaucuuauuauggcacgcucaaauacaaccucacuggauagccgcuucaauaauauuagaguucuuuuuaauuguacuccucauacccgaaccagaaaaacaaaggacuccccaagauaaccagcuuacuuauguagucauagcuauacuaacugugguugcugcaacgauggccaacgaaauggguuuucuagagaaaaccaagaaagaccuuggacugggaaguauagcaacacaggaaccagaaucuaacauuuuagauauagaucuacgaccggcaagcgcuuggacauuauacgccguugccacgacguucguaacaccuauguugcgacauagcauugaaaacucgucagugaauguuucacuuacagcuauugcuaaucaagcaacuguucucaugggccuaggaaagggguggccucuaagcaagauggauauuggugucccacuccucgcuaucgggugcuauucgcaagucaauccaauaacauuaacagccgcauugcuccuacucguggcucauuacgcuauaauaggcccuggcuuacaagcuaaggcaacgcgcgaagcgcaaaaacgugcagcggcaggaauaaugaaaaauccuacaguagauggaauaacgguuaucgacuuagaucccauaccguaugauccaaaguucgaaaaacagcuuggacagguuauguuacugauacucugugugacccaaguauuaaugaugagaacuacuugggcucuuugugaagcucucacccuggcaacgggaccaauuagcacguugugggaagggaauccaggucgauucuggaauacaacuaucgcaguaucaauggccaauauauuuagggguagcuaccuagcgggagcagggcuguuguucucuaucaugaaaaauacaacgaauacaagacggggaacgggaaacauuggagaaacacuuggcgaaaaguggaaaagccgacuuaacgccuuggguaaaucagaguuccaaaucuauaagaagagugguauacaagaaguugaucgaacucuugcaaaagaaggaaucaaacgaggagaaacagaucaccaugcagugagccgagguagugcaaaauuacguugguuuguugaaagaaauaugguaaccccagaagguaaaguaguagaccuagggugcggacguggaggcuggagcuauuauuguggcggauuaaagaacgucagggaaguaaaagguuuaacgaaaggaggaccaggucacgaagaaccagugcccaugucuacuuaugguuggaaucuagugaggcuucaaucuggaguugauguauucuucacacccccugaaaaaugcgauacacuuuugugcgacaucggggaaucgucacccaauccaacaaucgaagccggaagaacuuuaagaguacucaguuuaguagaaaacugguuaaauaacgauacccaauucugcauaaaaguacuaaauccauauaugccuagugucauagagaaaauggaaacguugcaaagaaaauauggcggagcccuaguacggaauccauugucgagaaacagcacacacgagauguauuggguaucaaaugcaacugggaauaucguaagcaguguaaacaugauauccagaaugcucauaaauagauuuacaaugaaacauaagaaggccacuuaugaaccggacguugaucuaggcuccggcaccaggaacaucggaauugaaagcgaaauucccaauuuggacauaauagguaagagaauugagaagaucaagcaagagcaugagacaaguuggcacuaugaccaggaccauccuuauaaaacaugggcuuaccauggaagcuaugaaacaaaacaaacaggaucugccaguucgauggucaaugggguugugcgucuucuuacaaaaccuugggacgucgucccuaugguaacccaaauggcuaugacagauacuacaccauuuggacaacaacgaguuuucaaagaaaagguagauacaagaacccaggaaccaaaagagggaaccaagaaacuaaugaaaauaacagcagaguggcuguggaaggagcucggcaagaagaaaacgccacguauguguacgagagaagaauuuacccguaagguuagaaguaaugcagcacuaggagcgauauuuacugaugaaaauaaguggaaaucugcuagagaagcgguugaagacagcagauuuugggaauuaguagauaaagaaagaaaccuucauuuagaaggaaaaugugaaacaugcguguacaauaugauggggaaacgagagaagaaacuaggggaauuugguaaagcgaaaggaagcagggcgauaugguauauguggcuuggagccagauucuuagaguucgaagcucugggguuucuuaacgaggaucauugguuuucaagagaaaacucucuaucagguguugaaggagaggggcuacacaaacuugguuacauuuugagagauguaucaaagaaagaagguggugcuauguacgccgaugauacagcuggcugggauacucggauuacucuggaagauuugaaaaacgaggagaugguaacuaaucacauggaaggugaacacaagaaauuagccgaggcaauuuucaaacuuacguaucaaaauaaaguaguccgaguccaacgacccacaccacgaggcacuguuauggauaucauuucacgacgcgaccaaaggggaucuggccaaguugggacguauggauugaacacauucaccaacauggaagcacaauuaauaagacaaauggagggggaagguauuuuuaaaucgauacaacaccugacaguaacagaggagauugcaguacaaaauugguuagcucguguuggucgagaaagacuuucuagaauggcuaucagcggagaugauuguguugucaagccccucgaugaucguuucgcgagcgcauugacggcacugaaugauauggggaaagucagaaaggacauacaacaaugggaacccaguagaggauggaaugacuggacgcaaguaccauuuugcucucaccauuuucaugagcuaauaaugaaagacggccguguucuaguaguucccugcagaaaucaagaugaacugauaggcagagcaagaauuucgcaaggagcugguuggagucucaaagagacugcaugucuagguaaaaguuaugcccagauguggucgcuaauguauuuucauagaagagaucuccgucuugcagcuaaugcuauauguucugccgugccaucacauugggucccaaccuccaggacaacguggagcauacacgcaaaacacgaauggaugaccacagaagauaugcuuacagucuggaacaggguuuggauacaagaaaauccuuggauggaggauaaaacaccgguagaaucaugggaagaaguucccuaucugggaaaaagagaggaucaaugguguggaagucuuauagggcucaccagccgugcuacaugggccaaaaauauacagacggcaauaaaucaaguaagaucuuuaauaggaaaugaggaauacaccgauuauaugccgucgaugaagagauucagacgcgaagaagaagaagcuggcguucugugguaa

SEQ ID NO: 22763 - RNA, 9876 nt, Artificial Sequence
  derived and/or modified CDS sequence (opt6) from DENV-2__EU482779__SS-prME
acugccgguguaauaauaauguuaauuccaacagcgauggcuuuucauuugaccacgagaaacggagaaccacauaugauaguaggaagacaagaaaaagguaaaucacuacuauuuaaaaccgaagacggaguuaauauguguaccuuaauggcaauugauuuaggagaauuaugugaagauaccauaacguauaaauguccguugcuacgucaaaaugaaccagaagauauugauuguuggugcaacucuacuucaacuuggguuacguacgguaccuguaccacuacuggagaacacagaagagaaaaacgaagcguagcuuuaguaccacauguuggaaugggauuggaaaccagaacagaaacuuggaugucuagcgaaggagcauggaaacaugcccagaggauagaaacguggauauuacgucauccaggauuuacgauuauggcagcgauucuugcauauacuguuggaacaacacauuuucaacgcgcuuugauauuuauuuugcuggcggcuguugcuccauccaugacaaugaggugcauaggaauaagcaaccgcgacuucguagaaggggucagcggaggaaguuggguagacauugucuuagaacauggaucgugcguaacuacaauggcuaaaaauaaaccuacgcuugacuuugaauuaauaaaaaccgaagcaaaacagccagcaacucugagaaaauauuguauagaggcaaaacugacgaauacgaccacggagucgagauguccaacucagggugaaccaucgcugaacgaagaacaggacaaacgauucguauguaaacauucuauggucgauagaggaugggggaauggauguggucuguucggaaaaggaggaauaguaacuugugcaauguucacguguaagaaaaauauggaagggaaaauugugcagcccgaaaaccuugaauauacaauuguaauaacaccacacaguggugaagaacaugcagugggaaaugacacuggaaaacacggaaaagaaaucaaaauuacaccucaaucaccgaucacagaggccgaacuuacaggauauggcacugugaccauggaauguucacccagaacuggccuagauuucaaugaaaugguuuuacuacaaauggaagacaaggccugguuaguacacagacagugguuuuuagauuuaccauuacccuggcuuccgggugcagauacacaaggaaguaacuggauacaaaaggaaacauuagucacauuuaaaaacccccaugccaagaaacaagacguugugguguuaggcucacaagaaggugcuaugcauacagcucucacgggugcuacagagauacagaugucauccgguaauuugcuguuuaccggacacuugaagugcaggcucagaauggauaaacuucaauuaaagggcaugucguauuccauguguaccggaaaauucaaaauaguaaaggagauagccgaaacucaacacggaaccauaguuauuagaguucaguacgaaggcgaugguagucccuguaaaauaccauuugaaauuauggaucucgagaaaagacacgucuuaggaagacugauuacuguuaaccccauagugacagaaaaagacaguccggucaauauugaagcggaaccaccauucggagauaguuauauaaucaucggugucgaaccaggacaguugaaauuaaauugguucaagaaggguucgucgauuggacaaauguucgaaaccacaaugagaggcgccaaacguauggcuaucuuaggggauacagccugggacuucggaucucuaggcgguguuuucacaaguauuggcaaggcacuucaucaaguauuuggggcgauuuacggggcagcauuuuccggaguaucguggaccaugaaaauuuugauaggaguaauaaucaccuggauuggaaugaauagccgaucaacaagccuaaguguuagcuuaguacucgugggcgugauaacguuguacuuaggagcuauggugcaagcagacucgggcugcgucguaucuuggaaaaacaaggagcuuaaauguggaucaggaaucuuuaucacagauaacguucacacauggacagaacaguacaaauuccagccugagucuccaucaaaauuagccucugcuauacagaaggcccacgaagaaggaauuuguggaauaagaaguguaacgagauuagaaaacuuaauguggaaacagauaacaccggaauuaaaucacauccuaagugagaaugaaguaaaacuuaccauaaugacaggagauauaaaggguauuaugcaagcuggcaaacgaagucugagaccacaacccacagaauugaaauauucuuggaaaacauggggaaaagcaaaaauguuaaguaccgaaagucauaaccaaaccuuuuugaucgauggaccagaaacggcagaauguccgaauacgaauagggcuuggaauagccuagagguugaagauuauggauucgguguuuucacaacaaacaucugguuaaaacuucgugagaaacaagauguauucugcgacucuaaauuaaugucugcagcuauuaaagauaacagagcgguccaugcugauauggguuauuggauugaaagugcccugaacgauacauggaaaauggaaaaagcauccuuuauagaagugaaauccugucauuggccgaaaucgcacacuuuauggaguaacggcgugcuugaaucugaaaugauaauaccuaaaucauuugcaggacccgugucacaacauaacuacagacccggcuacuacacgcaaacagcggggccauggcauuuaggaaagcucgaaauggacuucgacuuuugugaaggaaccacaguaguggucacagaagauugcggcaaucgugggccgucucuuagaaccaccacggccucaggaaaacuuauaacagaguggugcugccguaguuguacauugccacccuugcgcuaccguggugaggacgguugcugguauggaauggaaauccguccauugaaagagaaagaggagaaccucguaaacucauuaguaacagcagggcacggucaaaucgacaacuucaguuugggagucuuaggcauggcauuguuucuggaagaaaugcugagaacuagagucggaacuaaacacgcaauccuguuagucacgguaaguuuugucacuuuaauaacuggaaauaugucauucagggaccuuggcagaguuaugguaaugguuggugcugcaaugacagaugauaucgggaugggaguuaccuauuuagcacuucuugcugcauuuaaagugaggccuacguuugcagcaggauuacugcuccgaaaacugaccaguaaggaauugaugauggcaacaauaggcauugcacuccuaucacaaucaacaaucccugagacuauuuuagaacuaacagaugcauuagcguuggguaugaugguacuaaagauagugaggaauauggaaaaguaccaacuagcagucacuauaauggccaucagcuguguaccgaaugcugugauuuuacaaaacgcauggaagguauccuguacuauucuagcagcgguauccgucucaccguuauuacuaacuucaagucaacaaaaagcagauuggauaccccuggcccucacuauaaagggguugaauccuacagcuauauuucuuacuacacuuucgcgcacuucuaagaaaagaucauggccccucaaugaggcaauaauggccguugggaugguuuccauacuagcaucuucgcuacucaaaaacgacauuccaaugaccggcccuuuaguagccgggggauuauuaacaguaugcuacguacuaacuggucgaagcgcggaucuagagcuagaacgugcgaccgaugugaaaugggaagaucaagcagaaauuucuggaucaucccccauuuuaaguauaaccauagcggaggacgguaguaugaguaucaaaaaugaagaagaagaacagacgcuaacaauccuaauucgaacaggauuauuaguaauaucgggccucuucccagucagcauaccaaucacagcagcagcaugguaucuaugggaagugaaaaagcaaagagcaggcguuuuaugggauguucccucuccgccuccaguaggaaaagcugaacuggaagacggugccuauaggauaaagcaaaaaggaauauuaggguauucucagauaggggcaggaguguacaaagaaggaaccuuucauaccauguggcaugucacucgcggagccguucuaaugcauagagggaagagaauugaaccaucgugggcagaugucaagaaagaccuaaucucguaugguggagguuggaagcucgaaggggaauggaaagaaggggaagaaguacagguucuagcccuagagccuggcaaaaauccaagggcaguccagacgaaaccgggccucuuuaaaacaaauacuggaacuaucggagcuguaaguuuggacuucucuccgggaacaaguggaagcccaauaguagaucgaaagggaaaggucgucggauuauacgggaauggcguuguuacuagaucaggagccuauguuucggcuauugcccagacagaaaagagcauagaagauaacccagaaauugaagacgacauuuucaggaagaaaagacuaaccauaauggaucuccaccccggugcagguaaaacaaaaagguaccucccugcuauaguaagagaagcaauuaaaagggggcuaagaacuuuaaucuuagcaccuacacgaguaguagcggcagaaauggaagaagcgcucagaggauuaccaauuagauaucaaacuccugccauaagagcagaacauacagguagagaaauaguagaucuuaugugucaugcaacuuucacuaugcguuuacugagucccguucgcguuccuaauuacaaccuuauaauuauggaugaagcacauuuuacagauccggcaaguauagcggcccguggauauauuucgacuagaguagaaaugggagaagcugccgguauauuuaugacagcaacuccaccagguucacgagacccauuuccccaaagcaaugccccgauaauggacgaagaacgagaaauuccagaaagaucauggaacucaggacacgaauggguaaccgauuuuaaggggaagacggugugguuuguacccagcauaaaagcggggaaugauauagcggcaugucuaagaaagaauggcaagaaaguaauucaacugagucgaaaaaccuuugauagugaauacguaaaaacuagaacaaacgacugggacuucguuguaaccacugauauuagugaaaugggagcaaacuuuaaagcagaaagaguaauagacccgaggcgauguaugaaaccugucauuuuaacggauggugaggagcgagugauacuggccgguccgaugccugucacucacagcucugcggcacaaagaaggggucguauugggcggaacccuaagaaugaaaaugaucaguauauauauaugggagaaccgcuagaaaaugaugaggauugcgcgcauuggaaagaggcaaaaaugcuauuagacaauauuaauacaccugaaggaauaauaccaucgauguuugagccggaaagggaaaaaguagacgcuauagacggcgaauauagauuacguggcgaagcgagaaaaacguucgucgaccucaugcgaagaggagaccuaccuguuuggcuggccuaucgaguggcugcugaaggaaucaacuacgccgacagaagauggugcuuugauggggucaaaaauaaucaaauuuuagaagaaaaugucgaaguggagauauggacaaaagaaggcgaaagaaagaaauuaaaaccacgauggcuagaugcucgaauuuauucagacccgcuugcacuaaaagaauuuaaagaguucgcagccggacgcaaaucuuuaacccuuaaucuaauuacagaaaugggccgauuacccaccuuuaugacccagaaagcacgggaugccuuagauaaucuggcagucuugcauacagcugaagcgggaggcagagccuacaaccacgcgcugucagaacuaccggaaacucuagaaacuuuacuacuucuaacucuucucgcuacaguaacaggaggaauauuccuguuucuuaugagcggaaaagguguagggaaaaugacacucggaaugugcuguauuauaacagcgucaaucuuguugugguaugcacaaauacaaccucauuggauagcugcaucaauaauacuggaguucuuucuaaucgugcuauugauuccggaacccgagaaacagagaacuccgcaagauaaccaacuaacauacgucguaaucgcuaucuugaccguaguagcagcaacaauggcaaacgaaaugggcuuucuagagaaaacuaagaaagaucugggccuaggcaguaucgcaacccaagaaccggagaguaauauauuagacauugacuuacguccggcuagcgcauggaccuuauaugcuguggcgacuacuuucgucacuccaauguuaaggcauuccauugaaaauagcucggugaacguaucacugacugcgaucgcaaaccaagcuaccguucugauggguuuagguaaaggauggcccuugucaaaaauggauauaggagucccauuacuagcuauugggugcuauagucaaguuaaccccauuacccuaacugcagcccuacuuuugcuuguugcgcauuaugccauaauaggaccuggacuacaagcaaaagcaacuagagaagcacaaaaacgggcagcugccgggauaaugaaaaaccccacuguugacggugucacagucauugauuuagaccccauucccuacgauccgaaauuugaaaaacagcugggacaaguuauguuguuaauauuguguguaacccaaguauugaugaugagaacgacuugggcacugugcgaagcauugacuuuagcgacaggccccauaagcacacuaugggaagguaacccgggcagauucuggaauaccacgauagcugugaguauggcaaacauuuuuagggggucauaucuagcaggggccggguuauuguucaguaucaugaaaaacacuacaaauacaagaagagguacuggaaauauaggagaaacuuugggagagaaguggaaaagccgucucaacgccuuaggaaaaucagaauuucaaauauacaagaagucuggaauacaagaaguagauaggacacucgcaaaagaggggauuaaacguggcgaaacagaucaucacgccgugucaagggguuccgccaaguuaagaugguuuguugaacgcaauaugguaacuccagaaggaaaagucguggaccuaggaugcggucgaggaggauggucguauuauugcggagggcuuaaagacgucagagagguaaagggauuaacaaaagguggccccgggcaugaagaaccuauaccaaugucaacguauggcuggaauuugguucgucugcagagcggugucgaugucuucuuuacuccuccugagaaaugugauacacugcuuugcgacaucggagagucuagccccaauccaacgauagaggcagggaggacucuaagaguccuuucucucguagaaaauuggcuaaauaaugauacgcaauuuugcauuaagguauuaaacccauauaugcccagcguuauagagaagauggaaacacuacagcgaaaguacgggggugcucuagugcgaaauccucuaaguagaaauuccacgcacgaaauguauuggguaagcaaugcaacagggaacaucguaucaucaguaaauaugauuagcagaaugcugauuaacagguuuacaaugaaacauaagaaagcuacuuaugaaccugauguagauuugggcucaggaacucggaauauuggaaucgaguccgagauuccaaauuuagauauaauugguaaaagaauagagaaaauaaaacaagagcaugaaaccagcuggcauuacgaucaggaccauccguauaagacuugggcauaucaugggagcuacgaaacaaagcaaaccggcagugcaagcucaauggucaauggcgugguucguuuacucacaaaacccugggauguuguaccgaugguuacccaaauggcuaugacagacacaacaccauuuggacagcaacguguguucaaagaaaaaguugacacucgcacucaagaaccgaaagagggcaccaagaaguuaaugaaaaucacagcugaguggcuauggaaggaauuagggaagaagaaaaccccacgaauguguacaagagaggaguuuacuagaaaagugaggucaaaugcugcgcuaggagccauauuuacugacgaaaauaaauggaaaucagcaagggaagcgguggaagauagcagauuuugggaacucguagacaaagagagaaaucuacacuuagagggaaaaugugaaacguguguuuauaauaugaugggaaaacgugagaaaaaguuaggagaguucggcaaggcaaaagguucaagagcaauaugguauaugugguuaggcgcuagauuucuugaguucgaagcucuaggguuuuugaacgaagaucauugguucagccgugaaaauaguuugaguggaguagagggagaaggucuacacaaauuagguuauauacugcgugacgucucuaagaaagaaggaggcgcaauguaugcagacgauaccgcagguugggauacaagaauaacguuagaagaccuuaagaacgaagaaaugguaacgaaucacauggaaggugagcauaaaaaguuagcagaagcaauauuuaaauugacauaccaaaauaaagugguccgaguucaaaggcccaccccgagaggaacgguuauggauauuauuucucguagggaucaacgaggcucuggccaagucgguacauauggccuaaacacauuuacuaacauggaggcccaauuaauccgacagauggaaggggaaggaguuuucaagucaauacaaagguuaacaguaacagaagaaauugccguacaaaauuggcuagcacgaguagggagagagcgauuauccaggauggcaaucagcggagaugacuguguaguuaaaccauuagaugaccgauuugcuagugcucuuaccgcacuuaaugauaugggaaaaguucgcaaagauauacaacagugggagccauccagaggauggaacgacuggacacaggucccauuuugcucucaucacuuucaugaacugaucaugaaggauggacgaguucuagucgucccaugccguaaucaggacgagcuaauagguagagcucgaauaagucaaggggcaggcuggagucuuaaggaaacggcguguuugggcaaaaguuaugcacagauguggagucugauguauuuccaucgacgagacuuaagacucgcugcaaacgcaaucuguucugcuguaccaucacacuggguaccuacuagcagaaccacauggaguauucaugcaaaacacgaauggaugacaacagaagacauguuaacuguauggaaucgaguauggauacaagaaaaucccuggauggaggauaaaacuccggucgagagcugggaagaagugccauaccuggggaaaagggaagaucaaugguguggcagccuuauaggacugaccucaagggcuacuugggccaagaauauacaaacugccauaaaucaagugcgaaguuugauuggaaaugaggaauauacagauuauaugccuagcaugaagcgcuuuagaagagaagaagaagaagcagggguauugugguaa

SEQ ID NO: 22764 - RNA, 9876 nt, Artificial Sequence
  derived and/or modified CDS sequence (opt6) from DENV-2__EU482780__SS-prME
acagcuggggugauuauaauguugauaccuacagcaauggcguuucaucuuaccacgagaaauggagaaccucacaugauugugggaaggcaagaaaaaggaaaaagucuuuuguuuaaaacugaagacgguguaaauaugugcaccuuaauggcgauagaccucggagaauuaugcgaagauacaauuacuuacaaaugcccuuugcuacgacaaaaugaaccggaggauauugacugcuggugcaauaguacaaguacauggguuacauaugguacauguaccacuacgggagaacauagacgggagaaaagaucaguagcacugguaccucacguuggaaugggauuagaaacuagaacagaaacuuggaugagcagcgaaggagcguggaaacaugcucaaaggauagagacguggauacuacgccauccaggauucacuauaauggcagcaauauuagcguauacgguaggaacaacucacuuucagagggcacuaaucuucauccuuuuagcagcuguagccccaucuaugacuaugcgauguauuggaauuagcaauagagauuucguagaagggguaucagggggcucauggguagauauagugcuugaacacgguuccuguguaacuacaauggcuaaaaauaaaccgacacuugauuuugaacucauaaaaacagaagcaaaacaaccagcuacccuaagaaaauauugcaucgaagcuaaacuaacaaauacuacaacagaaucgagauguccaacucaaggagagccaucacuaaaugaagaacaagacaaacgcuuuguuuguaaacauuccaugguggauagggguugggguaauggguguggacuauuugguaaaggagggauagugacuugugccauguucacaugcaagaaaaauauggaagggaaaauaguccaaccggaaaauuuagaauauacuaucguuauuacgccccauucaggugaagaacaugcaguggggaaugacacaggaaaacacgggaaagagauuaaaauaaccccucaaagcccaaucacugaggcagaauuaacaggauacgguacuguaaccauggaauguucaccacgaacuggcuuagauuuuaaugaaaugguacuacuccagauggaagauaaagccuggcuaguacauaggcaaugguuuuuagaucuuccacuucccuggcuaccuggagcugauacccaaggaucuaacuggauacaaaaagaaaccuuaguaacuuuuaaaaacccacaugcaaagaaacaagauguaguaguauuaggaagucaagaaggagcgaugcauacagcucuuacaggcgcaaccgaaauacaaaugaguucuggcaaucuauuauuuacaggacauuuaaaaugccgccugcgaauggauaaacuacaacuaaaaggcaugagcuacaguaugugcacaggaaaauuuaaaauaguaaaagaaaucgcagaaacucaacauggaacaaucguuauaagaguacaauaugaaggugauggaucaccuuguaaaauaccauuugaaauuauggaucuugagaaaagacauguccuagggcgacucaucacaguuaauccuaucguaaccgaaaaagauucacccguaaauauagaagcugaaccaccuuucggagauucuuacaucauuaucgguguggaaccgggccaguuaaaauugaacugguucaaaaaggggucaaguauaggacagauguuugagaccacuaugagaggcgcuaaacggauggccauacucggggacacugcuugggacuuuggcucacuagguggaguguuuacaucgaucgguaaggcgcuucaccaaguuuuuggugcaauauacggagccgcauucuccggaguauccuggacaaugaaaauauuaauaggcgucauuauaacuuggauaggcaugaacucucgaucuacaagucuaucugugucauuaguccuaguaggcguuaucacauuauaucugggagccauggugcaagcagauucagguuguguuguuaguuggaaaaauaaggaacuuaaaugcgggucgggaauauucauuacagauaacgugcacacauggacggaacaauacaaauuccaaccagaaucaccgucaaaacuugccucagcaauccaaaaagcacaugaagagggaauuugcgggaucagaucaguaacgagauuagagaauuuaauguggaaacaaaucacuccagaacuaaaccauauacuuucagaaaaugaagucaagcucacuaucaugaccggagauauaaaaggcaucaugcaggcaggaaaaagaagccugcgaccgcaaccuacagagcugaaauacucauggaagacguggggaaaagcaaaaaugcuaaguacagaaucgcauaaccagacguuuuuaauagacgguccggaaacggcugaaugucccaacaccaacagagcauggaacucuuuggaaguagaagacuauggauucggcguauucacuacgaauauuuggcuaaaacuacgagaaaaacaagauguauuuugugauagcaaauuaaugucagcagcaauaaaagauaauagagcaguccaugcugacauggguuauuggauagagagugcccucaaugauacuuggaaaauggagaaagcgagcuuuauagaaguaaagucaugccauuggccuaaaucgcacacacuuuggaguaacggaguucucgaauccgaaaugaucauuccuaagucauuugcagggcccguuucccagcauaacuaccgaccaggauauuauacgcaaacugcaggaccuuggcaucugggaaaacuagagauggacuuugauuuuugugaagguacaacgguuguuguaacggaagauugcggaaaccgagguccguccuuaagaaccacaacagcauccggaaaauuaauaacagaauggugcuguaggucauguacucuuccaccucuaagauaccgaggugaagaugguugcugguacgguauggaaaucagaccauuaaaagagaaagaagaaaaccuaguaaauucucuaguuacagccggucacggccagauagacaauuucucucuaggugucuuaggaauggcacucuuucucgaagaaaugcuccgaacacgggugggaacuaagcaugccauuuuacuugucacaguaucauucguaacccugauaacagguaacaugucauuucgugaucuuggacgggucauggugauggucggagcagcaaugacggaugacaucgggaugggaguuaccuaccuugcccuguuagcagcauuuaaaguacgacccacuuucgccgcgggguuacucuugagaaaacuaacuucaaaagaauugaugauggccacaauaggaaucgcacuucuaagccaauccacuauaccagagacgauacuagaacuuacugacgcccuggcccuugguaugauggugcuuaagauaguaagaaacauggaaaaauaucaguuggcaguuacuaucauggcgauaucguguguaccgaacgccguaauuuuacaaaaugcuuggaaagugucguguacaauauuagcggcggugagcguaaguccacuccuuuuaacaaguucgcaacaaaaagcugauuggauuccuuuagcacuaaccauaaaggggcucaacccaacggcgaucuuucuaacgacacuaucuagaacuagcaagaaacgauccuggccauuaaacgaggcaauuauggcagugggaauggugagcauccucgcuagcucacuacuaaagaaugacauuccaaugacgggacccuuaguagccggagggcuauugaccguuuguuacguccuuacuggaaggucugccgaccuagaacuagaacgagcgacagacguuaaaugggaagaucaggcugaaauuucaggaucaucaccaauucuuagcauaacaauagccgaagauggaaguaugaguauuaaaaaugaagaagaagaacaaacacuuacuauauuaauaaggaccggauuacugguuauauccggauuguuuccugucuccauaccuauuacagcagcugcaugguauuuaugggaagucaagaaacagagagcaggagugcucugggaugucccauccccgccgccaguuggaaaagcugaauuggaagacggugcauaucguaucaagcaaaaaggaauauuaggguacucccaaauaggagccggcguauacaaagaggggacuuuucacacaauguggcacgugacaagaggagcgguauuaaugcacagggguaaaagaauagagccuagcugggcggaugugaagaaagauuuaauauccuacggcgggggcuggaaauuagaaggagaguggaaagagggagaggaaguccaaguacuagcacuggagccaggcaaaaacccacgcgcaguccagacaaagccgggcuuguucaaaacaaauacuggaacaauuggagccguaucauuagacuucagucccgggacaagcggaucaccaauaguugacaggaaagguaaagugguugguuuauauggaaacggagucguaacacgaaguggugcguauguuuccgcaaucgcacaaacugaaaaaucaaucgaagauaacccggaaauagaagacgacauuuucagaaagaaaagauuaacuauuauggaucuacauccuggcgcugguaaaacaaagcgauauuuaccggcaauaguacgugaggccauuaaacgcggccuuagaacacuaauacuagcuccgacacgaguaguagcagcagaaauggaagaggcauuaagaggccugccuauaagauaccaaacuccagccauacgcgcagagcacacugggcgcgaaauuguagaucuuaugugucaugcaacauucacuaugcgauuauuaucaccaguaagaguuccaaauuauaaucuaauaauuauggacgaagcacauuucacggacccagccagcauugcagcgagaggauauaucucgacaagaguagaaaugggagaagcagcuggcauuuucaugacugcuacuccgccagguaguagagacccguucccccagaguaaugcaccuauuauggaugaagagagagagauaccagaaaggucauggaacucaggacacgaauggguaacagacuuuaaagguaaaaccguaugguuuguaccuucaauuaaagccggcaacgacauugccgcauguuugcgcaagaacggaaagaaagucauucaauuaagucgcaaaacguuugacuccgaauauguaaagaccagaacaaacgacugggauuucguggucacaacugauaucucagaaaugggggcaaacuucaaagcggagcgaguuauagauccgagaagauguaugaaaccaguaauacugacagacggagaagagagaguuauccucgcggguccuaugccagugacccauucaagugcggcucaacguaggggccgaaucgguagaaauccaaagaacgaaaaugaccaguacauauacaugggagaaccccuggaaaaugaugaagauugugcccacuggaaagaggcuaagauguugcuugacaacaucaauacgccagaaggcauaauaccuuccauguuugaaccagagcgagaaaaaguagaugcaauugacggagaauaccgucuacgaggugaagcucgcaaaaccuuuguugacuuaaugcgacgcggcgaucugccuguguggcuugccuaucgcguagccgcugagggaauaaacuaugcagauagaagauggugcuuugacggagucaaaaacaaccaaauacuagaagagaauguagagguagaaauauggacaaaagagggggagaggaagaaauugaaaccacgauggcucgacgcucgcauuuacagugacccauuagcuuuaaaggaguuuaaagaauuugcggcuggcaggaaaucacuaacucugaacuuaaucacggaaaugggacgguugccaacauucaugacacagaaggcucgagacgcuuuagauaauuuagcuguacuacauacggccgaagcaggaggcagagcuuacaaucaugcgcucagcgagcugcccgaaacauuggaaacucuuuuguuacuaacguuacucgccacaguaacugguggaauauuuuuauuucucaugucugggaaaggaguggggaaaaugacacucgggauguguuguaucauuaccgccaguauuuuacucugguaugcucagauacaaccucacuggauugccgcuucaaucauauuagaguucuuucugaucguuuuauuaauaccugaaccagaaaagcaaagaacaccucaagacaaucaauuaacauauguggugauugcuauauugacagucguagccgcaaccauggccaacgaaaugggauucuuagagaagaccaagaaagaucuaggcuuaggaucaauagccacacaagaacccgaaaguaauauccuagauauagaucucagaccugcaucugcauggacacuauaugcaguggcuaccacauucguaacuccgauguuacgacauucgauagaaaacagcaguguaaacguguccuuaacagcaauagcuaaccaagcaacuguucuuaugggacuggggaagggcuggccgcuuucaaaaauggauauuggcguaccgcugcuagcaauuggauguuauagccagguaaauccaauuacacuaacggcagcucuccucuugcuugucgcucauuaugcgauaauaggaccaggucuucaggcuaaggcaacaagagaagcacagaaaagagcugcagcuggcauuaugaaaaaccccacgguagauggaguaacgguaauagauuuggacccaauaccauacgauccaaaauucgagaagcaacuuggacaagucauguuauugauacuaugcgugacgcaagucuuaaugaugagaacaaccugggcgcuuugcgaagcucugacuuuggccacaggaccuauuaguacguuaugggaaggaaacccugggagauuuuggaacacuacuauugcuguaaguauggccaauauuuuuagagguucauauuuagcgggagcuggacuacuauuuagcauaaugaaaaacacaacaaauacacgaagaggaacugggaauaucggcgagacacucggagaaaaauggaagucucguuuaaacgcacuggguaaaagugaauuucagauauacaagaaaagugggauucaagaagucgaccgaacauuagcaaaagaaggaauaaaaagaggugaaacagaccaccacgcggugucuagggguucagccaaacucaggugguuuguagaaagaaacauggucaccccagaagggaaaguaguagaccuaggcugugguaggggaggauggucauauuacuguggaggucuuaaagacgucagagagguuaaaggacuuacgaaaggagguccaggccacgaggagccgauaccaaugagcacguacggauggaaucuuguacggcuacaaaguggcguugacgucuuuuucacaccaccagaaaaaugugauacacugcuaugugacauaggagagucaucgccuaacccaaccauagaggcaggaagaacucuaaggguacucagucucguagaaaauuggcuaaacaaugauacgcaguuuuguaucaaggugcucaauccguacaugcccucugucauagagaagauggaaacauuacaaaggaaauacgguggugcccucguacggaauccauugagccggaacagcacucaugaaauguacuggguaucuaacgcaacaggcaacauaguaaguagcguuaauaugauaucucgaaugcuaauaaaccgguuuacaaugaaacauaagaaagcaacuuaugaaccugauguugacuuaggcagcggcacacguaauauuggaauugaaagugagauaccuaaccuagacaucauagguaaaagaaucgagaaaaucaaacaagagcacgaaacuagcuggcauuaugaucaagaccauccuuacaaaacgugggcauaccauggcucauaugaaacuaaacaaacuggaucagcuagcucuauggugaacgggguaguacguuuacuaacuaaaccaugggacgucguaccaaugguaacacaaauggcaaugaccgacaccacaccguuuggacaacaacgcguguucaaagagaaaguagauacaaggacacaagaaccuaaagagggaaccaagaaacuuaugaaaauaacugcggaaugguuauggaaagaauuaggcaagaagaaaacgccucgcauguguacaagggaggaguucacacguaagguaagaucuaacgcagcauuaggugcaauuuucacagaugaaaauaaauggaagucagcacgggaagccguugaagacucaagauucugggaauuaguagauaaagaacguaaucugcaucuugaaggaaaaugugaaacaugugucuacaacaugaugggcaaaagagagaagaaacuaggggaauuuggaaaagcaaaagguucuagggcuaucugguacaugugguuaggugccagauuccuagaguuugaagcguuaggcuucuugaaugaagaccauugguuuagcagagaaaacucucucaguggaguggaaggugaaggauuacauaaacuaggguacauacuaagggacguguccaagaaagaaggaggggcuauguaugcagacgauacugcgggaugggauacuagaauaacauuggaagaucuuaagaacgaagaaaugguuacaaaucacauggaaggagaacauaagaaacuagcugaggcgaucuuuaaacucacauaccaaaauaaaguagucagaguacaacgaccuacaccaagggguacaguaauggauauuauaagucgaagagaucagagagggaguggucaagucggaacguauggucugaauacuuuuacaaauauggaagcucaacuaauaagacaaauggaaggggaaggaguuuuuaaaucaauacagcgcuuaacugugacagaagagauagcaguucaaaauuggcuagcgaggguagggcgggaacgccucuccaggauggcaauaagcggagaugacugcgucguaaaaccacucgacgauagguucgcaagugcuuugacggcccugaacgauaugggaaaaguaagaaaagauauucaacaaugggagcccaguagaggauggaacgacuggacacaaguuccauucuguucgcaucacuuccacgaauugaucaugaaagacggucggauguuaguaguaccaugucgaaaccaagaugaauuaaucgguagagcccguauaagccaaggugcaggguggucucuuaaagaaacagcaugucuaggcaagucuuacgcccaaauguggucguuaauguauuuucaucgcagagaccugagacuugcagccaaugccauuugcagcgcaguaccuagccauugggugccaacaucgcguacgacuuggucuauucaugcuaaacaugaauggaugacuacagaggacaugcuaacagucuggaacagaguauggauacaagaaaaucccuggauggaagauaaaacaccaguggaaucaugggaagaagucccauaccuuggcaaaagggaggaucaauggugugggagcuuaauaggccuuacgaguagggcaacgugggccaaaaauauacaaacugccauuaaucaaguaagaucacuuauaggaaaugaagaauauacugauuauaugccuucgaugaagagauuuagaagagaagaagaagaagcaggcgucuuaugguag

SEQ ID NO: 22765 - RNA, 9876 nt, Artificial Sequence
  derived and/or modified CDS sequence (opt6) from DENV-2__EU482781__SS-prME
acugcagggguaauuauuaugcuaauccccacggcaauggcauuccaucuuacuacacggaacggugaaccgcauaugauaguagggagacaagaaaaaggaaaaucacuauuauucaaaacagaagacggagugaacaugugcacucuaauggcuauagaccuaggugaauuaugcgaagacacaaucacauacaaaugcccacuacuccggcagaacgaaccagaagauaucgauugcugguguaauucuacuucaacaugggugacauacggaacuugcacuaccacgggagaacacagaagagagaaacgaucaguagcccuaguuccucauguugguaugggccuugaaacccgaacugaaacauggaugucaucagaaggagcauggaaacaugcgcaacguauagaaacauggauacuucgacaucccgguuuuacaauaauggcagcaauucucgcauauacaguagguacaacgcauuuccaacgcgcacuuauuuucauauugcuagcggccguagcacccucaaugacgaugagauguauuggcauaagcaauagagacuuuguugaaggaguauccggagguucuuggguugauaucguacuugaacaugguucuugcguaacgacuauggccaaaaauaaacccacucuagacuuugaacuaauuaaaacugaagcaaaacaaccagcaaccuugcgaaaauacugcaucgaagcuaaacuaacgaacacaacaacagaaucaagaugccccacacaaggcgagccuucacucaacgaagaacaagauaaaagauucguuugcaaacacucuaugguagacaggggauggggaaacggaugcgggcuuuucggaaaaggagggaucguaaccugugcaauguucacauguaaaaagaauauggagggcaaaauaguacagccagagaaucuggaauacacaauaguaaucacgccucacucaggagaagaacacgcaguagggaaugacacaggaaaacaugggaaagaaauuaaaauaacuccgcaaagcccuauaacggaggccgaguuaacuggauauggaaccguaacuauggaaugcucuccucgaacuggauuagauuuuaaugaaaugguauuauuacaaauggaggauaaagcaugguuaguucaccgucagugguucuuagaucucccauuaccauggcuuccgggagcagauacucaagggaguaauuggauacaaaaagaaacucuggugacuuucaagaacccacaugcaaagaaacaggacguaguagugcuaggaagccaagaaggggcaaugcacacggcacuaaccggugcuacggagauacaaauguccucugggaauuugcuauuuacgggccacuuaaagugucgcuugcgaauggacaaguuacaacuuaaagggaugaguuauagcaugugcacagguaaguuuaaaauagugaaagaaauagcagaaacucaacauggaacaauagucauaaggguccaauaugagggagacggaaguccuuguaaaauuccuuuugaaauuauggaccuagagaaaaggcauguauuagguagacugauaacgguuaauccaauaguaaccgaaaaagacucgccagugaacauagaggcugaaccaccauuuggugauaguuauauaauaauugguguugagccaggucaauuaaagcuaaauugguuuaagaaaggcucgaguaucggacaaauguuugaaacaacaaugcgcggcgcaaaacgaauggccauucuuggugauacagcgugggacuuuggcagucugggcggaguauuuacaaguauuggaaaagcacugcaccaaguuuucggugccauauauggugcagcguucagugggguaucauggacaaugaagauuuuaauaggagucauaauaacauggauaggaaugaauagccguucaacaucucuaaguguauccuuaguucuagucggagucaucacucuuuaucuaggggcaaugguacaggcagauagcgggugugugguaucauggaagaacaaagaauuaaaaugcggaucugguauuuuuauaacagauaacguacacacguggacagaacaguacaaguuucaaccagaaagcccuuccaagcuggccucugcgauucaaaaagcccacgaagaaggaauaugugguauaagaagcgugacccggcuggaaaaccuaauguggaaacaaauuacaccagaguuaaaucacauuuuaucagaaaaugaaguuaaguuaacgauaaugacaggagacauuaaaggaauaaugcaaccagggaagaggagcuuaagaccacagccaacagaauuaaaguacucauggaaaacauggggaaaagccaaaauguuaucuaccgaaagccacaaccaaaccuuuuuaauugauggaccagaaacagccgaauguccuaacacaaaccgugcauggaacucccuugagguagaggacuauggguuugggguauuuacaacaaauauuugguuaaaauugagggaaaaacaggacgucuucugcgauucuaaauuaaugucggcagcgauaaaagauaaucgagcugugcaugccgacauggguuauuggauagaaucagcacuuaacgauacauggaagauggaaaaggcauccuuuauugaagucaagucuugccauuggcccaagucacauacguuauggucuaauggaguucuugaaagugaaaugaucauaccuaagagcuuugcagggcccgucagccaacacaacuacagaccuggcuauuauacacaaaccgcaggacccuggcaucuaggcaaauuagaaauggacuuugacuuuugcgagggaacaacgguaguaguaaccgaagacuguggcaaucguggcccaagucuuaggacaacaacggccuccggaaaauuaaucaccgaguggugcugucguucuuguacacuaccaccacugcguuauagaggggaggacggcugcugguacgguauggaaauaaggccguuaaaagaaaaagaggaaaauuuaguaaauagccuggugacagccgggcacggacaaaucgacaacuuuucauuaggcguuuugggcauggcauuauucuuagaagaaaugcuaaggacacgaguaggaacuaaacacgcaauauuauuaguaacaguaucuuuuguuacucucauaacgggaaauauguccuucagggaccuagggcgugucauggugaugguaggagcagcaaugacagacgauauagggaugggcguaaccuaucuagcacuuuuagcugcauuuaaagucagaccaaccuuugcagcgggacuacuacuaaggaaauuaacuucgaaagaacuaaugauggccaccauugguaucgcucuuuuaucacaauccacuauacccgagacgauucuagaacuaacugaugcguuagcguuaggcaugaugguacuaaagauuguaagaaauauggaaaaauaccagcuugcgguaacuauaauggcgaucagcugcguaccaaaugcgguaauucuacagaacgcauggaaggucucaugcacaauacucgccgcagucagcgucucccccuuauugcugacaaguagucaacaaaaagcagauuggauuccgcuggcgcuaacgaucaagggauuaaacccgacagccauuuuucugacaacacucucacguacguccaagaaacguucauggccacuaaacgaagcaauaauggcaguagggaugguaucaauauuagccucgucccuucucaaaaaugauauuccuaugacaggaccacuugucgcuggugggcuucuuacuguguguuacgugcugacaggaagguccgcagaccucgaguuagagagggcaacagaugugaaaugggaagaccaagcggaaauaucgggaucaaguccaauauuaagcauaacaaucgcggaagauggaucaaugucaaucaaaaaugaggaagaagaacaaacauuaacaauucucauaaggacuggacuauugguaaucucaggauuauuuccuguaagcauaccaauuacugcggcggcaugguaucugugggagguuaagaaacaaagagcuggaguacugugggacgucccgucaccacccccaguaggaaaagcugaacuugaagauggugccuauaggauaaagcaaaaagguauacuaggauauagccaaauaggggcaggagucuacaaagaaggcacuuuccacacaauguggcauguaacacguggagcuguauuaaugcauagaggaaagagaauugaaccaucuugggcagaugucaagaaagaucuuauaagcuauggcggcggauggaagcuggaaggcgaauggaaagagggugaagagguacagguucuugcucuggaaccagggaaaaauccgagggccguacagacaaaaccaggacucuucaagacuaacacagguacuauaggagcggucucucucgauuuuucaccugguaccucuggaagcccuaucguugaccgaaaaggaaaaguaguagggcuuuaugguaauggaguaguuacacguagcggagcuuauguauccgcuauugcucaaaccgaaaaaucgauugaggacaaccccgaaauagaggaugauauauucagaaagaaacggcuuacuaucauggaucuacauccaggcgcuggcaaaacaaaaagauauuugccagccauagugcgagaagcuauaaaacgaggucuccggacacuaauuuuggccccaacgagaguuguagcugcggaaauggaagaagcacuuagaggccucccaauuagguaucagacacccgccauuagagcugagcauacggguagagaaauuguugauuuaaugugccaugcuacguucaccaugagacuguuauccccaguaaggguaccuaacuauaaucugauuaucauggacgaggcacauuucacggaucccgcuucaaucgcagcuagaggauauaucuccacuaggguagaaaugggagaagcggcgggcaucuucaugacagccacaccaccugguaguagagacccauuuccgcaaagcaaugcgccuauaauggaugaggaacgggagauaccggaaagaaguuggaauagcggacaugaguggguaacugacuucaaaggaaaaaccguaugguucgugccaucgauuaaggccggaaacgauauagcagcaugucuacgcaagaauggcaaaaagguaauucaauuaucucgcaaaacauucgacucagaauacguuaaaaccaggacuaaugauugggauuuuguuguaacaacagacauuagugaaaugggcgcgaauuuuaaagcugaaagagugauugacccacgacgauguaugaagccgguaauacuuacugauggagaggagcgaguaauauuagccggucccaugccuguuacacauagcucagcagcucaaagacgcggaagaauagguagaaauccgaagaacgagaacgaucaauauauuuacaugggagaaccucucgaaaacgaugaagacugcgcgcauuggaaagaggcaaaaauguugcuugauaacauaaauacacccgaaggaauuaucccauccauguucgaaccagaacgggaaaagguagaugcuaucgacggagaauacagauuacguggugaagcacguaaaacauuugucgacuuaaugaggcguggcgacuugccggucugguuggcuuaccgagucgccgcugaaggaauuaauuaugcugaccgaagaugguguuucgauggugucaaaaauaaccaaaucuuagaagagaauguggaaguugagauuuggacaaaagaaggagaaagaaagaaauuaaaaccaagauggcuagaugcuagaaucuauucugauccuuuagcuuuaaaagaauuuaaggaauuugcugcuggucggaaaucuuugacguuaaacuuaauaaccgaaaugggacgacuuccaaccuuuaugacccagaaagccagagaugcucuagauaacuuagcgguucuucauacagcugaggccgguggacgggcauacaaucaugcuuuaagcgaacugccagaaacacuggaaacauuauuacuguugacgcuuuuagcaacagucacaggaggcauauuuuuauuucugaugucgggcaaagggguaggaaaaaugacuuuagguauguguugcauaauaaccgccagcauauuauuaugguaugcacaaauacagccucauuggaucgcggcgucgauuauccuugaguucuuuuuaauuguacuuuuaauuccugaaccggaaaaacagaggacgccacaagauaaccaauuaacguauguaguaauagcgauacuuacaguugucgcugccacgauggcaaaugaaaugggguuuuuggagaaaacuaaaaaggauuugggauuaggaucuauagcuacacaagagccagaaagcaauauauuagacauugacuuacgacccgcaucugcauggacuuuguacgcaguagcaaccacauucguaacacccaugcuaaggcacucgauugaaaacagcucggugaacgucucauuaacagccauagcaaaucaagcaacaguucuaaugggauuaggcaaaggauggccucuguccaaaauggacauuggagugccucuccuggcaauaggcugcuauucgcagguuaauccuauaacauugacugcagcacuucuuuugcuaguugcacauuaugcaauuauuggaccuggacuccaagcaaaagcaacacgagaggcccaaaaacgugcagcggcuggcauaaugaaaaaucccacugucgauggcguaaccgucauagauuuagacccuauacccuacgacccaaaauuugagaaacaacuuggccaggucauguuguuaauccuaugcguuacucagguacuaaugaugagaacuacuugggcauuaugcgaagcccugacacucgcaacagggccaauauccacacugugggaaggaaauccaggacgguucuggaacacaacuauagcaguaucaauggcaaacauauuuagaggcaguuaccucgccggugccggucuccuguucucaauaaugaaaaauacuacaaauacacgccgaggaacugguaacauuggugaaacacucggagagaaguggaagagucguuugaaugcgcuaggcaagucggaauuucaaauuuauaaaaaguccggaauacaagaggucgacagaacuuuagccaaagaggguauuaaacgaggcgaaacugaccaccaugcaguaucgcgggguagcgcaaaacuuagaugguuugucgaaagaaauaugguuacccccgaaggaaaagugguugaucuagguugugguagaggugguuggucauauuacuguggagggcuaaaagauguuagagaagugaaaggcuuaacuaaagguggcccuggacacgaagaaccaauaccaaugucuaccuaugguuggaaccuggugagauuacagucaggcguagauguauucuuuacgccuccagaaaaaugugacacuuuguugugugacaucggcgaaucuagcccuaauccuacuauagaagcaggaagaacauuaagggugcugucguuaguugagaacugguuaaauaaugauacucaauuuuguauuaaaguauugaacccuuauaugcccagcguaauugagaaaauggaaacgcuacaacguaaauacggaggggcauugguacgaaauccgcuaucacgaaauaguacacaugaaauguacuggguaucaaacgcaacuggaaauauaguaucuucaguuaauaugauaucuagaaugcucauaaauagauucacaaugaaacauaagaaagcgaccuaugagccggaugucgaucuggguucugggacaagaaacauagggauugaaagcgaaauuccuaacuuagauaucauagguaaacguauagagaaaauaaaacaagaacacgaaaccucguggcauuacgaccaagaucaucccuacaaaacuugggcauaucaugggucuuaugaaacuaaacagacuggaucugccucuaguaugguuaauggcgucgugcggcuacucacaaaaccaugggauguggucccaaugguaacacaaauggccaugacagauacgacacccuucggccaacaaagggucuucaaggaaaaaguagauaccaggacucaagaacccaaggaaggaacgaagaaacuuaugaaaauaaccgcagaauggcuauggaaggaauugggaaagaagaaaacaccccgaaugugcacacgugaagaauuuacccgcaaaguucgaaguaaugcugcuuuaggagcgaucuucacagacgagaacaaauggaaaagugcucgagaagcaguagaggacucucgcuucuggaagcuaguagacaaagaaagaaacuuacaucuagaggguaaaugcgaaaccuguguauacaauaugaugggcaaacgcgagaagaaauugggcgaguuuggaaaagcuaaagguucccgagcaauuugguauauguggcucggagcuagguuccuagaauuugaagcucuaggauuuuuaaacgaggaccacugguuuuccagggaaaacagucucucaggaguagagggagaaggguuacacaaacuaggauacauacuacgugaugugucuaaaaaggaagggggcgcuauguaugcugaugauacagccgggugggauacucguauuacucuugaggaucuuaagaaugaagagaugguaacuaaucauauggagggagaacacaagaaacuagccgaggcaauuuuuaaguuaacuuaucaaaacaagguaguaaggguacaacguccaacgccaagagguacgguaauggacauuauaucuagacgagaucagagaggaagcggacaagugggcacauacggauuaaauacuuucaccaauauggaagcgcaguuaauuaggcaaauggaaggagaaggaguguuuaaaagcauccaaaggcuaacagucaccgaagaaauagcaguacaaaauuggcuagcacgagugggccgugaaagguuaagucgaauggcaauaucaggcgaugauugcguaguaaaaccauuagacgaccguuuugcuagcgcgcuaacagcuuugaaugauaugggaaaaguucgaaaagauauacaacagugggaaccaucuagaggcuggaaugauuggacacaaguacccuucuguagucaccacuuccaugaacuaauaaugaaagacgggaggguccuaguuguuccgugccggaaucaggaugaguuaaucgggcgagcccgaauaucacaaggcgcuggguggucccuuaaagagacagccugcuugggaaaaaguuacgcgcaaauguggucgcuuauguauuuucaccgccgagauuuacgguuagcggcaaacgcaauaugcucugcaguuccaucccauugggugccaacaucucguacaacguggagcauucaugcaaagcaugaauggaugacaacggaggauaugcuaacagucuggaauaggguauggauacaagagaauccguggauggaggauaaaacaccagucgagucuugggaagaaguaccauauuuaggcaaaagggaggaccaauggugugguagccuuauaggccugaccuccagagcaacgugggcuaaaaauauucaaacagcuauaaaccaaguccggagccuaaucggaaacgaagaauacacggauuauaugccuucuaugaagcgauucaggcgagaggaggaagaggccggaguuuuaugguaa

SEQ ID NO: 22766 - RNA, 9876 nt, Artificial Sequence
  derived and/or modified CDS sequence (opt6) from DENV-2__EU482782__SS-prME
agcgcagggaugauaauuauguuaauaccaaccguuauggccuuucauuugaccacucgaaauggagaaccccacaugauaguaggaauacaagaaaaagguaaaucacuauuauuuaaaacagaagauggcgugaacaugugcacgcucauggcaauggaccuaggagaauuaugugaagauaccauaacuuauaaauguccacuucuaagacaaaacgaaccggaagauauagauugcuggugcaacaguaccaguaccuggguaaccuauggaacaugcaccacgaccggcgaacauagacgagagaaacguucaguagcuuuaguuccgcauguugggaugggucuagaaacacgcacagaaacauggaugucuucagaaggagcguggaaacacgcacaacgaauagaaacauggauacugagacacccuggguucacuauaauggcagccauuuuagcuuauacaaucggaacaacccacuuucaacgagucuuaauauucauucucuuaacagcaguugcacccaguaugacaaugagguguaucgguauaucaaacagggacuucguugaagguguuagcggaggaagcuggguggauauaguauuggaacauggaucuuguguaaccacaauggcgaaaaauaaaccaacauuggacuuugaacuaauuaaaacugaagcuaaacaaccagcaaccuuaagaaaauacuguauugaagcaaaacuaacaaacacuacaacagaaucacgaugcccaacacaaggcgaaccgucacuaaaagaagaacaagacaaacgauuugugugcaaacacucuaugguggaucgagggugggggaacggaugcggguuguucgggaaaggcgggaucguuacuugcgcuauguucacaugcaagaaaaauauggaagggaaaauaguacaacccgaaaauuuggaguauaccauugucguaacuccgcacaguggugaagaacacgcaguagguaaugacacaggcaaacauggaaaagaaaucaaaguuacaccccaaagcaguauaacugaagcggaauuaaccggauauggcacuguaacgauggaaugcagccccagaacgggauuggauuuuaacgaaaugguauuacuccaaauggaaaauaaggcuugguugguacaucggcaaugguuucuugacuuaccacuacccuggcuacccggcgccgauaaacaggaaucgaacuggauucaaaaagaaacccucguaacauucaaaaauccgcacgccaagaagcaggacgugguuguauuaggcucgcaagaaggggcaaugcacacugcgcugacaggagcaacugaaauucaaauguccaguggaaaccugcucuuuacuggccaucucaaauguagauugcguauggauaaacuucaacugaaaggaaugucauauucaauguguacagguaaauucaagguuguaaaagaaauagcggagacgcaacauggaacuauaguuauuagagugcaauaugaaggugauggaucuccguguaaaauuccuuucgagauaauggaccuagagaaaagauauguauuagggcgcuuaaucacgguaaauccaauaguaaccgagaaagacaguccugugaauauagaagccgaaccgccguuuggcgauagcuacauuauaauaggaguagaaccagggcaauuaaaguuaaauugguuuaagaaaggauccucuauuggucaaauguuugaaaccacuaugagaggcgcuaagcguauggcaaucuuaggcgacaccgccugggauuuuggguccuuagggggagucuuuacaaguauuggcaaagcucuccaucaaguauucggagcuauuuauggugcggcguucuccgguguuuccuggacuaugaaaauacuaauagguguuauaauaacauggauuggcaugaacucuagaucuacaucgcuuucaguaucuuugguccucgucggaauaguaacccuauaccucggaguuaugguacaagcagauucaggcuguguaguuucauggaaaaauaaagagcuaaaauguggaagcggaauuuuuauaacggacaacguccacaccuggaccgagcaauacaaauuccaaccugaaaguccaucuaaauuagcuucugcaauucaaaaggcccaagaagagggaauaugugggauacguagcguaacgcguuuagaaaaucugauguggaaacaaauaaccccugaacucaaccauauauuagcagaaaacgaagucaaauuaacaaucaugaccggagauauacguggaauaaugcaagcuggaaaaagguccuugagaccccaaccaacugaacuaaaauauaguuggaagacaugggguaaggcuaaaauguugaguacagagagcuauaaucaaaccuuucuuauugacggucccgaaacugcagaguguccaaacacaaacagagccuggaauagccuagaaguagaagauuauggguucgguguauucacgacaaauaucugguuaaaauuaaaggaaaaacaggacgcuuucugugauaguaaacuaaugucagcugcgauuaaagacaauagagccguacaugcagacaugggauacuggaucgaaucagcgcuaaacgacacauggaaaauagaaaaagccagcuuuaucgaagucaaaaauugucacuggcccaaaagccacacucuuuggaguaauggagugcuagagagugaaaugauaauaccuaaaaauuuggccggaccggucucucagcacaacuaucgaccaggauaccauacacagauagcaggaccauggcauuuagguaaacuagagauggacuuugacuuuugugauggcacaacagugauagucacagaagacugcggaaauaggggcccuucccugcgaacgacgacagcguccgguaaacucaucaccgagugguguugucguucauguacuuugccacccuuacgcuaccgaggcgaagacgggugcugguauggaauggagaucagaccucuaaaagaaaaagaagaaaaccucguaaacuccuuagucaccgcuggccacggucagguagauaacuuuucgcuggggguucuuggcauggcuuuguuucuugaagaaauguuaagaaccagaguggguacgaaacaugcaaucuuauugguggcagucagcuuuguaacucuaauaacggguaauaugagcuucaaagaccuaggaaggguaguaguaaugguaggagcuacaauggcugaugacauuggaaugggaguuacguauuuagcacuccuugcggcauucaaaguccguccgaccuucguagccggauuauuguuaagaaaacucacaucaaaagaauugaugaugaccacuaucggaauaguucuucugagucagaguaccauacccgaaacuguacuagaacuaacggaugcauuagcauuagguaugaugguacuaaaaauuguccgaaauauggaaaaguaccagcuagcaguaacaauaauggcuauucucugcguaccuaacgcaguuauuuuacaaaaugcauggaaagugucauguacaauacuugcaguaguaucaguaaguccauuacuccugacaagcucucaacagaaaacagauuggauaccauuagcguuaacaauaaaaggcuuaaauccuacagcuauauuuuuaacuacuuuaucaagaacaaauaagaaaagaucauggccgcuuaaugaagcaaucauggcaguagguauggucuccauuuuagcaagcagucuguuaaagaaugauauaccaaugaccggacccuuaguugccggagguuuacuaacuguaugcuaugugcuaacuggaagaagugcggaucuagagcucgaaagagcgacagaugugaagugggaggaccaagcagaaaucuccggaucaucucccauccucaguauaacuauaagugaggauggaaguaugucaaucaaaaacgaggaggaagaacaaacacuaacgauacuaaucagaacagggcugcucgugaucucugguuuauuucccauuagcauaccgauaacagccgcagcuugguacuuaugggagguuaagaaacaacgagcugggguauugugggacguacccucaccaccaccgaugggaaaggcagaauuagaagacggugcauacaggauuaaacagaagggaauccuuggauauucgcaaaucggagcaggggucuauaaagaaggcacuuuucacacuauguggcauguaaccaggggugcaguccuuaugcauaaaggaaagaggauugaaccaaguugggcagacguuaagaaagaucucauuagcuacggaggagguuggaagcuagaaggugaauggaaagaaggagaagagguucagguacuugccuuagagccagguaaaaauccucgugcaguccagacgaaaccuggacucuucaaaacaaauacgggaacaauaggugcuguuuccuuagauuuuagcccggguacaucagguucaccuauaauagacaagaaagggaaggucguggguuuguacggaaauggaguuguaacacgaaguggcgcauauguaucggcaauagcacaaacugaaaagucuauagaagauaacccggaaauagaagaugacauuuucagaaagagaagacuuacaauaauggaccuacauccuggagcuggaaaaacuaaaagguaucuaccagcaaucguaagggaagcuaucaaaaggggucuacguacccugauccuagcaccuacacguguuguggcagcugaaauggaagaagcgcuacgcggacuuccgauucguuaucagacuccugcuauacgagcugaacacacugggagagaaaucguagauuuaaugugccaugcaaccuuuacuaugcgguuauuaucgccaguccguguuccgaauuacaacuuaaucauuauggacgaagcgcauuucacagaccccgcaaguauagcagccagaggauacauaagcacgagggucgaaaugggcgaagcggcggguauuuucaugaccgcgacaccacccgguucucgggacccuuuuccccaaucaaaugcucccaucauagaugaagaaagagagauuccugaaaggucauggaacucgggacacgaaugggucacagauuuuaaagguaaaacaguuugguuuguuccuucgauaaaagccgguaaugacauagcagcuuguuuaaggaaaaauggcaaaaagguuauacaacuaagccgaaaaacauuugacagcgaauauguaaagacccguacaaaugauugggacuucguaguaacuacagauauaagcgaaaugggagcaaauuucaaagccgaaaggguaauagauccgagacgauguaugaaaccaguaauacuuacagauggugaagaaagagucauacuugcuggaccaaugcccguaacucacaguagugcagcucaaagacgaggacggauaggccguaacccuaagaaugagaacgaccaauauaucuacaugggggaaccacuugaaaaugaugaggauugcgcacacuggaaagaggccaaaaugcuacuugauaauauaaauaccccagaaggaauaaucccaucaauguucgaaccggagagggagaagguugacgccauugacggugaauaucgcuuaaggggcgaagcgaggaaaacguuuguggacuuaaugcgaagaggugauuuaccugucugguuagcauacaaaguagcagcugagggaauuaauuacgcggacagacgaugguguuuugauggaauuaaaaacaaucaaauacuggaagaaaauguagaaguugagaucuggaccaaagaaggagagaggaagaaacuuaaaccaaggugguuagacgcuagaaucuauucggacccacuugcacucaaagaguucaaagaguuugcugcagguaggaagucucuaacacuuaauuuaauuaccgaaaugggucgacucccgacauuuaugacccagaaaacuagagacgcacuagauaacuuggcaguauugcauacugcagaggcuggagguagagcauacaaucacgccuugucggagcuacccgaaacauuagaaacccuucuguugcuaacacuacuugcaacaguuacuggcgggauauuuuuguuucuuaugucgggaagagggauagggaagaugaccuuagggaugugcugcaucauuacugccucuaucuuauugugguaugcccaaauucaaccccauuggauagcggcaagcaucauauuggaguucuuuuugauaguguuauugauuccagaaccagaaaaacaaaggacaccucaagacaaucaacuaacuuauguuguuauagccauucuaacaguagucgcagcaaccauggcuaaugaaauggguuuucuagaaaagacuaagaaagaccuaggacuugguaguauagcuacucaacaaccagaaucuaacauacucgauauagaccuaagaccugcuucugccuggaccuuauacgcugucgcaaccacauucguaaccccuaugcuuagacauucgauagaaaauucguccgucaauguuucucugacagcgauagcuaaccaagcaaccguguuaaugggauuggguaagggauggccucuaucaaaaauggauauuggaguaccauuauuagcuauagggugcuacucgcaaguaaaccccaucaccuuaacugccgcauuacucuuguuaguggcacacuaugccauaaucggucccggcuuacaagcaaaagcuacgagggaagcucaaaaacgagcugcugcagguauaaugaaaaauccuaccguugauggcaucacugucauugaccuggacccaauuccauaugauccgaaguuugagaaacaacuaggacaagugaugcuucuuauuuuaugcguaacgcaaguacugaugaugcgaacaacuugggcauugugugaagcauuaacgcucgcaaccggcccaaucucgacgcuuugggaaggcaacccgggucgguuuuggaauacgacaauagcuguaagcauggcaaacauuuuuaggggcucauaccuagcuggggcaggucuauuauucuccauaaugaaaaauacaacuaacacaagaagaggaacggggaauauaggugaaacgcuaggagagaaauggaaaucgcgauuaaaugcauugggcaagagugaauuucaaauuuacaaaaagucuggcauacaagaaguugaucgaacacuagcaaaagagggaauaaagagaggggaaacagaucaccacgcgguaaguagaggaagcgcuaaauuacgaugguuugucgaaaggaacaugguaacuccggaaggaaaagugguugaucuuggaugcgggagaggagguuggagcuauuacugcggugguuugaaaaauguccgcgaaguaaaagggcuaacaaaaggugggccaggacacgaggagcccaucccaauguccacauauggcuggaauuugguccgguuacagucugggguagaugucuucuucaucccaccagagaaaugcgauacccuauugugugauauuggugagucuaguccuaacccaacaguggaagcuggacgaacauuaagaguuuuaaaucuaguggaaaauuggcuaaauaauaauacacaguuuugcauaaaagucuugaaucccuauaugccuuccgugauugagaaaauggaagcacuccaaagaaaguacggcggagcccuagucagaaauccgcucucacgaaauucgacucaugaaauguauugggucaguaaugccucgggaaauauuguaagcucagugaacaugauaucgagaauguuaauuaacagauuuacaaugaggcauaagaaagcaaccuaugaaccagauguagaucuggguucugggaccagaaacaucgguauagaaucagaaaucccaaaccuagacauaaucggaaaaagaauugagaaaauaaaacaagaacaugaaacaucauggcauuaugaucaggaucauccauauaaaaccugggcauaucauggcucauaugagacaaaacagacagguagugcaucgaguauggucaacgggguagugagacuauuaacaaagcccugggacguacuccccacagucacucagauggccaugacagauacaacaccguuuggacaacaacguguauucaaggaaaaaguagacacucgcacgcaggagccaaaggaagggacaaagaaacucaugaaaauuacagccgaauggcucuggaaagaguuaggcaagaagaaaacgccaagaauguguacgcgagaagaauuuacacggaaaguaagaucgaaugcugcguuaggggcuauauuuacagaugaaaauaaauggaaaucagcgcgcgaggcaguggaagacucucgauuuugggaguuaguagacaaagagcgaaacuuacacuuagagggaaaaugcgaaacauguguguauaauaugaugggaaaaagagaaaagaaacuaggagaguucgggaaagcaaaagguucaagagcaauuugguauaugugguuaggggcgagauuuuuagaguucgaggcucuaggauuuuugaacgaagaccauugguuuucgagagaaaacucuuuaagugggguugaaggugaaggucuccauaaguuagguuacauauuaagagacguaagcaagaaagagggaggagcaauguaugcagaugauacagcuggaugggauacuaggauuacacuugaagaccuuaaaaaugaagaaauggugacaaaccauauggaaggagaacacaagaaacuagcagaggcuaucuucaaauugacuuaucaaaauaaaguuguaagagugcaaaggccgacgccucgagguacaguaauggauauuauaucacgacgagaccaaagaggcaguggccaaguuggcacuuacggucuaaauaccuuuacaaauauggaagcccaauuaauaagacaaauggagggcgaaggaguuuucaagaauauccaacaucuaacaguaacugaggaaguggcgguacacaacuggcuagcuagaguaggaagagaacggcugaguagaauggcgaucucuggagacgauuguguagugaaaccguuggacgauagauuugcaaaugccuugacugcacuaaacgacaugggaaagauaagaaaagauauucaacaaugggagccaucaaagggauggaacgauuggacucaagucccauuuuguagccaucauuuccaugaauugauuaugaaagaugggagaguccuuguuguucccugcagaaaucaggaugaauugaucggacgagcacgcauuucacagggggcaggauggagccuacgcgaaaccgcaugccuugggaaauccuacgcacaaauguggucauuaauguauuuccacagaagagaccugcgacucgccgcuaaugcaauaugcagugcugucccuucacauugggucccuaccucgcgcaccacuuggucgauacaugccaaacacgaauggaugacuacagaagauaugcucacuguauggaauagaguuuggauacgagaaaaucccuggauggaggacaaaacaccagucgagaguugggaagagauacccuaucuaggaaaaagagaggaucaguggugcggaucucuaauaggacuuacgucaagagccacgugggcuaagaacauacaagcggcuauaaaucagguucggaguuuaauaggcaacgaggaauacacagauuacaugccuucaaugaagcgauuucgucgugaggaagaggaagcugguguucugugguaa

SEQ ID NO: 22767 - RNA, 9876 nt, Artificial Sequence
  derived and/or modified CDS sequence (opt6) from DENV-2__EU482783__SS-prME
acugcgggaguaauaauuauguugauucccacugcgauggcuuuccauuuaaccacuagaaacggagaaccccauaugauaguaggaagacaagaaaaagggaaaagccuuuuauucaaaacugaagauggaguaaacauguguacuuuaauggcuauugauuuaggagaauuaugcgaagauacgauuacguacaaaugcccguuauuacgucaaaaugaaccggaagacauagacuguuggugcaacaguaccucaacauggguuacauauggaacaugcacaacgacgggcgaacaccgccgugagaaacggagcguagcauuagugccacacgugggaaugggauuagaaacaagaaccgaaaccuggaugaguagugaaggugcguggaaacaugcacaaaggaucgaaacauggauacuaagacacccuggauuuacgauaauggcagcaauuuuagcauauacuguugguacuacgcauuuucaaagagcucugauauucauucuacuugcagcuguggcuccaucgaugacuaugcguuguaucgguauaaguaauagagauuuuguagaaggcgugucagggggcaguuggguggauauaguacuagaacauggaaguugcguuaccacuauggcgaaaaauaaaccaacacuagauuuugaauuaauuaaaacagaagcaaaacaaccagcuaccuugcgcaaauacugcauagaagcuaaacucacuaauaccacaacagaaaguagauguccgacgcaaggugaaccgucauuaaaugaagaacaagauaaaagauuugucuguaaacauaguaugguagaucguggauggggcaauggcuguggcuuauuuggaaaagggggaauaguuacgugcgcaauguuuaccuguaagaaaaacauggagggaaaaauuguccaaccggaaaauuuagaauauacgauaguaauaaccccgcacaguggcgaggagcacgcaguagggaacgauacaggaaaacauggaaaagaaauaaaaauaacaccccaaucucccauuacagaagcagaacucacgggauacggaacgguaacuauggaaugcucgccaaggacuggcuuagacuuuaacgaaaugguauuauuacaaauggaggacaaagcauggcuaguacaccgccaaugguuccuugaucuuccacucccauggcucccuggagcagauacgcaggguuccaacuggauucaaaaagaaacacucgucacauuuaagaauccccaugccaagaaacaggacguggucguauugggaucgcaagaaggugccaugcauacugcuuuaacuggugcaacggaaauccagaugucaagcggaaacuuguuauucacaggacaccugaaauguagacuacgaauggauaaacuucaacugaaaggaaugucguauucgauguguacaggaaaauuuaaaauuguaaaagaaauugcugaaacccaacacggaacaauuguaauuaggguucaauacgaaggugauggaucuccauguaaaauaccguucgaaauuauggauuuagaaaagagacauguacuaggucgauugaucacaguuaaccccaucguaacggaaaaagauuccccuguaaacauagaagcagaaccaccuuuuggcgacaguuacauaaucauaggaguagaaccaggccagcuuaaacuaaauugguucaagaaagggucaucaauuggucaaauguucgaaacaacgaugcggggagccaaaagaauggcaauacuaggggauacugcaugggacuucggcagucuaggaggaguuuucacgucgauagguaaagcauuacaccaaguguucggugccauauacggggcugcuuucucaggcgucuccuggacgaugaaaauucuaauugggguaauuauaacuuggauuggaaugaacagucguuccacgagcuugagcguaaguuuaguauuaguagguguaauuacgcuuuauuuaggagcaaugguucaagccgacucuggguguguggucucguggaaaaacaaagaguuaaaguguggaucaggaauuuuuauuacagauaacguacacaccuggacagaacaguacaaguuccaacccgaaucaccaucaaaacuugcaagcgcaauacaaaaagcccacgaagaagggauuugugguaucagaagugugacaagauuggagaauuuaauguggaaacaaauuacaccugaacuaaaccauauacuaagcgaaaaugaaguuaagcugaccaucaugacagguggcauaaaagggauaaugcaagcuggaaaacgaucacuuaggccgcaacccacagaauugaaguauucauggaagacuugggguaaggcgaaaaugcucuccacggagagucacaaccagacauuuuugauugacgggcccgagacugcagaaugccccaauacuaaucgugcauggaacaguuuagaaguugaagacuauggauucgguguuuucaccacgaacauauggcuuaaacuaagagagaaacaggauguauuuugcgauucuaaacuaaugagugcugcgauuaaagauaaccgugccguacacgcagauaugggcuacuggauagaaucggcauuaaacgauacauggaaaauggaaaaggcaucauuuauagaagucaaguccugucauuggccgaaaucucauacuuuauggucgaacggcgucuuggagucagagaugauaauaccaaagucauuugcaggcccaguaagccaacacaacuacagaccgggcuauuauacacaaacagccgguccauggcauuugggaaaacuugaaauggacuucgacuucugugagggaacaacaguuguagugacggaagauugcggaaauagagguccaucauuacguacaacgacagcaagcgguaaauuaauaacugaaugguguugucgauccuguacacuaccgccacuuagguaccguggcgaagacggguguugguacgggauggaaauccgucccuuaaaagaaaaggaagaaaaucuuguaaauuccuuggugacggcaggacauggacagauagauaauuuuagccugggaguucuuggcauggcccuauuccuagaagaaaugcuccgcacgagaguaggaacaaaacaugcaauauuacuggucacagugagcuuuguaacucuuauuacaggaaacaugucauuucgagaccucgguaggguaaugguaaugguuggagcagcaaugacugaugauaucggaauggggguuacauaccucgcgcugcuugccgccuucaaaguccggccaaccuuugccgcaggccuucuucuccgaaagcuaacaucaaaagaauuaaugauggcaacaauaggaauugcacuauuaagccaaaguacgauuccagaaacuauacuugaacugacagacgcauuggcacuaggaaugaugguuuuaaaaauuguuagaaacauggaaaaguaccaauuagcaguuacaauaauggcaaucaguuguguuccgaacgcuguaauacuacaaaaugccuggaaagugucauguacaauacucgcagcaguaucgguuaguccccugcuucuuacgucaucucaacagaaagcagacuggauaccauuggcacuuacaauaaaaggucuaaaccccacagcaauauuuuuaacaacauuaagccggaccucuaagaagcgcagcuggccacuaaaugaagcuaucauggcggucgguaugguaucaauauuagcaaguucacuucuuaaaaacgauauaccaaugacaggaccucuaguggcaggcgggcuucucacaguuuguuacguccuaacaggaagaagugcugaccucgaauuagagcgagcuacagauguaaaaugggaggaucaagcugaaauaagcggaucaagcccaaucuugaguauaacuauagccgaagacggaucuaugucaaucaaaaaugaagaagaagaacaaacacuaacaauacuaauaagaacuggcuuauuaguaauuuccggauuguuuccaguaaguaucccgauuaccgccgcagcaugguaccugugggaaguuaaaaagcagagggcgggaguuuuaugggauguuccgaguccaccuccuguaggaaaagcugaacucgaagacggagcauaucgaaucaaacaaaaggggauucuuggauauagucagauuggagcuggaguuuauaaggaaggaaccuuucauacgauguggcauguuacgcggggugcaguccuuaugcauagaggaaaacggauugagccuagcugggcagacguuaaaaaggacuuaauuaguuaugguggaggauggaaacucgagggagaguggaaagagggugaagaaguccaaguccuugcacuggaaccaggaaagaauccaagagcuguucaaaccaaacccggauuguucaagacgaauacagggacaauaggagcggugaguuuggacuucucaccaggaacaaguggcagcccuaucguagauaggaaaggcaagguaguaggauuauacggcaauggaguuguuacaagaucgggagcguaugucagugcaauagcccaaacggaaaagagcauagaggauaacccagagaucgaagaugauaucuuuaggaagaaaagacuuacgauuauggaccuacauccaggagcgggaaaaacuaaaagauacuuaccggccauuguuagggaggcuauaaaacgaggauuacgaacacucauacucgccccuacucguguuguggcugccgaaauggaggaagcgcuuagaggacuuccaauccgcuaccaaacccccgcaauaagggcagagcauacgggaagagaaauaguagaucuuaugugccacgcaacauuuaccaugcgauuauuaucgccugugcgaguuccuaauuauaaccuaauaauuauggacgaggcgcauuucacugacccugcgaguauagcagcaaggggauacauaaguacaagaguagaaaugggagaagcggcugggauauucaugacugcaacaccaccgggcucuagagaucccuucccacagucuaaugcuccuauaauggaugaagaaagagaaaucccagaaagaucauggaacucaggucacgaauggguaaccgauuucaaagguaaaacuguuugguucguacccagcauaaaagcugggaaugauauagcggcuuguuuaaggaaaaaugggaaaaagguuauucagcuaucacguaagacuuuugacucugaauauguaaaaacaagaacuaaugauugggacuucgucguuacaaccgacauaagugaaaugggcgcuaacuuuaaagccgaacgagugauugacccgagacgguguaugaagcccgucauacugacugacggggaggaaagaguuauauuggcggggccgaugccgguaacccauucaucagcagcgcaaaggagaggacgaauaggucguaauccaaagaacgaaaaugaucaguauauuuauaugggugaaccuuuagaaaaugaugaagacugugcgcacuggaaagaagcuaaaaugcucuuggauaacauaaauaccccagagggaauuauuccauccauguuugaaccagaacgggagaaaguugaugcaauagacggugaguauagguuacgaggcgaggcgagaaaaacauuugucgaccucaugcguaggggugaucugcccguuugguuagcguaucgaguggcggcugaggggauaaauuaugcagaucgucgcugguguuuugauggggugaaaaauaaucagauccuggaagaaaauguggaaguagaaauauggacaaaagaaggagagaggaaaaagcucaagccaagauggcuugaugcacggauuuacagcgauccauuagcauuaaaggaguuuaaagaauuugcggcggguagaaaaagccucaccuuaaaccuaauuacugagaugggaagacuuccaaccuuuaugacacagaaagcccgagaugcucuugauaaucuagccgugcuacauacggccgaggcaggaggucgggcuuauaaucacgcauuaucggaacuaccagagacccuagaaacauuauuacuacuuacguuauuagcaacuguaacagguggaauauuuuuguuucuuaugucggggaaagguguaggaaaaaugacccugggcauguguuguaucaucacagccaguauccuauuaugguaugcucagauacagccacauuggauugcagccuccauuauauuggaguucuuucuaaucguuuugcugauucccgaacccgaaaaacaaaggacuccgcaagauaaccaauuaacguacguagucauagcuauucuaacggucguggcggcaacaauggcgaacgaaaugggauucuuagagaaaacuaagaaagaucuaggacuaggcagcauagcaacacaagaaccugaaucuaacauacuagauaucgacuuacgcccagcaucagcauggacauuguaugcaguugcgaccacguuuguaacuccuaugcuaagacauagcauugagaacucaucaguuaauguuagcuuaacagccauagcuaaucaagcaacaguccucaugggcuuaggaaagggguggccucuuagcaaaauggauauaggaguuccacuucuagccauagguugcuacagccaggugaauccaaucacgcucacagcagcgcuucuacuauuaguagcacauuaugcuaucauuggcccgggauugcaagcuaaagcaacaagagaagcucagaaaagagcugcagccgguauaaugaagaacccaacugucgacggaauaacagucauagauuuagauccaauaccguaugacccaaaauuugaaaaacaacuuggucaagucaugcuacuaauacuuugcgugacucagguccuaaugaugagaaccacaugggcucucugcgaagcacuuacucucgcgacaggcccaaucucuacucugugggaaggaaauccgggcagguuuuggaacaccacaauagcaguuagcauggcgaacauauuuaggggcucguauuuagcuggggcuggacugcucuuuaguaucaugaaaaauacaaccaacacgagaagagggaccgguaauauuggagaaacacuaggagagaaauggaagucacgacuuaacgcauuagguaagagcgaauuucagauuuauaagaaaucggguauacaggagguggauagaacauuagccaaagaagggauaaaaagaggggaaacugaccaccacgccgucaguagaggaucagcuaaacuaaggugguuuguagaaagaaacauggucacaccggagggaaaaguagucgaccuaggguguggaagaggaggguggucauauuauuguggcggguuaaaagauguuagagaggugaaagguuuaacaaaaggagggccaggucaugaagaaccaauuccaaugucuacguacgguuggaauuuagucagacuacaaucaggcguugacgucuuuuucacaccuccggaaaagugugauacauuguugugcgauauaggagaaaguucaccgaacccaaccauagaagcaggacgaacauuaagaguguuaagccuaguagaaaauugguuaaauaaugauacucaguuuugcauuaaaguauuaaauccauacaugccaucaguaauagaaaagauggaaaccuuacagcggaaauauggcggagcacugguccgaaauccacugaguagaaauucgacacacgaaauguacuggguaucaaaugcaaccgguaacauugucagcaguguaaacaugauaagcagaaugcuaauuaauagguuuaccaugaagcauaagaaagccacuuacgaaccugacgucgacuuaggaagcggaacaagaaacaucggaauagaaagugaaaucccaaaccuugacauuauuggaaagaggaucgagaagauuaaacaggaacacgagacaaguuggcauuacgaccaagaucacccauacaaaacaugggcguaucacgguucauacgagacaaagcaaaccgguucugccaguaguauggugaauggaguggugaggcugcuaacaaaaccuugggaugucguuccuaugguuacacaaauggcaaugacagacaccacaccauuuggacaacaaaggguauuuaaagagaaaguugacacaaggacccaagaaccaaaagaaggaaccaagaaacuaaugaaaauuaccgcggaaugguuauggaaggaacuaggcaagaagaaaacuccaaggaugugcacacgagaagaauuuacacguaaagucagaaguaacgcggcucugggggccauauuuacagaugagaacaaauggaaaagugcuagagaggcaguagaagacagccguuuuugggaguugguugauaaggagcguaacuugcauuuagaggguaaaugugaaacaugugucuauaauaugaugggaaaacgggagaagaaauuaggggaguucgguaaagccaaggguucacgagcuauaugguacaugugguugggggccagauucuuggaauuugaggccuuaggauuuuuaaacgaggaccauugguucagucgagaaaacucauuaagcggaguagaaggagaaggccugcauaaacuuggauauauucuacgagauguaagcaagaaagaaggaggagccauguacgcagacgauacggcagguugggacaccagaauuacacuagaggacuugaaaaacgaagaaaugguuacaaaccacauggaaggagaacauaagaaacuagccgaagcgauauuuaaacuaacuuaccaaaauaaaguuguucgaguacaacguccgacaccccguggaacggucauggauauuaucagcagaagagaucagagaggaucgggacaggucgggacguauggucuuaacacguucacuaauauggaagcacaauuaauaagacaaauggagggcgaaggaguguuuaaaucaauacaaaggcuuacggugacugaagaaauugcgguacaaaauuggcuagcgcgaguugggcgggagagacuaaguagaauggcuauuucgggagacgacuguguaguuaaaccgcuagacgaucguuucgcuucagcacugacagcauuaaacgauauggggaagguaaggaaggacauacagcaaugggaaccuaguagaggauggaacgauuggacacaaguaccauuuugcucgcaccauuuccaugaacuaauaaugaaagauggccggguauuaguagugccaugucggaaccaggaugaauugauaggucgggcacgaauuucccaaggggccggauggaguuuaaaagagacagcaugccuagggaaguccuacgcacagauguggaguuuaauguacuuccauagaagagaucuucgcuuagcugcaaaugccauauguucggccguacccucacauuggguuccgacaucacguacuacgugguccauacacgcaaaacaugaauggaugacaacagaggauaugcugacgguauggaaucgaguuuggauacaggaaaauccguggauggaagauaagacucccguagagucuugggaagagguccccuaucucgggaaaagagaggaccaaugguguggcucuuuaauuggccuaacgucacgugcuacaugggcgaaaaauauucagacagcuauaaaucaaguaagaucccuaauuggaaacgaagaauauaccgauuauaugccgucaaugaaaagauuuagaagagaagaagaagaagcuggaguucucugguaa

SEQ ID NO: 22768 - RNA, 9876 nt, Artificial Sequence
  derived and/or modified CDS sequence (opt6) from DENV-2__EU482784__SS-prME
uccgccgguaugauaauuaugcuuauuccaacaguaauggcauuucaucuuaccacccgaaauggagagccacacaugauaguuggaauucaagagaaaggaaagucccuauuguucaaaacugaagauggaguuaacaugugcaccuuaauggcaauggaccucggggaauuaugcgaggacacaauaaccuacaaaugcccccuacugagacaaaacgaaccagaagauaucgacugcuggugcaauaguacaucuacuuggguaacauaugguacauguacgacaacaggugagcauagacgagagaaacgaaguguugcucugguaccacauguggggaugggucuugaaacacgcacagaaaccuggaugucaucagaaggagccuggaaacaugcgcagcgaaucgaaacuuggauacuccgacauccuggguuuacuauaauggcagcgauauuagcuuauacaaucggcacaacacacuuccaacgaguuuugaucuuuauucuauuaacugcuguagcgccuagcaugacuaugagauguauaggaaucucuaauagagacuuugucgaaggaguaagcggcgggaguuggguagauauaguacucgaacaugguaguugcgucacgacaauggcaaaaaauaagccaacccuggauuucgaauugauuaaaacagaagcuaaacaaccugcaacguuacgaaaauacugcauagaagcaaaacuaacaaauacaacgacugaaagcagauguccaacgcagggggaaccaucauugaaggaggagcaggacaaaagauucguguguaagcauaguaugguagaccgcggaugggguaauggcuguggguuauuugggaaaggagguaucgucaccugugcaauguuuacauguaaaaagaauauggaaggaaaaauaguccaaccagaaaauuuagaguauaccauuguaguaacaccgcacuccggcgaagagcaugcaguggggaaugacacaggaaagcacggaaaggaaauaaaagucacaccccaaucaagcauuaccgaagcagaguugacuggauauggaaccguaacgauggaguguucuccacgaacgggucuugacuuuaaugaaaugguguuauuacagauggaaaauaaggcaugguuaguucaucggcagugguuccuagaccuuccacuucccugguuaccaggagcagauaaacaagaaaguaacuggauacaaaaagagacauugguaacauuuaagaacccucaugcaaaaaaacaggauguugugguuuuagggagucaagaaggcgcaaugcacacagcccuaacuggugcuaccgaaauacaaaugucuagugguaaucuuuuauucaccggacaucuaaaaugucgacuaagaauggacaaauuacaguuaaagggaauguccuauuccaugugcacggguaaauuuaaaguagugaaggaaauagcugagacgcaacacgguaccauaguuauuagaguucaauaugagggagacggaucaccuuguaaaauucccuuugaaaucauggaccuugaaaaaagauacguguugggcagauuaauuacaguaaauccuauuguuacugaaaaagacagcccagugaauauugaagccgaaccuccuuuuggagauaguuacauuauaauuggcguagaaccgggucagcugaaauuaaacugguucaagaaggguucuaguaucggccaaauguuugaaacaacaaugaggggagccaaacgaauggcuauuuuaggggacacagcuugggauuuuggaucguuaggcggaguauucaccucuauaggaaaggcucuucaccaaguguuuggggcaauuuauggagcugcguuuucuggagucucuuggacaaugaaaauccuaaucggcguaaucaucacauggauuggcaugaauagccgcagcaccagcuuaagugugagucugguauuaguugguauaguaacacuauaucuuggaguuaugguacaagcagauuccggauguguuguuuccuggaaaaauaaagagcuaaaaugcgguaguggcauuuuuaucacugauaacguacacacauggaccgagcaauauaaguuucaaccugaaucacccucgaaacucgcauccgcaauucaaaaggcacaagaggaaggcauauguggcauaagaucgguuacgagacuggaaaaucuaauguggaaacaaauaacaccugaguuaaaccacauuuuagcagaaaacgaagucaaauuaacuauaaugacuggggacauaagagggauaaugcaagcaggcaagagaaguuuaagaccccaaccgaccgaacuuaaguacuccuggaagacaugggguaaagccaaaauguuguccacggaaagcuacaaccaaacguucuuaauagaugguccagaaaccgccgaaugucccaauacaaaucgggcuuggaauucacucgaaguagaagauuauggcuucggcguauuuaccacgaauauaugguugaaguuaaaagaaaaacaagacguuuuuugcgacagcaaacuaaugucagcagcaauaaaggacaguagggcaguacaugcggauaugggguauuggauagaaucagcuuugaacgauaccuggaagauugaaaaagcuucguuuauagagguuaaaaguugccacuggccaaaaucucauacgcucuggaguaacggcguauuagaaucugaaaugauaaucccgaagaacuuugcgggccccgucucacaacauaacuaccgaccaggauaccauacucaaacggccggaccuuggcaucuggggagauuggaaauggauuucgauuucugugaagguacuaccgucguaguaacugaagacugcggaaauagggguccgucacuaagaacaacgacagccaguggaaaacugauaacugaaugguguugcaggucaugcaccuuacccccauuaagauacaggggugaggacgguuguugguacggaauggaaauacguccauugaaggagaaagaagaaaaccuaguaaacagccucguuaccgcaggucauggucaaauagauaauuuuucguuagguguauuagguauggcgcuuuuuuuggaggaaauguuacgaacgagaauaggaacaaagcacgcaauauuauuagucgcaguaaguuuugugacguuaaucacaggcaacaugucauuucgagaccuagguagaguaauggucauggucggugcaacuaugacagaugauauaggaaugggggugacuuaucuagcuuugcucgccgcauucaaaguaagaccaacuuuugcagccggacuucuccuacguaaauuaacguccaaagaauugaugaugacaacuauaggaauagucuuauugagccaaucuacaauuccagagacuguucuugagcucacagacgcacuagcucuggguaugaugguguuaaagauuguaagaaacauggaaaaguaucaauuagccguaaccaucauggccauucuuugcguaccaaacgcaguaauacuucaaaaugccuggaaaguuucauguacuaucuuagcgguuguaucuguaucccccuuauuauuaacaucuucucagcaaaagacggacuggauaccguuagcauuaacgauuaaaggguuaaacccaacggcuauuuucuugacuacguuaagcagaaccaauaagaaacgcaguuggccguuaaacgaggcaauaauggcugugggaaugguuagcauuuuagcgucuagccuauuaaagaaugacauaccgaugacaggaccccuaguagcagggggacugcuaacuguauguuauguuuugaccggaagaagugcugacuuagaauuagaacgcgcuacagacgugaaaugggaagaucaagcugaaauuucuggcucaucgccuauuuuaucuauaacaauaucggaagacgggagcaugucaaucaaaaacgaagaggaggagcaaacacugacuauccucauuagaacuggcuuguugguaauaaguggcuuguuuccgauaucaauuccgauuacagcugcagccugguauuuaugggaagucaaaaaacagcgugcaggaguccugugggauguaccuucaccaccaccgaugggaaaggcugagcuugaagacggagcuuaucgaauuaaacaaaagggaauucuaggguauagucaaaucggagcaggaguuuacaaggaagguacguuccauacaauguggcacgucacaagaggagcgguauuaaugcauaaaggcaagaggaucgaaccuagcugggcugauguuaagaaagauuuaauuucauaugguggaggauggaaacuagaaggcgaauggaaagaaggagaggaagugcaaguucucgcccuagaaccgggcaaaaauccuagagcuguacaaaccaaaccuggucuauuuaaaacaaacaccgggacgauuggggcgguaucauuagauuucagcccugggacaucaggaagcccuaucauagacaaaaaaggaaaagugguaggucuauauggaaacggcguaguuacgaggagcggcgcauacguauccgcaauagcacaaacugaaaaaucuauugaagauaauccugaaauagaagacgauauauuuaggaagaggagacuuacuauaauggaucuacaucccggggccgggaagacuaaacgcuacuuaccagcaauaguuagagaggcaauaaagcgaggucuuagaacucuaauacucgcuccgacuagaguaguggcugccgaaauggaagaagcucugaggggauuaccaauuagauaucaaacaccugcuauucgagccgagcauacuggaagggaaauaguagacuuaaugugucaugccaccuuuacgaugagauuauuaucucccguaagagucccuaauuacaauuugauuaucauggacgaagcacauuuuacagacccugccucaaucgcagcuaggggauacauuucuacaagaguggagaugggugaagcugcagggauauucaugacagcuacaccgcccgguucuagggauccuuuuccacagucaaaugccccuauaaucgaugaagaacgagaaauucccgaacggucguggaacuccggccaugaauggguaacagacuuuaagggaaaaacaguaugguuuguacccucaauaaaggcaggcaacgacauagcagcguguuuacguaaaaaugguaagaagguaauccaauugucgagaaaaacuuuugauucagaauaugugaaaacaaggaccaacgacugggauuuuguagugacuacagauauauccgaaaugggggcgaauuuuaaagccgaacguguaaucgacccucguagauguaugaagccaguaauuuuaacugacggugaagagcgagucauucuggcuggaccgaugccugugacacauucgagcgcggcucagcgccgcggaagaaucggaagaaauccuaagaaugaaaaugaccaauacaucuauaugggagagccuuuggaaaaugacgaggacugugcucauuggaaagaagcuaagauguuacuagauaacauuaauacuccagaagggauuauccccaguauguuugaaccugaacgugaaaaaguugacgccauugauggagaguaccgucuccggggugaagcuagaaaaacauucguugauuuaaugagaagaggagauuuaccuguuugguuagccuacaaaguggcagcugaagggauaaauuacgcagacagaagaugguguuuugauggaauaaaaaacaaccaaauacuugaagaaaauguugaaguggagauauggacaaaggaaggagaaagaaaaaaauuaaaaccgcguuggcuugaugcccgaauauauucugacccacuagcauuaaaagaauucaaagaguucgcugcuggacgaaaaucacugacccuuaaucucauaaccgagaugggcagauugcccacguucaugacucaaaagaccagagaugcgcuagacaaucuagcuguccuacacaccgcagaggcuggaggaagagcauacaaccaugcgcuaagcgagcuuccagagacccuagagacuuuauuacuguuaacacuuuuggcuacaguuacaggcgguauuuuuuuauuucuaaugagcggccgaggaauuggaaaaaugacuuuaggaaugugcuguaucauaacugcaaguauauuacuaugguacgcgcaaauccaaccccauuggauugcugcgagcauuauccuugaauuuuuccuaaucgucuuauuaauuccugaaccagaaaaacaacgaacaccacaggacaaccaacuaacuuaugugguaauagcuauauuaacagucgucgcagccaccauggcgaaugaaaugggauuucuugaaaaaacaaaaaaggaccuaggacuaggaaguaucgcaacgcagcaaccagaaucaaauauacuugauauugaucuaaggccagcuagcgccuggacgcuauaugcuguagcaacaacauuugucacacccauguuacgacauuccauagaaaauucaucggucaacguuagccuaacagcaaucgcaaaccaggcuacgguauugaugggucugggaaaaggcuggccauuaaguaaaauggacauugggguuccacuucuagcuauuggaugcuauagucaagucaacccuauuacucuuacagcagcauuacuauuauuggucgcucacuacgcaaucaucgggcccggccuucaagcuaaggcgacacgcgaagcucaaaaacgggccgcggccggaauaaugaaaaacccgacgguagauggaauuacuguaauugaucuugacccaauuccuuaugauccuaaauuugaaaagcaauuggggcaaguaaugcuauugauacuaugcguaacucagguacuaaugaugcggacgacaugggcccuaugcgaagcacuuacgcuggcaacgggaccaauaucuacacuaugggaagggaacccaggaagauucuggaacacaacuauagcaguaaguauggccaacaucuucagagguagcuauuuagcaggagcaggcuuauuauuuagcauaaugaaaaacaccacaaacacgcgucguggaacuggaaauauuggcgaaacacugggugagaaauggaaaagccggcugaaugcacucggcaagagcgaauuccaaaucuacaaaaaaagcggaauacaagaaguagauagaacacuagcaaaagaagguauaaaacgaggggaaacggaccaccaugcaguaucacgcggauccgcuaaauuaaggugguuuguagaacggaauaugguuaccccagaaggcaaaguuguagaucuaggguguggacgagguggcuggucguacuauugugguggacuaaaaaauguuagggaaguuaagggacuaacaaaaggaggaccaggucaugaagagccaauacccaugaguaccuacgguuggaacuuaguuaggcuacaaucgggaguggauguauucuuuauuccaccagaaaaaugugacaccuugcugugugauauaggagaaagcaguccuaaccccacaguugaggcaggaagaacucuucggguuuuaaauuuaguggaaaauugguuaaauaauaacacucaauucuguauaaaaguauugaauccauacaugccaagugucauugaaaagauggaagcgcuccaaaggaaauauggcggugcacugguaaggaacccauuaucuagaaauuccacucaugaaauguacuggguuaguaacgcuuccggcaauauugucaguucugugaauaugauaagccguaugcugauuaaucgcuucacaaugagacauaaaaaagcaacguacgaaccugacguagacuuaggaucagggacaagaaauaucggaauugaaucugagauccccaaucuagacauuauuggaaaacguauugaaaagaucaaacaggaacacgaaacgucuuggcacuacgaccaagaucaccccuacaaaacaugggcauaucaugguaguuacgaaacaaagcaaacgggaagcgcaucauccaugguaaacggagucguucgauuacuaaccaaaccuugggacguccuuccgacggugacucagauggcaaugacggacacaacuccuuuuggacagcaaagaguuuuuaaagaaaagguggauacuagaacacaggaacccaaagaaggcacaaaaaaacuaaugaaaaucacagccgaauggcuguggaaagagcuaggcaagaaaaagacaccacgaaugugcacccgugaagaguuuacccguaaaguucggucuaaugcagcgcuaggcgcgauauucacagacgaaaauaaauggaaaucggccagagaggcagucgaggauucucgguucugggaacugguugauaaagaaaggaauuuacaucuagagggaaaaugcgaaacauguguuuauaacaugaugggaaaaagagaaaaaaaauuaggagaauucgguaaagcuaaaggaagcagagcuauaugguauauguggcuuggugcaagauuccuggaguucgaagccuuaggguuuuuaaacgaagaucacugguucagccgagaaaacagucuaagugguguggaaggugaaggccuccauaaacuaggauauauacucagagauguuuccaaaaaagaggguggugcaauguaugcugaugauacagcaggcugggauacccgaauaacauuagaagacuuaaaaaacgaagagaugguaaccaaucauauggaaggcgaacauaaaaaauuagcagaagcuauauucaaacucacguaucagaauaaaguagugaggguacaaaggccaacaccaagaggaacaguaauggauauuauuagucgucgagaccaaagagguucuggccaaguaggaacauauggacuaaauacauucacaaauauggaagcacaauuaauaaggcaaauggaaggggaaggaguuuuuaaaaacauccagcauuugacaguaacggaggaaguugcugugcacaauuggcuagcaagagugggaagagaaagauuaucuaggauggcuauaucaggugaugauuguguugugaagccguuagaugauagauuugcaaaugcguuaacagcacuuaacgacaugggaaaaauucguaaagauauccaacaaugggaaccgagcaaaggguggaaugacuggacucagguaccauuuuguucccaccacuuucaugaauugauuaugaaagauggacgcguguuaguuguaccuuguagaaaucaagaugaguuaauaggucgcgcaagaauuucgcaaggcgcaggcuggagcuuacgcgaaacagcuuguuuaggcaagagcuacgcccagauguggucuuugauguauuuucaccguagggaucuaagacuugcugccaacgccauuuguagcgcagugccaucacacuggguaccaacaucgcgcacaacgugguccauacaugcuaagcacgaauggaugacuaccgaagacauguuaacaguauggaaucguguuuggauuagagaaaauccauggauggaggacaaaacuccgguagaguccugggaggaaauaccauaucucgggaaacgagaagaccaaugguguggcucgcucauuggucucacgagccgggcuacuugggcaaagaauauacaagcugcaauuaaccaaguacguucacuuauuggaaaugaagaguacacugacuacaugccuuccaugaaacgauuuagaagagaagaagaagaggcaggaguauugugguga

SEQ ID NO: 22769 - RNA, 9876 nt, Artificial Sequence
  derived and/or modified CDS sequence (opt6) from DENV-2__EU482785__SS-prME
accgcuggaguuauaauuauguugauacccacagcgauggcguuucaucuuaccaccagaaauggagaaccacauaugauaguuggacgacaagaaaaaggaaaaucgcuacuauuuaaaacggaagacggaguaaauauguguacauugauggcgauagauuuaggagagcuaugcgaagauacaaucacguauaaauguccauuauuaagacaaaaugaaccagaagauauagauuguugguguaacagcaccaguacguggguaaccuauggaacuugcacgacaacaggagaacacagaagagagaaaagaagcguggcauuaguaccccacguagggaugggucucgaaacgcgcacagaaaccuggaugucaagcgaaggggcguggaaacacgcacaaagaauagaaaccuggauucucagacacccaggauuuacaauuauggcagcuauucuugcguauacaguaggcacuacacauuuucaaagagcuuugauauucauauuauuagcagcgguagccccaucaaugaccaugagauguauuggcauaaguaaucgugacuuuguagaaggagugagcggcgguucauggguugauauaguguuggaacacgguagcugugugacaacaauggcuaaaaauaaaccaacacuagauuuugaauuaauaaaaacugaggcuaaacaaccagcuaccuuacggaaauauugcauagaagcaaaauugacaaauacuacaaccgaaucacgcuguccaacgcaaggagaaccuucacucaacgaagaacaagacaaacguuucguguguaaacauucaaugguugauagaggaugggguaauggaugcggcuuauuuggaaaaggagggauaguuacgugcgcaauguuuacaugcaagaaaaauauggaggggaaaauuguacagccggagaaucucgaguauacaauuguuauuacaccucauucaggagaggaacaugcaguugggaaugacaccgggaaacacggcaaagagauuaaaauaacaccacaaucucccauaaccgaggcagaacugacaggauauggcacuguaacgauggaauguucgccgcgcaccgggcuagacuuuaaugagaugguauuacuacaaauggaagauaaagcaugguuaguacaucgccagugguuuuuggaucuuccacugcccugguuaccaggugcggauacacaaggaucgaacuggauucaaaaagagacauuggucacuuuuaaaaauccacaugccaagaaacaagaugucguaguuuuagggagucaagagggugcuaugcauaccgcauuaacuggagcuacagaaauacaaaugucuucagggaauuuacucuuuacuggacacuuaaaaugccguuuacgcauggacaaauuacaacugaaaggaaugucauacuccaugugcacaggcaaauucaaaauaguaaaagaaauagcggagacccaacacggcacgauuguaauaagaguacaauaugaaggcgacggauccccaugcaaaauaccguuugaaauaauggaucucgagaagagacauguacucggacgguuaauaacaguaaacccaauaguuacagaaaaagauaguccaguaaauauagaggccgaacccccuuucggagauaguuauauuaucauugggguagaaccaggacaacuuaaauuaaauugguucaagaaagggagcagcauuggucaaauguuugaaaccacaaugcguggugcuaagagaauggccauacuuggggauacugcuugggauuucggauccuugggcggagucuuuacaagcauaggcaaagcauugcaucaagucuuuggagcuauuuacggagcugcauuuucaggugucuccuggacaaugaagauucuaaucggagucauuauaacauggauaggcaugaacuccagaaguacgucacuaucuguaucgcuaguacuuguuggaguaaucacucuauaccuaggugcuaugguccaggcugacaguggauguguaguuucuuggaagaauaaagaguuaaaauguggauccgguauuuuuaucacugacaauguccacacauggacugaacaauauaaauuucaaccagagagucccucgaaacuagcuagcgcuauacagaaagcacacgaggagggaauaugcgggauuagaucuguaacacggcuugagaauuuaauguggaaacaaauaaccccagagcuaaaucacauacuaagugaaaacgaaguuaaacuuaccauaaugacgggagauauaaaggguaucaugcaggcgggaaagagaucuuuacgcccucaacccacugaacucaaguacaguuggaaaacaugggguaaagcaaaaaugcucaguacagaaucacauaaucaaacuuuccugauagauggcccagaaacagcggagugcccgaauacaaauagagcguggaacuccuuagaagucgaagacuauggguuuggcguauucacuacgaauaucugguuaaaauuaagagagaaacaagaugucuucugcgacucuaaacuaaugucugcugcuauaaaggauaaccgagcaguacacgcugacaugggauacuggaucgaaagugccuuaaacgauacuuggaagauggaaaaggcuucauuuauugagguuaaaucaugucauuggccaaagucacauacauuguggaguaauggagugcucgaaagcgaaaugauaaucccaaaauccuuugccgguccugucagccaacacaacuaucgcccuggauacuauacacagaccgcaggcccuuggcaccugggaaaacuugaaauggauuucgacuucugcgaggggacaacugucguaguuacggaagauugugguaauagaggaccaagccuacgcacaacgacagcaagcgguaaacuuaucaccgagugguguugcagaaguugcacauuaccaccuuuaagauaccgaggugaagacgguugcugguauggaauggaaauaagaccacuuaaagaaaaagaggagaaucugguaaauucacuuguaacagcagggcauggucaaauagauaauuucuccuugggcgugcuagggauggcgcuauuucuggaagaaauguuaagaacucgggucggcacaaaacaugccauacuauuagugaccguaucuuuuguuacgcuuauaacggguaauaugagcuuucgggacuuagggagagugauggucaugguaggugccgcgaugacugacgauauagguaugggcguaacauauuuagcccuacuggcugcguuuaagguaagaccaacguucgccgcuggauuguuacugcguaaacugacaucuaaggaacugaugauggcaacgauugggauagcacuacucucacaaucuacaauuccggagacuauacuagaacuaacugaugcauuggcuuuagguaugaugguccugaagauuguacgaaauauggagaaauaucaacuagcugugacaaucauggcaauaaguugugugccuaaugcgguaauacuccaaaaugccuggaaaguaucaugcaccaucuuagcagcaguaucuguuucaccuuuacuguuaacaucuucccagcagaaagcggacuggauaccgcuggcgcugacaauaaagggccucaacccaaccgcaauauuucucacgacccuaagcaggacaaguaaaaagaggucauggccacuaaaugaagcgaucauggcugucgguaugguaucgauccuggcaucaagccuacucaaaaacgacauuccaaugacagguccauuaguugcagggggauuauuaacaguuugcuauguguuaacaggucgaucagcugaucuagaacuugagcgagcgaccgacgucaaaugggaggaccaggcagaaauuucagggucuagcccgauuuugagcauuacgauugcugaagaugguucaaugucaaucaaaaaugaagaggaagaacaaacccuuaccauccuuauaagaacaggacuucuuguaauuagugguuuauucccaguuagcauaccaauaacagcagcugcaugguaccuaugggaaguuaaaaagcagagagcuggcguauugugggacguucccagcccaccuccaguugaaaaagcagaacuugaagauggugcauacagaauaaagcaaaaagguauacuaggguauucgcaaauuggagcaggcguauauaaagaaggaacauuucauacaauguggcacguaacgcguggggccgugcuaaugcaccgcggaaaaagaauugagccaucaugggcagaugucaagaaagauuuaauaaguuauggugggggauggaaacuugaaggggaauggaaagaaggggaagagguacaagugcuagcguuagaacccgggaagaauccgcgcgcaguccagacuaagccaggucuguucaaaacaaauacugguacaauaggugcuguaucacuggauuucucuccagguacgucaggcucaccaauaguugacagaaaaggaaaaguggucggucuauauggaaauggagugguuacaaggagcggggcauauguuagcgcaaucgcccaaacagaaaaaucaauagaagauaacccagagaucgaggaugauauauucaggaagaaaagauuaaccauuauggauuuacauccuggcgcuggaaagacaaaacgauaccuaccggcaauaguaagagaagcgauaaagagagggcugagaacuuuaaucuuagcaccaacucgaguaguugcagcggaaauggaggaagcacuucgcggcuuacccauuagguaucagacaccagcgauaagggcggaacacacggguagggaaauagucgacuuaaugugucaugcuacuuuuacaaugcgucucuugucaccgguuagaguaccaaauuauaaucugaucauuauggacgaagcucauuucacagauccggcuucuauugcugcucgaggauauauaagcacaagaguagagaugggugaagccgcagguauuuuuaugacagccacaccgccugggucacgagacccauuuccccaauccaacgcaccaauuauggaugaagaacgugagauaccagagagaagcuggaacuccggacaugaguggguaacagauuuuaaagggaaaacgguaugguuuguaccaucuaucaaagcagguaaugacaucgcugcauguuuacguaaaaacggcaagaaaguuauacaacuaucuaggaaaacauucgauuccgaauauguaaaaacacgaacaaaugacugggauuucguaguuacaacagacaucagcgaaaugggagcaaacuuuaaagcugagagggucauagacccaaggagauguaugaaacccgucauucucaccgauggggaggaacggguaauauuagccggaccgaugccuguaacacauucaucggcagcacagaggaggggcagaauuggacggaacccgaagaacgaaaacgaucaauauauauauaugggagagccgcuugaaaacgacgaagacugcgcgcauuggaaggaagcuaaaaugcuacuagacaacauuaauacuccugaaggcauaaucccuaguauguucgagccagagagagagaagguagaugccauagauggggaauacagacuaagaggcgaggcgagaaagacuuuuguagaccuaaugcggcgaggcgacuuaccuguuuggcucgcuuacagaguagcugcugagggaauaaauuaugcagaucggcgauggugcuucgacggaguaaagaauaaucaaauucuggaggagaacguggaaguagagauauggacaaaagaaggugagaggaagaagcugaagccaagaugguuagaugcaaggauuuacucagauccguuagcucuaaaagaauuuaaagaauuugcggcaggccgaaagagccuaacuuugaauuuaauuacggagaugggaagguugccgacuuucaugacccaaaaggcaagagaugcuuuagacaaucuggcuguacuacacacggcagaggccgggggcagagccuauaaucacgcacugagugaacuaccugagacuuuagaaacauuacuccuccugacauuauuagccacuguuacaggcggaauauuccuuuuccugaugucaggaaaaggaguuggaaaaaugacacuagguauguguugcauaauaacggcgucgauucuacuaugguaugcccaaauccagccgcauuggauagcggccucgauaauacuagaguucuuuuuaauaguccuuuuaauuccugagccugaaaagcaacgcacgccacaagacaaccaacuaacuuacgucguaauugcuauuuuaacagucguggcagcaacaauggcaaaugagaugggcuuucucgaaaagacgaagaaagacuuaggacuggggucuaucgcuacacaggaaccugaaucuaauauucuggauauagaucuacgacccgcaucugcauggaccuuauaugcagucgcuacuacauucguuaccccuaugcuaagacacagcaucgaaaauaguucaguuaaugugucauuaacagccauagccaaccaagcaacgguacuaaugggccuagggaaaggauggccacuaucgaaaauggauaucggagugcccuuacuggcuauagguuguuauucacagguaaacccaauuacacuaacugcugcucugcuauuauuaguggcccauuacgcuauaaucggccccggauugcaagcaaaagccacaagggaagcacagaaaagagcagcagcaggaauuaugaagaauccuacaguggacggagugacugugauagaccuugauccaauacccuaugacccgaaauuugaaaaacaacucggucaagugaugcuacuaauacuuuguguaacucaaguacuaaugaugagaacaacuugggcuuugugugaagcauuaacacucgcaacgggcccgauuaguacacuaugggaaggaaauccugguagauuuuggaauaccacaauugcggugucuauggcaaacauauuuagagggaguuaucuagcuggagcggggcuucucuucaguauuaugaaaaauacaacaaacacuagacgaggaaccggaaauauuggcgaaaccuuaggagaaaaguggaaauccagacuaaacgcguuaggcaaaagugaauuucaaauuuauaagaaaaguggaauccaagaaguagauagaacauuggcgaaggagggaauaaaacgcggagaaacugaucaucacgcagucucacgcggaucagcuaaacugcgaugguuugucgaaagaaacauggucacaccggaaggaaaaguggucgaccuuggauguggaagaggaggauggagcuauuauugcggcggccuaaaagacgugcgugaagugaaaggacuaacuaaagguggaccugggcaugaggaacccaucccaaugaguacauacggguggaaucuaguccgauugcaaucagggguugacguauucuuuacaccaccggaaaaaugugauacucuauuaugugauauuggagagucuucacccaacccaacaauagaagcaggaagaacauuacgcguauuaagucuagucgaaaauuggcuaaauaacgacacacaauuuugcauaaaaguauuaaacccauauaugccuucagucaucgagaaaauggaaacguuacagcguaaauaugggggagccuuaguuagaaacccccuuaguagaaauagcacacaugaaauguauuggguuaguaacgcaacuggcaauauagucagcucagucaacaugauuagucguaugcuuauaaaucgguuuacaaugaaacauaagaaagccacuuaugaaccagauguugauuuggguucuggaacgaggaauaucggaauagaaucugaaauuccaaaucuggauaucauaggcaaaaggauagaaaagauaaaacaagagcaugaaacaucauggcacuacgaccaagaucauccuuacaaaacaugggcguaucacgguucguaugaaacaaagcaaaccgggucagcaucaucaauggugaauggaguaguacgucuacuaacgaaaccuugggacguaguaccgaugguaacacaaauggcaaugacugacacaacgcccuuuggucaacaacgcgucuucaaagaaaaaguugacacucgaacacaagaaccuaaagaaggaaccaagaaacucaugaagauuacagcagaaugguuauggaaagaauuagguaagaagaaaacuccucgaauguguacaagggaagaauuuacacguaaagugcgcucaaaugcagcacuaggggccauuuucacagaugaaaauaaauggaaaagcgcuagagaagcaguagaagacucaagauuuugggagcuaguggauaaggaaagaaauuuacauuuagaagggaaaugcgaaacgugcgucuacaacaugauggguaaacgagagaagaaacugggcgaauuugggaaagcgaaaggaucgcgcgcuauaugguauauguggcucggggcacgguuucuugaauuugaggcccuaggguucuuaaaugaagaccacugguuuucgcgugaaaauaguuuaaguggaguagaaggagagggauugcacaaguuaggguacauccuaagagaugugaguaagaaagagggaggagcgauguaugccgacgauacagccggcugggacacacgaaucacauuggaggaccucaaaaacgaagaaauggugaccaaucacauggaaggggaacauaagaaauuagcagaggcuauuuucaagcuaacuuaucaaaauaaaguagucagaguucagcgcccgaccccaaggggaacgguaauggacauaauaucgcggcgugaccagcguggcagugggcagguuggaacauacgggcuuaacaccuuuacaaauauggaagcgcaacuaauucggcagauggagggugaggguguauucaagagcauucaaagguuaacgguuacugaagaaauagcaguacagaacugguuagcaagaguaggcagagaacguuuaucgcgaauggcaauuucaggggaugauugugucgugaaaccuuuggacgaucgauuugcuucagccuugacagcacuuaacgacauggggaaaguaagaaaggacauacagcaaugggaaccaagucgggguuggaacgauuggacacagguaccauucuguucgcaucacuuucacgaguuaauaaugaaagacgggcgaguacuggucgugccaugcaggaaccaagaugagcuuauagggagagcuaggauuagccaaggugccgguuggagcuuaaaagaaacagccugucuaggaaaaagcuaugcacaaauguggucauugauguauuuucaucgacgugacuuaagauuagcagcgaaugcaauaugcuccgccgucccuagucauuggguaccaacaucaaggacaacguggagcauucacgccaagcaugaguggaugacaacagaagauauguuaaccguauggaauaggguauggauccaagagaacccauggauggaggauaaaacgccaguggaaucaugggaagaaguacccuaucuggguaaaagggaagaccaauggugcggaucuuuaaucggucuaacaagucgugcuacaugggccaaaaauauucaaacggcaaucaaucaaguaagaucgcuaauaggaaaugaagaauauacagauuacaugcccucgaugaaacgcuuccggcgggaagaagaggaggcgggcgugcuaugguaa

SEQ ID NO: 22770 - RNA, 9876 nt, Artificial Sequence
  derived and/or modified CDS sequence (opt6) from DENV-2__EU482786__SS-prME
ucugcaggaaugauaaucaugcugauaccuaccguuauggcauuucaucuaacaacaagaaauggggaaccacauaugauuguaggcauucaagaaaaaggcaaaucauugcuauuuaaaacggaagauggaguuaauauguguacgcugauggcaauggacuugggggaacuuugcgaagacacaauuacguauaaaugcccacucuuacggcaaaaugaaccagaagacauugauugcuggugcaacucuacuucaacuugggugacuuauggaacgugcacaacuaccggcgagcauagaagagagaaaagaucaguugcucuaguuccucaugugggcauggguuuagaaaccagaacagaaacauggaugucaucggaaggagcauggaaacacgcacaacggauagaaacauggauacuacgacacccggguuuuaccauuauggcagccauuuuagcauauacuauagguacuacucacuuucaaagagucuugaucuucauuuuacuuacagcaguugcaccuucaaugacuaugcgauguauaggcauuucuaauagagauuucguagaagggguuagcggcggaucguggguagacauuguucuagaacauggcucaugcgucacgacuauggccaaaaauaaaccaacccuugacuuugaauugauaaaaaccgaagccaaacaaccagcaacccugagaaaauauuguauagaagccaaacuaacaaauacuacgacagaaaguagguguccaacgcaaggagaaccuuccuugaaagaagaacaagauaaaagauuuguauguaaacacagcaugguugacagaggauggggaaauggauguggcuuguucggaaaaggugggauaguaacaugugcaauguucacgugcaagaaaaauauggaagggaaaauuguccaaccugaaaacuuagaauauaccauaguugugacaccucauuccggagaagaacacgcuguagggaaugauacuggaaaacacggaaaagaaauaaaaguaacaccacaaucaagcauaacagaagcagaacuuacaggauacgguacagucacaauggaaugcaguccuaggaccggauuggauuuuaaugaaaugguacuacuacaaauggaaaauaaagcgugguuagugcaucgacaaugguuucuugauuuaccccugcccuggcugccgggcgccgacaaacaagaaaguaauuggauacaaaaagagacauuaguaaccuuuaaaaauccacaugcuaagaaacaagauguaguaguacuaggaagucaagaaggagcgaugcauacagcccuaacgggggcaacagaaauacaaaugaguaguggaaauuuauuauucaccggacauuuaaaaugucguuugagaauggacaaacuucaacuuaaaggaauguccuacucaauguguacaggcaaauucaaagugguuaaagaaaucgcggaaacccaacacggcacaauaguaauacguguacaguaugaaggggacgguagcccaugcaaaaucccguucgagauuauggaccuagagaaaagguauguucuuggucgccuaauuacgguaaacccuauaguaacagggaaagacagccccgugaacauagaagcugaaccuccuuucggcgauucuuauaucauaauugggguggagccuggucaacuaaaacucaauugguuuaagaaagggucaucaauaggacaaauguuugaaaccacaaugcguggagcuaaaagaauggccauucuaggcgacacagcgugggacuucggaucacuaggaggaguguuuacgucaaucgggaaagcauuacaucagguauucggagcgauauacggagcggcuuucuccggaguaucguggaccaugaaaauucuuauaggaguaauuauaacuuggaucggaaugaacucuaggaguacaucauuaaguguuucucuagucuuaguaggaauuguuaccuuauaucuaggggucauggugcaagcagacagcgggugcguaguaucauggaagaacaaagagcuaaaaugcggaagcgggauuuucauuaccgacaauguucacacuuggacggaacaauauaaauuccaacccgaaucaccuucgaaacuugcaucagcgauacaaaaggcucaagaagaaggaauuuguggaauuaggagcguaacaaggcuggaaaaccuaauguggaaacaaauaacuccagagcuuaaccacauuuuagcugaaaacgaaguaaaacuaacgauaaugacgggcgauauaaaaggcauaaugcaagcuggaaaacgaucucuucguccccagccuaccgagcucaaauacucuuggaaaaccuggggaaaagcaaaaaugcucucgaccgaaucuuacaaccagacguucuugauagacgggccugaaacugcagaauguccgaauacaaauagagcauggaacagcuuggaaguagaagacuaugguuucgguguguuuacuacaaauauuuggcuaaaguuaaaagaaaaacaagaugcuuucugugacagcaaacuuaugucagcugcaaucaaggauaauagggccguucaugccgauaugggauauuggaucgaaucagcacuuaaugauacuuggaagauagaaaaggcaaguuucaucgagguuaaaaauugucacuggccuaaaucacacacguuauggucaaauggaguauuagagagugagaugauaauccccaaaaaucuagcuggaccgguuagccaacauaauuaucgaccuggauaccacacacaaaucgccgggccauggcauuuagggaaacuggaaauggauuuugacuuuugcgacggcacuacagucauugugacagaggauuguggaaauagagggccaucucuuagaaccacuacugcuagcggcaaacuaauaacggaauggugcuguaggucuuguacucucccuccucuacgauauagaggugaagacgggugcugguaugguauggaaaucagaccauuaaaggaaaaagaggaaaaccuagucaauagccuaguaacggcgggacauggucaagucgacaauuuuucuuuagguguccuggggauggcacucuuuuuagaggaaaugcuaagaaccagaguagguacgaaacaugcgauacuacucgucgcaguuucuuucguuacauugauaacggguaauaugucuuuuaaagauuugggaaggguagucguaaugguaggggcgacaauggcugacgacauugguauggggguuacuuaucuugcucuacuggcugcauucaaagugagacccacguuugcggcaggacuacuucuccgaaaauugacauccaaagaacucaugaugacaacaauuggcauaguccucuuaagccaaucuaccauaccagagacaguucuagaacugacagaugcacuagcacuaggaaugaugguucuaaaaaucguuaggaauauggaaaaauaccagcucgcuguaacuauuauggcaauauuaugcgucccgaacgcagucguacuacagaacgcauggaaaguuagcugcacaauucucgcagucgucucaguaucaccccuauuacuaacaaguagucaacagaaaacugacuggauaccauuagcccuuacaauaaaagguuuaaacccuaccgcaaucuuucuuaccacccugagucgaacgaacaagaaaagaucguggccacuaaaugaagcgauaauggcagucggcaugguuagcauccuugcuucuucacugcugaaaaacgacauuccaaugacaggaccguuaguugcuggaggccuuuuaacugucuguuacguucuuacugguagaucggccgaccuagaauuagagcgagcaaccgaugucaaaugggaagaucaagcagaaauuucuggaucgucgccaauccucuccauuacaaucucugaagauggaucaaugaguaucaagaaugaagaagaagaacagacccucacuauuuuaauuaggacuggauuacucgugaucagcggauuauuuccaaucaguauaccuauuacugcagcagcaugguaucugugggaagucaagaaacaaagggcaggcguucuaugggauguaccgagcccuccaccgaugggaaaggcggaguuagaggauggagcauaucgaauuaaacagaaaggaauccuugguuacagccaaaucggcgcuggagucuauaaagagggaacguuucacacuauguggcacgucacacgaggagcaguauuaaugcauaagggaaaacgaauagaaccaucaugggccgauguuaagaaagaccugauuagcuacggcggugguuggaaacuagagggugaauggaaagaaggagaagaaguucaaguauuagcccuagaaccgggcaaaaacccacgagcaguacaaacuaaaccaggacuauucaaaacaaauacagggacaaucggagcgguuucacuggacuucaguccaggaacgaguggaaguccaauaauugacaagaaagguaagguugugggacuuuaugguaauggcgucguaacgcgaagcggagcuuacguuucagccauugcgcaaacugagaaauccaucgaagacaacccugaaauagaagaugauaucuucaggaaaagaagauugacuauuauggacuugcauccaggcgcggguaaaacuaagagguauuugccggccauaguucgagaggcuaucaaacgagguuugagaacauuaauccuagcaccaacuaggguaguagccgcggagauggaagaagcacugagagggcucccaauccgguaucaaacaccagcgauuaaagcugaacauacaggucgagaaauugucgauuuaaugugucacgcaacauucacuaugaggcuccuaucgcccguaaggguacccaacuauaaccuaauuauaauggaugaagcacacuucacagaccccgcgagcauagcagccagagguuacauaaguacucgggucgagaugggggaggcagcggguauuuuuaugacugccacacccccaggaagcagggauccuuuuccacagucuaacgcuccaauuauagacgaggagagagaaauuccagaacgguccuggaacagugggcaugaauggguaaccgacuuuaaaggcaaaacaguuugguucguuccguccaucaaagcugguaacgacauagcagcuugccuaaggaaaaauggaaagaaaguuauacagcucucccgcaaaacauuugacucagaauaugugaaaacccgaacuaacgacugggauuuuguagugacaaccgacauaagugaaaugggcgccaauuucaaagcagaaagaguuaucgauccaagaagguguaugaaaccaguuauucuaacggacggagaagagagaguaauucuagcagguccuaugccaguuacacauaguagugcagcacaaaggagaggcagaauuggaaggaaccccaaaaaugaaaaugaccaauacauauacaugggagagccgcuugagaaugacggagauugugcucacuggaaagaagcaaaaaugcuucuugauaacauaaacacaccugaagguauuauaccuucuauguuugaaccugagcgcgaaaagguagaugcuauugauggagaauacagguuacgcggugaagcaaggaagacauucguagauuuaaugcgucgaggagacuuaccuguaugguuagcauacaaagucgccgccgaaggaauuaauuaugcagacagacguugguguuucgauggcauaaagaacaaccaaauucuggaagaaaaugucgaaguagaaauuuggacaaaagaaggagagcguaagaaacuaaaaccccgcugguuggacgccagaauuuauuccgacccuuuagcccugaaggaguucaaggaguucgcugcgggaaggaagucuuugacguugaacuuaauuacugaaaugggucgguuaccaacuuuuaugacacagaaaacaagggaugcacuugacaaucucgccguuuuacauaccgcggaagcaggaggcagggcauacaaucaugcacucucagaacuaccagagaccuuggaaacauuacuauuacuuacgcuccuggcaaccguaacagguggcauuuucuuguuucucaugagcgggagggguauuggaaagaugacacuggguauguguuguaucauaacagccucuauccuacuaugguaugcacagauucagccacacuggaucgcagccaguauaauuuuggaguucuuucugauaguacugcuuauaccugaaccugagaaacaaagaacgccgcaggauaaucaguuaacauauguuguaauugcaauacucacgguugucgcugcuacgauggcaaaugaaaugggguuccucgagaaaacuaagaaagauuuaggauuggguucuauagcaacacaacaaccugaaucgaauaucuuagacauugaucuacgcccagcaucagcauggacucuuuaugcagucgccacaaccuuuguuacaccaaugcuuagacacagcaucgaaaauaguagcgugaacguaaguuugacugcgauagcuaaccaagcaacuguacuaaugggguuaggcaaaggcuggccccuaaguaaaauggauaucggugucccucuccuugcaauaggaugcuauucucaaguaaacccgauuacccuaacugccgcuuuacuguugcucguggcgcauuacgcgauaauaggaccuggauuacaagcgaaggcgacucgagaggcgcagaaaagggcggcggccggaauaaugaaaaacccuacaguugaugggauaaccguaaucgaucuugauccaauaccuuacgauccgaaauucgaaaaacaauugggccaaguaaugcuucuaauucuaugugugacacagguauugaugaugaggacuacgugggcauugugugaggcccuuaccuuagcaacagguccaauuaguacacugugggaaggaaacccaggaagguuuuggaauacaacuaucgcaguaucuauggcuaauauuuucagagguaguuaucuugcuggagcaggauuacuuuucucaauuaugaaaaacacaacaaauacuagaagagguaccggaaacauaggagagacucuaggagaaaaauggaaaagccgacuuaaugcucuugggaaauccgaguuucaaauauauaagaaauccgguauucaagagguggaucgaacccuugcaaaagaaggcauaaaacguggagagacagaucaucaugcaguaaguagagguucugcgaaauuaagaugguuuguggaaaggaacaugguuacgccagagggcaaagucguagaccuuggaugcgguagagguggauggaguuauuauugcggcggcuuaaagaauguuagagagguaaaagguuugacuaaaggaggcccuggucaugaagaacccaucccuaugaguacauacggcuggaaccuuguucgccuccagucaggaguagauguuuucuuuauaccuccagagaaaugugauacauuacucugugacaucggugaaucaucaccuaauccaaccguagaagcaggaagaaccuugcggguauuaaaccuugucgaaaacugguugaauaacaauacacaauuuuguauuaaggugcuaaauccuuacaugccauccguaauugagaagauggaagcauuacaacgaaaguacggaggcgcuuuaguacgcaauccacuaucaagaaacaguacccacgaaauguacuggguaaguaaugcauccggaaauaucguaucaucagucaacaugauaucgcgaauguuaauaaaucguuucacuaugcgucauaaaaaggcaacauacgaacccgacguggaccuaggaucaggaaccaggaacauagguauagaaucugaaauaccaaaccuagauaucaucggaaaacguauagagaaaaucaagcaggaacaugaaacaucguggcauuacgaccaagaucaucccuacaagacaugggcguaucauggaucuuacgaaacuaaacaaacgggcagcgcuucaagcaugguaaaugggguugugagguuacuuacaaaacccugggauguccuaccuacaguuacacaaauggcgaugacggauacgacaccauucggacagcagaggguauucaaagaaaaagucgauacuagaacccaagaacccaaagaagggacgaagaaacuuaugaaaauaacugcaaagugguuguggaaggaacuagggaagaagaaaacuccgaggauguguacaagagaagaguuuaccagaaaaguuaggucuaacgcagcacucggggcaauuuuuacugacgaaaauaaauggaaaucagcgcgugaagcaguagaggacucaagauuuugggaacuggucgacaaagagcguaacuuacaucuugagggaaaaugcgaaacuuguguuuacaauaugaugggaaaaagagagaagaaauuaggagaguuuggcaaagccaaagggagucgggcgauaugguauauguggcucggugcuagauuuuuagaauuugaagcauuagguuucuugaaugaagaucauugguucucacgagaaaauaguuuaucgggaguugaaggugaaggacuacauaaauuaggcuauauucuccgagauguaucuaaaaaggaaggaggugcuauguacgcugacgacacggccgggugggauacaaggauaacacuugaagauuugaaaaacgaagaaaugguuacgaaucauauggaaggagaacauaaaaaguuggccgaagcgauauucaaacuaacauaccaaaacaaaguuguaagaguccagagaccaacccccagagggacgguuauggacauuauaaguagaagagaucagagaggauccggacaaguggggacuuacggucuaaacacuuuuacgaacauggaagcccaacucaucagacaaauggaaggagaaggaguauuuaaaaauauucaacacuuaaccguuacggaagaaguggcaguccagaauugguuagcgcgggugggaagggaacgcuuaucgagaauggcuaucucaggcgaugacugcgucguuaaaccacucgaugacagauuugcuaaugcacuaacugcacugaacgacaugggaaaaauaagaaaagacauacagcaaugggaaccuucaaagggauggaaugacuggacacaagugccauuuuguagucaccauuuucacgaacucauuaugaaagaugggcgcguccuagugguacccugucgcaaccaagacgaauuaauuggaagggcccgcauaucucaaggggcaggauggucccuaagggagaccgcguguuuaggaaaaucauacgcucaaauguggucguuaauguauuuucaucgccgagaucuaagacuagcagcaaaugccauauguuccgcuguaccgagucauugggucccuacaagccguaccacauggucaauucaugcgaagcacgaauggaugacgacagaagauauguuaacuguauggaacagagucuggauacgagagaauccauggauggaagauaaaacaccaguagaaucaugggaagaaauuccauacuuaggaaagagagaagaucaauggugcggaaguuuaauaggguugacaucucgagcuaccugggcuaaaaauauacaagccgcaauaaaucaaguucgaucccuaauaggcaacgaagaauauacugauuauaugccuaguaugaagagauucagacgugaagaagaagaggcagggguucuuugguga

SEQ ID NO: 22771 - RNA, 9876 nt, Artificial Sequence
  derived and/or modified CDS sequence (opt6) from DENV-2__EU482787__SS-prME
accgcugggguuaucaucaugcuaauacccacugcaauggcauuccaucugacaacuagaaacggugaaccucauaugauuguuggaagacaagagaaagggaaaucauuguuauuuaaaacagaagacggaguuaauauguguacguuaauggcaaucgacuuaggugaacucugugaggauacgaucacauacaaguguccuuuacuucgccaaaaugagccggaagacauagauuguuggugcaauucgacaucaacuuggguuacauacgguaccugcacuacaacgggggaacaccgacgagaaaaacgaagcgucgcacuuguuccacauguggggaugggcuuggaaacacguaccgagacuuggaugagcagcgaaggagccuggaaacacgcacaaagaauugaaacguggauauugcggcaucccggcuucacaauuauggcugcaauauuggcauacacaguagggacaacacauuuccaacgagcuuugauauucauacuccuggcugcaguggccccuucuaugacaaugcgauguauuggaauaucuaaucgugauuucguggaagguguuagcggcggaagcuggguggacaucguuuuggagcacggcucaugugugacuaccauggccaagaauaaaccaaccuuagacuucgaacuaauaaagacagaagcuaaacaaccagccacccuuagaaaguauuguauagaagcgaaacuaaccaacaccacaacggaaucgcgaugccccacacagggagaaccauccuugaaugaagaacaagauaagagauucguaugcaaacauuccaugguagaucgaggauggggcaauggguguggacucuucggaaaaggugguaucgucacuugugccauguuuacaugcaaaaaaaauauggaagggaaaauuguucaaccagaaaauuuggaauauacaauugucauaacuccucacucaggcgaggaacaugccguaggaaaugacacuggcaaacauggaaaagagauuaagauuacaccucagucuccaauuacagaagcugaacuuacaggauauggaacaguuacaauggaauguaguccacgcacagggcuagacuucaacgaaaugguauugcuccagauggaagauaaagcauggcuuguacauagacaaugguuuuuagaucuaccacuacccugguuaccgggagccgauacacaagguucaaacuggauucagaaagaaacuuuaguaacguucaaaaacccacacgcaaagaaacaggacguugucguauuagggucacaagaaggggcaaugcacacugcuuuaaccggggcuacagaaauacaaaugucguccgguaaucuauuauuuacaggacacuuaaaaugcagacuaagaauggacaaacuccagcugaaaggcaugagcuauaguaugugcaccggcaaauuuaaaaucgucaaagaaauagcugagacccaacauggaaccaucguaauccgugugcaguacgaaggagacggcucaccauguaaaauaccauucgaaauaauggaccuugagaaaaggcauguacuagggagguuaaucacuguaaacccaauaguaacagaaaaagacagcccugucaauauugaagcagaaccccccuucggggauaguuauauaauaauaggaguggaaccaggacagcuuaagcuaaacugguuuaaaaagggaucuagcauaggucaaauguuugaaacuacaaugcggggagcuaaaagaauggcaaucuuaggcgacacugccugggacuuuggaaguuugggaggaguuuuuaccucuaucggcaaggcgcuccaucaaguuuuuggagcaaucuacggcgcagcuuucuccggagugagcuggacaaugaagauauuaauaggaguuauaauuacuuggaucggaaugaauagccgauccaccagucuaaguguaagccuaguacucguuggcgucauuacucucuaucuaggagcaauggugcaagcagacagugggugugucgugucguggaagaacaaagaacuaaaaugcgggucagggaucuucauaacagacaauguacacacauggacggagcaguacaaauuccaaccagaaaguccaucgaaacuagcaagcgcaauucaaaaagcacacgaggaaggaauauguggaauucgcagugugacacggcuugagaaccugauguggaagcaaauaacuccagaauugaaucauauuuuaagugaaaaugagguaaagcucacaauaaugacaggagauauuaagggcauaaugcaagcaggaaaacgcucucuaagaccucaacccaccgaacugaaauauucuuggaaaacuuggggaaaagcaaaaaugcuaaguacggaaucgcacaaccagacauuucuaauugacgggcccgaaacugcagaaugcccaaacacuaacagggcauggaacucauuagagguagaagacuacggauuugguguauuuacaacuaacaucuggcuaaaguuacgugaaaaacaggauguguucugugacuccaaacuaaugucugcagcaauuaaagauaauagggccgugcacgcagauaugggauauuggauugagucagcuuugaaugacacuuggaaaauggaaaaagcgaguuuuauugagguaaaaucaugccauuggccuaaaucgcauacgcuauggucuaacggcguucuagaaucugaaaugauaauaccaaaaucauucgccggaccaguuagucagcacaauuaucgacccggauauuauacacaaacggcggguccguggcacuugggcaagcuagagauggauuuugauuuuugcgaaggaacaacuguuguaguaacagaagauuguggcaauagaggccccucacuacgcacaacaacagcgucuggaaaauuaauaaccgagugguguugucgaucauguacucucccaccauuaagguauagaggagaagauggauguugguauggaauggagauuagaccgcuuaaggagaaagaggagaaucuuguaaacagucuaguuacagccgggcauggccaaauagauaacuuuucacuaggaguauuaggcauggcacuuuuuuuagaagaaauguuaagaacacgaguagguacaaagcacgccauacuacuagucaccguauccuuuguaacauuaauaaccggaaacaugucauuucgugauuuaggaaggguaaugguuaugguuggugcugccaugacagacgauauaggaaugggaguuacuuaucuagcguuacuggccgcauucaagguacgaccgacauucgcagcagguuuacugcuccgcaaauuaacuucuaaagaauuaaugauggccacgauugggauagcauuacuuucacaaucaacgauucccgagacuauccuagaacuaacugacgcacuugcgcuaggaaugaugguauuaaaaauuguaagaaauauggaaaaauaccaauuggcgguaacaaucauggcaauuucaugcgucccaaaugcuguaauacuucaaaacgccuggaaaguaucuuguacuauacuggcagcuguuucagucucaccacucuuacuuacaagcucucaacagaaagccgauuggauuccacucgcacuuacaaucaaaggucuaaauccaacagccauauuucuaacuacauuguccaggacgucaaaaaaacguucauggccucuaaaugaggccaucauggcggugggaaugguaucaauucuugccucuucucuacuuaagaacgauauaccaaugacggggccucuaguagcagggggcuuauuaaccguuugcuauguguugacugggagaucagcggauuuagaacuugaacgugcuacugacguaaagugggaggaccaggccgaaauaaguggaucuuccccuauacuaucuaucaccauagcagaagauggaucuaugaguauaaagaacgaagaagaagaacaaacgcuuacuauuuuaauucgaacagggcuucuaguaauaagcgguuuauuuccaguuuccauaccaauuacugcagcggcaugguauuuaugggaagucaagaaacaaagagcuggugucuuaugggacguaccaaguccuccucccgucggaaaagcugaacuagaagauggagcuuaucggaucaaacaaaaaggaauacuaggauauagccaaauuggagccggcgucuauaaagaggguacauuccauacaauguggcacguuacaagaggugcuguuuugaugcaucgaggaaaacgaaucgagcccaguugggcagacgucaagaaagauuuaauaucuuacggagguggauggaaacuagaaggagaauggaaagagggcgaagaaguacaagugcuugcacucgaaccgggcaaaaauccucgagcaguccagacaaaaccagguuuauuuaaaacuaguacaggcaccauaggggcugugucacuagacuuuucaccaggaacgucugguucgccgauaguggacagaaagggaaagguaguuggauuguaugguaauggaguuguaacuagaaguggggcguacguuucagccaucgcacagacagaaaaaagcauagaagauaauccagagauugaagaugauauauuuaggaaaaaaagacuuacaauuauggaucuacaccccggcgcggguaaaacaaagagauacuuaccggcaauagucagagaagccauaaaaagaggcuuaagaacgcuuauacuugccccuacucgaguuguagcagcggagauggaagaagcccuaagagggcugccgauacgauaucaaacgccugcgaucagagcggaacauacaggacgagaaauuguagacuuaaugugucaugcuacauuuacgaugcgucugcuuucgccuguaagagucccgaauuacaaucucauaauaauggaugaagcacauuuuacagauccggcgaguauagcagcccgggguuauaucucuacgagagucgagaugggagaggcagcaggaaucuucaugacagcuacacccccaggaaguagggauccauuuccgcaaucaaacgcuccuauaauggaugaggaacgagagauaccggaacgaaguuggaauucuggucacgaaugggucacagacuuuaaaggcaaaacagucugguuugugccuuccauuaaagccgguaaugacauagcggcaugccuccgcaaaaacgguaaaaaagucauccaguuaucuagaaaaacguucgauucggaauacguaaaaacgcgaaccaacgauugggauuucguaguuacaaccgauauaucggaaaugggagcaaauuuuaaggccgaacgugugauagacccaagaaggugcaugaaaccgguaauucuuacagacggcgaagaaagagugauauuagcgggaccaaugcccguaacacauucaagugcugcucaaagaaggggucgaaucggaaggaauccuaaaaaugaaaacgaccaauauauauacaugggggaaccacucgaaaaugaugaagacugcgcccauuggaaggaagccaagaugcuacuagauaauauuaauacucccgaaggaauuauuccaucuauguucgagccugaaagagaaaaaguagaugcaauagauggggaauacagacuaaggggugaggccaggaagacuuucguagaucuaaugcgaagaggagacuuaccuguauggcuagcauauaggguggcagcagagggaauuaauuaugccgaccgccgaugguguuucgauggaguaaagaacaaccaaauacuagaagaaaauguagaaguggagaucuggacaaaggagggagaaaggaaaaaauuaaaaccgagauggcuagaugcgagaauuuauagugacccccuagcacugaaggaauucaaagaauuugcugcaggacgaaaaagucuaacguuaaaccucaucacugagauggguagacuaccaacauuuaugacucaaaaagcccgggacgcacuagauaauuuggcuguuuuacauacagcagaagcugguggcagggccuauaaucaugcuuuaagcgaguuaccggaaacucuugaaacguuauuguuauuaacauugcucgcaacggugacaggcggaaucuuucucuuuuugaugucuggcaaggggguuggaaaaaugacacuaggaauguguugcauaauaacagcauccauccuacucugguacgcccagauucaaccucauuggauugcagcaucgaucauucuugaauuuuuuuuaauaguauuacuuauacccgagccggaaaaacaaagaacuccacaagacaaucaauugacuuauguugucaucgcaauuuuaacagucguagcagcaacaauggcaaaugagaugggauuccuugaaaaaaccaagaaagauuuaggucucgguuccauugcaacgcaggaaccugagagcaacauacucgauauugaucucagaccugcguccgcuuggacccuguaugcgguugccaccacauuugucacaccgaugcuuagacauaguauugaaaauagcagcgucaaugucucccuaacggccauugcgaaucaagccacaguacuuaugggauuaggaaagggauggccuuuaucgaaaauggacauugguguaccccuacuggcaaucggauguuauucccaagucaaucccauaacauuaacugccgcacuacuucuauuaguugcucacuacgcaauaauaggacccggcuuacaggccaaagccacuagagaagcacagaaacgugcagcagcugguauuaugaaaaauccaacugucgaugggguaacaguuauagacuuagacccgaucccguaugauccaaaauucgaaaagcagcuaggacaggugauguuacuaaucuugugcgucacccaaguccugaugaugagaaccacgugggcucuaugugaggcacuuacauuggcuacaggucccauaaguacacugugggaaggaaauccagguagauuuuggaacacaacaauugcgguaucaauggcgaauauauuucgagggucauaucuagccggugccgguuuacuuuucucaaucaugaaaaacacaacuaauacacgacgagguacgggcaacauuggagaaacucuaggagaaaaauggaaaaguagacuaaacgcuuugggcaaaucggaauuucagauauacaaaaagaguggcauccaagagguugaucgaacacuugcgaaagagggcauaaagcgaggggaaacagaccaucacgcgguuucuagggggagugcuaaguuaagaugguuuguugaacggaauaugguaacaccagaggguaaagugguagauuuaggaugcggacgcgguggauggucauacuauugugguggauuaaaggauguuagagaaguaaaaggacuaacaaaggguggaccaggacacgaggaaccgauaccaaugagcacauauggauggaauuugguucgucuucagucuggaguagacguauucuucacaccccccgaaaaaugcgauacauuauugugugacauuggcgagucaucgccgaaucccaccauagaggccggacguacucuucguguccuuucucuuguggagaacuggcuaaacaaugauacacaauuuugcaucaaaguuuuaaaccccuauaugccuaguguaauugaaaaaauggagacccugcaaagaaaauaugggggagcuuugguucguaacccucuaagccggaacaguacucacgaaauguauuggguaaguaaugcuacggguaacaucgugagcucaguaaauaugauaucucgaaugcuaauuaauagauucacaaugaagcauaagaaagcaaccuacgaaccggacgucgaccucggaucuggaacucggaacauagguauagaaucagaaauaccaaauuuagacauaauaggaaaaagaauagaaaagauaaaacaggagcaugaaaccucuuggcacuacgaucaagaucacccguacaaaacuugggcauaucacgggaguuaugagacuaaacaaacaggcucagcaucaucgauggucaaugguguuguaagacuacuaacuaaaccgugggacguagucccgauggucacgcaaauggcaaugacggauaccacaccauuuggucaacagaggguauuuaaagaaaaggucgacacacguacgcaagaacccaaagaaggaacaaaaaagcuuaugaaaauaacagcagaaugguuauggaaagaacuugggaaaaagaaaacuccaagaaugugcacgcgugaggaauucacaaggaagguuaggaguaacgcagcauuaggagcaauuuuuacagaugagaacaaguggaagagugcucgcgaagcaguggaagauaguagguucugggagcuagucgacaaggagcgcaaucuacauuuagaaggaaaaugugagaccuguguauacaacaugaugggcaaacgggaaaaaaaguugggagaauucgguaaagcaaaaggaucucgggccauuugguacaugugguuaggggcacguuuuuuagaguuugaagcucuaggauuccucaaugaagaccacugguucagucgagaaaauucccuuuccgguguagaaggagagggccugcacaaacuaggcuacauacugagagaugugagcaagaaggagggaggcgcgauguacgcugaugauacagccggcugggauacgagaauuacucuugaagacuuaaaaaaugaagaaaugguuaccaaucauauggaaggggaacauaagaaacuagcagaggcaauauucaagcuaacuuaucaaaacaagguagucagaguacaaaggccaaccccacgagggacuguaauggacauaauaaguagaagagaccaacguggaaguggacagguaggcacauacggcuuaaauacauuuacgaauauggaagcacaguugaucagacaaauggagggagaaggugucuuuaaaaguauucaacgauuaacugugacagaggaaauagcuguccaaaacugguuagcgagaguagggcgugagagguuaucuagaauggcgauaaguggcgaugauugcguuguaaaaccauuagaugacagauuugcaucagcgcucacugcacucaacgacaugggcaaaguuagaaaagauauacaacagugggaacccucacgcgguuggaacgauuggacacaaguaccauucuguucucaccauuuucaugaacucauaaugaaagaugguagaguuuuaguaguaccauguaggaaccaagaugaauuaauugguagagcucguauaucgcaaggagcgggauggagccuuaaagaaacagcaugcuuggguaagaguuacgcacaaaugugguccuuaauguauuuucaucgccgagauuugagacuggccgcaaaugccauauguuccgcagucccaucucauuggguacccacuucuaggaccacauggaguauucaugccaaacacgaauggaugacaacagaagauauguugacagucuggaaccguguauggauacaagaaaauccuuggauggaggauaaaacuccuguugaaucaugggaagaagucccauaccuuggcaaaagggaagaucaauggugugguucguuaauaggccuuaccucucgagccaccugggccaaaaacauccaaacagccauaaaucaagucagaucucuaauuggcaacgaagaauauacagauuauaugccaucgaugaagagauuuagacgggaggaagaagaagccgguguacuaugguga

SEQ ID NO: 22772 - RNA, 9876 nt, Artificial Sequence
  derived and/or modified CDS sequence (opt6) from DENV-2__EU482788__SS-prME
acugccgguguuaucaucauguuaauuccgaccgcaauggcauuucaucuaaccacaagaaauggugaaccgcacaugauaguuggucgccaagaaaaagguaaaaguuuacucuucaaaacugaagaugguguuaauauguguacccuaauggcaauagacuuaggagaacuaugugaagauacaauuacguauaaaugccccuugcuucgacaaaaugaaccagaagauauugauuguugguguaauaguacaucaacaugggugacguauggaacauguaccaccaccggagaacaccguagggagaaaagauccguagcauuagucccucacguuggaauggggcuugaaacuagaaccgaaacguggaugucaucagaaggagcauggaaacaugcacaacgaauugaaacauggauccugagacauccagguuuuacaauaauggccgcuauccucgcauauacaguuggaacaacacacuuucaaagggcccucauuuuuauauuacucgccgcaguggcuccaucaaugacaaugcguuguauagggauaucaaauagagacuucguggaagguguaagcgguggcuccuggguagacaucguacuagaacauggaaguugcgucacgaccauggcuaaaaauaaaccaacauuggauuuugaacuuauuaaaacagaagcaaaacagccugcgacgcuaaggaaauauuguauagaagcaaaacuaacuaacacuacaacagaaucaagauguccaacucaaggugaaccuucacuuaaugaagaacaggauaaaagauuuguuugcaaacauaguaugguagauagaggauggggaaauggauguggacuguucggaaaaggaggaauuguaacgugugccauguucacuuguaagaaaaacauggaaggaaaaauaguacaaccggaaaacuuagaauacacgauagucauuacgccacacucaggagaagaacacgcagucggaaaugacacgggcaaacauggaaaagaaauaaaaaucacaccucaaucaccuauaacagaagcugaauuaacuggauacggaacaguaacuauggaauguucaccccgaacaggccuggacuuuaaugaaaugguauuauuacaaauggaagacaaggcuuggcuaguacaucgacaaugguucuuagaucuaccccuuccaugguuaccgggggccgauacccaagguucaaacuggauacaaaaagaaacacucguuacguuuaaaaauccgcaugccaagaaacaagauguaguuguacuuggcucacaagaaggagcaaugcacacugcguuaaccggcgcuacagaaauacaaaugucgucaggcaacuuguuguucacaggacaccuuaaaugccgauuaagaauggauaaacugcaacugaaagggaugucauauaguauguguaccggcaaauucaaaauugucaaagagauugcagagacccaacacggcacaaucguaaucagagugcaauaugagggugauggcucgccguguaaaaucccuuuugaaauaauggauuuggaaaagcgccauguguuagggcguuugauaaccguuaacccuauuguuaccgagaaagauagcccaguaaauauugaagcggaaccgccguucggagacagcuauauaauaauagggguugagccuggacaacuuaaacugaauugguuuaaaaaggguucaaguauaggucaaauguucgaaaccacuaugagaggcgcaaagcgaauggcaaucuugggggacaccgccugggacuuugguuccuuagggggaguauuuacaucgauaggaaaggcuuuacaccaaguauuuggcgcaauauacggcgcugcauucagcgguguaaguuggacuaugaaaauccuuauuggcguuaucauaacauggauuggaaugaacuccagaagcacuucccuaagcgucagucucguacucguagguguaauuacgcuuuacuugggagccaugguacaggccgacucuggcugcguaguaaguuggaagaauaaagaacucaaaugugguucggggauuuuuauaacggacaacguacacaccuggacugaacaguauaaguuucaaccagagagccccagcaaguuagcaagugccauucaaaaagcccacgaagaggggauuugcggcauuagguccgucacuagacuagaaaaccuuauguggaaacaaauaacuccggaacuuaaccacauucuaucggaaaaugaggugaaacuuacaauaaugacaggagacaucaaaggaauaaugcaagcaggaaagagaucacuuagaccucaaccaacagaacuaaaauacagcuggaaaacauggggcaaagcaaaaaugcuuaguaccgaaagccacaaccaaacauuucuaauagacgguccugaaacagcugaguguccuaacaccaacagagcauggaacucuuuagaaguagaagauuaugguuuuggcguuuuuacaacuaacauaugguuaaagcuacgagaaaaacaagauguauuuugugauuccaaacucaugucagcugcaauuaaagacaaccgugcuguucaugcggauaugggcuauuggaucgagucagccuuaaaugauacguggaaaauggaaaaagcaucauucauagaaguaaagaguugccacuggccaaaaucacauacacuuuggucuaauggcguucucgaaucagaaaugaucauccccaaaucauuugcgggcccagucucacagcacaacuauaggcccggauacuacacgcagacagcuggaccuuggcaucugggaaaguuagaaauggauuuugacuuuugcgaagggacuacaguaguagucaccgaggauugugggaacagagggccuaguuuaagaacaaccacagccucaggaaaacuuauaacugaauggugcugucgaaguugcacccucccgccgcuuagauaucgaggagaggauggguguugguauggaauggaaauucgaccgcucaaagaaaaagaagagaauuuagucaacagucuuguuacagcaggacauggucaaauugauaauuuuucacucggaguacuggguauggcguuauuucuggaagaaauguuacggacaaggguaggaacgaaacacgcuauuuugcuagucacuguaucauuuguaacgcugaucaccgguaauaugucguuucgcgaccucggacggguaaugguuauggugggcgcagcgaugacugacgacauaggcaugggcgugacguaccucgcgcuacuagcggcauuuaaaguucggcccacauuugccgccggcuuauugcucagaaaacucacauccaaagaacucaugauggcaacaauuggaauagcauuguuaagucaaaguacuauucccgaaacaauuuuagaacuaaccgacgcacuugcacucggaaugaugguacucaagauuguuaggaauauggaaaaauaucaacucgcaguuaccauaauggcgauuaguuguguuccaaacgcaguaauucuacaaaacgcauggaagguaaguuguaccauccuugcugcuguaagugugucaccacuacuacuaacuucaucucaacagaaagcggauuggauaccuuuagccuugacgauuaaaggucucaauccuaccgcgauauuucuaacuacacuguccagaacuucuaagaaaagaucauggccucuuaaugaagcaaucauggcuguaggcauggugucuauacuagcuagcagccuauuaaagaaugacauucccaugacugggccacugguugcgggcggacuucucacaguuugcuacguucuaacaggaagaucugccgaucuagaauuagaaagagcaacagauguuaaaugggaggaucaggcagaaauaucagguuccucacccauauuaagcauuaccauagccgaggauggaucaaugucgaucaaaaaugaagaagaagaacagacucuaaccauacugauacguaccggacuccuuguaauaucuggauuauuuccggucaguauaccgauaaccgcggcugccugguaccuuugggaagucaagaaacaaagggcaggaguccuuugggauguaccuaguccucccccagucggaaaggcggaacuagaagauggagcuuaccgaaucaaacaaaaaggaauacuaggcuauucucaaaucggggcaggaguguauaaagaaggaacauuccauacuauguggcacguuacgaggggagcugugcugaugcaucgcgguaaaaggauagaaccaucaugggccgauguaaagaaagaccuaauaucguauggcgguggcuggaaauuagaaggggaguggaaagaaggagaagaggugcaaguacucgcccuagaaccaggcaagaauccucgugcuguccaaacaaaaccaggauuauucaaaaccaacaccggcacuauaggcgcaguaucacuggauuuuaguccggggacauccggaagccccauaguagauaggaaggguaaaguugugggacucuaugguaaugggguaguuacucgaucuggagcguaugucucggccauugcacagacagagaaaaguauugaagauaaccccgaaauagaagaugacauauuuagaaagaaacgacuuacuauuauggauuugcacccaggcgccgggaagacaaaaagauaucuaccugcaauaguaagagaggcaauuaaaagaggccuacgaacuuuaauuuuagcaccaacucggguaguggcagcagaaauggaggaagcacuaagaggauuaccuauccgauaucaaacgccagcgauuagggcggaacauacaggccgagaaauuguagaucuaaugugucaugcaacuuucacaaugaggcuuuugaguccaguaagagugccaaauuauaauuuaauuauaauggaugaagcacauuucaccgacccugcuucuauagcagcccgagguuauauaaguacucgcgucgagaugggcgaggcagcagguauuuuuaugacggcgacaccuccuggaucgcgcgauccguucccacagaguaaugcaccaaucauggaugaagaacgagaaauaccagaaaggucuuggaacucuggucaugaauggguuacagacuucaaagggaaaacaguuugguucguaccguccauuaaagcuggaaaugauaucgcggcaugccugcgaaagaauggcaagaaagucauucaguuaucacguaaaaccuuugacagcgaauacgucaaaacuaggacaaaugauugggacuuuguuguuacuacagauauaucggagaugggcgcaaacuuuaaagcagagagaguaaucgacccuagaagauguaugaagccaguaauuuugacggauggagaagaaagaguaauccuugcugguccuaugccuguuacacacucaucagcagcacagaggcgggguagaauaggaagaaauccuaagaaugaaaacgaucaauauauauacaugggcgaaccuuuagaaaaugacgaggacugcgcacauuggaaagaagcaaagauguuauuggacaauauaaauacaccugaaggaaucauaccaaguauguuugaaccagagagagaaaaaguagaugccauagacggggaauaccguuuaagaggggaagcacgaaaaaccuuuguugauuuaaugaggagaggcgacuuacccguaugguuggcauauaggguugcggccgaaggaauaaacuacgccgauaggagaugguguuucgauggggucaaaaacaaccagauauuagaagaaaauguagagguagaaauauggacgaaagaaggggaacguaagaaauuaaaaccacgguggcuagaugcgcguauauacucugauccucuugcauugaaagaguucaaagaguucgcagcagggcgaaaaagucugacccugaauuugauaacugaaaugggucgucuuccaacauuuaugacgcaaaaggcacgcaacgcauuggauaaccucgcaguuuuacauacagcagaggccgggggacgagcauauaaccacgcauuaagcgaacuaccggaaaccuuggaaacauuauuacuacuaaccuuacuagccaccgugacugggggaauauucuuauuuuuaaugucaggaaaaggagugggaaaaaugacucucgguauguguuguauaaucaccgcaucaauauuacuaugguaugcccaaauccagccgcacuggauagcggcuagcauuauucuugaguuuuucuugaucguuuuguuaauaccagagccggaaaaacaaaggacaccgcaggauaaccaacugacauauguugugauugcuauacuaacagucguggcagcuaccauggcgaaugaaaugggauuccuagaaaagacuaagaaagaucucggacucggaagcauagcaacucaagagcccgaaagcaacauccuagacauagaucuucguccagcaagugcguggacacuuuaugcuguagcuaccacauuuguaacaccuaugcugcgacauagcauagaaaauuccucagugaauguauccuuaacagcuaucgcaaaucaagccacugugcucaugggccuaggcaaaggauggccauuaagcaaaauggacauaggagugccacuauuagcuauaggaugcuacucgcaagucaaucccaucacucuaacugcagcguuacuccuucuuguugcacauuacgcaauaauagguccaggucuacaggcuaaggcgacacgagaagcgcagaaaagggcagcugcaggcauaaugaagaauccaacugucgacggaauaaccgugauagacuuagacccaauaccuuaugaucccaaguucgagaaacaauuaggccaagugauguuacuaaucuuaugcguuacacaaguauuaaugaugagaacgacaugggcucuaugcgaagcauuaacuuuagcaacgggaccuauaucaacucucugggaagggaauccgggacgcuuuuggaacacaacaaucgcuguuagcauggcaaacauauucagagguaguuaccuugcaggagcagguuuauuguuuagcauuaugaaaaauaccacaaauacaaggaggggaacaggaaacauaggagaaacguuaggagagaaguggaaaucacgauugaaugcucuuggcaaaagugaguuccaaauauacaagaaaucaggaauacaagaaguugaccggacacuggcuaaagaagggauaaaaagaggugaaacagaccaucaugcaguaagcagagguagugccaaacuacguugguuuguagagagaaacauggucacgccagaagguaagguugucgauuugggcugcggaaggggcgguuggagcuacuacuguggaggccuaaaagacguaagagaaguaaagggacucacaaaaggugguccgggucaugaagaaccaauaccaaugucuacguacggguggaaucuaguaagacuacaaucgggagucgauguauucuuuacucccccagagaagugugacacccuucuaugugauauuggagaaucaagcccaaacccaacaauugaggcaggaaggacgcuuagggucuuaaguuuaguggaaaauuggcuuaauaacgacacucaguuuugcauaaaaguccuaaaucccuauaugccgagcgucauagagaaaauggaaacucuacaaagaaaauauggcggagcucuaguaagaaauccccugagcaggaacagcacacaugaaauguacuggguaucaaaugccacaggaaauauagucagcagcguuaauaugauuaguagaauguuaauaaauagauuuacuaugaagcauaagaaagccacuuacgaaccagauguagauuuagggagcgguacgaggaauauaggcauugagagcgaaaucccuaaucuagauauaauuggcaaacguauugaaaagauuaagcaggaacaugaaacuucguggcacuaugaucaggaucauccauauaaaacgugggcuuaccacggaagcuaugaaacaaagcaaacgggcagugcuagcaguaugguaaacggaguuguuaggcucuugacuaaaccuugggacgucguaccaauggucacacagauggcuaugacggacaccaccccuuuuggacaacaaagagucuucaaagagaaaguagauacccgaacccaagagcccaaagaaggaacuaaaaaguugaugaaaauuaccgcagaaugguuguggaaagaacugggcaagaagaaaacaccccguauguguacacgugaagaguucacaagaaaaguaaggucaaaugcagcacuaggagcuauuuuuacggacgagaauaaauggaaaagugcacgagaagcugucgaagacucaagguuuugggagcuaguagauaaggaaagaaaccuacauuuggaaggaaaaugugagacgugugucuauaacaugaugggaaagcgugaaaagaaacuaggagaguucgggaaagcuaaagguagucgcgcaauaugguacauguggcugggagcaagauuucucgaguuugaagcccuuggauuuuugaaugaagaucacugguucagucgagaaaauucauuaucggguguagaaggagagggacuacauaaguuaggguacauacugagagauguuagcaagaaagagggaggagccauguacgcugaugacacggcuggaugggauacaagaauaacauuggaagaucugaaaaaugaggaaaugguuacaaaucacauggagggagaacacaagaaacuagcagaagcuauauuuaaacugacguaccagaauaaaguuguucggguucaaagaccaacgcccagaggcacaguaauggauaucauaagucgucgugaucaaagaggaucaggucaaguuggcacauauggucuaaauacauuuacuaacauggaagcccaauuaauuagacaaauggaaggagaagggguguucaagucuauucaaagauugacaguuacagaagaaauugccguccaaaauuggcuggccagaguuggcagggaaagauuaucaaggauggcuauaucaggcgaugacuguguaguaaagccgcuagaugauagauucgcaucggcuuugacggcgcuaaaugacauggguaaaguacgaaaagacauccaacaaugggaacccucuagggguuggaaugacuggacucaagugccuuucugcucucaccauuuucaugaacuaauuaugaaagauggaagggugcuaguuguaccuuguagaaaucaagaugaguugaucgggagggcgcgcaucagccaaggugcugguugguccuugaaggaaacagcaugccuggggaaaucauaugcgcaaauguggucucuaauguauuuccauagacgagacuuacgguuagcugcaaacgcaauuugcucagcagucccaucccauuggguuccuacuucgagaacaacuuggucaauucacgcaaagcacgaauggaugaccacagaagauauguuaacaguguggaauagaguauggauucaagaaaauccauggauggaagauaaaacaccaguagagucuugggaagaaguacccuacuuaggcaagagggaggaccaauggugugguucccuaauaggucuaacuagcagagcuacgugggccaaaaauauucagacugcgauuaaucaaguccgaucacugaucgguaacgaagaguacacagacuauaugccuucaaugaaaagauucagacgcgaggaagaagaagcaggaguacuaugguaa

SEQ ID NO: 22773 - RNA, 9876 nt, Artificial Sequence
  derived and/or modified CDS sequence (opt6) from DENV-2__EU482697__SS-prME
ucggcaggcaugauaauuauguuaauaccaacaguaauggccuuucauuuaaccacccguaacggugaaccacauaugauuguagggauacaggaaaaagggaaaucgcuuuuguuuaaaaccgaagacgggguaaacaugugcacauugauggcuauggaucuaggugagcuaugugaggauacaauuaccuacaaaugcccauugcuacgucaaaaugaaccagaggauauagauuguugguguaacucuacgaguacuuggguaacuuacggaaccugcacuacuacuggcgaacauagacgugagaaacgaucaguagcccuugucccacaugucgguaugggauuagagacgagaacggagacauggaugagcuccgagggagcauggaaacaugcccaacguauagagacguggauauugagacauccaggguucacaauaauggcagcuauacuggccuauacaauaggaacaacccacuuccaacggguccuaauauuuauucuuuuaacagcgguagcgccaaguaugacgaugcgaugcauuggaauaucaaauagggacuuuguagaaggcguuucaggaggcaguuggguagauauuguacuagaacacggaucaugcguuacaacaauggccaaaaauaaaccgacuuuagacuuugaauuaauuaaaacagaagcuaaacaaccggcaacucuccgaaaauauuguauagaagcaaaauuaaccaauacaacuacugagagccgcugucccacacaaggcgagcccagccuuaaagaagaacaagacaaaagguuuguauguaaacauaguaugguagaucguggauggggaaacggcugugguuuauucgggaaaggaggcauagucacuugcgcaauguuuacgugcaagaaaaacauggaagguaaaaucguucaaccggaaaaucuggaauauaccauugugguaacaccucauucaggggaggagcaugcuguagggaaugacacuggcaaacacggccaagaaauuaaagucacaccacaaucaucuauaaccgaagcugaguuaacaggcuacggaacuguuacuauggagugcagcccgcgaacaggccuagauuuuaacgagauggucuuacuccaaauggaaaauaaagcauggcucguacaucgacagugguuucucgacuuacccuuaccauggcucccaggagccgacaaacaagaaucuaauuggauacaaaaagaaacucuggugacuuucaaaaauccgcaugccaagaaacaagacguuguagugcuuggaagccaagagggugcaaugcacacagcucugacaggagccacagaaauacaaaugaguagcggcaaucuauuauucacaggacauuuaaaauguagauuaaggauggauaaauuacaauugaaaggaaugaguuacaguauguguacaggaaaauuuaaaguagugaaagaaauugccgaaacacaacaugggaccauagucauuagaguucaauaugaaggugacgguaguccuuguaagauacccuucgaaauaauggauuuagaaaaacgauaugucuuaggacgcuuaauuacuguaaacccuauugucacagaaaaggauucaccgguaaacaucgaagcggaaccgcccuuuggagacagcuauauaauaauaggagucgagccuggucaacugaaauuaaacugguuuaagaaaggauccaguauuggacaaauguuugaaacuacaaugagaggggcaaaaagaauggcaauacuaggggauacagcgugggacuuuggcucuuuaggugggguuuuuaccagcauaggaaaagcauuacaccaagucuuuggggcaaucuacggugcugcguuuagugggguaucuuggacuaugaaaauauuaaucgguguuauaauuacauggaucggcaugaauagccgaucaaccucgcuuucaguaagccucguauugguaggaauaguaacacuauauuuagggguaaugguacaagcugauucaggaugugugguuuccuggaaaaacaaagaacucaaauguggaucagguaucuuuauuacagauaauguacauacguggacagagcaguauaaauuucagccagaaucaccuucaaaauuagcaagugcaauacaaaaagcucaagaggagggaauuugugggauaagaagcguuacacguuuagaaaaucuuauguggaagcaaauaacaccagaacucaaucacauacuugccgaaaaugaaguuaaacucacaauaaugacuggcgauauaaagggaauuaugcaagcagguaaaagaucauuacggccacaaccuacugaacuuaaauauucauggaaaaccuggggcaaggcaaaaauguuauccacggaaucauauaaucaaacguucuuaauugauggaccagaaacagcggaauguccaaauacuaacagagcauggaauagcuuggaaguggaggacuacggauuuggagucuucacaacaaacaucugguugaaguuaaaggagaagcaagaugccuuuugcgauagcaaacuuaugucagccgcaaucaaggacaacagagcaguacaugcagauaugggauacuggaucgaaucagcauuaaaugacacuuggaaaauugagaaagccagcuucauagaggugaaaaauugucauuggcccaagagucauacacuuuggucuaauggaguguuggagucggagaugauaauacccaaaaaccuagccggaccggugucgcaacauaacuaucguccuggcuaucauacgcagauagcaggacccuggcauuugggaaaauuagaaauggacuucgacuucugugauggaacgaccguuauaguaacagaagacugcggaaauagagguccgucucuucguacgacuacggcgucggguaagcucaucacagaaugguguugucgaagcuguacuuuaccgccguuacgguaccguggcgaagauggcuguugguacggcauggaaauuaggccucuuaaagagaaagaggaaaaccugguaaauagucuuguaacggcggggcauggccagguugacaauuucucauuagguguacuuggcauggcuuuauuuuuagaagaaaugcuaagaacaagagucggcacaaaacaugccauucuccuugucgcaguaucguucguaacucucauuaccggaaauaugucauuuaaagaucuaggucgcguugucgugaugguaggugcgacgaugaccgacgauauaggaaugggaguuacuuauuuagcacuauuagcugcuuucaaaguaagaccgacauucgccgcuggauuguugcucagaaaauuaacgucaaaagagcucaugaugacuaccaucggaauagugcuccucucacaaucaacuauucccgaaaccguuuuggaacugacugaugcccuggcacuuggaaugaugguucucaagaucguaagaaauauggaaaaauaccaguuagcugugacgauuauggcaauuuuaugugucccaaaugcaguaauacuccagaaugccuggaagguuagcuguacaauacuagcgguuguaagcgucucaccauuacuauuaacaucaucgcaacagaaaacagauuggauaccuuuggcacuaaccauaaaagguuuaaauccaaccgcuauauuuuugaccacauuaagucgaacuaauaagaaacggucguggccauugaacgaggcaauaauggcuguggguaugguuuccaucuuggcuucuagccuuuugaaaaacgauauaccuaugacugggccauuaguagcagggggucuauugacaguauguuauguauuaacaggaaggucugcggacuuagagcucgaaagagccaccgauguaaaaugggaggaccaagcugaaauuucuggaucauccccaauauuaagcaucacaaucucagaagacgggaguaugucaaucaaaaaugaagaggaggagcaaaccuuaacaauacucauacgaacaggacuauuagucauaaguggucuuuucccgauaucgauccccauuacugcagcagcuugguaccuaugggaaguuaagaaacaacgagcugguguguuaugggaugucccaaguccgccaccuaugggaaaagccgaacucgaagauggagcauaccgaauaaaacaaaagggaauacuagguuauucacaaauaggugccggugucuaucgggaaggaacauuccauacgauguggcacguaacacggggugcuguucuaaugcauaaaggaaagcguaucgagccuaguugggcggacguaaagaaagacuuaaucaguuauggaggaggauggaaauuggaaggcgaauggaaagaaggagaggagguacagguauuagcgcucgaacccggcaaaaacccuagagccguccagacuaaaccaggacucuucaaaaccaauacaggcacaauaggagccguuaguuuagacuucaguccuggcaccaguggcuccccaauaauagauaagaaaggaaaaguggugggucuuuacggaaauggcguugucacucgcuccggagcuuacguaagcgccauagcucagacugagaaaagcauugaagacaacccggaaauugaggaugauauauuccguaaaagaagauuaacgauuauggaccuacauccgggggcagggaaaacuaaacgauacuugccggcgaucgucagggaagcaauuaaaagaggccugcggacgcuaauacuggcacccacgcggguaguggccgcagaaauggaagaagccuugcgaggauugccuauacgguaccaaaccccggccauacgagcugaacauacuggaagagaaauaguagaucugaugugucaugcaacuuuuacgaugcggcuucuaucgccaguaagaguaccgaauuauaacuuaauaauaauggaugaagcacauuucacagauccggcuagcaucgcagcgagagguuauauaaguacccguguagaaaugggugaggccgccggcauuuuuaugaccgcuacuccuccuggauccagagacccauuuccacaaucuaacgcuccaauaauagaugaagaaagagagauuccagaaaggucauggaacucggggcaugaaugggucacggauuuuaaagguaaaacagucugguucguacccucaauaaaggcaggaaaugauauagcggccugccuaagaaagaacggcaagaaaguaauacaauugucgagaaagacauuugauagugaguauguuaaaacaagaacaaaugacugggacuuuguuguuacuacagacauaagcgaaaugggugccaauuuuaaagcugagagaguaauagacccucguaggugcaugaaaccgguuauauugaccgacggagaagaaagaguuauauuggccgggccuaugcccguuacacauucuagugccgcgcagagaagaggacguauuggaagaaauccaaagaaugaaaaugaucaauauaucuacaugggagaaccauuggagaacgacgaagauugugcacacuggaaagaggccaaaauguuacuugauaacauaaauacgccagagggaauuauuccaagcauguucgagcccgaaagagaaaagguggacgccaucgauggagaauaucgacuacggggagaggcacgaaagacauucguugaucuuaugcgacguggagauuuaccaguauggcucgcguauaaggucgcugcggaaggaauaaacuacgcggacaggaggugguguuuugaugguaucaaaaacaaucaaauucuagaagaaaauguggaaguugaaaucuggacaaaagaaggcgaaaggaagaaacuuaaaccaaggugguuagaugcccgcauauauucagauccacuugcccuaaaggaauuuaaagaguuugccgcuggucgaaaaucguuaacauuaaacuugauuacugaaaugggaagguuaccgacuuucaugacucagaaaacccgagacgcauuagauaaucuagcuguccuccacacugcggaagcagggggucgggcuuauaaccacgcauugucagaacuaccugaaacucuagaaaccuuacuauuacucacacuacuugcuacgguaacgggaggcaucuuuuuguuccuaaugagugggaggggaauugggaaaaugacacuggggaugugcuguauaauuacggcaucgauucucuuaugguaugcgcaaauacaaccacacuggaucgcugcuucuauuauacuugaguucuuucuaauuguacugcugauaccggaaccugaaaaacagcggacaccucaggauaaucaguuaacauacgucguuauagcgauacuuacaguaguagccgcaacaauggcaaacgaaaugggauuuuuagaaaagacaaagaaagauuuagguuuagguucuauagcaacacagcagccugagaguaauauccuagauauagaucuuagaccagcuagugccuggacucuauaugccguagcuaccacguucguuacaccaauguuaagacauucuaucgaaaauuccucaguuaaugucagcuuaaccgccauagcaaaccaagcuacaguacuuauggggcuugggaagggauggccauuaagcaaaauggacauugggguccccuuacuagcaaucgguuguuauucucaagugaauccuauuacauuaacagcagcacuccuauugcugguagcucacuaugcaauaauugggccaggccuucaagcuaaagcaaccagggaagcccagaaacgagcggcggcagguauaaugaaaaauccgacuguagauggaauaacaguaauugaccuagacccgauaccauaugauccaaaauucgaaaagcagcuaggacaagucauguuacuaauacuaugugugacacaaguccuuaugaugaggacaacaugggccuuaugugaagcacugacccucgcaacaggaccuauaagcacauuaugggaaggcaauccuggccguuucuggaacaccaccauugccguuaguauggccaauaucuuuagggggucguauuuagcaggagcuggauuacuauuuucaauaaugaaaaauaccacuaacaccagaagaggaacagggaacaugggagaaacauuaggugagaaauggaagucucguuugaaugccuuaggaaaaucagaauuucaaauauacaaaaagucuggaauacaggaaguugaccggacacucgccaaagaagggauaaaaaggggcgaaacagaucaucacgcaguuucucguggaucugcaaaacuacgaugguucguagaacguaauaugguaacaccagaaggaaagguaguugacuuaggguguggucgaggcgguuggagcuauuauugcgggggauugaagaacguuagagaagugaaaggauuaacuaagggagggccaggucacgaggaaccaaucccuaugucaacauacggguggaacuuagugaggcuacaaagcggaguagacguguucuuuauacccccggagaaaugugauacacuucuuugugacauaggugagagcucucccaacccuacaguagaagcaggccgaacauugcgaguguuaaauuugguagaaaacugguuaaacaauaacacucaguuuuguaucaaaguuuugaauccauacaugcccagugugauagagaaaauggaagcccuccaaagaaaauacggaggcgccuuagucagaaauccucuuagucgaaauucaacucaugaaauguauugggugucaaaugccucuggaaauauaguuaguucugugaauaugauauccagaaugcuuauuaauagguuuaccaugcggcauaagaaagcaaccuacgaaccugacguagauuugggaagcgggacucgcaauauuggcacagaguccgaaauuccaaaccuagacauuauagguaaaagaauugaaaagauaaaacaagaacaugaaacaaguuggcauuaugaccaggaucacccuuauaagacaugggcauaccaugguucuuacgagacaaaacagacuggaucugcaucgucaaugguaaacgggguaguacgacuccucacaaaaccuugggacguacugccgaugguuacucaaauggcaaugacagauacuacgccguucggccaacagagaguguuuaaagaaaaaguggauacacgaacgcaggaaccuaaagagggcacuaaaaagcuaaugaagaucacagccgagugguuguggaaagaacuuggcaaaaagaagacaccgcgaaugugcacaagagaagaguucacgcgaaaaguuagaaguaaugcagcacuaggugcaauuuucaccgaugaaaauaaauggaaauccgcuagggaagcaguagaagacagcagauuuugggaauuagucgauaaggagagaaauuuccaccuagaagggaaaugugagacuugcguauauaauaugaugggcaaacgagagaagaaauuaggggaauuuggaaaagcaaaaggaucacgggcuauaugguauaugugguuaggggccagauuuuuagaguucgaagcgcugggauuuuuaaacgaagaccauugguuuucaagagaaaauaguuuguccggaguggaaggcgaagguuuacacaaacuaggguauauuuuaagagacgugagcaagaaggagggaggcgcaauguacgcugaugauacagcagguugggacacacgaauaacauuggaagauuuaaagaaugaggaaaugguuacuaaucacauggaaggggagcacaaaaagcuggcagaggcuauauuuaaauuaacuuaccaaaacaaaguggugcgaguacaaagaccaaccccuagaggaacugugauggauauaauaucuagacgugaucagaggggaucaggacaaguaggcaccuaugggcugaauacauucaccaauauggaggcucaacuuauaagacaaauggaaggugaggguguauuuaaaaauauccagcaccuuacaguuacagaagaaguugcuguuaaaaauugguuggcacguguggggagagaacggcuuagucguauggccaucagcggggacgauugcgugguaaaacccuuggaugacagauucgcuaaugcauugacagcucucaacgauaugggaaagauucgaaaggauauccaacaaugggaaccuagcaaaggauggaaugacuggacacaaguaccauucuguucucaucacuuucaugagcucauaaugaaggacggacgaguccuaguuguuccaugucgaaaucaagaugaacuaauugggcgagcaagaaucagucaaggcgcgggcuggucucuccgugagacugcauguuuaggaaagagcuacgcucagauguggagucuuauguacuuucauagaagagaccuuagacuagcagcgaaugcuauauguucugccgugccgucacacuggguuccgacuucucgcacaacauggaguauucaugcaaagcacgaguggaugaccacugaagauauguugacgguauggaaucgagucuggaucagagagaauccuuggauggaagauaaaacgccaguagagucuugggaagagaucccauaucuaggaaaacgagaggaucaauggugcggaagccuaauaggacucacaucacgagcgacuugggcuaagaauauacaggcggcuauaaaucagguaagaaguuuaauuggaaaugaagaguacacugauuauaugccaagcaugaaaagauuccggagagaagaagaagaagcuggaguauuaugguag

SEQ ID NO: 22774 - RNA, 9876 nt, Artificial Sequence
  derived and/or modified CDS sequence (opt6) from DENV-2__EU482699__SS-prME
agcgcaggcaugauaauaauguuaauaccaacaguaauggcuuuucauuuaacgacaagaaauggggaaccucauaugauaguuggaauccaagaaaaaggaaaaucccuccuauuuaaaacggaagacggaguuaauaugugcacguuaauggcaauggaucugggagaauuaugcgaagacacaauuacguacaaaugcccguuacuuagacaaaaugagccagaagauaucgauuguuggugcaacucaacaucaacauggguuaccuauggcacaugcaccacaacaggagaacaucgaagagagaaaagauccguagcauuaguaccacacguaggcaugggauuagaaacaagaacagaaacauggaugaguagugaaggagcuuggaaacacgcacaaaggauugaaacauggauacugcgccacccgggguuuacaauaauggccgccauucuugcuuauacaauuggaacaacacacuuucaaagaguucuuauauuuauauuacuuacggcaguagcuccaaguaugacuaugcgaugcauaggaauaucaaacagagauuucguggaaggaguaaguggggguagcuggguagauauaguucuagaacauggcagcuguguaacaacuauggcgaaaaauaaacccacauuggauuucgagcuuaucaaaacagaagcaaaacaacccgcuacucuaagaaaauacuguaucgaggcaaaauugacgaauacuaccacugaaagccgauguccuacccagggcgagcccucucugaaagaagaacaggauaaaagauucgugugcaaacauucaaugguagauagaggaugggggaauggcugcgguuuauuugguaaaggaggaaucguuacuugugcaauguucacaugcaagaaaaauauggaagggaaaauuguacaacccgaaaaucuugaauauacaaucguaguaacaccucacucgggagaagaacacgcugucggaaaugauacaggaaaacauggaaaagagauuaaaguaacaccacagucaucaauuacagaagcugaacucacuggcuauggaacgguuaccauggaauguaguccgaggacaggcuuagauuuuaaugaaaugguacuacugcaaauggaaaauaaagcaugguugguccauagacagugguuccucgaccuuccucuaccaugguuaccaggcgccgacaaacaagaaucuaauuggauucagaaagagacauugguuacauucaaaaauccacaugcaaagaaacaagauguaguaguauuagguucacaagagggugcaaugcauaccgcauuaacaggagcuacggaaauucagaugucaucaggaaauuuacuuuuuacaggccaccuaaaauguagauuacguauggacaaacuacagcucaaagguaugagcuauagcauguguacuggcaaauucaaaguggugaaagaaauagccgaaacacaacauggaacaauagugauacgaguacaauaugaaggcgacggcagcccuugcaaaauaccuuuugagauuauggaccuugaaaagagauacguacuaggucgguuaauaacagucaacccuauuguaacugagaaagacucuccaguaaacauagaggcagaaccgccguuuggugacucauauauaauaauagggguagaaccaggucaguugaaauugaauugguuuaagaaagguucaagcauaggccagauguucgaaacaacaaugcgaggagcaaagagaauggcaaucuuaggagacacugcgugggauuuugguucuuugggagggguuuucacaagcaucgguaaagcgcugcaccaagucuuuggagcaauuuauggagcagcauuuaguggaguuagcuggacaaugaaaaucuugauaggcguaauaauaacauggauaggaaugaacucaagaucaaccagccuuucgguuagucuaguauuaguuggcauaguaacuuuauaucucggagugaugguacaagcagauucugguuguguaguaaguuggaaaaauaaagaacuaaaauguggcagcggaauauuuauaacagauaacgugcauaccuggacugaacaauauaaguuucagccagaauccccuucuaaacuugcgucggcaauccaaaaagcacaagaggaaggcaucuguggaauccggucaguuacgcgacuugagaaucuaauguggaaacaaaucaccccagagcuuaaccauauacuagcugagaacgaggucaaacuuacaauuaugaccggcgacauaaagggcauaaugcaggcggguaaacggucacuaagaccacagccgaccgagcuuaaguacucguggaaaacguggggaaaagcgaagaugcucucuacggaaucucauaaccagaccuuucucauagacgguccugaaaccgccgaauguccuaauacaaaucgugcauggaacagcuuagaagucgaagauuacgguuuuggcguuuucacaacaaacauuugguuaagguuaaaggaaaaacaggaugcguuuugugauucgaaauuaaugucggcggcuauaaaagacaauagggccguucaugcagacaugggcuauuggauagaaagcgcauuaaaugacacauggaaaauagaaaaagccagcuucaucgaagugaaaaacugucacuggccuaaaucacacacgcuauggucaaauggggugcuagaaucugagaugauaauucccaagaauuuagcgggacccguuucucaacacaauuaucgaccaggauaccacacccaaauugcgggacccuggcaccuagguaagcuagaaauggacuuugauuuuugugauggcacaacuguuauaguaacugaagacugugguaaucgaggcccaucgcuccguacgacgacugcgucugggaaauugauaaccgagugguguugucgaaguugcacacuaccaccccuaagauaucgaggggaagaugguugcugguacggaauggaaauaaggccccugaaagaaaaagaagaaaacuuaguaaauucgcucgucaccgcaggucacggccaaguugacaauuuuucauuaggcauuuugggaauggccuuauuucuggaggaaaugcuacgcaccagaguagguacaaagcaugcgauccuauuagcagcuguuucauucguuacacuaauuacagggaauaugucuuuuaaagauuuaggccgaguaaugguaauggucggagcuacuauggcagaugacauagguaugggagucacuuauuuagcuuuacuugcggcguuuaagguaagaccgacuuuugcugccggguuauuacugaggagacuaacaucaaaagaacucaugaugacaacuauaggcaucgucuuauuaagccagaguacaaucccagaaaccguacuagaauugacugaugcacucgcuuugggaaugauggucuuaaaaauaguacgaaaaauggaaaaauaccaauuagccgugaccauaauggcgauccuauguguaccaaacgcuguaauacuucaaaaugcauggaaaguaaguuguaccauccuggcuguuguaaguguaucgccccuauuacuaacaagcucgcaacagaaaacagauuggauuccucuagcacuaaccaucaaagguuuaaauccaacugcaaucuucuuaacuacacuaucccguaccaauaagaaacgauccuggccacuuaacgaggcuauuauggcaguaggcaugguuucaauuuuggcgucaucacuuuugaaaaaugauauuccuaugacggggccucuaguugccggaggauuauuaacaguuugcuaugucuugacaggaagaucagcagaccuugaacuagaaagagcuacggaugugaaaugggaagaucaagcggaaauaucaggcaguuccccaauccuuaguaucacaauauccgaagaugggaguaugucuaucaaaaaugaggaagaggagcaaacguugacuauuuuaaucagaacagguuuacugguaauaaguggucuauuccccaucucuauaccgaucacagcugcugcuugguaccugugggaaguuaaaaagcaaagagcgggaguacuuugggacgugccguccccaccaccuguagguaaagcagaacuggaggacggagccuaccguauaaaacagaaaggaauuuuaggauauucccaaaucggugcagggguauauaaggaaggaacauuccauacuauguggcacgucacaagaggugcgguauuaaugcauaaagggaaacguauugaacccuccugggcagaugucaagaaagaucuaauaucauauggcggaggcuggaaacuagaaggagaauggaaagaaggagaagaaguccagguacuagcauuggaacccgggaaaaauccaagggcgguucagaccaaaccagguuuauucaaaacaaauacuggcacgaucggagcugugucccuggacuuuucgccaggaacgucagguuccccgauaauagauaagaaaggaaaaguuguugguuuauacgggaaugguguugugacuagaaguggugccuauguaagcgccauugcccaaacagaaaaaucaauagaagacaauccugagauugaagaugacauauuuaggaaaagacgauuaacaauuauggauuuacacccgggggcuggaaaaacuaaaagauauuugccggcaaucguacgugaagcaauaaaaagaggacuaagaacuuuaauuuuagccccaacaagaguaguugcugcugaaauggaggaggcacuuaggggucuacccauccgcuaucaaacgccagcaauacgagcagaacacacgggacgugagauaguugacuuaaugugucaugcuaccuuuaccaugagacuucuuucuccgguucgagugccaaauuacaaucuaauaaucauggaugaagcacauuuuacggaccccgccucuauugcggcuagaggauauauauccacucgaguugaaaugggcgaagcggcuggaauauuuaugacugcgacuccuccaggauccagagauccauuuccgcagaguaacgcuccaauaauagacgaagaacgagagaucccagagcgaagcuggaacucaggccaugaauggguuacagauuucaaaggaaaaacagugugguucguacccaguaucaaagcaggcaaugauauagccgcauguuuaagaaagaacggaaagaaggucauacaguuaaguaggaaaaccuucgacucggaauauguuaagaccaggacaaacgauugggacuuuguugugacgacggauauaagugaaaugggcgcaaauuuuaaagcggagagagugauagacccacgaagguguaugaagcccgucauacuaaccgauggagaagaaagagucauuuuagcagguccaaugcccgucacgcauucaucagcugcccagagaagagggcgaauugguagaaaucccaaaaacgaaaaugaucaguauauuuacaugggugaaccgcuugagaaugaugaagauugcgcucacuggaaagaagcgaaaauguuauuggacaauaucaauacaccagagggaauaauaccaucaauguuugaaccggaaagagaaaaagucgacgcgauugauggcgaauaccggcuuaggggagaagcuagaaaaaccuucguugaucuuaugcgacgcggugauuuaccaguuuggcuggcuuauaaaguugcugcagaaggaauuaacuacgcagaucgaaggugguguuuugacgguauuaaaaauaaucaaauauuagaagaaaacgucgaagucgaaauauggacgaaaggaggagagaagaagaaacugaaaccucguuggcuagaugcuagaauuuauucagacccccuggcauugaaagaauuuaaagaauuugcugcuggacguaaaaguuuaacccugaauuuaauuacggagauggggcgucuaccgacuuucaugacacagaaaacccgcgaugcauuggauaacuuagcuguauuacacacggccgaagcugguggcagagcuuacaaucaugcccuaucugaacuacccgagacuuuagaaacauuacuacuccuaacguuacuagcaacaguaacagggggaauauuccuuuuucugaugaguggccggggcaucggaaaaaugacgcucgggauguguuguauaauuacugcuagcauuuuauugugguaugcacaaauacaaccucauuggauugcagccucuauaauauuagaguuuuuccugauagucuuacucauaccggaaccagaaaagcaaagaacuccacaagauaaucaauuaacauauguaguuauagcaauucuaacuguuguggcagcuacaauggcuaacgaaaugggguuuuuagagaaaacgaagaaagaucuagguuuagguuccauagcaacacaacagccugaaucaaacauucuugauauagaucuaagaccggcaucugccuggacguuauaugcaguugcaacgacguuuguuacuccgaugcuacgucacagcauagaaaacuccagugugaaugucagcuugacugcuauugccaaucaagcaacaguuuuaauggguuuaggaaaaggcuggccccugagcaaaauggacauaggcguaccguuacucgcaauaggauguuacagucagguaaaucccauuacacuaaccgccgcuuuauuacuacuugucgcacauuacgcuauaauaggcccuggccugcaggcuaaagcaacccgugaagcgcagaaacgggccgccgcagguaucaugaaaaauccuacaguugacggaauaacaguaauugacuuagaccccauacccuacgacccuaaauucgaaaaacaauuagggcaaguaaugcuacuaaucuugugugucacgcaaguucugaugaugagaacuacuugggcgcucugugaggcccucacucucgcaacggguccaauaucaacacucugggaagggaauccggguagauuuuggaacaccacaauugcuguaagcauggcaaauauauuuagagguaguuaucuggcaggggcaggacucuuguuuaguauaaugaaaaauaccacaaacacacggagagguacggguaacaugggcgaaacauuaggagaaaaauggaaaagccgauuaaacgcacuaggaaaaucagaauuucaaaucuacaagaaaucugguauucaggaaguagaucgcacguuggcgaaagaagggauuaagaggggcgaaaccgaccaucaugcuguaucucgagguucagcaaagcuaagaugguuugucgaacggaacaugguaacucccgaaggaaaagugguagauuuaggguguggucgagguggauggagcuauuacugcggaggguugaaaaauguuagagaagucaaggggcuaacaaaggguggaccagggcacgaagaaccaauuccuaugagcacauacggauggaauuugguucgacuacaaucaggcguugacguauucuuuaucccgccagagaaaugugacacccuauuaugugauauaggugaaaguucaccgaauccuacuguugaagcaggcaggacacugcggguuuuaaauuuaguagaaaauugguuaaauaauaauacacaauucugcauaaaaguauuaaacccauauaugccuucuguuaucgaaaagauggaagcguugcaacgcaaauacggaggagcgcuaguacguaauccacuaaguagaaauucuacccaugaaauguacugggugucaaaugcauccggaaacauugugaguucuguaaacaugaucucuagaauguuaauaaaucgcuucacgaugcgccacaaaaaggcuacauacgaacccgacguggaucuuggcucuggcacaagaaacauagggauugaaucagagaucccaaacuuagauauaauaggaaagagaaucgagaagaucaaacaggaacacgaaacaagcuggcauuaugaucaagaucauccguauaagacaugggcuuaucacggcucguaugaaacuaagcagacaggcucagcaagcaguauggugaaugguguaguaagacuauuaacaaaaccaugggauguuuugcccacaguuacgcaaauggcgaugacagauacuacaccauuuggucaacagagaguuuucaaggaaaaaguggauacuagaacgcaagagccuaaagaggggacaaagaaacugaugaaaauuacggcagaguggcuauggaaagaauuggggaaaaagaaaacuccacggauguguacaagagaagaguuuacacgaaaaguuaggaguaaugcagcccuaggagccauuuuuacugaugagaauaaauggaaaagcgcuagggaagccgucgaagauaguagauuuugggaauuaguggacaaagagcgcaacuuacauuuggaaggaaaaugugagacauguguuuauaacaugaugggaaaacgcgagaagaaauuaggugaauuuggaaaagcaaaagguagccgugccauuugguauauguggcuuggggcacgguuucuagaguucgaggcucuaggauuccuuaacgaagaucauugguucucaagagagaacagcuuaucaggcguagaaggcgagggucuacauaaacuagguuauauacugagagauguuucgaagaaagaaggaggggcuauguacgcugaugauaccgcagguugggauaccagaauaacucuagaagaucucaaaaaugaagagaugguaacuaaucacauggaaggagaacacaagaaacuagcagaggccaucuuuaaacugacauaccaaaacaaaguaguacgcguacaacgacccacuccucgugguacaguuauggacauaauuagccgucgcgaucaacgcgggaguggucaaguagggacuuaugguuuaaauacuuuuaccaauauggaagcccaguuaauacggcagauggaaggugagggcguauuuaaaaacauacagcaucuaacagucacugaagagguagcaguccaaaacuggcuagcaagagucggaagagaaagacuauccagaauggccauaagcggggacgauuguguugucaagccacuagacgacagauuugcgaacgcccugacugccuuaaacgacaugggaaaaauacguaaagacauucaacaaugggaaccaaguaaagguuggaacgauuggacacagguucccuucuguagucaucauuuccaugaacuaauuaugaaggauggacgugucuuaguagugcccugccgcaaucaagaugaguugauaggucgagcccgaauaucacaaggugccggguggagucuacgagaaacggcguguuuaggaaaaucuuaugcacagauguggucucuaauguauuuucaucgccgcgaucuccgguuggccgcaaaugcaauaugcucggccguuccgucccacuggguaccaacaagcagaaccacaugguccauccaugcaaaacaugaauggaugacaacagaagacaugcuaacuguuuggaauaggguauggauaagagaaaacccuuggauggaagauaaaaccccaguagaaaguugggaggaaauaccuuaucuaggaaagagagaagaccaauggugcggaucacuuauaggacucaccuccagagcaaccugggcuaagaauauccaggcugcaauuaaucaaguccguucacuuauaggaaacgaagaguauacggacuacaugccaucuaugaaaagauucagacgugaggaggaagaggccgguguucuaugguaa

SEQ ID NO: 22775 - RNA, 9876 nt, Artificial Sequence
  derived and/or modified CDS sequence (opt6) from DENV-2__EU482701__SS-prME
agugcaggaaugauuaucauguuaaucccaacuguuauggcauuucaccuaacaacaagaaacggagagccccauaugaucgucggcauacaggaaaaggguaaaagucuacucuuuaaaacggaggacggaguaaacaugugcacacuaauggcuauggauuugggggagcucugcgaggacacuauaacguauaagugcccacuucuuaaacaaaacgaaccggaagauauagauuguugguguaacaguacuucgacaugggucaccuacggcacaugcacaacuaccggggaacaucgacgagaaaaaaggucagucgcuuuagucccgcacguaggaaugggguuagaaacccguacugaaacauggaugucaucagagggagccuggaaacacgcucagaggauagagaccuggauucuuagacaccccgguuucacuauaauggccgcaauacuagcuuauacaaucggcacaacccauuuucagcgaguccuaauuuuuauuuuacugacagccgucgcaccaucuaugacgaugcggugcauaggaaucucaaauagagacuuuguggagggcguaucuggugguaguugggucgacauaguucuagaacauggcucaugugucacaacaauggcgaagaauaaacccacucuugacuuugaacucauaaaaacugaagcgaaacaacccgcuaccuuaagaaaguacuguauugaagcaaaacuaacgaacacgacuacggagucccguuguccaacacaaggugagccaucacuuaaagaggaacaagacaaacgcuuuguuuguaagcacucaauggucgaucgaggauggggaaauggcuguggcuuauucggaaaaggcggaauuguaacuugcgcgauguucacuugcaaaaaaaacauggaggggaaaauugugcaaccagagaauuuggaauacacaaucguagugacaccacauucgggagaagaacaugcuguaggcaaugauacaggaaagcauggaaaggaaauaaaagugacuccccaaucgagcaucacagaagcugaauuaacagguuauggaacgguuacaauggaaugcucacccaggacagggcuggauuucaaugaaaugguucuucugcaaauggagaacaaagcaugguuaguacauagacagugguuucuagaucuaccgcuacccuggcucccaggcgcugauaagcaagaaucaaacuggauccaaaaagagacuuuaguuacuuucaaaaauccacaugcaaagaaacaagaugucguugugcuaggcagccaggaaggugcgaugcaugcugccuuaacaggggcgacagaaauacaaaugucaagcgguaaccuacucuucacaggacaucuaaaaugucgauugcggauggauaaacuucaacuuaagggaauguccuacagcauguguacuggaaaauucaaaguuguaaaggagauugccgaaacacaacauggaaccauagucauucgaguucaauaugaaggcgauggcaguccaugcaaaauacccuuugaaauaauggaucuugagaaacgauacguguuagggagacucauaaccgugaauccuauugucacggaaaaagauucuccagugaauauagaagcugaaccaccguuuggugauucuuauaucauaauagggguagaaccgggacaauuaaaauugaacugguuuaaaaaaggaucaaguaucggccaaauguuugaaacaacaaugcgaggugcaaaaagaauggcaauacuaggugauacugccugggauuucggaagucucggcgggguauuuacaaguauuggaaaggcacuccaucagguauucggagcgauuuacggugcugcuuucucaggagugagcuggacaaugaaaauucuuauuggaguaauuaucacauggauaggaaugaauucuagaagcacaucacucucgguuaguuuaguucuaguugguauaguaacauuauacuuaggcguuaugguucaagccgauaguggaugcgugguuucauggaagaauaaagaguuaaaaugcggaagcggaauuuuuauuaccgacaauguacacacauggacugaacaauauaaguuucaacccgaaucuccaucaaaauuagcaagugcaauacaaaaagcacaagaagaagguauaugcgguauuagaagugucacuaggcucgagaacuuaauguggaaacaaauaacgccugaauuaaaccauauccuugcugaaaaugagguaaagcuaacgauaaugacgggggacauaaaagguauaaugcaagcagguaaacguuccuuacgaccacaaccgaccgaacuuaaauauucauggaaaacuugggguaaagcuaaaauguugaguacagaaagucauaaucaaacguuuuuaaucgacggcccagaaacagccgaaugucccaacacaaaccgagcauggaauuccuuagaaguagaagauuauggguuuggaguguucacaaccaacaucuggcuuagguuaaaggagaaacaagaugcauuuugugauagcaagcuaaugagcgcugcgguuaaagauaaucgugccguacacgcagauaugggauauuggauagagucagcacuaaaugauacauggaagauugaaaaagcaagcuucauagaaguaaaaaacugucauuggccgaagagccacacacucuggucaaauggaguacuugaaagcgaaauggucauuccuaaaaaccuugcgggaccuguuagucaacauaauuauagaccaggauaccacacacaaaucgcgggaccauggcacuuaggaaaacuugagauggacuucgauuuuugugacggaacgacugugauuguuaccgaagauugcggcaaccgaggacccucacuacgaacaacuacagcaucgggaaaauuaauaacagaauggugcugcaggucuugcacgcuucccccucucagguauaggggugaagaugguuguugguauggcauggaaauaaggccauuaaaagaaaaagaggagaaucuuguaaauucacuugucacagccggucaugggcaaguugauaauuucucacuuggaaucuuggguauggccuuauuucuggaagaaaugcuucgaacaagagugggaacaaaacaugcaauacuauugguagcuguaagcuucguaaccuuaauaacagggaacaugucauuuaaggacuuaggaaggguaguuguuaugguuggugcuacaauggcggacgauauugguaugggaguaacauaucuugcacuauuggcagcguucaaaguuagaccgacguucgcagccgguuugcuucugcgaaagcuaacgucaaaagagcugaugaugaccacaauuggugugguauuauuaucccaaaguacuauuccagauacggucuuggaauuaacggacgcccuagcauuagggaugauggugcugaaaauaguccguaacauggaaaaauaucaacuagcgguaacaauaauggcaauacuaugcgugcccaaugcugugauauugcagaacgcuuggaaaguaucaugcacaauuuuggcuguggucucggucucaccgcuucuauuaacaagcagucaacagaagacagauuggauaccuuuagcauuaacaauuaaaggacugaacccaacagcaauauucuugacuacacuaagucgaacaaauaaaaagaggucauggccucuuaacgaggcaaucauggcgguggguauggucucgauacuagcuagcucauuacuaaaaaacgacauccccaugacaggacccuuagucgcgggaggauuacuaacagugugcuauguccuuacgggucgcucagccgacuuagaacuagaaagggcaacggacguaaaaugggaagaucaagcugagaucucugguucgucuccgauacuaucaaucaccauuucugaagauggcaguaugaguauaaaaaaugaagaggaagagcagacauugacaauucuuauuagaacuggacugcuggucauaucaggccucuuucccauaagcauaccaauuacagccgcagcuugguacuugugggaaguaaagaagcaaagagcaggaguacugugggauguaccaaguccaccaccaauggggaaagcagaacucgaagacggagcuuaucgaauaaagcaaaagggaauucuagguuauagucaaauuggcgcagggguauauaaagaagguacauuucauacaauguggcauguaacacgaggggcaguacuaaugcacaaagguaaacgaauugaaccaaguugggcagauguaaaaaaagaucuaauaucauacggaggggguuggaaacuagaaggcgaauggaaagaaggggaagaaguccaggucuuggccuuagaacccgguaaaaauccuagggcaguccaaacaaagccuggcuuguuuaaaacgaacaccgguacaaucggcgcugucagccuagauuuuagcccaggaacuucaggaucuccaaucauagacaaaaaagguaaagugguaggacucuacggaaauggaguggucacaagaaguggggcguaugucucagccaucgcucaaacagagaaaaguauagaggauaauccggaaaucgaagaugacauauuuagaaaacgaagacuaacgauuauggaccugcauccuggggcaggaaagacgaaaagguaucuuccugcaauaguuagagaggcaauaaaacgcggacugcgcaccuuaaucuuagccccgacuaggguagucgcagcagaaauggaggaagcgcuacggggcuuaccuaucagguaucaaacuccugcgaucagagcagaacauacaggacgagagauuguagauuuaaugugucaugcaaccuucacaaugcgacuauuaucucccguaagaguaccuaacuacaaucucauaauaauggaugaggcacauuucacagacccagcaucaauagcagcucguggauacaucucuacgcgaguugaaaugggcgaagcugcuggaauauucaugacggcgacgccuccaggauccagagauccuuucccccaaucuaacgcuccuauuauugaugaggaaagagaaauaccagagcgaaguuggaacucuggccaugaauggguaacugacuucaaaggaaaaacuguaugguucgucccuaguauaaaggcggguaacgacauagcagcuuguuuacgaaaaaacgguaaaaaaguuauacagcuaucccgaaaaacauucgauucugaauacguaaagacccgaacaaaugacugggauuuuguaguaacuacugauauaucagaaaugggagcaaauuucaaggcggaaaggguuauugauccccggagauguaugaagcccguuauauuaacagauggugaggaacgaguaauacuagcugguccaaugccagucacgcauucaagugcagcacagcguagagggagaauugggagaaacccuaagaaugaaaaugaccaauauauauauaugggagaaccuuuggaaaacgacgaggauugugcacacuggaaagaagcgaaaauguuauuagauaacauaaauacaccugaaggaaucauuccaucgauguuugagccagagcgcgaaaaaguagacgcuauagauggagaguauagguuacggggggaagcacgaaagacuuucguggauuuaaugagaagaggagaccugccaguauggcuggcuuacaaaguagcagcagaagguauaaauuaugccgaccgacgauggugcuuugaugguauaaagaacaaucaaauacuugaggaaaacguugagguugaaaucuggaccaaggaaggagagcggaaaaaacuuaaaccaagaugguuggacgcucgaauauauuccgauccacuagcauuaaaagaauucaaagaauucgcggcuggucgaaaaucuuugacacuaaaucuuauaacugaaaugggacgguuaccaaccuuuaugacucaaaaaacacgagacgcauuggauaacuuagccguccuucacacggcagaagcaggcggucgugccuacaaccaugcauugagugaauugccagaaacacuugaaacuuugcucuugcucacuuuauuagccacggugacaggagguauuuuucuguuucucaugagugguagagguauagguaaaaugacguuaggaaugugcugcauaauuacugccucaauacuauugugguaugcccaaauacaaccacauuggaucgcagcaucaauuauauuggaguuuuuucugauaguucucuugauuccagagcccgaaaaacaacggacgccacaggauaaucaacucacauauguaguuauugcaauccuaacagucguagccgcuacaauggcaaaugaaaugggcuuucuugaaaaaacaaaaaaggauuugggcuuaggcucaauagcgacacaacaaccagagagcaacauauuagacauagaccuacggccggcuagugcauggacauuauacgcagucgcgacaacguuugugacgccuaugcuaagacauaguauagaaaauucauccguaaacguuucauugaccgcuauugcaaaucaagcaacaguucucaugggacuaggaaaaggcuggccgcuaaguaagauggauauaggaguuccauugcuagcgauuggauguuauucacagguaaauccuauuacccuaacggcagcauuauuguuacugguagcacacuacgcuauaauagguccuggguuacaagcgaaagcuacccgagaagcgcagaaacgagcagcagcaggaauaaugaaaaacccaacgguugacgguauaaccgugauagauuuggaucccauuccauaugauccaaaauuugaaaaacaacucggucagguaaugcuauuaaucuuauguguuacacaaguuuugaugaugagaacuacgugggcucuaugcgaagcucuaacucuugcaacaggacccauuucuacguugugggagggaaauccuggucgcuuuuggaauacuacaauugccguaucuauggcaaacauauuccggggaagcuaucuugcuggcgcgggacuauuauuuucuauaaugaaaaacacaacaaauacacgaagaggcacgggcaacaugggcgaaacccuaggagaaaaauggaaauccagacuaaacgcucuaggaaaaagugaauuucaaauuuacaaaaagaguggcauccaagagguagacaggacauuagcuaaagaggguauaaagcguggagagacggaccaccaugcagucucacgcggcagugccaagcuacggugguucguggagaggaauaugguaaccccugaagguaaggugguagacuuaggauguggucgugguggauggucuuauuauugcggaggauugaaaaacgucagagaaguaaagggauugacgaaagguggcccuggucacgaagaaccaauaccaaugagcacguacggauggaauuuagugcguuuacaaaguggugucgauguguucuucaucccuccagaaaaaugugacacucuauugugugauauuggcgaaucauccccuaaucccacuguagaagcagggaggacguugaggguauuaaacuuaguugaaaauugguugaacaauaacacucaauuuugcauuaaaguccuaaacccauacaugccgucagucaucgaaaaaauggaggcucugcaacgcaaguacgguggcgcacuaguacgcaacccguuaucuagaaacaguacucacgaaauguauugggucucaaacgcuagcgggaauauaguaucgucaguaaacaugauaucuagaauguuaauaaaucguuuuacaaugcgacacaagaaagcuaccuaugagccagacgucgaccuggguucuggaaccagaaauauugguauagaaucagaaauccccaaucuggauauaauaggcaaacgcauagaaaaaauaaaacaagaacacgaaacgaguuggcauuaugaucaagaccaucccuacaaaacuugggccuaccacgggucauaugagacaaagcaaacaggaucagcaucuucgaugguuaaugguguaguaagguuacuaacgaaaccaugggacguguugcccacagucacccaaauggcuaugaccgauacuacuccauucgggcaacaaagaguguuuaaggagaaagucgauacaagaacacaagaaccgaaggagggaacuaaaaaauugaugaaaauuaccgccgaauggcuauggaaggaauugggcaaaaagaaaacgccgagaauguguacaagagaagaguuuacgagaaagguaagaaguaaugcagcgcuaggcgccauauuuacagacgaaaauaaauggaaaucagcaagggaagcaguagaagacaguagguucugggaguuaguagauaaggaacggaauuuacacuuagaagguaagugcgaaaccuguguguacaauaugauggguaagagagaaaaaaaauuaggggaauuuggaaaagcgaaaggaucucgggcaauaugguacauguggcuaggggcuagguuuuuagaauuugaagcgcuaggauuccugaaugaagaucacugguucucgcgggaaaacagccucucaggaguagaaggggaaggguuacacaagcugggguauauauuacgugauguaucaaaaaaagaggguggggccauguaugcugacgacacugcuggaugggacacaagaauaacacuggaagaccuaaaaaaugaggaaaugguaacaaaucauauggaaggggagcauaaaaaguuagcagaagccauauuuaaauugaccuaucagaauaaaguaguccgaguucagaggccuacaccaaggggaacagugauggacauaauaagcagacgagaucagcgggggaguggacaaguaggaacguacggucugaacacauucacuaauauggaagcacaacuaauaagacagauggaaggagaaggaguguuuaaaaauauucaacauuuaacgguaacugaagaagucgcaguacaaaacugguuggcgcguguggggcgugaacgucugucacggauggccauuuccggggaugacugcgucgugaagccccuagacgauagauuugcaaacgcguugacagcacuuaaugauaugggaaagaucagaaaagacauacaacaaugggaaccaagcaaaggauggaaugauuggacgcaagugcccuucuguucucaucacuuucaugaacuuauaaugaaagacggccguguuuuaguggugcccugucggaaucaggaugaacuaaucgguagggcgcggaucucacaaggugcaggcugguccuugcgggaaacagcaugccuaggcaaaaguuaugcacagauguggagucuuauguacuuucauagacgagaccuucguuuagcagcuaacgcuauuuguucagcuguaccaucacacuggguaccaacaagccguacuacauggucgauacacgcuaaacaugaguggaugacuaccgaggauauguuaacaguauggaaucguguauggauacgugaaaauccauggauggaggacaagacaccuguagaaaguugggaagaaauccccuauuuagguaaacgagaagaucaauggugcgguucauuaaucggucuuacaagucgagcuacuugggcgaagaauauucaggccgcaauaaaccagguacguucuuuaauaggcaacgaagaauauacugauuacaugccaaguaugaaaagauuucgaagagaagaagaagaggcuggcguacucugguaa

SEQ ID NO: 22776 - RNA, 9876 nt, Artificial Sequence
  derived and/or modified CDS sequence (opt6) from DENV-2__EU482703__SS-prME
ucggcgggaaugauaauuaugcuaauaccaaccguaauggcguuucauuugacuacgcggaacggagaaccacacaugauaguagguauccaagaaaaagggaaaagucuauuauuuaaaacagaagacggcguuaauauguguacacuuauggcaauggacuuaggagaacuuugugaggacacgauaacuuauaaauguccguuauuaagacaaaaugaaccagaagacaucgauuguugguguaacucuacuucaaccuggguaacauauggaacaugcacaacgacuggugaacacaggcgagaaaaacgcucugucgcacuuguaccacauguaggaauggguuuagaaacgagaacggaaacauggaugucaagugagggugcuuggaaacaugcgcaacgcauugaaacauggauucugagacacccaggcuuuaccauaauggcagcuauucucgcauauacuauagggacaacacauuuucaaagaguauugaucuucauuuuauuaacggcaguugcucccagcaugacaaugcguugcauagguaucucaaacagggauuucguugaggguguguccggaggcucuuggguagauauaguacuagaacaugguaguuguguaaccacuauggccaaaaauaaaccgacacuggauuuugaacuaauuaaaaccgaggcaaaacaaccagcaacuuuacgaaaauauugcauagaggcaaaacuaacgaauacaacuacagaaagccgcugcccgacacaaggagaaccuucacuaaaagaagaacaggacaaaagguuugugugcaaacacaguaugguagacagagguuggggcaacggcuguggucuguuuggaaaaggcgguaucguuacuugugcaauguuuaccuguaaaaagaacauggaaggaaagauuguacaaccagaaaacuuagaguacacuauagucguaacgccacauucaggagaagaacaugcaguuggaaacgauacagguaaacaugggaaagaaauuaaaguuaccccacaaaguaguauaaccgaagcugaguugacuggcuauggaacgguuacaauggaaugcagcccacggacuggacucgauuuuaaugagauggugcucuuacagauggaaaacaaagcguggcuuguacacagacaaugguuuuuggauuugccauuaccgugguuaccgggggcagauaagcaggaaaguaacuggauucaaaaagaaacguuaguaacauuuaaaaacccucacgcgaagaaacaagauguuguaguauuggggagucaagaaggggcgaugcacacagcacucacaggcgcaaccgagauucaaaugagcucggguaaccuucuuuuuacgggucaucugaaauguagauuacgaauggauaaauugcagcuuaagggaaugucauacaguauguguacagguaaguuuaaaguaguuaaagaaauagcugaaacccaacacgguacaauuguaauaagggugcaauaugaaggugauggguccccuuguaaaauaccuuucgaaauaauggauuuagaaaaacgcuaugucuuaggucgauuaauaacaguuaacccaauaguaacugaaaaagacagcccuguaaacaucgaggcugaaccucccuucggagacucuuacauuauaauaggcguagaaccuggacaacuuaaacuaaauugguuuaaaaagggcaguucuauaggacaaauguucgaaacuacuaugagaggggcuaagcggauggcuauacucggugacacagcaugggacuucgggagucuagggggcguauuuacaaguauagguaaagcucugcaccaaguauuuggcgcaauuuacggagcagccuuuucuggcguaaguuggacaaugaaaauauuaauuggcguuaucauaaccuggauaggcaugaauagcagaaguacaucgcuaaguguaagccuaguguugguuggcauaguuacccuuuacuugggaguaaugguacaggccgacuccggcugugucgucucuuggaaaaauaaagaguuaaaguguggcucuggaauauuuauuacagauaacguucauacuuggacggaacaauacaaauuucaaccagagucuccgucuaaacuggcuagugccauucaaaaggcccaagaggagggaauaugugggauaagaagugugacaagauuagaaaaucuaauguggaagcaaauuacaccugaguuaaaucacauacuagcugaaaaugaagugaaguuaaccauaaugacuggagauauaaaggguauaaugcaagcagguaagagaagccuuagaccacaaccuacagaacuuaaauauucauggaaaacaugggguaaagccaaaauguugagcaccgaaucauauaaucaaacuuucuuaauagacggucccgaaaccgcagaaugucccaauacaaaucgcgccuggaacagucuagaaguagaggacuaugguuuuggcguauucacuacgaacauuuggcuaaaauugaaagaaaagcaagaugcuuuuugugacaguaaauuaaugagugcagccauaaaagauaacagagccguacaugccgauaugggcuauuggauagaaucagcauuaaaugacacuuggaagauagaaaaggcgagcuuuaucgaaguuaaaaacugccauuggccaaaaucucacacacuauggaguaaugguguccuagaaagcgaaaugauuauucccaaaaaucuagcugguccaguaucacaacacaauuacagacccggauaucacacucaaauugcgggaccauggcaccuuggcaaauuagaaauggacuuugacuucugugacgguacgacaguaauaguaacggaggauugugggaacagaggcccuagucuaagaacaacuaccgcaagcgggaaauuaauaacagaaugguguugucgaagcugcacuuuacccccucuacgauaucguggagaagacgguuguugguacgggauggagauaagaccacuaaaagaaaaagaagagaaucuaguuaacucccuagucacugccggucacggucaaguagacaauuuuagucuuggggugcugggcauggcuuuauuccuggaagagaugcuacgaacgagaguuggaacaaagcacgcuauuuuacuugucgcagucagcuucgucacucuaauuaccgguaauaugagcuucaaggaucucgguagaguaguaguuauggugggggcgacaauggcugacgauauuggcaugggugugacuuaccuagcacuuuuagcggcauuuaagguaaggccaaccuuugcugccggacuuuuauuaaggaaacuaacaagcaaagagcucaugaugacuacaaucgguauuguucuauuaucucagucaacgauaccagaaacgguguuagaauuaacagacgcgcuggcgcuggguaugauggugcuuaaaauugucagaaauauggaaaaguaccagcucgccgucacuaucauggcuauucuuugcgucccaaacgcagucauauuacagaacgcuuggaaaguggggugcacuauccuagcaguaguaucuguuuccccuuuacuacuaacaucuucucagcagaaaaccgacuggaucccguuggcauuaacgauaaaagguuuaaacccuacugccauauucuuaacaaccuuaagucgaacaaauaagaaaaggucuuggccauuaaacgaggcaauaauggcaguuggaauggucucaauucuagcaagcagucuacuuaaaaaugauauaccuaugacagggccgcuaguugcuggagguuuacuuacuguauguuacguuuuaacuggaagaucugcugaucuagaacuggagagagcgacagacgucaaaugggaagaucaagcagaaauaucaggauccucuccgauccuaagcauaacaauuucggaagauggaagcaugucaauuaagaacgaggaagaggaacaaacucugacaauacuaauaaggacaggucuauuaguuauuuccggacucuuuccgauuagcauuccgauuaccgcggcugcuugguaucuuugggaagucaagaaacagcgagcgggcguacuaugggaugucccaaguccgccaccuauggguaaagcagaauuggaagauggugcauauagaauuaaacagaaagguauucugggauauagucagauaggagcgggcguauauaaagaagguacauuucauacuauguggcaugugaccagaggugcaguucuaaugcacaaaggcaaacgaaucgaaccuuccugggcagaugucaagaaagaucuaauuagcuauggaggaggguggaagcuagaaggagaauggaaggagggagaagaaguacagguuuuggcucuugaaccugguaaaaauccaagagcugugcagacaaaaccuggacuauucaaaacaaauacgggaaccaucggagcaguuucuuuagacuuuucgccgggaacaaguggaucaccaauuauugauaagaaagggaagguaguaggccuguaugguaauggcguuguaacaagaucaggugcguaugugucagcgauagcacaaacagaaaaaucaauagaagacaauccugaaauagaagaugauauauucagaaaaagacgccuuacuauaauggaucuacauccaggugcuggcaaaacgaagcgcuaccuuccugcaaucgugcgugaggcaauuaaacgaggguuacgaacccuaauacuugcaccuacacggguuguagcugcggaaauggaagaggcccuuagaggauugcccauccguuaucagacaccagcaaucagagcugaacacacgggccgagagauaguggaccuaaugugucacgcaacuuuuacaaugagauuacuaucacccguaaggguuccaaacuacaaccugauuauaauggacgaagcacauuuuacugauccugcaaguaucgcugcacgugguuacaucucaacgagaguagaaaugggggaagccgcaggaaucuuuaugacggcaacaccacccggcagucgagauccuuucccacaauccaaugcaccaaucauugaugaagaacgagagauccccgagagaucauggaacaguggucacgaauggguaaccgauuuuaaaggaaaaaccguaugguucgucccgaguauaaaggcagguaaugacauugcugccugccuaaggaaaaacgggaaaaaggugauucagcuaucuagaaaaacguucgacucugaguacguuaagacaagaacuaacgauugggauuucguggugacuaccgauauuagugagaugggagcgaacuuuaaagcugaacggguaauagauccaagacgcuguaugaaaccaguuauccuaacggacggagaagaaagagucauucuggcagguccuaugccaguaacucauuccucggcagcccaaagacgaggcagaauaggcagaaaccccaaaaaugaaaacgaucaauacauauacaugggagagccucuagaaaacgaugaagauugcgcacacuggaaagaagcuaaaaugcuguuggacaauauuaacacuccugaagguauaauaccuucaauguuugagccagaacgcgaaaaaguagacgcuauugauggugaauaucgcuugcgaggagaagcacguaaaacuuucguagauuuaaugagacggggagauuuaccuguuugguuggcauauaagguagcagccgaaggaaucaacuacgcugacaggagauggugcuucgacggaauuaaaaacaaucagauacuagaagaaaacguggagguagagauauggaccaaggaaggcgagaggaagaaauuaaaaccacguugguuagaugcacgaauauacuccgacccucuagcucuaaaagaauuuaaagaauuugcagccggucgaaaauccuuaacccucaauuuaaucacagagaugggcagauuaccaacuuucaugacucagaaaaccagagaugcgcuggacaauuuggcgguguugcauaccgcugaagcuggagguagagcauacaaucaugcuuuaucggaacucccagaaacacuggagacuuuacuguuacuuacgcuauuagcuaccguaacagguggaauauuuuuauuuuuaauguccggaaggggcauuggaaaaaugacuuuggguauguguugcauaauuacagcaagcauccuacuaugguaugcccaaauacaaccccauuggauugcggcuaguauuauuuuagaauuuuuccuuauaguauuacuuaucccggaaccagaaaaacaaagaacaccccaggauaaucaguugacuuauguugucauagccauacuaacuguuguugcagccacaauggcgaacgaaauggguuuucuggagaaaacuaagaaagaccucggucuugguuccaucgcaacucaacaaccagaaaguaauauauuagauauagaccuaagaccagcaagcgccuggacuuuauacgcaguagcuacuacuuuugugacaccuaugcuuaggcauuccauugaaaauucaagcguaaauguaucauugaccgcuaucgcuaaccaagcaaccguacuaaugggccuaggcaaagguuggccccuguccaaaauggacauaggugugccacuccucgcuaucggauguuauagucaaguaaauccuauuacucuaacagccgccuuacuacuauuaguugcccauuaugcgaucaucggcccgggacuacaagccaaggcaacacgagaagcgcagaagagagcugcggcagguauuaugaaaaauccgacgguagacggaauuaccguaauagacuuagauccaauccccuacgauccgaaauuugaaaaacaauuaggccaaguaaugcuucuaauucugugcgucacacaaguucucaugaugcgcacuacaugggcucuuugugaagcgcuuacacucgcaacgggaccaauaagcaccuuaugggaggguaauccuggacgcuuuuggaauaccaccauagcagucucgauggccaauauauuccguggaaguuacuuagcgggcgcaggcuuacucuuuaguaucaugaagaacacaacaaauacgagacgaggaacuggcaauaugggugaaacacuaggagagaaauggaaaucuagauuaaacgcauuaggcaagagugaauuucaaauauacaagagauccggaauacaggaaguggauagaacuuuagcgaaagaaggaauaaaaagaggagagacggaucaccaugcagucucaaggggaucugcgaaauugagaugguucguugaaagaaacaugguuacaccagaagguaagguagucgacuugggcuguggaagaggcggcuggucauacuauugugguggauugaaaaauguucgggaaguaaagggccuaacuaaaggcggacccggucaugaagaaccuauuccaaugucaaccuauggauggaauuuggugagauuacagaguggaguugauguauucuuuauaccgccggagaaaugcgacacauuacuaugcgauauuggagagucgucuccuaauccaacugucgaagcaggccgaacucuaagagucuuaaaucuggucgaaaauugguuaaauaauaauacacaguuuuguauaaaaguucugaauccguauaugcccaguguaauagaaaagauggaagcacugcagagaaaauaugggggagcuuugguuagaaauccgcuuucaagaaauucuacacaugagauguacuggguaucaaacgcaucagguaacaucguaucgucaguuaacaugauuucgcgcaugcuaauaaaucgguuuacaaugagacacaagaaagccacauaugagcccgauguggacuuggguagcggaacucguaacaucggcauagagagugagauuccgaacuuggacauaauaggaaaaaggauagagaaaauaaaacaagaacacgaaacgaguuggcauuacgaccaagaucaccccuauaagacuugggcuuaucaugggagcuaugagacaaagcaaacagguucagcaucaucaaugguaaacgguguuguccgucuguuaaccaaaccaugggacguauugccaacgguuacucaaauggcuaugaccgauacgacucccuuugggcaacaaagaguauucaaagaaaaaguagacacuagaacacaagaaccuaaagaagguacgaagaaacuaaugaaaauuacagcggaaugguuauggaaagaacuaggaaagaagaaaaccccgagaaugugcacaagagaggaguuuacuaagaaggugagaucgaaugcugcccuaggagcaauuuucacggacgaaaauaaguggaaauccgcuagagaagcaguugaagauucaagauuuugggagcuaguagauaaggagagaaaccuacacuuggagggaaaaugcgagacauguguauauaauaugaugggaaaaagagaaaagaagcuaggugaguuugguaaggccaaagggaguagagcaauaugguacaugugguuaggagcgcgguuuuuagaguucgaagcacugggguuuuugaaugaagaccauugguucucucgcgagaacagccuaagcggaguagaaggagaaggccuucacaaacucggauacauauuacgcgauguaagcaagaaagaaggaggagcgauguacgcagaugacacugccgggugggauacgcguauaaccuuagaagauuugaaaaacgaagaaaugguaacaaaccauaugaaaggagaacauaagaaauuagcagaagcaauauucaaguuaacauaucagaacaaagucguccgaguccaacggccgacaccuagggggacuguaauggauaucauuucuagacgugaccagcgaggaucugggcaagugggaacguauggacuaaauacguuuacuaacauggaagcucagcuuaucaggcagauggaaggagagggcguauuuaaaaacauucaacaccuaaccguuacugaagaagucgcaguucagaauuggcuugccagaguuggcagagagcgguuaaguaggauggcuauaaguggagaugacugugugguaaagccguuagacgacagguucgccaacgcccuuacugcauuaaaugacaugggcaaaauaagaaaagacauccagcaaugggagccuuccaaaggauggaacgauuggacccaaguaccuuucugcagccaucauuuccacgaauuaauuaugaaagauggaagaguucuuguaguuccaugccgaaaccaagacgaauugauuggccgggccagaauaucucaaggagcaggauggucccucagagagacagcaugccuaggaaaaaguuacgcucagauguggucucugauguauuuucaucguagagauuuaagacuugccgcaaacgcuauauguagcgcugugccaagucauugggugccaacaaguagaacuacuuggucaauacacgccaagcacgaauggaugacuacugaagacaugcuuaccguauggaaucgagucuggauacgggaaaauccauggauggaagacaaaacuccuguggaaaguugggaagaaaucccauacuuagguaagcgugaagaucaaugguguggaagccuaauuggacucaccagucgagcgacuugggcuaaaaacauucaagcggccaucaaccaaguacgcucacugauagguaacgaagaauauacagauuauaugccuagcaugaagcgguucaggagagaagaagaagaggccgguguauuaugguaa

SEQ ID NO: 22777 - RNA, 9876 nt, Artificial Sequence
  derived and/or modified CDS sequence (opt6) from DENV-2__EU482705__SS-prME
agcgcagggaugauuauaaugcuaauaccaacaguuauggcguuccaccugacgacgcgaaauggggaaccacauaugauuguaggaauacaagaaaaaggcaaaagccuacuuuuuaaaacagaagauggagucaauaugugcacauuaauggcgauggaccugggagaacugugugaagauacaauaacauacaaaugcccccuccuacgccaaaaugaacccgaggauauagauuguugguguaauucaacgucaacuugggucaccuacggcaccuguacaacgaccggggaacaucgucgugagaaaagaucgguggcguuagugccgcacguagggauggggcuggagacucgcacugaaacguggaugucuucagaaggagcuuggaaacaugcccaacgaaucgaaacauggauauuaagacaucccggauuuacaauaauggccgcaauuuuagccuauacaauaggaacaacucauuuccaacgagucuugaucuuuauacuacuuacagcaguugcuccaucaaugacuaugcgauguauugguaucagcaaucgagacuucguagagggagugucuggugggaguuggguagauauaguacuagaacauggcucuuguguaacaacaauggccaaaaauaaaccaacgcucgacuuugaguugaucaaaacugaagcaaaacaaccagccacauuacgaaaauacugcauagaggcaaaacuuacaaauacaacuacagaaucccguuguccaacacagggcgaacccagccugaaagaagaacaagacaaaagauuugugugcaaacauucgaugguagacagagguugggguaauggcuguggacucuuuggcaaagguggaauuguaacgugugcuauguuuacaugcaaaaagaauauggagggcaaaauaguacagcccgagaaccuugaguacacaauuguagugacaccacacucaggagaggagcaugcaguuggaaacgacacgggcaaacauggcaaagaaauaaaagucacaccacaaucgagcauaacagaagccgaacuaacaggcuaugggacaguaacgauggaaugcagcccccgaacgggcuuagauuucaacgagaugguccuacuacagauggaaaacaaagccuggcuuguccauagacaaugguuucucgaccuucccuuacccuggcuaccaggugcggauaaacaggaauccaauuggauucaaaaagaaacauuaguaacauucaaaaacccacacgcaaagaaacaagauguaguaguacuaggcagucaagaaggagccaugcauacagcacuaacuggugccaccgaaauacaaaugucaucugggaaucugcuguuuacuggacaucuaaaaugccgauuacgaauggauaaacuacaacuaaagggaaugucuuacucuaugugcacaggcaaauuuaaaguaguuaaagaaauugcagagacacagcacgguaccauaguaauuagaguucaauacgagggagaugguucuccaugcaaaauaccguucgaaaucauggaucuggagaagagguacguacugggacgccuaauaacggucaauccaauaguuacugagaaggacucaccaguuaacauugaagccgaacccccauuuggugacaguuauaucauaauuggaguagaaccgggccaacuaaaauuaaauugguucaagaaagguagcaguauuggucaaauguuugaaacaacuaugagaggugccaaaaggauggcaauauuaggagauacagcgugggauuucggaucucucggaggcguguucacauccauaggaaaagccuugcaccagguuuuuggagcuauauauggcgcagcuuuuucuggaguuagcuggacaaugaaaauacuaauaggaguuauuauuacuuggaucggcaugaacucgcggagcacuucacuuucaguaagucucguacuuguugguauuguaacuuuauaccucggaguaaugguacaagcggacagugggugcgucguaaguuggaagaacaaagaacuaaagugcggaagcggaaucuuuauaacagacaauguucauaccuggacugaacaauacaaauuucaaccggagaguccaucgaaacuagcguccgcuauacaaaaagcccaagaagaaggaaucugcggcaucagaagugugacacgcuuagagaaucuaauguggaagcagauaacuccagaauuaaaucauauucuugcagaaaacgaaguaaaauuaacaauuaugacuggagacauuaaagguauaaugcaggccggcaaaagaucucugaggccacaaccuaccgaauuaaaauacaguuggaagacauggggcaaagcuaaaaugcuaucuacagaaaguuacaaucaaacuuucuuaauagacggaccagagacaacugaauguccaaacaccaauagagcauggaacuccuuagaaguugaggauuacggauuuggaguauucacaaccaacauauggcucaaacuaaaagaaaaacaagacgcauucugcgauucuaaauuaaugagugcagcuaucaaagauaauagagcagugcaugccgauaugggauacuggauagaaucugcacuuaacgacacguggaaaauagaaaaagcgaguuuuauagaaguaaagaacugucauuggccaaaaucacacacacuauggaguaacgguguccuugaaagcgaaaugaucauuccgaaaaacuuggcaggaccuguaucccagcauaacuauagaccgggauaucauacgcagauugcaggacccuggcaucuagguaaguuggaaauggacuuugauuuuugcgacgguacaacaguuauuguuacugaggacuguggaaaucggggaccauccuuaagaacaacaacagcguccggaaaacuuauaacagagugguguugccguucuugcacacuaccuccacuccgauauagaggugaagauggguguugguauggaauggaaauacguccucuuaaggaaaaggaagagaauuuaguuaauaguuuagucacugcaggucaugggcaaguugacaauuuuucucuagguguucuugguauggcauuauuccuagaagaaauguuaagaacaagaguagguacaaaacacgcuauacuauuagucgcaguaaguuuugugacacugauaacuggaaauaugucuuucaaagaucucggacgaguaguaguaaugguuggagcuacgauggcggacaauaucggaauggguguaacauaucuagcgcuauuggcagcauucaagguaagacccaccuucgcagcaggucuacuauuacgaagacucacaaguaaggagcuaaugaugacuaccauaggaauuguuuuguuaucccaaucgacgauaccggagacaguauuagaauuaacagaugccuuagcucucggaaugauggugcuaaaaauaguuagaaauauggagaaguaccaauuagcagugacuauaauggcuauauuauguguucccaaugcuguaauauuacagaacgccuggaaagucucaugcaccauccucgcgguagucucaguuucacccuuacuacuuacuucaagucaacagaaaacagauuggauuccacuggcacuaacaauuaaagggcuuaaucccacugccaucuucuuaacaacgcugucgagaacaaauaagaaaagaucguggccacuaaacgaagccauaauggccgucggaauggucucaauuuuagcaucuucucuguuaaagaaugauauaccaaugacagguccucuuguggcgggaggacuauuaacuguaugcuauguauuaacaggaaggagcgccgaccuggaacucgagcgggcaaccgauguaaaaugggaagaucaggcagaaaucagcggauccucaccaauccuuucaauaacgauaucagaagaugguagcaugaguauuaaaaaugaggaagaagaacaaacuuugaccauacuaauccgcacuggccuauuagucauuucagguuuguuuccaauuucaauuccaauuacugcggcagccugguaccuuugggaggucaaaaagcagcgagcugggguuuuaugggacguuccaucacccccuccaaugggaaaagcagaacucgaagauggugcuuauagaauaaagcagaaagggaucuuaggauauucucaaauaggcgcugguguguauaaggaagggacauuucauaccauguggcauguuaccagaggagccguauugaugcacaaaggaaaacgaaucgaaccaagcugggcugauguuaagaaagaucugauauccuauggaggcggauggaagcuagaaggggaauggaaggagggugaggaagugcaaguauuggcccuagagccaggcaaaaacccccgggcuguacaaacaaaacccggauuauucaaaacaaacacugguacuaucggugcaguuucacuagacuuuucgcccggaacgaguggcaguccgauaauagacaagaaaggaaagguaguuggacuauaugguaacggcgugguaacccguuccggagcguauguaagugcaauugcgcaaacggaaaaaucaauagaagacaauccagagauagaggacgacauauuuaggaaacgcagacuaaccauaauggauuugcauccuggagcagguaaaacaaagagauauuuaccagcuauugugagagaagcaauuaaaagaggucuaagaacacuaaucuuggcaccuacacgaguaguggcugcggaaauggaagaagcacucaggggacuacccaucagguaucagaccccagcaauacgagcugaacacacaggaagagaaauuguugaccucaugugucaugcaaccuucacaaugcguuuguuaucuccgguucggguacccaacuauaaucuuauaauuauggacgaagcacacuuuacagacccagcuaguaucgcagcucgaggauauauuaguacaagagucgaaaugggagaagcugcaggcauauuuaugacagccacaccucccggaucccgggauccguuuccucaaucgaaugcgccgauaauugaugaggaaagagaaauaccagaacgguccuggaacagugggcaugaguggguaacggacuucaaaggaaagacugucugguucguaccaucaauaaaggcaggaaaugacauugcggcaugucuaaggaaaaaugguaagaaagucauccaacuaucaagaaaaacuuuugauucagaguauguaaaaacaagaacuaaugacugggacuuuguagucacaacagacaucagcgagaugggggcgaauuuuaaagcugagagagugauagauccacguaggugcaugaaaccagugauauuaaccgacggagaagaaagagucauacuugcagggccaaugccuguaacccauucaagcgcagcgcagcgacgagggagaauaggaagaaauccuaaaaacgagaaugaccaauauauuuauaugggagagccauuggagaacgaugaagauugugcacauuggaaagaggcaaaaaugcucuuggacaacauaaauaccccagaagggaucauucccucaauguuugaaccggaaagagaaaaaguagacgccaucgauggugaauauagguugcgaggagaagcacguaaaaccuuuguagacuuaaugagacgcggggaccuuccaguauggcuugccuacaagguggcagcagaaggaauaaauuaugcugauaggagauggugcuuugacggaaucaagaauaaucaaauauuagaagagaauguagaaguugagaucuggacuaaggagggagaaaggaagaaacucaagccuagauggcuggaugcacgaauuuacagugauccccuugcccugaaagaguucaaagaguuugcugcagguagaaaauccuuaacauuaaauuuaauaacggaaaugggaagacuuccgacuuucaugacucagaaaacucgugaugcuuuagacaaccuggcgguccuucacacggcugaagcaggagggcgggcuuacaaucaugcguuaucagaauuaccugaaacuuuagagaccuuacuucugcuuacauugcuagcaacaguaacgggcggaauauuuuuauuucuuaugucgggucguggaauuggcaaaaugacucuaggaauguguuguauuauaacugcaucuauauuauugugguaugcccaaauacagccacacuggauagccgccucuauaauacuugaguucuuccuuaucguacuauuaaucccugagccggagaaacagcguacuccgcaagacaaucaacugaccuacguugucauagcaaucuuaacuguuguggccgccacaauggcaaaugagaugggauuuuuagagaaaaccaagaaagaccucggccuuggaaguauugcgacccaacagccugaaucuaacauucucgacauugauuuaagaccagcaucugccuggacccuuuacgcaguggcuaccacauucgucacaccuauguuaagacacucaauagagaacaguuccgugaauguaagucuuaccgcaauagcuaaucaggcaaccguacuuaugggacugggcaaaggcuggccauugaguaagauggauauuggagugccgcuucuagccauaggaugcuauucacaagugaaucccauuacguuaacagcugcuuuacuuuuguuaguugcacacuaugcaauaauuggucccggccuacaagccaaagcuacaagagaagcgcagaaaagagcggcagcgggcauuaugaaaaauccaacuguagauggaauaaccguaauagauuuagauccaauaccauacgacccaaaauucgaaaaacaacuaggacaaguaaugcucuugauacuaugcguuacacaaguuuuaaugaugcgaacaacaugggcucuuugugaagcguuaacauuagcuacaggaccuauuucuacacuaugggagggaaauccuggcagguuuuggaauacgacaauugcugucucgauggcgaauauauuuagagguaguuauuuagcgggagcugggcuacuguucagcauuaugaaaaauacaacaaauacgcgcaggggaacugggaauauaggggagacccuaggcgagaaauggaaaagcagauugaacgcacuaggaaaauccgaauuucaaauuuauaagaaaagugggauucaagaagucgacaggacacuggcgaaggagggaauuaaaagaggggaaacagaccaccacgcaguuuccagggguucagccaaacuucguugguuuguagaaaggaauauggugaccccugaagguaaagucguagacuuaggcugugguagaggaggauggagcuauuacugugguggacugaaaaauguucgagagguaaaggggcuaacuaagggcggucccgggcaugaagaaccuauaccaaugucaaccuacggcuggaaucuagugcgucuccaaucuggcguggacgucuucuucauaccaccugaaaaaugugauacauuauugugugacauaggcgaaucgucuccaaauccgaccguggaggccggacgcacacuccgcgucuuaaaucuaguugaaaauugguugaauaacaacacacaauucuguauuaaaguauuaaauccguacaugccgucgguaauugaaaagauggaagcacuucagcggaaauauggcggugcgcuagugagaaacccauuaucuaggaauagcacacaugaaauguauuggguaucaaaugcuagcgguaacauaguaucauccguuaacaugaucagcaggaugcuaauaaacagauucacuaugagacacaagaaagcaaccuaugaaccggauguagauuuaggcucuggaacaaggaauauuggaauagagucagaaauaccgaacuuggauauuauaggaaaaagaauagagaaaauuaaacaagaacacgaaaccagcuggcauuaugaucaggaccaccccuauaaaaccugggcguaucacgguaguuacgaaacuaagcaaacuggcucugcaaguucgauggugaaugggguaguaagacuauuaacaaaacccugggauguacuaccaacgguaacucaaauggcgaugacagacacgacccccuuuggacagcaaagggucuuuaaagagaagguagauacccgaacucaagagccgaaagaaggaacuaagaaauuaaugaaaauuacggccgaauggcucuggaaggaauuaggcaagaagaaaacaccucguauguguacaagagaagaauuuacaagaaaaguccgaagcaaugcagcguuaggggccauauucacagaugagaacaaauggaaauccgcgagagaagcagucgaagacaguagauuuugggagcuaguugauaaagaacguaacuugcauuuggaagggaagugugaaacauguguauacaauaugaugggaaagcgagagaagaaacuaggggaguuuggaaaggcaaaaggcaguagagcaaucugguauauguggcuaggugcacguuucuuagaauuugaggcauuaggguuucuaaacgaagaucacugguuuaguagagaaaacucacuauccgggguagaaggugaaggccuacauaaauuagguuauaucuugcgugacgucuccaaaaaggaagguggagcuauguaugcagaugacacugcagggugggacacucguauuacauuagaagaucugaagaaugaagaaaugguaacuaaucauauggaaggcgaacauaaaagacuagcugaggccauauuuaaacuaacauaucaaaacaaaguaguuagaguucaaagaccuacuccacgagguacggucauggacauaaucucuaggagggaccaacgcggcagcggccaaguugggacuuacggacuaaauacauuuacaaauauggaagcgcaacuaauaagacaaauggaaggcgaaggaguauuuaaaaauauccaacaucuuacaguaacugaggaaguagcaguacagaacuggcuagcacggguagggcgugaaagacugagccgaauggcuaucucaggagaugacuguguaguuaaaccacuagaugacagguuugccaaugcacuaacggcacuaaaugauauggguaaaauucgaaaagacauccagcagugggaaccguccaaagguuggaaugacuggacacaaguucccuuuuguucucaccauuuucacgaacugauuaugaaagacggucgagugcuuguaguuccgugccgcaaccaagacgaacuuauaggcagagcuaggauuagucagggagcgggauggagccucagagaaacggcgugccuugguaaaaguuacgcacagauguggaguuuaauguauuuucacagacgagauuuacgacucgcagcgaaugcaauaugcucugcaguaccuucccauuggguaccuacaucccgaacgacguggucgauucaugcuaaacacgaauggaugacuaccgaagauaugcugacggucuggaacagaguauggauaagagaaaauccauggauggaagauaaaacaccggucgagagcugggaagaaaucccuuauuuaggaaagagagaggaucaauggugcggcucguuaauaggauugacaaguagggcuacgugggcuaaaaauauccaagccgcgauuaaccagguaaggucuuugauaggaaaugaggaauauacagacuauaugcccucgaugaagagauuuagaagagaagaagaagaagcagggguccuaugguaa

SEQ ID NO: 22778 - RNA, 9876 nt, Artificial Sequence
  derived and/or modified CDS sequence (opt6) from DENV-2__EU482463__SS-prME
agugcagggaugauaaucaugcuuauuccuacaguuauggcauuucacuugacuacaagaaauggagaaccccauaugauaguaucaauacaggaaaaagguaaaucucuacuauucaaaaccgaagaugggguaaacaugugcacucuuauggcgauggaucuuggcgagcugugugaagacacaaucaccuauaaauguccccuuuuacgucaaaaugagcccgaagauauagacugcuggugcaacucuacaagcacuuggguaacuuacggaacuuguacaacaacuggcgaacauagacgggagaaaagaagcguggcacuuguuccccaugugggaaugggccucgaaacaagaacagaaacuuggaugucaucugaaggagcuuggaaacacgcacagcguauugaaacuuggauauugagacacccuggauuuacaaucauggcagcuaucuuggccuacaccauagguaccacacacuuccaaagaguauuaauuuuuauauuacuuaccgcuguugcgccaucgaugacaaugcguuguaucggcauaaguaaucgugacuucguggaaggggucuccgggggaucuuggguugacauaguauuagaacacggguccugcguuacgacaauggcuaaaaacaaaccaacacuugauuucgaauugauaaaaacugaagcgaaacaacccgcgacgcuucggaaauacugcaucgaagcgaaacuuacuaacacaacgacugagucccgcugucccacacaaggagagccaagucuuaaagaagaacaagauaaaagguucguaugcaaacauaguaugguggauaggggaugggguaacggauguggccucuucgguaaaggagggauuguuacgugcgcuauguuuacaugcaagaaaaacauggaaggaaaaaucguacaaccggagaaucuagaauauacgaucgugguaacuccccauucgggggaagaacaugcaguaggcaacgauaccggcaaacacgguaaagaaauaaaaguaacaccacaaaguaguaucaccgaagcagaacuuacaggguaugggacuguaacaauggaauguucaccacgcacagggcuagauuucaaugaaaugguucuucuccaaauggaaaauaaagcaugguuaguccauagacaaugguuccuagauuugccgcuaccauggcuaccaggagcagacaaacaggaaagcaacuggauacagaaagaaacguuagucacuuucaaaaacccacaugccaagaaacaagauguaguaguacucggcucccaggaaggugccaugcauacagcauugaccggagcuacagaaauccaaaugucguccgggaaccuucuauucacaggacauuuaaaaugcagauugagaauggauaaauuacaauuaaaagggaugucuuauucuauguguaccgguaaguuuaaggugguaaaagaaauagcagaaacccaacacggaacgaucgucauuagggugcaauaugaaggagacgguuccccuuguaagauuccauuugaaauaauggaucuugaaaaacgcuauguacuaggaagacuuauaacaguaaaccccauaguaaccgaaaaagacuccccuguaaauauagaggccgagccucccuucggagacucuuauauuauuauuggcguggaaccuggacaacuuaaauugaacugguucaagaaaggaucaagcauuggccaaauguuugagacuaccaugaggggugcgaaacggauggcgauacuuggugacacugcaugggacuucgguucacuaggaggggucuuuacaucgaucggaaaagcacuacaucagguauuuggggccauauacggcgccgcuuucaguggugucucuuggacaaugaaaauacucauuggagucauuaucacuuggaucgguaugaauagccgauccacgucgcugucggucucgcuaguauuaguugguaucguuaccuuauaucugggcguaaugguacaagcagauucaggcugugucguaagcuggaaaaacaaagaacugaaaugugguucgggcauuuuuauuacagacaauguucauacguggacugaacaauacaaguuucaaccagaaagcccaaguaaauuagcuucggcuauucaaaaggcacaagaagaagguaucugugggauucgcucaguaacaagauuagaaaauuuaauguggaaacaaauaacaccggaauuaaaucacauauuggcagaaaaugaggucaaacuaacuauaaugacuggagauauaagaggaaucaugcaggcggguaaaagaucguugcguccccaaccuacagaacuaaaauacuccuggaagacguggggcaaagcaaagauguuaagcaccgagucuuacaaucaaacguucuugauugauggccccgaaacagcagagugcccaaauacuaauagagcauggaauaguuuggaaguagaagauuaugguuucgguguuuuuaccacaaacauuuggcucaagcuaaaggagaaacaagacgcuuuuugugauucaaaacuaaugucagcagcuaucaaagacaacagagcuguacacgcagauaugggguacuggaucgaaucugcgcuaaaugacacauggaaaauagaaaaggcgaguuucauagaaguuaaaaauugucauuggccaaaaagucauacgcuauggucaaacgggguacuggaaucagaaaugauaauacccaaaaauuuagcagggccaguaucacaacacaauuaucgaccaggauaucacacucaaaucgcggggccuuggcaucuugguaaauuagaaauggacuuugacuuuugcgauggcacuacuguaauugucacugaagacugcggaaaucgcgguccuucucuuagaacuacaacugcaaguggaaaauuaauaacugaauggugcuguaggagcugcacauuaccaccacuaagguacagaggggaagauggauguugguaugguauggaaauacgaccgcuaaaagaaaaagaagaaaaccucgugaauagcuuggucacggcaggacacggacaaguagauaacuuuaguuuagguguauugggaauggcccuuuuucuugaggaaaugcuuaggacgaggguuggaacgaaacaugcuauucuccuaguagccguuucauuugucacucuuauuacagggaacaugaguuuuaaggaucugggacggguugugguuaugguaggagccacgauggcagaugacauugguaugggcguaaccuauuuggcccuacucgcagccuuuaaaguaagaccuacguuugcggcaggacuguuacuaagaaaauuaaccucaaaagaacuuaugaugacgaccauaggaauaguacugcuaucacaaucaaccaucccugaaaccguguuagagcuaacagacgcacuagcauugggaaugaugguauuaaaaauaguuagaaacauggaaaaauaucaacuagccgucacaauuauggcuauuuuauguguaccaaaugcaguaauucuccaaaaugcauggaaggugucaugcacaauccuggcagugguuucagugucaccguuauuacucacaucaucccaacaaaagacugacuggauaccacuggcccuaacaauaaaaggccuaaacccaacagcuaucuuuuuaacaaccuuauccagaacaaauaagaaacgaucuuggccuuuaaaugaagcaauaauggcaguaggaaugguaucaaucuuagcaagcagucugcugaaaaacgauauuccuaugaccggaccucuaguugcaggcggauuacuaaccgucuguuauguuuuaacaggacgauccgcagaucuagagcuggaaagagcaacggauguuaaaugggaagaccaagccgaaauuagugggucauccccaauacucucuauuaccaucuccgaagaugggaguaugucaauuaaaaaugaagaagaagaacaaacacuaacgauacucaucagaaccggauuauuaguuauaagugggcuauuuccuauuucaauaccaauaacugcugcugcaugguaccugugggagguaaagaaacaacgcgcaggaguucugugggauguuccaagcccgccacccaugggaaaagcugaacuugaggacggagcuuauagaauaaaacagaaaggaauauugggauauagccagauaggugcaggaguuuauaaagaaggcacauuucauacaauguggcaugucacucggggagccguauuaaugcacaaagguaaacguaucgagccaagcugggcagaugugaagaaggaucucauuuccuauggcggcggauggaaguuagaaggagaauggaaagaaggagaggaaguccaaguccuugccuuggaaccgggaaagaauccgagagcaguucaaacaaaaccaggcuuguucaagacaaacacugguaccauaggugcugucucccucgacuucaguccagggaccagcgggaguccgauuauugacaagaaaggaaaaguuguugguuuguauggcaacgggguugucacucguucaggugccuauguaucagcaaucgcucaaacugaaaaaucaauagaagauaauccagaaauagaagaugacauuuuccguaaaagacgacuaacaaucauggacuuacauccgggagcaggcaaaacuaaacgauauuuacccgcgaucguccgcgaggcuauuaaacgcggauugagaacacucauucuugcuccuacacgugucguggcugcagaaauggaagaggcauuacguggguuaccgauucgguaccagaccccugcaauaagagcugaacauacuggacgugaaauaguagaucugaugugucaugcuacauucacaaugaggcuacuaucgcccguaagaguaccaaauuacaaucugauaauaauggaugaagcacauuucacagacccugcuagcauagcagcucgugguuacauauccacucggguagaaaugggcgaagcagcagggaucuucaugacagcaacgccaccagguucgagggacccauucccgcaaagcaaugcaccuauuauagaugaagaaagggagauuccggaacggucauggaacucugggcacgaauggguaacggauuuuaagggcaagacaguaugguucguaccuaguauuaaagcuggcaaugauauagcagcuugucuaaggaaaaaugguaagaaaguaauacaacucucacguaaaacauucgacagugaguacguaaaaacucguacaaacgauugggacuuuguagugacaacagacaucucggagaugggggccaauuuuaaagcagaaagagucauugauccacgacgguguaugaagccaguaauuuuaacggacggagaggaacguguuauauuggcaggaccgaugccaguuacgcacuccagcgcagcucaacguagaggaagaauaggaagaaacccaaagaaugaaaaugaucaguauauauauaugggagaaccucucgaaaacgacgaggauugugcacauuggaaagaggcaaaaaugcuacuugauaauauaaacacucccgaaggaaucauucccucaauguuugagccugagcgugaaaaaguggaugcgauagacggagaauaucguuugcggggagaagcacguaagacauucgucgaccuaaugagaagaggugauuuaccagugugguuggcuuacaaaguggcagcagaaggaauaaacuacgcagaccguagauggugcuuugacggaaucaaaaauaaucaaauacuggaagaaaaugucgaaguagagaucuggacgaaagaaggagagagaaagaaauuaaagccucgaugguuagaugcccgaaucuauucugacccacuggcauuaaaagaauuuaaagaguuugccgcaggaagaaagucauuaacguuaaaucugauaacagaaaugggaagauuaccuacauuuaugacacagaaaacaagggaugcccuugauaaccuagcgguuuuacauacggcugaagcuggaggucgugccuacaaucacgcccucucugaacuuccagaaacacuugaaacgcucuuguugcuaacucuccuugcgacaguuacaggagguauauuuuuguuucucaugagcgggagagguauaggaaaaaugaccuuaggaaugugcugcauuauaacagcaaguauacucuugugguacgcucaaauacagccgcauuggauugccgcaucaauaauauuagaguucuuucuaaucgugcuguuaauuccagaaccagagaaacaaagaacuccccaagacaaucaacugaccuauguaguaauugccauuuuaacaguggucgcggcgacaauggcuaacgagaugggauucuuagaaaagacgaagaaagaucuuggucuagguucgauagcaacacagcaacccgagucgaacauauuagacauugauuuaagaccugccuccgcauggacgcuauacgccgucgccacuacguuugugacgcccaugcuucggcauucgauagaaaacagcucagucaacgugucucucacagcaauagccaaccaagcaacuguuuugaugggcuuggguaagggauggccucucagcaaaauggauauagggguaccauuacuugcaauuggaugcuauagccaaguuaacccgauaacguuaaccgcugccuuacuacuccuggucgcccacuaugcaauaaucggaccaggacuccaagcaaaagcaacacgcgaggcucagaaaagagcagcggcaggcauaaugaagaacccaacaguagaugguauuacuguaauugauuuagauccuauaccguaugauccaaaguucgaaaaacaauuagggcaagucaugcuacucauucucugugucacccaagucuuaaugaugagaacaaccugggcccuuugugaagccuuaacauuggcuacgggaccaauaagcacacucugggaaggaaaccccggaagauucuggaauaccacaauagcggucuccauggcgaauaucuuucgaggcucauaucucgccggagcagggcuuuuauuuucaaucaugaagaacacaacgaauacacgaagaggcacugggaacauaggugaaacauugggggagaaauggaaaaguagauuaaaugcucuagggaagagugaguuucaaauauauaagaaaagcgggauccaagaagucgauaggacacuagcuaaagaggguauuaagagaggagaaacugaucaucaugcugugucaagaggcagcgcaaagcuccguugguucgucgagagaaauaugguuacaccagaaggcaaaguuguagaucuaggcuguggaagaggaggcugguccuauuauuguggaggacucaaaaauguuagagaaguuaaaggguuaacuaagggcggaccuggucaugaagaaccuaucccuaugucaacauauggauggaacuuggucagacuacagucgggcguagaugucuucuuuauaccacccgaaaaaugugacacacuuuuaugugacauuggugagaguucaccaaauccaacaguugaagccggccgaacacuaagaguccuaaacuugguggagaauugguugaacaacaauacacaguucugcauaaaagugcuuaauccauauaugccaucuguaauagagaaaauggaagcacuccagcggaaauaugggggagccuuaguaagaaauccuuugucuagaaacucgacucaugaaauguauuggguuuccaaugcaagugguaauauaguaucuuccgucaauaugauaucacgaaugcuuauaaauagauuuacgaugcgacacaagaaagcgacauaugaaccagacguggauuugggcucaggaacaaggaauauugguauugagagugaaaagccgaaucuugacauaauaggaaaacguauugagaaaaucaaacaggaacaugagacuuccuggcauuaugaucaagaccaucccuauaaaacaugggcguaccacgguaguuaugaaacaaaacaaacaggcucggcuaguucgaugguuaacggaguggucagauuauuaacaaaacccugggauguccugccgacuguaacucaaauggcaaugacagauacaacgccauuuggacaacagagaguuuucaaagaaaaaguggauacaagaacccaggaaccgaaagaaggaacuaagaaacucaugaagaucaccgcugaauggcucuggaaggaauuaggaaagaagaaaacuccaagaauguguacacgggaagaauuuacaaggaaaguaagaaguaaugcugcauuaggggccauauuuaccgaugaaaacaaguggaaaucagcucgggaagcgguagaagacagcagguuuugggaauuaguugacaaagaaaggaauuuacauuuagaaggaaaaugugaaacaugugucuacaauaugauggggaaaagagaaaagaagcugggagaauuuggaaaagccaagggaaguagggccauaugguauauguggcuuggugcuagauuucuugaguucgaggccuuaggauucuuaaacgaagaucacugguuuagucgagaaaauucauuguccgguguggaaggagaaggauuacauaaacuaggauauaucuuaagggacgugagcaagaaagaagggggagccauguaugcagacgacacggccggaugggauacucgaauuacuuuagaggacuugaaaaacgaagaaaugguaacaaaucauauggaaggugagcauaagaaauuagccgaggcaauuuucaaacugacguaccaaaauaaaguaguuagaguacaacguccgacaccacgaggaaccguaauggauaucauaucacgcagagaccaacguggaucaggacagguugguacauauggauugaacaccuucacgaauauggaagcgcaguugauacgacaaauggagggggaggguguuuuuaaaaacauacaacaccucacagucacagaagaaguagccguacauaauugguuagcuagaguagggagggaacggcucagucgaauggcuauuucuggagaugauugcgucgucaaaccauuggaugaucgauuugcaaacgcucuuacagcacuaaaugacaugggaaaaauuagaaaagauauucaacagugggaaccaucaaaaggauggaacgauuggacccagguaccauuuuguucucaucauuuccacgaauugauaaugaaagacgggcgcgugcucguuguaccuugccgaaaucaagaugaacucauagggagagcgcgcaucagucaaggggcggguuggucucuacgugaaacggcuugcuuaggaaaaaguuaugcccaaauguggagcuuaauguacuuccaucgaagagacuuacgccuggcggccaaugccaucuguucugcugucccaagucauugggucccaaccagucguacgaccugguccauccacgcaaaacacgaauggaugacuaccgaagacauguuaacuguuuggaacagaguauggauaagggagaacccauggauggaggauaaaacaccuguggaaagcugggaagaaauuccguaccuuggcaaaagagaggaccaauggugcgguucacucauaggcuuaacaagucgugcaacaugggcaaagaauauccaggcggcaauuaaucaggucagaucacuuauagguaacgaagaauauacagacuacaugcccaguaugaagagguucagacgagaagaagaggaagcaggaguacuuugguaa

SEQ ID NO: 22779 - RNA, 9876 nt, Artificial Sequence
  derived and/or modified CDS sequence (opt6) from DENV-2__EU482464__SS-prME
agugcuggaaugauaaucaugcugauaccaacuguaauggcauuucauuuaacaacgcgcaacggagaaccgcauaugauuguugggauacaggaaaaagguaaaagucuuuuauucaaaacggaagacggaguaaauauguguacacugauggcaauggauuuaggagaacugugcgaagauacaaucacuuauaaauguccuuugcuucgacaaaacgaaccugaagauauugauuguugguguaauagcacgagcacauggguaacuuaugggacauguacuacuacuggggagcaccggagagagaaaagauccgucgccuuaguuccgcauguuggaauggguuuagaaacaagaacugaaacauggaugucgucagaaggagcuuggaaacaugcacaaagaaucgaaacauggauacuuagacacccgggauucaccaucauggcugcuauucucgcauacaccauugguacgacccauuuucagagaguguuaauauuuauuuuauuaaccgcagucgcgccaagcaugacgaugagaugcauaggaauaucaaauagagacuucguggaaggugugagcggaggcucauggguugauauaguguuagaacaugggagcugcguuaccacaauggcgaaaaacaaaccaacucuugauuuugaacuaauuaaaacugaggcaaaacaaccugcaacucuaagaaaauauugcauugaagcaaaacuuaccaacaccacgaccgagaguagauguccaacacaaggagaaccaucauuaaaagaagaacaagacaaacguuuuguaugcaaacauagcaugguagacaggggauggggaaacggauguggucuguucggcaaaggagggaucguaacaugcgcaauguuuacauguaagaaaaauauggaaggaaaaauuguacagcccgaaaaccuugaauauaccauaguagugacaccacacagcggugaggagcacgccguaggcaacgauacagguaaacacggcaaagaaauaaaaguaacuccgcaaucaaguaucacagaagcagaacugacgggauacggaacggugacuauggaguguucuccccgaacagguuuagacuucaaugaaaugguauuacugcaaauggaaaauaaagcauggcugguucauagacagugguuucuggacuugccacuuccauggcuuccuggagcugauaaacaagaaaguaacuggauacaaaaagaaacgcuggucacauuuaaaaacccgcaugcuaagaaacaggaugugguaguauuaggcucgcaagagggugcaaugcauaccgcucuaacaggcgcaacagagauccaaaugucaaguggcaauuuacuauuuacaggacauuugaaaugccguuuacguauggauaaauugcaauugaaaggaaugucuuacagcauguguaccggaaaguuuaaagucguuaaagaaauagccgaaacacagcaugguacaauuguuauucgagugcaauaugagggcgauggauccccauguaagauuccauucgaaauuauggaucuagagaaaagauauguacucgggcgacuaauaaccgucaauccaauaguaacugaaaaagauucuccagugaacauagaagccgaaccaccauuuggcgauucguacauuaucauuggcguggaaccuggacaacugaaacuaaauugguuuaaaaagggaucuaguauuggccaaauguucgaaacgaccaugagaggggcgaaacggauggccauacuuggugauacugcuugggauuucggaagccuaggagguguauucacaaguauaggaaaggcuuuacaucaaguauucggagcaauauauggugccgcauuuagugguguaucuuggacgaugaagaucuuaauuggugucaucauuaccuggauaggaaugaacucuagaagcacgagucugucgguuagcuuaguucuaguaggcauuguaacgcuuuauuuaggaguuaugguccaagcagacucaggcuguguuguaaguuggaagaauaaggaacucaaaugcggaagcgguauuuuuauaacugauaacguucauacuuggacugaacaauacaaauuucagccugaaagcccuaguaaacuugcuucagcuauucaaaaagcacaagaagaggguaucuguggcauuagauccguaacgcgauuagaaaauuuaauguggaagcagauuacacccgaauuaaaucauauucuggcagagaaugaaguaaaacuuacaauaaugacuggcgacaucaaggggaucaugcaggcgggcaaaaggucucuaagaccacaaccuacggaauuaaaauacucuuggaaaaccuggggaaaggcaaaaauguugaguacugaaucguacaaucaaacguuucuaauagacggcccagaaacgacagaaugucccaauacaaaucgagcguggaauaguuuagaaguugaagauuaugguuucgguguauuuacgacuaauauauggcuaaaauuaaaagagaagcaagaugcguuuugcgauaguaaauugauguccgcggccauaaaagauaacagagcgguucaugccgacauggguuauuggauugaaagugccuuaaacgacacguggaaaaucgaaaaggcaucauucauagaaguuaaaaacugucauuggccgaaaucccacacuuuguggagcaauggaguguuagaaagcgaaaugauuauucccaaaaaccuagccggaccggucucccagcauaacuauaggccuggauaccauacacaaauagcuggucccuggcaccugggcaaguuagaaauggauuucgauuucugugauggcacgacagugaucgugacggaagauugcggaaacagaggccccucguuaaggacaacuacagcaucagggaaacugauuacugaauggugcugucggaguuguacguugcccccacuacgauauagaggagaagacgguuguugguacgguauggagauuaggccauuaaaagagaaagaagaaaauuuaguaaacuccuugguuacugcuggucacggacaagucgacaacuucucucuaggcguacuagguauggcccuauuuuuagaggaaauguuacguacaagaguaggcacaaagcacgcaauacuacuuguggcuguuucuuuugugacucugauaacugggaauaugagcuuuaaagaucuagggcgugucgugguaauggucgguacaacaauggcugaugacaucgguauggguguaacauaucuagcacuacuagcggcauuuaaaguccgacccacguuugcagcgggguuacuauuacgcaaacuaacauccaaagaacuaaugaugaccacaauagguauuguccugcuuagccagucaacaauuccagaaacggucuuagagcuaacugaugcuuuagcuuuaggaaugauggugcuuaaaauaguccgaaacauggagaaauaucaauuagcaguuacuauuauggcaauuuugugcguuccaaacgcuguaauauugcaaaacgcguggaaagugucuugcacgauauuagcugugguaaguguaucaccucuacuacuuacuucaucgcaacaaaagacggauuggauaccgcuagcauuaacuauuaagggauuaaauccuaccgcuaucuucuuaacuacauuaucccgaacuaauaagaaacgauccuggcccuuaaacgaggcaauuauggcugugggcaugguaucuauccuagcaaguucacuacuaaagaacgauaucccuaugacaggcccacugguugcuggugggcuccuuacuguauguuauguccuuacaggaagauccgcagauuuggaacuggagagggcaacugacguaaaaugggaagaccaggccgaaauuuccgguuccucuccaauacucuccauaacuauuucagaagacggcuccaugucaauuaagaacgaggaagaagaacaaacguuaacaauucugauacguaccggcuuauuggugauaucuggccuauuuccuauuucaauuccuauaaccgcagcagccugguaucucugggagguaaagaaacaaagagccggagugcuuugggacguaccuucuccacccccaaugggaaaagcagaacuggaagauggagcauauaggauaaaacaaaaaggaauacuagguuauagucaaauuggugccgguguuuauaaagaaggcacauuccauaccauguggcacgugaccagaggggcaguccugaugcauaaaggaaaacgcauugagccaucaugggcugacguaaagaaagacuuaauaucuuaugguggggguuggaaacucgaaggcgaauggaaagaaggagaagaaguucaaguuuuagcccuggaaccgggcaaaaacccuagagcaguucaaacuaaaccuggguuauucaaaacaaauacaggaacaauaggagcaguuagccucgauuucucaccagggacgucagguucccccaucauagacaagaaaggaaaaguaguugggcuauacgguaauggcgugguaacucgaucgggugccuaugucuccgccauagcccaaacagagaaaaguaucgaggauaauccugaaauagaagaugauauauuucggaaaagaagacuuacaauuauggaucuucauccaggagcaggaaaaacuaaaagauauuugccagcaaucguuagagaagcuauuaaaagaggacuuagaacguugaucuuagcaccuacuagaguaguugcggcugaaauggaagaggcucuacgaggucuucccauacgauaucaaaccccagcaauaagagccgaacauaccgggcgugaaauaguagacuuaaugugccacgcgacauuuacgaugagguuauuaucaccgguacgaguaccgaacuacaacuugauuauaauggacgaggcacacuucacugaccccgccaguauagcggcacgagguuacauaucaacaagaguugaaaugggcgaggcugcaggaauauucaugacagccaccccuccagguuccagagacccauuuccacaaucgaaugcacccaucauagacgaagaaagagaaauacccgaacgcaguuggaacagcggucaugaauggguuaccgauuuuaagggcaagacugugugguuuguaccguccauaaaagcuggaaaugacauugcagcuugucugcgaaagaacgguaagaaaguaauacaauuaagucgcaaaaccuucgauucggaauauguaaaaaccagaaccaaugacugggacuucguaguuacaacggacauaagcgaaaugggagcaaacuuuaaggcagaaagaguaauagauccccgacgaugcaugaaacccguaauccucacagauggggaagaacgaguaauuuuagcagggcccaugccuguuacacacucuucugcugcucagaggcgaggacgcauaggaaggaacccaaagaacgagaacgaucaauacauuuacaugggagaacccuuagagaacgacgaagauugugcucauuggaaagaagccaagauguugcucgacaauaucaacacccccgaaggcauaauuccauccauguucgagcccgagcgagaaaaaguagaugcuauagacggagaguaccgacuuagaggggaagcgagaaagacguuuguagauuuaaugcgaagaggggacuuacccguauggcuagcuuacaagguggcagcugaagguauuaauuacgcggaccggagaugguguuucgacgggauuaaaaacaaccaaauauuagaagaaaacguggaagucgagauauggacaaaggagggcgagaggaagaaauuaaaaccuagguggcuagaugcaagaauauacucagacccauuggcacuuaaggaguuuaaagaguuugcugcaggacguaaaucguugacguuaaauuuaaucacugagaugggccgguuaccaacauucaugacucagaaaacuagagaugcacuagacaacuuagcuguacuccacaccgcagaagcugguggacgagcuuauaaucacgcacuuuccgaacuacccgaaacauuagagacucuuuuauuguuaacacuuuuagcuacuguuacuggagggauauuuuuauuucuaaugucaggacggggcauuggaaaaaugacacucggaauguguuguauaauuacagcaucgauauuauuaugguacgcacaaauucaaccgcauuggauagcggcaaguauaauacuagaauuuuucuuaauaguguuauuaaucccugaacccgaaaagcaacggacaccucaagauaaccaacugacuuauguagugaucgcaauucucacgguggucgcagcuacuauggcuaacgagaugggguuucuggagaaaacuaagaaagaccucggacuuggaaguauagcuacucaacaaccugaaagcaauauuuuagauauagauuugagaccggcuucagccuggacauuauaugcuguggccacaaccuuugucacuccaauguuaagacauagcauugaaaacucaucuguaaaugugucacugacugcuauagccaaccaagcuacaguauugaugggucuggguaaaggauggccucuguccaaaauggauauuggaguacccuuguuagccauagggugcuauucucaaguaaaucccaucacacucacugcagcauuauuacuacugguugcccacuacgcaauaauaggaccuggccugcaggcuaaagcgacuagagaagcccaaaaacgggcugcagcuggaaucaugaaaaauccuacagucgacggaauaacgguaauagaccucgacccaauuccauacgauccaaaguuugaaaaacaauuaggucaaguuaugcuacuuauucuuuguguaacccaagugcuaaugaugagaacaacuugggcgcugugugaagcucuaaccuuagcgacuggaccaaucagcacacugugggaagguaaucccggaagauucuggaauacaacaauugcagugucaauggcgaacaucuucagaggaucauaccuugcgggugcaggccuacuauuuucaauaaugaaaaacacgacaaacacuagaagaggaacaggaaauaucggagagacauugggcgaaaaguggaaaagucgccuaaacgcccuaggcaaauccgaguuccagauauacaagaaaucugguauccaggagguagaucggacacuugcuaaagaaggcaucaagagaggagaaacagaucaucacgcaguaucuagagguagugcaaaacuaaggugguucguugaacguaauaugguaacccccgagggaaaaguuguggaccuaggaugugguagagggggaugguccuauuacuguggcggacuuaaaaacguacgugaaguuaaaggacuaaccaaaggcggaccaggacaugaagaaccgaucccaaugucuacguauggcuggaaucuaguuagauugcaaucaggcguugacguauucuuuauuccuccggagaaaugugauacccuacuaugugauauuggagaaagcucuccgaacccaacaguagaagcaggucguacacuaagaguauuaaaccugguggaaaauugguuaaauaauaauacucaauucuguauaaaagugcucaaucccuauaugccaaguguaauagagaaaauggaagcgcuucagaggaaauacggcggugcguuaguuagaaacccuuuaucacguaauaguacccacgaaauguacuggguaucaaaugcaagugggaacauaguaagcaguguuaauaugauuagcaggaugcuuauuaacagauuuacgaugcgacauaagaaggccacguaugaacccgacguugaucuuggcucagggacacgaaacauagguauugaaagugagauuccaaaccuugauauaauagguaaacgaauagaaaagauaaaacaagaacaugaaacuucuuggcacuaugaucaagaccauccguauaagacaugggcuuaccacggaucuuacgaaacuaaacaaacaggaucugcaucgaguaugguuaauggagucguccggcuacucaccaaaccuugggacguacuccccacuguuacccagauggcaaugacggacacaacuccauuuggacaacaaaggguguuuaaagagaagguagauacucggacccaagagccgaaggaggggacaaagaaauuaaugaaaauuacagcagaauggcuauggaaagaauuagggaaaaagaaaacgccaaggaugugcacacgugaagaguucacgcgaaaaguacgcucuaaugcagcgcuuggagccauauuuaccgaugaaaauaaauggaaauccgcucgugaagcuguagaagauucacgcuucugggaauugguugauaaagaacguaaucuucaccuagaagguaagugugaaacauguguauauaauaugaugggaaaacgagaaaagaaauuaggugaguucggcaaagccaaaggauccagggcuauaugguacauguggcuuggagcucgauuucucgaauuugaggcacugggauuccuuaacgaagaucacugguuuucucgagagaacaguuuaucagggguagaaggcgaaggacuacacaaacuaggauacauucucagagaugugucaaagaaagaagguggugccauguaugcagaugauacugcgggaugggacacacggauuacauuagaggaccucaaaaacgaagaaaugguaacaaaucacauggagggagaacacaagaaacuugcagaagcuauauucaaacuaacuuaucaaaauaaaguaguaaggguacaacgucccacaccaagaggaacggugauggauaucauaagccgacgugaucaaagagguaguggucaggucggaacauauggauuaaauaccuuuacaaauauggaggcacagcugauucgacaaauggaaggagaaggaguuuucaaaaacauccaacaucuaacgguaacggaggaagucgccguccaaaauuggcuagcacggguaggaagagaaagauugucuagaauggcaauuaguggugaugauugcguggucaaaccacucgacgacagauuugcgaaugcucuagcugcucuuaacgauauggguaaaauuaggaaagacauacaacaaugggaaccaucgaaggguuggaaugauuggacccaagucccauuuuguucccaucacuuucaugaauugauaaugaaagacggaaggguccuagugguaccuugcaggaaucaagaugaauuaaucgggcgggcuagaauuucacagggggccgguuggucacuaagagaaaccgcuugccuaggaaaaucuuaugcacagauguggucuuugauguauuuccacaggagagaccucagauuagccgccaacgcgauauguagcgcaguaccuagccacugggugcccacaucaagaacaacuuggaguauccaugcaaagcacgaguggaugacgacugaagacauguugaccguguggaaccgaguauggauacgcgaaaauccuuggauggaagacaagacucccguggaaucaugggaagaaauaccguacuuagggaagcgagaagaccaaugguguggaucacucaucgguuugacaagucgcgcuacuugggcaaagaacauacaggcggcaauaaaucagguacgaucacuaauaggaaacgaagaauauacugacuacaugccauccaugaaaagauucaggagagaagaagaggaagccggaguacuaugguaa

SEQ ID NO: 22780 - RNA, 9876 nt, Artificial Sequence
  derived and/or modified CDS sequence (opt6) from DENV-2__EU482465__SS-prME
agugcugggaugaucauuaugcuaauaccuacaguuauggcuuuucaccuaacaacacguaauggcgaaccacauaugauaguaggaauccaggaaaaaggaaaaucauuauuguuuaaaacagaagauggcguaaacaugugcacguuaauggcaauggacuuaggugaauuaugugaagacacuaucacuuacaaauguccgcuauuacggcaaaaugaaccagaagacaucgauuguuggugcaacucuacgagcacaugggucacguacggaacaugcacaacgaccggcgaacaucgucgagagaaaagaucaguagcucuuguaccgcauguugguauggguuuagaaacuagaacagaaacuuggaugucaucugaaggugccuggaaacacgcacagagaauagaaaccuggaucuugcgucauccuggguucacaaucauggcugcaauacuggcguacacgauaggaaccacucauuuucaaagaguauuaauuuucauccuucuaacagcgguagccccuaguaugacuaugcgaugcauugguauuagcaacagagacuucguugaaggcgugucaggaggcagcuggguagacaucguacuggaacacggaaguugcgucacaacaauggcuaaaaacaaaccgacgcuagacuuugaauuaauuaaaacugaagcaaaacagccagcaacccuaagaaaauacuguauagaagcaaaauuaacaaauaccacaaccgaaagucgcugcccgacccaaggugaaccaagucuaaaagaagaacaagacaaaagguuuauauguaaacauucaaugguagacagaggaugggggaacggcuguggccuuuuuggcaaaggaggaaucgugacaugcgccauguucacuuguaagaaaaacauggaagggaaaauuguacaaccagaaaaccuugaauacacaauuguugugacaccucacuccggggaagaacacgcaguugggaaugauaccgguaaacacggcaaagaaauuaaaguaacaccccaaagcaguauuacagaagcggaauuaacagguuaugguaccguuacaauggaauguucgccucgaacuggcuuggacuucaacgaaaugguguugcuacaaauggagaacaaagccuggcuaguacauaggcagugguuuuuagacuuaccgcuaccauggcuuccgggugcagauaaacaagaaucuaauuggauucaaaaagaaaccuuaguuacauuuaaaaacccgcaugcgaagaaacaagacguuguuguauuggggucccaagaaggggcaaugcacacagcguuaacaggggcuaccgagauucaaaugucgagcgggaauuuauuguucacgggccauuuaaaauguagacuuaggauggauaaauuacaacuaaaaggaaugucuuauaguaugugcaccggaaaauucaaaguaguaaaggagauagcagagacucagcacgguacaauaguuauaagaguacaauacgaaggugauggaaguccaugcaaaauucccuucgaaaucauggaccucgaaaaacgauauguccuagggcgauuaauaacaguaaacccuaucguaaccgaaaaagacagucccguaaauaucgaagcugaaccuccauucggugacucauacauaauaauaggggucgaaccaggccaacuaaaauuaaacugguuuaagaaaggauccucaauagggcagauguuugagacaaccaugagaggagcgaaaagaauggcuauuuugggggauacugcuugggauuucggcagcuuaggaggcguauucacuagcauaggaaaagcccuacaucagguauuuggagcgauauauggagcagcauucaguggcguaucauggacgaugaagauucucaucgggguaauaauuacauggaucgggaugaacucacgaaguaccaguuugucagugagucuuguccuaguugggauaguaacgcuauacuugggaguaaugguucaagcagauuccggauguguaguuucuuggaaaaacaaagagcuaaaaugugggaguggaauauucaucacugauaacguucacacauggacugaacaauauaaauuccagcccgaaagucccuccaaauuagcuagugcaauucagaaagcacaagaagaaggaauaugcggaauacggaguguaacacgauuagaaaaucuuauguggaaacagauuacaccggaacuuaaccauauuuuggcggagaaugaggucaaacuaacuauaaugaccggggauauaaaaggcauuaugcaagcugguaagagaagucuucgaccacaaccgacugaacuaaaguacagcuggaaaacauggggaaaggcuaaaaugcuaucuaccgagucguauaaccaaacauuuuuaauagacgguccagaaacagcugaauguccuaacacaaauagagcuuggaacucgcuggaaguagaagauuauggguuuggcguuuucacaacuaacauuuggcuaaaacuaaaagaaaagcaagacgcguuuugugauucaaaacuaaugagcgccgcaauaaaagacaaucgagcaguucaugcggauaugggauauuggaucgagucagccuuaaaugauacauggaaaauagaaaaagccagcuuuauagaaguuaaaaacugucauuggccaaaaucucauacacuuugguccaaugggguguuggaauccgaaaugauaauccccaagaacuuagcaggaccaguaucacaacacaacuaucgcccaggcuaucauacacaaauugcugggccauggcaucuuggaaaacuugagauggauuucgauuuuugugaugggacaacaguaaucgucacagaagacuguggaaaucguggaccuaguuuacgaacaaccacggcaucagggaaacuaaucacagagugguguuguagaaguuguacguuaccaccauuacgauaccgcggagaagacgggugcugguacgggauggaaaucagaccccuuaaagaaaaagaggaaaacuuaguaaauaguuuagucacugccggucauggucagguagauaacuuuucauuggguguucuggguauggcauuguuucuugaagaaaugcuccgaacaagaguaggaacgaaacaugccauauugcucguagcuguuaguuuuguaaccuuaauuacaggaaauaugucauuuaaagaccuaggaagaguaguuguuaugguaggagcaacaauggccgaugauauugggaugggaguaacuuaucucgcacuguuggccgccuuuaaagucagaccuacuuuugcggccggcuuauugcuacguaaacuaacaucaaaagaguuaaugaugacaacuauagggauaguccuauugucucaaaguacaauaccugaaaccguguuggaauugacggacgcuuuggcauuaggcaugaugguucuuaaaauagugcgaaacauggaaaaauaccaacuugcuguuacuauaauggccauuuuauguguaccaaaugcaguuaucuugcaaaaugcuuggaagguuaguuguacaauucuagcgguuguaagugucucaccccuauuacuaaccaguucgcagcagaaaaccgauuggauacccuuagcacuaacaauaaaaggauuaaacccaacugcuauauucuuaacuacauuauccagaacuaauaagaaaagaucguggcccuugaacgaggcgauuauggcaguaggaaugguaucaauauuggcgaguucacuacuaaagaaugauauacccaugaccgggccauuagucgcuggggguuuauuaacuguauguuauguacuaacugggcgcuccgccgaccuugagcuggagcgagcaacugauguaaaaugggaggaucaagcugaaauuagcggaucaucuccuauuuugucaauaacgaucucugaagauggaucaaugucaaucaaaaaugaagaggaagaacaaacacuuacuauauuaauccggaccggguuauuagugauaaguggauuguuuccuauaaguauaccuauaacggccgcggcaugguaucucugggaggucaagaaacaaagagcaggaguccuaugggacgugccaagucccccuccuaugggaaaagcugaauuggaggauggagcuuacagaauuaaacaaaaaggaauacugggauacucacaaauuggagcggguguguauaaagaggguacuuuucauacuauguggcaugucacuaggggagccguacuaaugcacaaaggaaaacgaauagaaccaaguugggcagauguaaagaaagaccugauuaguuauggcgggggcuggaaauuggaaggcgaauggaaagagggugaagaaguacaaguucuagccuuagaaccugguaaaaauccaagagccgugcaaacgaaaccaggguuguucaaaacuaauacgggaacuauuggcgcgguuagccuagacuuuuccccggguacaagugguaguccaauaaucgacaagaaaggaaaagugguuggacuuuacgguaacggcguugucacgagauccggcgcauauguuucagcuauagcacagaccgagaaauccaccgaggacaacccggaaaucgaggaugacaucuuucggaagagacgcuuaaccauaauggauuuacacccuggagcgggaaagacaaagcguuaccucccugcaaucguccgcgaggcaauaaagagaggguuaagaacucuaauauuggcaccaacacggguaguugcagcagaaauggaagaggccuuaaggggacugccuaucagauaucagacaccagccauucgagccgaacauacgggacgagaaauuguagaccucaugugccaugcaacuuucacuaugaggcuauuaucaccaguuagaguucccaauuauaauuuaauuauaauggaugaagcacacuuuacugacccggcaucaauagcugcucgcggauacauauccacacgaguggaaaugggagaagcagcggggaucuuuaugacugccacucccccagggucgagagacccuuuuccacaaaguaaugcaccuauuauugacgaggagagagaaauaccagaaagauccuggaacucaggucacgaaugggucacagauuucaaaggcaagacuguaugguucguaccaagcauuaaagccggaaaugauaucgcagcauguuuaaggaaaaaugguaagaaaguaauucaauuaucucguaaaacauucgauagcgaauaugugaaaaccagaacaaaugacugggacuucguugugaccaccgauauauccgagaugggcgcuaauuucaaagcggaaagaguaauagacccucgucgguguaugaaaccaguaauacuaacggauggagaagaaaggguaaucuuggcugggccaaugccuguaacacauaguagcgcugcccaacgaagagguagaaucggacgaaacccuaaaaaugaaaacgaccaauauauauauaugggagagccgcucgaaaaugaugaagacugugcacacuggaaagaagcaaaaauguuauuagacaacauuaauacgcccgaggguauuauucccucaauguuugaacccgaacgagagaaagucgacgcaauagauggcgaauaucgcuuacggggcgaggcacggaaaaccuucgucgauuuaaugagacgaggcgaucucccuguaugguuagcauauaaaguagcagcugaaggaaucaauuacgcagaucgaagauggugcuuugacggcaucaagaacaaccaaauacuagaagagaacgucgaaguggaaauuuggacaaaagaaggggaaaggaagaaauuaaagccgagguggcucgaugcacggauauacagcgacccacuggcccuaaaagaguucaaagaguucgcugccgguagaaaaagccuaacacuaaauuuaaucacagagauggggcgauuaccaacuuuuaugacacagaagacacgggaugcauuggauaaccuagcaguacuccauacagccgaagccggaggacgagcguauaaucacgcauuaucggaacugccugaaacccuugaaacgcuauuacuauuaaccuuacucgcgacagugaccggaggcauauuccuguuucuaaugagcggcaggggaauaggaaaaaugacacucgguaugugcuguauuacaaccgcaucaauuuugcuaugguacgcccaaauacagccacacuggauugccgcuucaauuauacuagaguucuuuuuaauagugcuccuaaucccggaaccggaaaaacaacguaccccucaagauaaucaauuaacauaugucgugauugcaauacuuacuguaguggccgcaacaauggccaacgagauggguuuucuagaaaagacaaagaaagaucuagggcuaggcucaauagcaacucagcaaccagaaaguaauauauuggauauagaucuuagacccgcuagcgcauggacacucuacgcuguggcuacuacauucguuacuccaauguugagacauagcauugaaaauuccucuguaaauguaucucuaacugcaauugcaaaucaggcgacuguacucauggggcucgggaaaggauggccgcuaagcaaaauggacauagguguaccccuguuagcaauuggguguuauucccaagugaauccaaucacucuaacugcugcuuuacuacuccuaguagcgcauuacgcgauuauaggcccuggauuacaggcuaaagcuacgagggaagcucagaagcgcgccgcggccggcauaaugaaaaaucccacaguagauggaaucacagugauugaucuugacccaauucccuaugauccuaaauucgaaaaacaacuaggacaaguaaugcuucugauacuaugcgugacccaaguguugaugaugagaaccacaugggcauugugcgaggcuuugacacuagcaaccggaccaauaucaacauuaugggaaggaaacccugggagauuuuggaauacaacuauugcuguaagcauggcuaauauuuuuagaggcaguuauuuagccggagcagggcuacuauuuagcauaaugaaaaauacaacaaacacucgaagaggaacaggcaacaugggagaaaccuuaggagaaaaauggaagagucgauuaaacgccuuaggcaaaucagaauuucaaauauauaaaaggagugggauccaagaaguugauagaacucuagcuaaagagggcauuaaaagaggggaaaccgaucaucaugcaguaagccgaggcucggcaaaauugagaugguuuguagaaagaaauaugguaacacccgaagggaaaguaguagacuuaggaugcggcaggggagguuggucguauuauugugguggacuaaagaaugugagagaggugaaaggauugacaaaagguggaccuggacaugaggaaccgauacccaugaguacuuauggauggaaucuaguuagauuacaaucagguguagaugucuucuuuauacccccugaaaaaugcgauacccuauuaugugauauuggagaaucaagcccaaauccaacuguagaagcagggcgaacacuuaggguguuaaacuuggucgaaaauuggcuuaauaauaacacacaauuuuguaucaagguucucaacccauacaugccuuccguuauugagaaaauggaggcacuucaaagaaaauauggaggugcgcuuguaaggaauccauuaaguagaaacucaacgcaugaaauguacuggguaucuaacgcaucaggaaauauagugaguucgguuaauaugauuucaaggauguuaaucaacagauucacuaugcgucauaaaaaggcaacauaugagccggacguugaccuagguaguggcacgcgcaacauuggaauugagagugaaauucccaacuuggauauuauugggaagcguauugagaaaauuaaacaggaacaugaaacgaguuggcacuaugaccaagaccacccauauaaaacgugggccuaucauggaucauaugaaacaaaacaaacaggcucugcuuccaguauggucaacggaguaguacgauuauugacgaagccuugggauguccuaccuaccguaacgcaaauggcgaugacugauaccacucccuucggacaacaacgcgucuuuaaagagaaaguugacacuaggacgcaggagccaaaagaaggcaccaagaaacuaaugaagauaacagcagaguggcuauggaaagaauuagguaagaagaaaacaccuaggaugugcacuagagaagaguucacucggaaaguuagaucaaacgcugcacuuggugccauauuuacagaugaaaauaaauggaaauccgcccgcgaagcaguagaagacucucgauuuugggagcuaguggacaaagaaagaaaucuacacuuggaagggaaaugcgaaacguguguauacaauaugauggggaagagagagaagaaacuaggugaguucgguaaagcaaaagguucacgggcuaucugguauauguggcuaggugcacguuuccucgaguucgaagcacuggguuuccuaaacgaagaucacugguucucuagagaaaacucucucagcggagucgagggagaaggacugcauaaguuagguuacauacucagggacgugagcaagaaagaaggaggggcaauguaugcggaugacacugcaggaugggacacacgaauaacacuugaggaccuuaaaaacgaagaaaugguaaccaaucauauggaaggggaacauaagaaacuagcggaagcgauauucaaauugacguaccaaaacaaaguuguaagagugcaaaggccuacuccuagaggaacaguaauggauauaauaagucggcgcgaucaacgagggaguggacaagucggaacauacggacugaauacuuucacuaacauggaagcccaacuaauaagacaaauggagggggaagggguguucaagaacauacaacauuuaaccgugacagaagaggucgccguucaaaauuggcuagcccgaguuggaagggaacgauugucacgaauggcgauuucuggagaugauuguguaguaaaaccauuggacgacagauuugcuaacgcacucacggccuuaaaugauaugggaaaaauaagaaaggauauccaacaaugggaaccaagcaaagguuggaacgauuggacucagguaccguuuuguucgcaccauuuccaugaacuuauuaugaaagacgguagaguacucguaguuccaugcagaaaccaagaugaacuuauuggcagagccagaauaucacaaggagcugguuggucgcuaagagagacagccugcuuaggcaaaucuuaugcacaaauguggucgcuaauguacuuucauagacgagaucugagauuagccgccaaugcuauuugcagcgccguuccgagucacuggguaccaacgucgcgaacgacauggagcauacacgcuaagcaugaauggaugacgacugaagauauguuaaccguuuggaaccgaguauggauaagagaaaacccauggauggaagacaaaaccccaguagaaucaugggaggagauuccauaucucgguaaacgugaagaccaauggugugggucacugauaggguuaacgucgcgugcaacaugggcaaagaauauacaggcagcgaucaaccaaguaagaagucucauugggaaugaagaguacacugauuacaugccaaguaugaaaagguuucgacgugaagaagaagaggcugggguacugugguaa

SEQ ID NO: 22781 - RNA, 9876 nt, Artificial Sequence
  derived and/or modified CDS sequence (opt6) from DENV-2__EU482466__SS-prME
agugcaggaaugauuauaaugcuaauaccaacggucauggccuuccaucugacuacccguaauggagaaccucacaugauaguaggaauacaagaaaaagguaaaucauuacuauuuaaaacugaagacgggguuaauaugugcacacuaauggccauggaucucggugaauuaugcgaagacacaauuacguacaaauguccuuuacucaggcaaaacgaaccggaagacauagauuguugguguaauucaaccucuacguggguuacauauggaacguguacuacuacuggcgaacacaggagagagaaaagaaguguagcacuuguaccacacguuggaaugggccuagaaacacgaacagaaacguggaugaguagugaaggggcauggaaacacgcucaacgcauagaaaccuggauauugagacauccuggauuuaccauaauggcagcuauauuagcguacacaauagguacaacacauuuucaacgaguauuaaucuucauauuauuaacagccgucgccccaaguaugacaaugcguuguauuggaauuucaaaucgagacuuuguagaaggcguaagcgggggaucuuggguugacauaguacuagaacacggaaguuguguuacaacuauggcuaaaaacaaacccacauuggauuuugaacugauaaaaacagaagcuaaacaaccggcaacuuuacguaaauauugcauagaagccaaacugacaaauacaacgacagaaagucgauguccuacucaaggcgaacccagccucaaagaagaacaagacaaaagauuuguauguaaacacuccaugguagauagaggauggggaaacggaugcggacucuucgggaaagguggaauaguuaccugugcaauguuuacuugcaagaaaaauauggaggguaaaauaguacaaccagaaaaccuagaauauacuauaguagugacaccacacagcggagaagaacaugcaguaggcaaugacacagguaaacacggacaggaaauaaaagucaccccacaauccucuauuacagaagccgaguuaacuggauacgguacaguuacuauggaauguaguccacggacaggccuggauuuuaaugaaaugguacuguugcaaauggaaaauaaagcaugguuggugcaccggcagugguuucuugacuugccauuaccaugguuaccaggagcugauaaacaggaaaguaauuggauucaaaaagaaaccuuggugacauucaaaaauccacacgccaagaaacaggauguuguagugcucggaucucaagaaggagcaaugcacacugcccuuacgggcgccacagaaauccaaaugaguucugguaacuuguuauuuacagggcaucuaaaaugcagguuacguauggacaaauugcaacugaaagguaugucauacucuauguguacagguaaauuuaaagucgugaaagagauagcugaaacgcaacacggaacgauagucauucgcguucaguaugaaggcgauggcucacccugcaaaauacccuucgaaaucauggaucuagaaaaacgcuauguacuagggagacuaauaacaguaaauccuauaguuaccgagaaagauucaccaguaaacauagaagcugaaccacccuuuggagacaguuacauaauaauaggaguagaaccgggacaacucaaacugaacugguucaagaaagguuccucgauuggucaaauguucgaaacaacaaugcgaggcgccaaaagaauggccauccuaggagauaccgcgugggauuuuggaucgcugggcggcguauuuacaagcauaggcaaagcacuucaccaaguguucggagcgauauauggagccgcguucagugguguuucuuggacaaugaaaauuuuaauuggaguaauuauaacauggauuggaaugaacucuagaaguacaucauugagcgugucccuaguuuuaguugguaucguaacucuuuauuuaggaguuaugguacaagcagacagcggauguguaguuucuuggaaaaacaaagaacugaaauguggaucuggaauauuuaucacugacaacguacauaccuggacggaacaguauaaauuucaaccugagucaccuagcaaguuggccagugcuauccaaaaggcucaagaagagggaauuuguggaauuagaucaguaacaagauuggaaaacuuaauguggaaacagauuacaccagaacuaaaucacauauuagcugaaaaugaaguuaaacucacgauuaugacuggagauauuaaagggauaaugcaggcgggaaaacgcucguuacgaccacaaccaacagagcuaaaauauagcuggaagacguggggaaaagcuaaaauguuaagcacggagagcuauaaucaaacauuucuaaucgacggacccgaaacugcugaaugccccaauacuaaucgcgcauggaacagccucgaagucgaggauuaugguuuuggcgucuucacaacuaauauauggcugaaacuaaaagaaaaacaggaugcguuuugugacagcaaauuaaugucagcagcaauuaaagauaacagagcgguucaugcagauaugggauacuggaucgaaagcgcauuaaacgacaccuggaagauagagaaagcaucauucauagaagugaaaaacugucacuggccgaagucacacacacuuuggucuaauggggucuuagaaagugagaugauaauuccgaagaacuuggcuggccccguuucucaacacaauuaccgaccggguuaccauacacagauagccggacccuggcaccuuggcaaacuugaaauggauuucgacuuuugugauggaacgacaguaaucgugacagaagacugcggaaacagaggcccaagccuacguacgaccacugcaucaggcaaacuaauaacagaaugguguugcagaaguuguaccuugccuccguuacgguaccgcggagaagauggauguugguaugguauggagauucgaccucugaaagaaaaagaggagaauuuaguuaacucacuuguaaccgcuggacauggccaaguagauaacuucucccuaggcgucuuagguauggcguuauuuuuagaagaaaugcuaagaacacgcguugggacuaagcacgcaauauugcuagucgcaguaaguuucguaacauuaauuaccgggaacaugucuuuuaaagaucuagggcguguuguaguaauggugggagcgaccauggcagacgauauugggauggggguuaccuacuuagcauuauuggcugcauucaaaguacguccgacuuuugcugcuggauuacuccuacgcaaauugacgucuaaagaacuuaugaugaccacuauugguauuguccuauugucgcaauccacaauaccugaaaccguccucgaacucacugaugcccucgcauugggaaugauggucuuaaaaauuguacgaaacauggaaaaauaccaacuagccguaacuauuauggcgaucuuaugcguaccuaacgcaguaauauuacaaaaugcauggaaggucucguguacaauacuugccguuguaagcguauccccguuauuauuaacaucuagucaacagaaaacggauuggaucccacuagcacuaacuauaaaaggucuuaaucccacagcaauuuuccuaacuacacuaucacgcacaaauaagaaaagguccuggccuuugaaugaggcuauaauggcuguggggaugguaucuauccuagcaaguucacuccugaaaaaugacauaccaaugacaggaccuuuaguagcugguggacuacuaacuguuugcuauguauuaacuggaagauccgcagaucuagaacucgaacgggcaacugacguaaaaugggaagaucaagcggaaauuuccggcucgucuccuauuuuaagcauaacaaucuccgaggacgggagcaugaguaucaagaaugaagaagaagaacaaaccuuaacgauucugauaagaacaggucuauuaguuauaucggguuuguuuccaauuucuauaccaauaacugcggcggcuugguauuuaugggaaguuaagaaacaacgagccggaguauuaugggaugugccuucaccuuuaccgaugggaaaagcggaauuagaagauggcgcuuaucggauuaagcaaaaagguauuuugggguacagucagauuggagccggagucuacaaagaaggaacguuucacacuauguggcacguuacgagaggugcugugcuuaugcacaaaggaaaacgcaucgaaccaucaugggcagacguuaagaaagacuuaauaaguuauggcggugguuggaaguuggaaggagaguggaaagaaggugaggaaguccaggucuuggcccuagagcccggcaaaaauccucgcgcaguccagacgaaaccgggucuuuuuaaaacuaauacagguaccauaggagcuguaucuuuggauuuuagcccggguacuucuggaucgccuauaauagauaagaaaggaaaaguagugggucuauacgggaauggagugguaacacguucuggugcauacgugucugcuauagcucaaacagaaaaaucaauagaagacaauccggaaauugaagacgauauauucaggaaacggcguuuaacuauaauggaccugcacccuggugcaggaaagacaaaacgguaucuaccugcaauagugcgcgaagccaucaagagaggauugcggacucugauucuagcuccaacacgagucguugcagcagagauggaagaggcucuacgaggguuaccgauacgauaccaaacaccagcaauacgagcagaacacacgggacgcgagauuguugacuuaaugugccaugcaacuuucacuaugcgacuucuuuccccgguccggguacccaacuauaauuugauaauaauggacgaagcucacuucaccgauccagcaucaauagcagcaagaggauauauuucaacaagagucgaaaugggugaagcugcaggaauuuuuaugacugcaacaccucccgggagccgagacccuuuuccccaaaguaacgcuccaaucauagaugaggaaagagaaauaccagaacgcaguuggaacagcgggcacgaauggguuacagacuuuaaagguaaaacaguaugguucguaccgaguauuaaggcugguaacgacauugcugcaugucugcguaaaaaugggaagaaaguuauacaacuuucuaggaaaacauucgacucugaauacgugaaaacacgcacaaacgacugggauuucguagucacgacagacauuucagaaaugggugcuaacuuuaaagcagagaggguaauugauccgcgacgcugcaugaaaccaguuauauuaacagauggagaagaacggguuaucuuggcagggccgaugccaguuacccacucauccgccgcgcaaagacgagggagaaucggaagaaauccuaaaaacgaaaaugaucaauauauuuacaugggagaaccucucgagaacgaugaggacugcgcccauuggaaagaagccaaaauguuacucgacaacaucaacacaccagaagggauaauacccaguauguuugaaccugaaagagaaaaaguugaugccauagauggcgaguauagacugagaggggaagcgagaaaaacauucguggaucuaaugagaaggggugaccuacccguauggcuugcauacaagguagcagcagaaggaauaaauuacgcggaccgucgaugguguuucgacgggaucaaaaauaaucaaauacucgaagagaauguggagguggagaucuggacaaaagagggcgaaaggaagaaacucaagccucgauggcuagacgcaagaaucuacagcgauccucuugcccuaaaagaauuuaaggaguuugcagcagguagaaagagcuuaacgcuaaauuuaauaacugagaugggacgauuaccuacauuuaugacucaaaagacacgugaugccuuagauaauuuagcgguacuucauacugcugaagccggugggagagcauauaaucaugcccuuucugaauuacccgaaacucucgaaacucuucucuuauugacauuguuggccacaguaacagggggaaucuuuuuauuuuugaugucaggacgcggaauaggcaaaaugacucugggaauguguuguauuauaaccgcgagcauucuucuaugguacgcacaaauucaaccacauuggaucgcugcuucaaucauauuggaguucuuucugaucguacuucuaauaccugaaccggaaaaacagagaacgccacaagacaaucaacucacauacgucguuauagcaauucuaacugucguugcggcaacaauggcuaaugaaaugggauuuuuagagaaaacgaagaaagaccugggauuaggaucuauugcuacacaacaaccagaguccaauauacuggauaucgaccugcgccccgccuccgcguggacgcucuacgcagucgcuacgaccuuuguaacaccaauguuacgucauucuauagaaaauucaucugucaauguaaguuuaacagcuaucgccaaccaagcgaccguccucaugggauuagguaaaggauggccacuuucaaaaauggacauaggaguaccuuuacuagcuauagguugcuacucgcagguaaaucccauuacacugacagccgccuuacucuuauugguagcacauuaugcgauaauaggaccggguuugcaagcaaaggccaccagagaagcacagaaaagagcagcggcagguauaaugaaaaauccaaccguggacggaaucacaguuauagacuuagacccaauacccuaugacccuaaguuugaaaaacaguuaggacagguuaugcuauuaauuuuaugcgugacccaaguguugaugaugcggaccaccugggcauuaugcgaggcacuaacauuagccacaggucccauaucaacacuaugggaagggaauccgggucgcuucuggaauacuacuauagcaguaucuauggcaaacauauuccgcggaucuuaucuggcaggagcuggucuccuauuuagcauaaugaaaaauacgacaaacaccaggagaggaacuggcaacaugggcgaaacacuaggagaaaaauggaaaucuagauuaaaugcacucgguaagucugaauuucaaaucuauaagaaguccggaauccaagaagucgacaggacucuggcaaaggagggcauuaaacguggagagacagaucaucacgcggucucacggggaagugcuaaacugcgaugguucguagagaggaauauggucacgccugaagguaaagucgucgacuuagguuguggaagaggaggguggucauauuauuguggaggucuuaaaaauguacgcgaaguaaaaggucuuacuaaaggagguccuggccacgaggaaccgauacccaugucuaccuaugguuggaaucucguaagacuacaaucagguguggacgucuucuuuaucccuccggaaaaaugugauacgcuauuaugcgacaucggugaaucuagucccaacccuacuguagaagcaggacgcacauuaagagugcucaaucugguagaaaacuggcugaauaacaauacucaauuuuguauaaaaguacuaaacccuuauaugccuagugucauagagaaaauggaagcucuacaacgaaaguacgggggagcuuugguaagaaacccucuuucgcgcaauucaacccacgaaauguacuggguaucuaaugcaagugggaauauugucuccucugucaauaugaucagucgaauguugauuaauagguuuaccaugcgacacaagaaagccaccuaugaaccggauguagacuuaggcagugguacuagaaauauaggcauugaaagcgagacucccaaccuggauauaauaggaaagaggauugagaaaauuaaacaagaacacgagacgagcuggcauuacgaccaagaucauccguacaaaacuugggcguaccacgggucuuaugaaacaaagcaaaccggcuccgcuaguagcauggugaaugguguagucagacuacuuacaaaacccugggacguccuaccaaccguaacacagauggccaugacggauaccacuccguuuggacaacagcgcgucuucaaggaaaaagucgacacccguacucaggagccaaaagaagggacuaagaaacuaaugaaaaucacugcggaauggcuuuggaaagaacuugguaaaaagaagacaccacguaugugcacuagggaggaguucacgcgcaagguuaggucaaacgcagcccuaggagccaucuuuacagaugaaaacaaauggaaaucagcuagggaagcgguagaagacucaagauuuugggaauugguggauaaagaaagaaaucugcaccuagaaggaaaaugugaaacuuguguuuacaauaugaugggaaaaagagaaaagaagcuaggcgaauuugguaaagcaaaaggcagcagggcaaucugguacaugugguugggcgcaagauuucuagaguucgaagcacuaggcuuucuuaaugaagaucauugguuuaguagggaaaauuccuugagcggcguggaaggggaaggauuacauaaauuaggauacauucuaagggauguuuccaagaaagaagguggcgcuauguaugcggacgauacggccgggugggauacaagaauaacacucgaggaccucaaaaacgaagaaaugguaacaaaucauauggaaggagaacacaagaaacuugccgaggcgaucuucaagcuaacauaucagaacaagguuguacggguacaaagaccgacaccacgcggcacuguaauggacauaauaaguagaagagaccaaagaggcaguggacaaguggguacuuacggacuuaauacuuuuacgaacauggaagcacagcuaauaagacagauggaaggagaagguguauuuaaaaacauucagcaccucacugugaccgaggaggucgccgugcagaauugguuagcuagggugggaagggaaagauugucacguauggcaaucuccggagacgauugcgucguaaaaccuuuagaugaccgcuuugcuaaugcgcugacugcacuaaaugacaugggcaaaauacgaaaagauauccaacaaugggaacccaguaaaggguggaaugauuggacucaggucccuuuuugcucacaucauuuccacgagcuuauuaugaaagacgguagagugcuagugguacccugucguaaucaagaugaacucauagggagagcucgaauaucucaaggagcaggcuggagcuuacgagaaacagcuugucuugggaaaucauacgcccaaauguggucacuaauguauuuucaccguagagaucugagacucgcagcaaacgcaauaugcagcgcuguuccaagucacuggguaccuaccaguagaacaaccuggucaauacacgcuaaacaugaauggaugacaaccgaggauaugcuaacagucuggaaccgaguauggauacgcgaaaaucccuggauggaagauaaaacccccgucgaaucuugggaagagauuccguaucuaggcaaacgcgaagaucagugguguggaagccucauuggauuaacaucucgagcuacaugggcgaaaaauauacaagcagcaauaaaucaaguccgaaguuuaauugguaacgaagaauauacggauuauaugccaagcaugaagagauuccguagagaagaagaagaagccggaguacuaugguaa

SEQ ID NO: 22782 - RNA, 9876 nt, Artificial Sequence
  derived and/or modified CDS sequence (opt6) from DENV-2__EU482467__SS-prME
agugccgguaugauaauaaugcuaauuccuaccguaauggcauuucauuuaacgacacgaaauggagagccccauaugauaguuggaauccaagaaaagggaaaauccuuauuauucaaaacagaagauggaguaaacauguguacacucauggcuauggaccuaggagagcucugugaggacacuauaaccuauaaauguccauuacuccgacagaacgaaccagaagacaucgacuguugguguaacuccacuucaacuugggugacauacggcacaugcacgacgacaggcgaacaucgacgggaaaaaagaaguguagcacuaguaccacacgucgguaugggacucgaaacgagaacugaaacuuggaugucauccgagggcgcauggaaacacgcucagagaauagaaaccuggauucuaaggcacccggguuuuacaauaauggcugcaauacucgcguauacaaucgguacaacgcacuuucaaagaguacucauuuuuauucuucuaaccgcaguggcaccaucaaugacaaugcgauguauugguaucucaaaucgugacuucgucgaaggagucuccggagguucguggguggauauuguacuagagcacggaucaugugugacaacuauggcaaaaaacaaacccacauuagauuucgaauugaucaaaacagaagcaaagcaaccagcaacauugcgaaaauauugcauagaagccaagcugacuaauacuacuaccgaauccagauguccaacucaaggugaaccaagccuaaaagaggaacaagacaaaagguuuguguguaagcauucgaugguggacagaggcuggggcaauggauguggauuauucgguaaagggggaauaguuacaugugcaauguucaccuguaaaaaaaauauggaagggaaaauaguccaaccagaaaacuuggaauauacgaucguagugaccccacacucaggugaggaacacgcaguggggaacgauaccgguaaacaugguaaggaaauaaaaguuaccccacagaguaguauaacugaggcugaacucaccgguuacggcacgguaacuauggaaugcagcccgagaacuggucuagauuuuaaugaaaugguacuacuacagauggaaaauaaagcguggcuuguccaucgacaaugguuucuugacuuacccuuaccgugguuaccaggagcagauaaacaagaauccaauuggauucaaaaagagaccuuaguuacauuuaagaauccacacgcaaaaaaacaagauguaguaguccuggggucacaagaaggugccaugcacaccgcguugacaggugccacggaaauccaaaugucaaguggcaaucuacuauuuacuggucacuugaagugcagauuaagaauggacaaacuucaacuuaaaggaaugaguuauucaauguguacaggaaaauucaagguuguaaaggagauugcagaaacacaacacgggaccauugucauucgggugcaauacgaaggggacggaucaccgugcaagauacccuuugaaauaauggacuuagaaaaacgcuacgugcugggucgacuuauaacaguaaacccuauagugacugagaaagauagucccguaaauauagaagccgagccaccauucggagauuccuauauaauaauaggcguugaaccgggucaacugaaacugaacugguuuaagaaaggaagcucaauaggucaaauguuugaaacaaccaugagaggggcuaaaagaauggcuauauugggugauacagcaugggauuuugggaguuuaggcgggguguuuacaucuauagguaaagcauuacaucaaguauuuggagcuauauauggggcugcguuuucuggcguaucauggacaaugaaaauauuaauagguguaauuauaaccuggauaggaaugaauucaagaagcacaagucucuccguauccuuaguuuugguugggauuguuacacuuuaccuaggaguuaugguacaagcagauucuggaugcguaguaaguuggaaaaacaaagaacuaaaaugcggauccgggauuuuuauaacugacaauguucacacauggacggagcaauauaaauuucaaccagagagcccuagcaaguuagcaucagcaauacagaaagcccaagaagaaggaauaugugguauaaggucaguaacuaggcuagagaauuugauguggaaacaaaucacaccagaauugaaccauauccuagcggaaaacgagguaaaguuaacuauaaugacgggagauaucaaagggauuaugcaggcaggcaaaagaucgcuucgaccucaaccaacagaauugaaauauaguuggaaaacauggggcaaagcaaaaaugcuaaguacggaaaguuauaaucagacauuucucauagacggucccgaaacagcagaaugcccaaauacaaacagggccuggaacaguuuagagguagaagacuacggcuuuggaguauuuacuacaaacauuuggcuuaaacuaaaagaaaaacaagaugcuuucugugacucgaagcuaaugucggcagcgauuaaggauaaccgggcaguacaugcagauaugggauauuggauagaaagugcccugaacgacaccuggaagauugaaaaagccagcuucauugagguuaaaaauugccauuggcccaagucgcacacucuguggucgaauggcguauuagaaucugaaaugauaauaccaaaaaaucuggccgggccggucucucagcauaauuaccgaccuggauaucacacgcagauagcagguccauggcaucuagguaagcuagaaauggauuuugauuuuugugacggaacuaccguaauuguuacggaagacuguggcaacagagguccgucauugcgaaccacaacugcaagcgggaagcuuaucacagaauggugcuguagaucuugcaccuuacccccguugcgauaucgaggugaagacgguugcugguacgggauggagauacggccgcuaaaggaaaaagaagaaaacuuggucaauagcuugguuacggccggucacgggcaaguagauaacuuuagucuuggaguucuuggaauggcauuguuuuuagaagaaaugcuaagaacaagaguaggcaccaaacaugcuauucugcucguggcaguaucauuugucacccuuauaacaggaaauaugagcuuuaaagacuuaggacgggugguugucaugguuggugcuacaauggcugacgauauaggaaugggaguaacauaucuagcucuauuagcagcauucaagguucggccuacguuugcugcaggacuuuuguugaggaaauugacuagcaaagaguugaugaugaccaccauaggcauaguucuacuaucucaauccacgauaccagagacuguacucgaacuuacagacgcucuugcucuugguaugaugguauuaaagauaguacggaauauggaaaaguaccagcuagccguuacaauaauggcaauauuaugcguuccaaacgcgguuauacuacaaaacgcuuggaaaguuuccuguacaaucuuggccguuguuucuguuagcccguuauugcucacaaguagucaacaaaaaacggauuggauuccguuagcccuaacuaucaaaggacucaaccccacggccauauuuuuaaccaccuuaucgcgaacaaauaaaaaaaggaguuggccauugaacgaagcuauaauggcagucggaauggucucuauacucgccucgucauuauugaaaaaugacauacccaugacuggaccacugguagcaggcgguuuauuaacggugugcuauguacuaacagggagaagugcugacuuagagcuugaaagggcaacggauguaaaaugggaggaccaagccgaaauaucaggcagcagcccaauuuuaagcauaaccauuucagaagaugggucgaugucaauaaaaaacgaagaagaagaacaaacauuaacgauucugaucagaacuggccuacuuguaauuucaggacuguuuccuaucagcauaccaauaacagccgcggcaugguaucuuugggaagugaagaaacaacgagcgggaguacuaugggacguaccaucuccgccuccuauggguaaagcagaauuagaagauggagcauauagaauaaaacagaaagggauucugggguacucucaaauaggagcagguguguauaaagaagguacauuccacacgauguggcaugugacacguggggcuguacuaaugcauaaaggaaagagaauugaaccaaguugggcugaugucaaaaaagauuugaucagcuauggagguggauggaaauuagaaggugaauggaaagaaggagaggaggugcagguacucgcauuagagcccgguaaaaauccgcgagcaguacagacuaagccaggacucuuuaagacuaauacgggaacgauuggggcgguguccuuagauuuuuccccaggcaccucaggaagcccaaucauagacaaaaagggcaaaguaguagggcuuuaugggaacgguguugucacacguagcggugcguauguuucagccauagcacaaacggagaaaaguauagaggauaacccugaaauugaagaugauauauuucgaaaacgaagauuaaccauaauggaucuacauccaggugcaggaaaaacuaaaagauaccucccggcaauaguaagagaagcaaucaagagaggucuucgcacgcuuauauuagcaccuacucgaguaguagccgcugaaauggaggaggcauuaagaggacucccaauucguuaucaaacaccugcgaucagagcggaacacacaggaagagaaauaguugacuugaugugucacgcuaccuucaccaugcgcuuacuaagcccaguuagaguaccaaauuauaaccuuauuauuauggaugaggcacauuuuacugauccagcgagcaucgcagcaagaggguacaucucgacgagaguagaaaugggagaggcagcagguaucuucaugaccgccacaccuccuggaucccgugauccauucccucagucaaaugcgccgauaauagaugaagagcgcgaaaucccggaacgcaguuggaauagcggucaugaauggguuacagauuucaaaggaaagacagugugguucguuccaucuauaaaggcaggaaaugacauugcggcuugccuacgaaaaaacgguaagaaaguaauucaguugucccgaaaaaccuucgauucagaguauauuaaaacgcgaacaaaugacugggacuucgucgucaccacugacaucagcgaaaugggugcaaauuuuaaggccgaaaggguaauugauccgcgacgguguaugaagcccguaauccucaccgacggcgaagagagaguaauauuagccggacccaugccaguuacccauucaucggcagcucagcggagaggaagaauaggucgaaaccccaagaaugaaaacgaucaauauaucuacaugggagaaccccuugaaaacgaugaggauugcgcccacuggaaagaagccaaaaugcuucuagauaauauaaacaccccagaagguauaauaccaucgauguucgagccagagagggaaaagguagaugcaaucgacggugaauauagauugcgaggagaagcuagaaaaaccuucguugauuuaaugagacguggugauuugccaguguggcuagcguacaaaguugcagcugagggcaucaauuaugcagacaggagauggugcuuugacgggaucaaaaacaaucaaauucuggaagaaaauguggaaguugaaauauggacaaaagaaggagagcggaaaaagcuaaaaccacgcugguuggacgcacgcauauauuccgauccauuagcauuaaaggaauuuaaagaauuugcagccggaagaaaaagcuuaacauuaaaccucaucacggaaaugggacgacuuccgacguuuaugacucagaaaacacgagacgcuuuggauaaccuggcaguuuuacacaccgcagaagcuggcggacgugccuacaaucacgcuuugucugaauuacccgagacguuagagacauuacuguuacuaacacuacuugcaacuguaacggggggcauauuccuauuuuuaaugagcggcagagggauaggaaaaaugacguugggaauguguugcauuauaacagcaucaauuuuacuaugguacgcacaaauucaaccgcauuggauagcggccucaauaauuuuggaauuuuuucuaauuguacucuugauuccagaaccugaaaagcaaaggacuccucaagauaaccaauuaacauauguaguaaucgcaauauugacaguuguugcggcuaccauggcuaaugaaauggguuuuuuagaaaaaacaaagaaagaucuaggauuggggucuauugcaacucaacagccagaaucaaauaucuuagauauagauuuaagaccagcuucggcauggacgcucuacgcaguugcaacgacauuuguaacaccuaugcuacgacauucaauagaaaauucaaguguaaacguaagucuuacagcaauugcuaaucaggcaacuguauugaugggguuaggcaaaggauggccccuaagcaaaauggacauaggagucccuuuacuagccauaggcuguuacucccaaguaaaccccauaacucucacagcugcccuuuuauuacuaguggcccauuaugccauaaucgggccagguuuacaagcaaaagcaacacgagaggcgcaaaaacgagccgcugccgguauaaugaaaaauccuacgguugacggcauuacuguaauugaccuugauccaauaccauaugauccuaaauuugaaaaacaacugggccaaguaaugcuguugauucuaugcguaacacagguacugaugaugcggaccaccugggcacuuugcgaagccuuaacacuggcaacuggucccauaucgacauuaugggagggaaauccagggcguuuuuggaauacaacaauagcagucaguauggcuaauauauuuagaggcucauaucuugcgggagcuggccuacuauucuccauuaugaagaauaccacaaacacaagaagaggaacuggaaauaugggagaaacauuaggagaaaaauggaaguccaggcuaaacgcacuaggaaaaucagaauuccaaaucuauaaaaagaguggcauucaagagguugaccguacccuugcuaaagaaggcauaaagagaggagagacggaccaucaugcggucucucgcggaagugcaaaacuacguugguuuguagaacgaaacaugguaacgcccgagggcaaaguaguagaccuuggaugcggacgcgggggauggaguuacuauugcggagguuuaaaaaacgugcgcgaaguaaaagggcuaaccaaaggagggccuggccaugaggagccgauuccaaugucgacauacggcuggaaucuggugagauuacaaucaggagucgauguuuucuuuauaccucccgaaaaaugugacacccuacuaugugauauaggagaaaguucuccuaaucccacgguugaagcaggaagaacccuaaggguucuuaauuuaguagaaaauuggcuaaauaauaauacccaauuuuguauaaaaguucugaacccauacaugcccucgguaaucgagaagauggaagccuuacagcgaaaauauggaggugcacuuguuaggaauccccuuuccaggaauucgacacaugagauguacugggucuccaaugcaaguggcaacaucguaaguagcguuaacaugaucagucggauguugauaaaccgcuucacaaugcgccauaaaaaagccacauaugaaccagauguugaucuagguagcgguacacgaaauauaggaauagaaagcgaaauuccaaauuuagauauaauaggaaagcgaauagagaaaauaaagcaagaacaugaaacaagcuggcauuaugaccaagaucauccauacaaaacaugggccuaucauggaucguaugaaacaaaacaaacggguucggcuucgucaauggucaacggagugguacguuuauugacaaagcccugggauguucuaccgacaguaacccaaauggcaaugacagauacgaccccuuucggacaacaacgaguuuucaaagaaaaaguugacaccagaacacaagaacccaaagaaggaacaaaaaaacugaugaaaauaacggcagaauggcuguggaaagaauuagguaaaaagaaaacuccucgaaugugcacaagggaagaauuuacucguaagguucgaaguaacgcggcgcucggcgcaauuuuuacugacgaaaacaaauggaagucagcacgggaggcgguagaagacucccgauuuugggaauuaguagacaaagaaaggaacuuacaccuggaaggaaaaugcgaaacaugcguauacaauaugaugggaaaacgagaaaaaaaacuaggugaauuugguaaagccaaaggcucaagagcaauaugguacaugugguugggagcccguuuucuggaauucgaagcauuaggcuuuuugaaugaggaccauugguucucucgagaaaauucuuuaaguggaguagaaggagaaggacuacauaaacuuggauacauucuuagagacguuagcaagaaagaagguggagcuauguacgcugacgauacagccgggugggauacaagaaucacauuagaagauuugaaaaaugaagagaugguaacgaaccauauggaaggagaacaucgcaaacucgcagaagccauauucaaauuaacuuaucaaaauaaagucgucagggugcaacgcccgaccccgagagguacaguaauggauauuaucagcagaagagaccagagagguucaggucaaguuggaacguauggacuaaauacauuuaccaacauggaagcacaauuaauuagacaaauggaaggagaagggguguuuaaaaauauacaucaccuaacaguaacagaagaagucgccguucaaaauuggcuagcuagggucgguagggaaagauuaagucguauggccauuagcggugacgacugcgucguuaagccgcucgacgaucguuuugccaaugcacuaacugcacuaaacgauaugggcaaaauccgaaaagauauucaacaaugggagccaaguaaaggguggaacgauuggacacagguaccguucuguucacaccacuuucacgagcuaaucaugaaggacgguagagugcuuguaguuccuuguagaaaucaagaugaacucauuggaagagccagaauaucucaaggcgcaggauggagccuucgagaaacugcauguuuaggaaagaguuacgcgcaaauguggagucugauguauuuccaucgaagagacuugcgacuggcagcgaaugcaauauguucugccguacccucacacuggguaccaacgucuagaacaacauggucaauacaugcgaaacaugaauggaugacgacggaagauauguuaacuguauggaauagaguauggauccgagagaauccauggauggaagauaaaacuccuguagagaguugggaggaaaucccguauuuaggcaagagggaagaucaauggugcggaagccuuauaggccugaccagcagagcgacaugggcuaagaacauacaggccgcuauaaaucaaguuagaagucuaauugguaacgaagaauacacagacuauaugccuagcaugaaacgguuucgcagagaagaagaagaagccggaguauugugguga
